United States Patent 9,487,797 (GENOMIC PLANT SEQUENCES AND USES THEREOF) - sequence listing, part 32

SEQ ID NO: 60066 - DNA, 35993 bp, Oryza sativa
gcgattaaattgatataaaacctgtagttttgtgataactttgttactaaatctgtagttttgcgatagtccaccttatatttgtacttctgtgataaatttagtgttaaatctgtagttttgtgatacatcataattaggtcatctatcaaatggtgttcagtacaggattatattaagatcttttcactaggaccatgcaattggtcacaggaaaatggaacacatgaatcagagaagatccaagtaatcaagtttccaacaagccagaaagctagaaggcataacataaattggcacatattacacagttcagaataggttctgatgtacctaaaatgtaggggggaaagagaataggtcgagtagatggcaacaattgtctaacaaagatagaatatcttacttgtaacctgaaggtgcatgtgcaagaacaatgcgctgtttgttctcaattattaatcttaagtctcgccgtgcagcttcaagatgcatataatcgcggaactgatcctgttaagatatgaagagaaagtacaagaagagaattgcataagttgatatttttgtttgtcatacaagcatggttctgaaagtaccaacagcaacaaatggactaacaggataccaggctttactgtagtttttttctcactaacatgcacatgtttagaatcagaaacatgtgcaaacgataaacaaaaactaaattcataaaattgtatcatcatgtgcttgacacatggataccaaaccaacttataaaaccaaaactgtaagtacgtgaggattaccttagtaaaacctgggcttgcaattacagcacattggactacttcaaaatcaatatgcttcaggaaagcctgtaggcaaattaagtaatgcatcagtccaaattggtttcattaatattatcatttccttgaggaaacatttttcatttacttgcaaaacatgttcaaagaacttcttgagggcctacaaaagagcaaaacaaagtcagttgggaatagatagaacaattagattacacaatatcagaaccagtttccataccgactcataaccagcaatcgcagggccatgcttccgaggaatagatgtttcaatacgtgctctggttactgttatgctgtttagataaccatagctaataagtcaaatacaatcaccgcaagaggtaactcaagcctttaaaagaatagggaatcaaacagggctactattaagataatactctttcatcatcacaattagcatgctatcatgggaagtacaataaaaattatcttggtcgtgccatggcacaatgagtcaatgactcaacttaccttctaccaatgaggaacaaatgtgcaagtccttcttgcatgagaataactgctagatcagcacttgcagttgggtctaatagaggtttagatgcactcagttagaacattgcatttctcaagaaagaataataacagaaaatatgataagttgataaaacaaaagtagaagtttatgtctcaatagaaatcacaagatagatatcactaggggtctcaatgcatattcaagatgatggatgataaattgattaattatcaatagttctcattaataggtcaaagtaacaagtttgcaaaggttgtcaagcactcctggtatccgcggtacaaccataccaataattttgcagagcagaagatggaacgcaaacaatatataaacactggacataatggcacatcaggtttgaaagaaaagagatactctatttatgagtgagtttctctgcattaaaatctattcataagaaggggagcaatatgttcaaaatctctgataatcaaaatatctcagaggtgatggcagaaaaaatggagatatgtgcaatcagtttatactgattattatggttggaagacagcttgaaattagggttaatacttcgagatatttaggccctcctaacaggcaggacccggatgggctttcctgctaaacttaaggtcctatttgtaagcttaggcctcttcccacaaattctccagaaaaaaaaaacagattatgagtttcagtgagtaactaagtatcattgtacaatcaacatagtgccaactttgttggataattcatcaggactgaaaaaaaacaaccacatgtttttttcccagtggcttaagtaatctagatgaatgggcatatcaagcattagcaggctaaaatttgaggtacaggtagcattcctaatgtgataaccatgtaaccattcagatcaatccatcatagaatataagagcaataagacaggaaaagacagatggaatgtacagaattagaagatagtaacatttcagttctcacataccacatgcttgttggatggtatcaagagctaaccaatcccaaagttcctgcaaaagtagaaatagcaatctctcctcaggtaagctacaacagaccaaaagaaggtacattctaaatggactaccacaatttacaaaaataaacaatggtgataaaattttcaacaacgatatgtatctgagaatagttggggaacattatcatcagccactgaaagaaggaaactatattatgtcaataatcgttatgctttccaactcctaagtagtcatcgtagacactatgaattaccagaggctggaaaagatacaagttccatgggcagggacaaaaaaaactcatatgcaagtgcaagattcattaagaaaattagggaaagaaaaggatagcagtctgatgaaagtgccaagtttttttatataactgagtccatagtaatgtttaattgcaaagggatatttgtataatataaatattgcaaagctaaggaaaggtcccattgtcaagtgctattaaaagaaatgaaccaaatttggccaacctagttgttcaagatatatgacagtaaataaaaaagcatgtgcacagatgcctgcatatcctatttcacttataggttcagttaaaaaaagggcaagctgcaaatgggatagaaagtttatctattaaaaatctactagctcaaagcaccctgtttgtagcactctcaggtaggcctgttcacaggttgggctcaaaccgatgaacataccaaaccaaaccaactgaaaccagttaatctcttgtatatataggtaggttgggtttcctccacaatccatcaaacactatgactccttcatcttcttcaggacctcgtcctcgcacgcaggcagagccatctttgcaatctcaagcggtggccgtgtccacccaccggcaaagaccttcacagaggccatgtcccccaccgatgtccccgatggcaatgtcccccacaagcgacgagttctccagagccacggccacatccccacacaattgacaagtcccaatagtggccatgaccccaacccctcgatgggccttcaccgtggccgcgtcatctcacactcgaaggcgacttcccctcacatgcgacgatacatcgcgcgctcgatggctgcacctctgtagtcggggcgtcccttgcatgttcaacagcaactcgtggacgtggctgcgtccagtggcctgtcacaatctttgtgtgctctgctgtgcttcacaggaaaggaatgccatggccatttctagctcctctgcccgaaggactcttgatctgcttctttctcttgttgaggaaacagtttaacccgtgaaaccagaccatctaaaccgtacttctttgggctgggctgggttaacatgctaaatcaccttaaaccatcgatgaataaccacacttttcaggtaaggcttaacaaatcccacatcagcttggaatgtgccggatattggtgccatattttaaccatttagaatcatatccaaattttgaaccattagtgtagtgtttaagacaatcctatccatcattagctgaagactataatgtggtcccctagtaaacaggtaaaggcagtttgatcaaattttagggcataccttcgtcaaagtaaattgtctcttcagctcaagctccacagtatgaaactgtccaatcttcacatgatcgttctcagttatattttttccacgtacacgcaagacagatccctccttatcataatctacagactatgtgcaaaacaaaggagcatgtcagttatcatcaagaaaataggtaagttttgatttggaaacaataaggaacaaaactaataagagcatcactggctaaaaaactaaagacagcattattttttagtatgcaaggagaaatagatttctcgacctcttcggctgtggtgccacttagctctaagtaattcaaatgcttaagtgacgatgcttgttgcttgacttggggggtcccattactccattatgcaactctaaattattatttttctaaggcagaggcagaaattttgcatttaaaaagtacagaatttcactccaataatattatgtttaggtcacccattgtacagcctttgcggtttgttagattgtcaatctctttccagttcacgcattgtgtaggtaaactaggctctcttcccaaataatcaaacaatgacagtgccactcaagtctcaaattcacaggttgcaatccacataggttacatctgactgtaatcactagtataagcactcagtgcagatagaaggaagacagatgatatatcacctcgactacaatttccaactttaacctcacacgctcagcatcacgtcctccagatgccatctctctcagaactttcctgggaatcaacaggataaaaatatgtttaaggggattatgagttctcactgtgcactgaaggatctagatatattttgatggagaaacatagaagttcacaagaataaaggggacagaatcttcaagtaacacaaactacattaccaccaaggttgaagtatgagtatgatcaaagcctttcaagtaattttacatatctaatttttctataatcacataaaagcataatggcattgagaaattgttaggtttagtttttttaataaaatggatgtttaaagtaaacgaaacagtaacactaattccagcacttccttttcttcccgcaatcccaattcttaagtcccagtccaagagccaaaaactatttatcacgtagtgaaccatgccttccctaagtttacgccaaaattggaagtttggttgaaattggaacgatgtgacggaaaagttggaagtttgaagaaaaagtttggaactaaactcggcctaaatctaagtgccctaattcctctaccagggtaggactaggacatcgaggatagttcgaaattaacagctcaaaattgctaaaccgaaataaattactctggttactaactgaaccaacactacacaatcactacataaaacggaggaactcacctcacagtgacggactggagggtatcccccggaacaataaggttgtaggcatgccacaggtcgtcctcctcctccggcaccagctgcgctttcacaataaatcgatctaagtcatccaatcagcacacgaaccacacaacccccacaaaaggggatcaccaccgtacccccaaacccaaacaacactagacctagtgcaagcgatcaaacggagagcgagatggggaggggaggggagggttcacaccttgacggagccggggccgttgcgggcgaggttgcggtagacgagcttcatcgccggtggcccggagctgtagaacgcagagatgcttggctcctcgtgcgggtctcgctctcggcggcggcggcgcgagcggcgggggggattttgcgacggcgaggggagggatgcggcggaagctgtgtcgacagcgtgggatgggatgtgaaaccggacacggaatctgtctccctttctgttacgacgttatatacatggggccccaaagaccggattagctgccggcccagccgcgtcgacgtctataatcggagtccaactccacattggactcgagttcggcccatgattagtaccacctcaggtctggcaagtgttactctctagttttaatgcttgaacgccgttaacctctagttctttttattttaaaaagttcatgtttttttgttttactataattttttattgttaaatatactcctaccatgacttatatttttgtatttttaaaataaaattaataagacatatatcgaagacaccaaaaatcaagcgcgtcaaacgttaaaaaccagagagagtaggcgttcacaactataattgtgtgtgttttccacgtgcgtgcatgagtacatcgatcgaatttagcccctacatattttcaaagcggtagataatactttgactttggtcaaacttaaaaaaataacttaaaaaattaagcgacttacaatatgaaatatgaaatgggtataaacggaagggacagtaacaaacagctatcattatttgtcagaatttctgagtagctgatactttggcaccccatctgtttctaaatgtttgacatagcacatatttgatcgttcgtcttattaaaaaaattgcgaaatatgtaaaactatatgtatacatgaaagtttgtttaacaataaatcaaataatatgaaaagaattaataattacttaatttttttaataagacgaatggtcaaacatgtttaaaaaatcaatggcgtcaaatatttagaaaccgaggaagtaataaccaacatcttatgtttatcattttttctgcatatgtattgtacagttcaccgcgcctttttacttcagatgaaatggcacactgagctagctttacatttcgttctcgatgaccaggctaaattactcgctactagctagctagctagccaagcctctttctgatgacgccttccaccgagccgacgaacgcgaacgtgccgacgacgaagcagacgacgctgaacgcctgcagcgcggcccaccgcggcgtccacggcgagatccgccgctgcacgcagtacatctcgacggggaggtagatggcgagcggccagaacacgagcgcgccgagcacgcccagcacctcgttgaagtaggggaacaccagcgccagccccgtcgtgctcgccacgtacaccgtcctgaagcacacccgctgcaggttcacctcgtacctccccgggccgccgccgccgccgccgcgccgccacgggaggatcttgacggagtacgacctgttcacgaacgcgctgttcggaaagctcgccgcgaagcaccggtcggcgaacgtgaatatctgctggctaaacatctgatgcatcgagttcatgcaggattcgatcaggatagttttttcagagaaaagcaatgcgattttggagaagtttgagtcgcagcttcacctggtagccgccgaggaggtggagcacgatgcaggcattggcgaagtctatgagccagtagggctcgtagaagccgaagccggtgaggaggttgcccggcgcggcgttgccgaaggcggagtagccgaagcagccgacgcagaggtagaagaaggtggtggcgaggaccgcgatcacgttgcccttctgcatcgtctcgctctccggcggtggcgatctcagcgtgtcctgttcggtccatcagtctcagttcagatgaatcttgactaatttcagctaaaaagtgtccaaaaaaatgtctgcttttcgtgttctgaaattggccgtgcgcacctgtatctccaggagaacgatggtgtacgggtaggcgaatgcgatgtcgccaattgcttgagccactcgccaaactttctgcattggggtggccatcgcaacaccggcaatgttccctttgacagttccatcacctgacacgaagcaaatgcaccaagatttacacagtttccggctaattaattaagcactgctgaattgtgacatcggcatcaatcaaatggaacaatcaagctactataccaatggtcttggcgaggccgaggccgaggccgatggtggagtaggcgaaggacatgatcgccgcgacgacggacagccacgccatcttgtggaaattgggtatgaaggacagcagcagctgggctgctccgaagagcagcatgtagaagtgttcaccgttcgagtcgcagggagcgtcacggccttcgctgtggtagcagttcgccctcttaattgccctgtcaacgggaacaagttaattaagcacaggttgaacaaacaacagtttaatcttctacttgaagatctgtatgaaaaaaaaactgtaaaattcacctcatacaagttgccgtagtgattgtgtaagcaattcctatcccgtacaagttcaggtactgcagcaacccacataaccaagtgtgcttcctccctaaacatattgccaagttgccacaaaaaccataccattaatttactgctacccaatatacaatccaaaagtggtatctatatttgaccaattggacttcctgaggaaaagattggctaactaacttagctgaagtaggattaatcaaggtacttaattacctaagtgaactctgacggcgtccatgtaggagtagttcctctgcatcttctccgagccaggagacctgtagcagtgcgacagcaggaaggccgagatgtaggtgacgaaggcgaagcacaccatggcgatggggccggccacccagccgagctgcgcgacgctccacgacagcgccagcacgccgcacccgatcaccgcggtgataatgtgcgctacgcacgtccatagattccctgaaagttcatcgaagaagaagaagacaaggaaaattagaagagaagagctcaagagcaccttactacttgccggcatgcctgaattctcgtcgatgaaccaaacagatcgaacaaatctcggcgacagagagcgtaccggtgcgttgtgggtggccgtcgtcgtcgagcttgggagcagaggccacctcgagcggcagctgcggcgccattgtcaaaggctcagtgaagccttcaaatttgactcgttggactacagggaggactgaggagtgaacacgcgagagctatacagtactactatatactagtccactaaccaattaagctagcgttgtcactggattggtgagtgatttggataaagaaacttgggggataactctgccgtatcgacagccggaatcgcgccttgttttaagtacaaaatggcacgagcagacgaggctgctgctcatgttcgttgaatcattgtatagtagcctcctgacaaatccaactgcagcacagcctgtatgtactacaagaacacacgtcaaaattgtcggtttctaggagcgcctgtagtttgccaaggcctctaaactgcatattagtactacctccgttttttaataggtgatgttgttgactttttcttacatgtttgaccattcgtcttattcaaaaaattttatacaaatatataagatataaaccacacttaaaagactatgagtgataaaacaactcataacaaaataaattataattatgtaaattttttgaataagatgaatggtcaaacatgtgagaaaaaattaacggtgtcatctattaaaaaatgaagggagtagtactgtagtagtattatgttataatcgagtcacaggtttaataccaaacctagccaaccaaaaatttatgttgattagaaaggatgcacaatataccacaaacattttgacagtgactgactgggaattagcggcacggttatggatcattttcaatgcgcatgttgcttttttcgtggatgaattgaacattgcttgcttacaagtcactgggctcgttttcatggattacgggtggggtcaacggcacctcttcttgtcagctgctttgacaacttttttctgtatacgggttacgagggctgaataaagccacggtgtagaagatcagggtttctttttttgtgttcatatatgatgtcttcacatctctgggcataaaaacaggctgggagcaaatctcctttccgatgacgatgaggtggttggtacttctacgtggtagtgatttgcggcctttttctttgtttatttcctcgagattattattatttgcctatatagattggttctttgatatatgtgaaaatatagtatggtacaatgatacatgtggtgcctacatgagaattatgtgatactagtctgttaaaaaaaggtaaactctagctatgagcttaggcacgagattcgtaactaggattggacttttttttttgacagaggggtagacggtttttgataattcgggatatgctcctctctggacatccgctatttatgttgtgacatgctcattattgcaaagaaactagagaaaaaatgctcactatatactatacagagaaacctgacatacatattggacagataaattaacaatttttaagaaaatatttcctccatctaaaacacatttttttaagtactacgaatctaaaggcattgctaattttggagggtttcttggaagtgtagtgtggctccgctaccgccctctcttttttttttggtagtttccctttctttcaccagttgcagctctgatttttccttttctttccccatgacataggcatgtctggccgtttgtgtgtgtaacaaaaactcttttgtttttaatatattgacgtgcaatccttttgcacgttcgtagtactaggaagtgtcccatctgtccaaaattcattatattctgggatggatggagtacctaaaggtacgatattttctactgtaagaaattctgatataaatgttgatacctcttgatattttgacatataaaaccgtatcttctaatgtaaaaatttatggtgtaacttttaatacctcttagtaatttgaggtaccaatagtggctcggtggacattccctcgttgtttgcatgtcatccaaatggctataaaaaatttaacaagatagattaataggtatgggataaatcacttaacaaacatgcaagttaaaatttaacttttacaggttgcaacgaaaaaacaaattaaactatggcttaacatatattcgcactcaaatttataatctgttgtaacatatgtaaattaaatttgagcttgcatgtttgtggagtgatttatcacatattaacatgcaactagcgaaaggataaccccttaagagttaatagtttcccatatcagggtactaaattttacattaaaaagtgatacctcccggtatttctcgttgactgcaataccatttttgttcattctggattcaaaatcatataattttagattcccctatttagcttactagtcatataaactggtaacagaacatatataatcactctgtcaatggtggaaaaataaagaaagacaggtatatacagaacaatgcttaaacagagtcaatttttcttcttgataatcagttcgtggcaccagaccagaacctgcctgcaaaactttccccaaggcaatgggagctatctagtgggtgcttagttcagctatcagggttgaatggaatccttctgcgtttcatgtaattttcgcacgctttcttgagcggatcgcacgagtgcgcttttgccaactccatgatgccgctcgcggtgtcgtcgccgatgaagcggcacaggttgctcgcgcacatcagcttcagcctctccatggcgtacatgtcggcggcctcgaacacctcccgcgccatggcagccgcgttccggcccttgttcgcctccggcggcaggctgtcgtggtagacgtagtggagcacggcgccgaacgcctccgggctcatctcccggaggcggatcgccggcgagctcgcctcgttcccgacctggccgtagaggagcttccggaagtagagcgactggccggcgagcgcgaggcggtgcgccccgaacgtcgcgtcgccgacgtggatctccaggtcgaacggggcgtcgccgctgaggaggaactccatggcgttcctggcgtggcacgacggcggcacgggcacgcggacggggccgccggcgccggtgacgacgggccggccggcgccgcggcggcgctggatgacgtgcatggtgcagcgcaccgtcagcgcgtcgtcgtggatggcgcccagggcggcgccctccagctgctcccgggcgatgtacttgcggatgccccacgagttgttgcggttgtcgaacctgcacgggcgatcgatccgcacgtcgtggagtacggcgccgccgccgccgccgccgccgagcagcgcgaaggagaactcgacgtggtacacggagccgcacgatggccggtagagggactggaggaagaaggcgacgtggtcggacgtgtcgctgttgtagccgtcggggtagaagcggacgaaccactcgcggccggcgacggtgaagttccgggagaggacggaattgccgacgcccttgcccttgacgccgctgtactgccggatcgtgaactggtgcacgccggtcaccctcggcacctcgttcaccgagcccgacacggcgtcgtcgtgctcgtagccgtcgtcgtcgatcaccgagaagcagcaacccatctcgccgctggtatagtcgcgttaattagggttttagccgcccctggccggtcgtcgatcgtttcgatatcggtaagggaaaaatagcctgatggagatcgtaaaggtgcattacatgcatgcagaaacggaaaagcggaaacgtcgccaagacatagtagtaagatatatatattcctagtataaatacggatcagatttcatatagagaaattaattaacgggctccttttctttctctgcataggctctgtcacgttcattgcccacgtcgcgcacaacctttgtcacgttgacgtaatacgtagtatatatattttttttgttattactccatccatttcaaattgatctacatatagtatttttgaggttatttttaaatgatttacatatttgaatttatttattaagtctattcgttatttgtgcattgaaataaatggacattgatgcatctatccatgcacacaagtatttataacccacatgcaatatcttgatttgcaattggctagaaaatagtggggatggtgtatacattgagtttgttgctagagtaaatatggtatgagagagttattagtttttttggtcttggtgtatctatgaaatatgtagatcaatttgaaatggagggagtactgcgcacaacgtacatgaggtgaggcatgaaaacgagtcggctcggcaccgtgaaccgctttgtatcgcatcatcagattaattggtgtacgtcttgacatcgacaaggtttctatcagcctaccaggaaaacgaacttagctttgtgaacagtgcgaaggctgatgtgagaagctagttcagtgttcgtgcgcgaagccgcgaaccccgtgtgaccgtgtccggtgtccccctgcacgcggctgtccacacgtacgattgatggcgccgacagcgagagctccaccagattaccggccagagagacaccggctgatgatatgagcaacacggcagcctcatcgtccggtgcgtgtcacctcggcgtacgtgatcggagccgacggtgtacgtaataacgacgtccgccatcggcgacccacgcgttggtgcatgcgtcgccacagcgaaatcggcggcgttgattttcggccggagttggaggatcatcacgacccaagctaggggggtggcgcgcgcggtacgacgtacgtgtcggccggccggctcgtttaattcgaggcggtgcttggctgcatacgtctccttttcgccttgaagcgttacggcgcaacagggtgtccggcatattgaccctgacaaacaagtatacggcgctgcatgccgccccttctcacggccttctgcgtcgtcgagtttgtcgtgccgtgtcacctattccttccgtataaaaaaaataaaaaaaaaccttgaatttacgtttctgtccgtcttatatgaattttttttataattagtattttcattgttgttagatgataaaacataattattattttatgcgtgatttgtctttttattttttttcatatttttttcaaataagacggacggtcaaacgttagatatagaaacccagggtttgtcttttttgggacagagggagtacgggtgggacgctgaagcatctaggcccccggtgttaattttggtaattaatgacaagcgctaattgtggactaaccgttgtctttgagctatacattttaagttaggtccacgtcgaatgtgcgcatggatgattatcgatggattaaaattgacgtcgcaaagcaaagggaaagaagacggtaaaactagcgctttaatttagaattgatcgaggtgtagggcgatcaaatttgctagtttatttttagtttcgccgtactattaagaggggtaatgacctagcaaagagataattttaattgccacattaggtcattatgcatttagacttgtgctcacatttcacacacatacacacttcactgggttcgggctgaccaggggcggtcagaccggccacatagtaggggacttcacagggtagtggcggtctgaccggcgtgccctggccggtctgaccggccgcaagaaggcggtctgaccgacgcgtaaggctggtctgaccggcggcacatgcgcggtcagaccggccccctggaggccgggatggtgctgctcgggatggccgatacagagccgacggagccgtattcggtcagaccgagccgatggcggtctgaccgagccgaggccggtctgaccggctaccccatgtcggtctgaccggccaggccgatggggccctttgacagggctacaacggctagttttctagccgttgcagagtagcacggtctgaccggccacatacctccggtcagaccggcagagcacagagttaggggatttcgcccccaacggctagttttggtgggtgggagtataaatactcccccaccagcagcaagggggctctcttggcacccaattcaattgcatacaccccatgcacctttctcacactcacttgagctttgtgttcatccatctagtgtgttagaggattgtttagccaagagtcaagtgcatttgcttccattgtagagctagtgtggcacttgatcatctccacgccgggtcattgcttgttactcttggaggttgccgcctcctagacggcttgtggaggagttgcccgatgacctctccgagaagattgtggaggaggcccggcgccggtttgtgagtgggttggagttcaccaccttcggagtgaaggaagaactaccccgagtgatcgaggcttgggtagtcctctccgtgggccggctcccgccttgcccaccccttgacgaagggggcgtgcggtggcttcgtggttgagcggtggagttgggctcgtctcaacggggagtaggaaaccggcgagtttccgaacctcggtgaaaaatctcttgtctccttgtcttatttgattgtcgcatttacatttgtgcaatttacttttctagagacatacttgagatcatatcatcctaggattgcaaaactttgacataggagtgtgatttactttccttgagatataattgaaccactatcaccctaggtttacaaaacataacttagttgcttagttagagttcacccttaccaagcctagcaatttaggttagttttgattaggtgttatttagttttaaatcgcctattcacccccctctagtcgatatctcgatcctacagacgcgtgccaagaaacattcaaacaagtctgtgaatacagttcagtattacatttacacagcagttagcagtattgctatctaggaattttgctcatcctagatagcaatattctaggatgaaggtaggagtagcacgtagcagagatgagagttgagaccatcacttcgaatccaccgagacggccagtctgaatgtttgctagagagagtatttcatttcagtttgcattactgtttgtatatctatattcaaaaggattttgtatatattacgtactaattctccgctacttctatattcaaaaggattttgtatatattacgtactaattctccgctacttctatattcaaaaggattttacacatgctatttttccaaataatacttattgcactgttctttgatctgttatagattttggatttgcgacatgttctatttactcaacccaaaacccatgagcattatcaattattttgacaaggttgacaaaggcttcaaccaaaagagcttacgtagtactccatcatctgctctttttcctaaccagatacagatgatgatcgaaaataccccatcattgagtacaccattgttgaatttctgagcgtgagcctccgcaactcgatgtcgaagttaaacaatacggtacgctagtcactagtacggggcggcaggggataaatgaactagcggacatgcacgcaacgcacgaatccagtggcgccaccacacggggaggacggtgatccatcatcgatgttctcgaaggatcccgcagaaaaccacgacgagccatgttagctcacttaaaaaaaaaaaagcccctcaccccctcgacctcgcgcttttcgcatagccacgccacggcacggcatctcagggcccgtatacatcgctggcaaaaattttcaccaaatcacatcaaatatttaataaaatattagtaaatatataaaaaaataactaattacacatattgtgtctaaattatgagatgaatcttttaaacctaattattctatgatttggtaatatggtgcttaaatattattaatgacagattaattatacttaataaattcgtcttacagtttacatgtggaatttataatttattttgttattaatttatatttaatacttgtgtgcgtgtgtattcgatgtgacacgccaaaactttacatccatggatataaacactccctcaccctctatcgggtgcaaatacgcggaacaccaaggacctgggtgcaaaaacacccatcaccctcccccgacgaagcaagagaagcttccactagaaaatggcccaatcccgtcgcccccttcccctcctccgctcctcccaaacccaaatccgccaaatttgactcgcgcgaggggcccgattcgtggggcgcgcttccccctgctgctgctgctgctgctgctgggattcggacgagctggtcgcgttcgcgttcgtgtgatctaggggggggatatggggtacttgagctccgtgatccccacggatggatcgccggtcagcggcggcggcctcaggtgggagcgattgattctcgggacgcctctcctgtcctctttttgcgcttttttttttgggtctgattcgtgtttgctttacccgaattctgggttttttttttggagtactccatctagtcaattcgattgtctagcttagctctggcgactagcagtttttgttttagataatggataatctggcaactagtagataatggctgaatgtttagttctaatcaattcagtacggtccaggcgtgtgatacgttgcttgctgcatcgcacgaatttcgtataactgctcgcgtgggtttcctttgctttgaacacgctgtttaagctcaaaagcaaggctggagtatgggataagctatgcaatcccatttttgtttgttttattagtactttttggtgggactataaacaagataaatccagtttggagttatgttgtccgtttaagtaggatattcatatgctacatacctgatctgagcataagcagttgcgtcgaataaatttggacggttattctgaatacagactaaaatgaacttatgtgatgttacgttggagaattattaagtgtagcacgtcctaatgggcatgatagcaaaaggtaagaggccaccttagatgtgcttatacattctatgggttgagatcaaggaaactaatgagtaatgcacggtttgggcatttggtactgttagttgcaagctggaagttcgtctccctcatttctcaaatgcattttctatgaatatgacatcttgcatcatgccatgttagttctttcagtaacagcatatacaataggtcatgttgttgtagctcaccacacaacacaaccggttctagctttttgaaccagtgaactgtaataattgtagtgcctgcaatctggctgcgtctggaagtttaggagtagtgactttatgaataatattctatttccaattaatcaacgttgtcatggtagcttgattttatggtgtaaatgcagttattaggactgttgctctcctatttgctcaacatttctcattctttttttgccagccagaatggtaagtttagctatgggtatgcgagctcccctggtaaaagggcttccatggaagacttttacgagacaagaattgactctgttgatgggcagattattggtctttttggagtttttgatggtatgtatgaatttgtcacattcgtgcataatctctacccattgataattctttatcattttagaaaggaacatttctaagattacactcttccaagttttagacctttctcttttgtaccaaaagaacataccatttatgtttcctttgctaatcttgtatagtataaaaaagctcaaaataattcatttgccttgtaacatttcttatttccgcagttagagctagtatgacggtgagaagtccatggagaaagttttaaagattactcatactagggcacaatgctttaaattgaactagaagtgtggatataccaagctcttgagcttattttaggaaaaataaatgctaaacatacagttcattttataggtcatggtggtgctaaagtagctgagtatgttaaacagaatctcttcagtcatcttctaaggcatccaaagttcatcagtgacaccaaagtggcaataggtattggtttgttctctttccataattcactagatgttgagttttgtgtatagaattgacagaactaccacgtgatattgtttgctgtagatgatgcttataaaagtaccgacagtgaattcttagaatctgacagcagtcaaaaccagtgtggatcaactgcatcaaccgctgtccttgttggtgaccgtctctttgttgcaaacgttggagactctagggctatcatatgcagggggggaaatggtaattgacagttcactgtaccatctcttcagcttcctggttgcatttacttgatactttctgactttatatagcatgacacattattttttttcttttttatggtatgcttaaaaattcaagagagccgattatgtttggcatattctattattaatagagacctctcttaaggtacgaatatttttgcttgttttgttagaatgttgtatttaccactgagcatctgcattgtaccaggcatgagaatcaagatttgttggtgatgaaatgagtgccatgagaaataatctgtaggttatctgtgataatttatcagttcttcacatagaagctctgctggttttttgcagctatagctgtttcaaaagatcacaagcctgatcagacagatgagcgacaacgtatcgaagatgctggaggttttgtaatgtgggcaggtgctaagcactacattatcttattttgtatatgaatggactatgatcgtgttcctaatgatggtattttgttccttaggaacatggcgtgttggtggtgtgcttgctgtttctcgcgcttttggtgacaaactcttaaagcagtatgtagttgtggatcctgagattcgggtatgcaatcctgaccaatttaatgtttgttatgtctacttacctctcaaaatgcatatgtaggtatcaccatgacagtaggtgaacgtttggaatcatgattcccttgtgtcattggattgaatgtcaagagtgatattgatagtagttgccatcttaatcatgatatacttattgaggggatatttgtggcataaattttcgaaggaaaaattaaggatggctttctaccagcctgaacattttattgatcaaaatttgtaccaagttacatacatattgtgaagaggtacgggggatgagggcctgagtggaagctaaagggtcctatatattacaaagtgcgagaaatttgttcccccaatctagtatacattgccagctaaaactatttgtgctgcgatgggaccactggaggtcttccgcacagcgtcttgtcgtagttgctgaaaactttgttgttgaggcacttccagatattccatagcaaaactaatagggcggtatgataaacgaccagggacatattttgtcttcagcattgtttcatttttggcctttttgttatcaatgtcttacagctgcacttctgatctgttctactgccagcttcttagtcgacctgaagaaccatttcctaatatatgttgttaattttttaggcttcagaataatcatcctttatattcacctttcacaaatgatgaccttgttcagtaatgcttttgtgggtcataggaggaagttattgatcactctctcgagttcctcattcttgcaagtgatgggctgtgggatgtagtaaccaatgaggtaaattcaagaaaatgaaaagagaagatttttatgtatcttaatcgtattccttgtgcttgatgtagcccccttttgcatttgctcttatgcaggaggctgtcgacatgaccagatcgattcatgacccagaagaagctgcaaagaagctcttgcaagaggcctacaagagggagagcagtgacaacataacttgtgttgtcgtgcgcttcttgcatgggcaagggagtagtggatatgcttaaaaaacaactggtaaaagttacccaatgtagttgtgtaccaccatgtatacatgttttaattcaaatctcacggggttaaatggagagaaactcggagtaggatacgtgtattctgatggctgaagtaagctgaagggtgagtatgccttaggttaacaataagtttgctggtgaccgatcaccatagttcgttgcttttgaccctggatttgatggtcgtgttgtattgctacgggagactggatcgtttccctaggttcaatgtacgtggatattactcctctatttatttgtttgtatcctccacttccggtgagctaagtttgactttgtagccattcttgttattactgtagacatcagtgagacagtgacagcattatgtatctctgcagtttggtgggttggaagagaagtagagaatccatgctgttctacatggccgaaccagattcagattgcagagtttatggcagagcaaccacatctcaaactgcatgttttttatgtgtgatgctggacgccctggagctctccatcctgaccggccgtccggcggtgagaatcgagatccgacgagaattgcggcgtgtcgtgcccgtgtcgagggcagggaagccggcaccacacaagatatcatcgaagacagatcggagcgtttgattaatcatcaaagacagattggagatggtggcaaagggtttaacagttttggaatgttaataatcatttctagatgattagagttccttcaagtatgttagagggcaaatacagccaccgttatcattgaaggaaaggcgccctgcgccttgtgacctgaacttttcgcagcctaagaagaggcccttctcagggacatgttcagtacatccatttttggcatgccaatgccccatcgatgatttcttttgaccggtgatctacacaggcgctttcacaaacacaatcctcaaaatccaacactttgccagttgttactaacaagcaacgccgttcctgcccatgtgatcaccagcagaaaccatttgggccccgacggccatatcttctgtaatatacaatgactagttagaataatagctgaagagaagtagctgaaacaaatttgaaagactgacaaattttcaatcaaaacatactgagtcacatccaaaatttctcaatgtttgggcagaatttgaagttccaggtttcactctttctaattattgggttgtgtataaaaaaaccaaatatactaatgtggctaatactcatcacccttcaaagatactatttaacagtgcaagtagagtctgccagtaacttaccactttcactatctgatgcatcgtcaagtctggctatagcatcgagtaatgactgctcctggtcctacaaggacaccatttgacctcacaactctagacgaaggatatctataaggagcttttctccatcatacataattctgtagaaaattgcataacaacagacaagccaactcacttgcaaaagtttcttggccttttcgatctcacccatatttggattggacaaaaccctctccacctgggttggaacatacaatagtgaggtaaaaaaccaatatctgaatgcataatatctgatctcatgagataatttacctctatgacaacacttcgagtgttaggtacatcaatgtgaccaatattcctgttaattccattttggggaggagcactatccttagtaggctcatttcgagaaaaccttcctcctcccctacttgccattgccattgtaccgttgttgcctgggtgcctcctcatcccaggatgaggaccccaaccatctcgatttgagatgccttgatcatcaaggtcccatattatatcttcaggtgccaactgagaaatgatttatcatcttcttttgattaaatgttaaacaaacagtggcaattagccaggacgattcaacaattttcatgttctagctaaaaacaagtaaaacttaataaatttataacagatgacatgctattcaacaaactctatactctaataactaactaaattttagtactcctaccggttacactacagttcagcttcagaaacctagataaccaaaggttctaaaatttaggaaaaaaatacattttgacttctaaaactgtcccacctgacaaaacattaaaacccactatacttgaaaaaaataacgtatctaaacatctcctcaaggcggccctgacggtggtcttgccaccaaggcaaataatgtggcccatcacatggtaatgactccgcgaacaaaaaatacaaactcatcgcaaaatgggtgtaaggtgtcataaaaaccctcttttacatccagttccatgactactcaggcactagccatgctgctcaattccaaagtcctatctagtttttactctcccaaatcttatctagcttctacttaacccccatgaccctcaatttgttgaataattgccgcatcatcagctgcagtggtaagatactaagatcatattccaagttgctccaggggagttacttagaaggtatcacatagttttggtaggccatctaaactattgtaatttcctgcagaactactatcaacgtaattatgacaataaatctgcagcaacagaaaaatgtttcctgtttaatttctatgttattgggcacgcgagcagacagtcactagtttgtcattgcaacaaatcaaatgtaacataaaaatatgaatatcccacggccacagatcaagaaagaaaaactttattatggattagtaaaaaaacatctacagatagaaacaaggcaatggttgaaaatactgcttacatcactaagtctgactgactcccaagtctgggctactgtgcccatgtcatagacgagagcatgtttaccctgaaaagtatcaggggtgtccataagcttcgcttacttgacaaaaatgcaaatctgcagcaagtagcaaaaataatagtgaaattaaacaacaaaccgtagcaggattatagtcagttatagtggcctcatagaagttattgtcatctggccatcttgtataaattttccggttaatcaatgaagttggatccgcggatggcacagcgagtggtgtattctgtaatgcataaaaaaagaactcatgatattactactatgggaatgcaacaaacatgacttgtcgtattcaaaacacaccgtcctagtcttcttgccctttgttcctgaaaatggtccccactttgtagatgaaggaactgagggagaaggcatcgcaggggactggaggccagcagaatgtgaaggaatagaaaggggtgtcctttgcctctttgcagctgggccaggttctgtatcatgaaaaattctgctgccacgatgctgtgcactcagggatccacctccctgtctaaactccctgcaaaatattgcgaaggataaataaattactaacgaaaaaataaaatggttggtttaaacatgtgcatgaacaaaaattgaatgattgtatgaagacctcattctgcggatggccacatcttcattaactttgtttaatagttccctgtgttcatcatcagagactcttaattctttcctgagttcagtgatcaaactttctttttcctggacaaaaaatatacattttttattctcaacacaaaaaaggcatgtgcaaagaatggctactaaaactgttagcacaagattcttttttttatacatacatacccaggatatagcatcagattgcactttaaatgctctaagaacaccagtgtacgcctcttgctcaacctgatgtatttcactctccaaatcaccgtgcggcctaatgtaagaaaatggcataacagatgccctgccattcgcactaaaagatcgcactcttaatcctctattttgtgttggagggagatcgtcgtcagtccctgaaattttgatagaatgaacagacaagtcactataccatgaaattcactatatgagaaaaaagacataaatattttgtgaactacagggttcaataactgcccacaacaattgggcttcacaatttggcaagataagccagaatctagagctggccgacgtcatgtcatcagtctgcaccaagggtttggcagcaggatctttctctagttgatcaggaacgcataaacagaaacagtggtttccttaaaacttcacataatatcagaaagataaaaaaaaaaaaggtccatctttattagaacacagtaagcagatccacttcagaagcaactattgccaacctcgtctcaaaggctttcatccatagtggcagagtcttaggccatggttcataaaatgcatagtaaaactatgaaataaatgtctttcactgcattgaccgcctcaattacaaattcataataaccaataacctgccaacaaaacattttttttcttacaatacctacgcacctaatcaaccgatattactgaagcaataattttgaaggaaaaaaaaagacacatgttatcgaaacgaggcagggacgcagcagacaaccaatctgacggaaacaaaaaaaaaacatacaaactacaaatcctggagagggcttaaccgcgcgcgcccaaacctaccagcacaaaaatcctcctaacccgacgcaactcaccgctggaatcgtaggggttattgtaccccatggccttcatgaacacccgccgggacgcgcgacggtgtggaaccctagaaaacccgccgcggcgcgattcctccggatccgggcaccgcggcaacgccccccgctcgaatccggagatgcagcggccggatcgagcaccgcctcgaccgattcgggaggtttagggcttggaatcggatggggatttggggggcgatgggaatcgctcgtgtcggggagaggagaggaggagaggacgactaggtttagccacgcgctgctctgctcggctcagctcggctcggctcgggctcgagccggaccccgctcggctcccacgcgtgcaacgtcggctcgagcttaggtccgggccgagcgagggatgcggcggaagctgtgtcagcctgggatgcgaaacccaaagcccagattagctgccggcccagccgcgtccaactccacattggactcgagttcggcccataattagtactaccatctttagaagtaggcttttgtcggtccatgtccatccagactaatctcaggtctggcaagtgaattactctctagttttaatgcttgaacgccgttaacttctcgttcgttttatttaaaaaaagagagtataatatatgggcgggccctaaacttatagacatatgtcatctaggtccccaaactcagaagacacatttttgggtccctaaactcgcttagccgtacattacctgtccaaatagtatttgacctagtcgctcgccgacatggactgccagcgtggaggggcagggacagctagggtgtgaaatatgaaaaaaaaaatctattccctcatcatttcattcgccaaatatcattttcagtacatttcagataattgcacattttcaactagcctgaaggtagtacacatcttggtcaccacaacaaatacacaacaagctactacacatttcagtcctaacaagttgctctgcagcatgttcatgtccctatgaagtctgaacccagctcaaccaattcatttctctgcacatgcacaacaggagctggacattttgcatggataccagaagctgcaagagccaagatgtcctgtatttgtcaaatactccttatattgatcctcccaataccaaaactcacatccatttccatctcaatgaaaaaacttgcacatgtaaactcaaaatgcttgcaagacaccaatgctctacaacaggagagaagaaataacctgatgtaaaagatgatgcctttattctcagctgtattaagagcaattaatcaacgggattccatgtaaccacaccagccatttgcgcagtagttgtaggacatgtagttgcgctcgggctaggcgacagtgccgagcttggcgtcgtcgagctcctggtggatccgacgaccagggtttcccaaaccgccgggcccggggttaccgcgccccggcggtaagcatggttaccgcggtaatcgtgaaaaaccatacgaaactatgtaaaatttatcaaaaatttaaattattttttaatttatttgaatttaaggaggttaccgtggtatttttattaccgtacccccacggtaaggccggtaaccgctgtaaccgcgcggttaccagcggtattgtaaaccttgccgatgacggccacacaccgacggagttgttgttggtgctgtagccatggtagaacatgacgaatcgcacgcagctctagttgatcttgacgtcgtcacagcgtcactagggaatcaaagaaggggatagtgaatcgaccaagagcttgctagggatttcgttgctcagcatggtggggaaaaaatggggacaggggattcgatatgatttctaggatgagggaataggggggttctttgcatatttgacaccctagctgtccccgcccctccacgctggcagtccacgtcggcgagtagactggctcaaatgcaatttggacaggtgatgtacggctaagcgagtttagagacccaaaactgtattttctaagtttggggacctagatgacatagccttacaagtttaggggccgcccatacattttactccttcaaaaatctcgtgcttttttgttttactatgatttttattattaaacatattcttactatgaattatatttttacaataaaattaaataagacaaatggtccaatgtatatccaagacacctaaaatcaagtgtgtcaaacattaaaaaccggagatgttatacccagttttgcaccaattttgatagatgaggtggtataactggttttgcagttaagggggacgatttgatcaggggcaagagatgagggaggtaaaatagacttgttccattttttttattggcttcattatttagcaggccggtccaattcattcacccgtgctgaatcgggctctttttttctttttaccaggccgcctgttcagcccatgcttgtacacattcagggatgtatcagcaggcacctcagcttgacctcaaaagaaagaaattttggttcttttgattttttttattggcattaacaaatatcgctataatgttagacagatatattactagtttataaaatacatgaagtaagtcggaaactaaacatctctccttcaaagagggtgtgagagggatcaagagtatcctaattatcgcaattaggaatggatccaattctgttgagtctgactcattgtggtcatttctcttttaacaaaccttagttataaaaggattgaacttggatccatttatggatccaattctatttagtctgactcattgtggtcatttctctttaacgaaccttggttataaaaggcttgaacaatcgggatccaattacttattacttatgatacctagttgatattaatagctcgagatttacgtcttggtcaagcgtgtgtgtgtgtgtgtgtgtgtgtgtgtgtgtatatatatatatatatatcgatcgatcctgactccatgagcgtaagaatatgctataatttttaacgatgatatataatcatatagacacttttttttatttgatagtacaatagtataatccggttacagcttagatagatatcctgcatgcaggtttattcagtatacaatacatttattctggtggaacactcttaatttgtgccattttattctagcttcacgcatggccagcgcctactcacgcagcaccaccatcggggcgccggtgtagaacgggtacacctccgacctgaggaggcacctcggcccggcgatcctggcgccgtcgacgttcgccgggaacgtgtcccaccacctggcgacgaggccctcgaggcagccgcggcacgcctccagcgtgatgtcgaacgcgcactgcgccgtcgcgtacaggttggggaaccccgggtcggcgcccacccgctgccccgtcgcgaacagcttcctcgcgatgtcccccgccgcgtactccgcggtggccgccagcagccgcgtcaccgcgcggtcgtaggcggcgacgtcggcgccgctgctgatgttggtgctgctcatgagggtcgtcagctgccccggccccaccttgtcggcgaggaagtcgtccttgtcggagaggcgggcgtagcactcgttgtagacgagggcgacgtccttggcgcggcggcacgcgctcccggcgtccctccacacgctggtgccgcagtcgtagcaggcggcgcgggagatgtcgccgcggcagaggaggaggccgtagacggtgttcggggcggcgccgttggagcccgtggagaagaggatctcctgggaggaggcgccgtcgcggagggtgagggccaggttcaggaggttgttctcgtaggcgctcccctgctcgtacgtgccgtcgccgcaggtagcccacggctggccggcggcgagcgggacgaccgccaccgccgccgccacgaggagaacgagcaaagtgcaccgcgccattgcaatggcagtgatcgttaagctataggttgatggattagcgatcgatgtgtgtgcagcaaagcgtcgagcattgcatgcatatttataggtacggtaacgtactaaggtagttttggacgacacgcatcgccaacctatcgttttggatgaggctctaatttgtcgagatagctagctagttggcaatttggcgtgtgctatttgccgataactaaacacacagttccacaaaacaagctgaattggcgccgattttatgtacgggtttaactgtttaagaaaccggtcaaaaccgttggttctgatttcaacatcgatccagccaatgagagaaccacgcacggcagctgcgctgatctttgatagcactagttcaatgttgcctagtcggattaattcgctggtttcagacgaactatagaggaacagcattgactgttaggtacattcgtcgcactcgcacaggcgcacattcagtggatatttcgttactctactttaattaatttgtagtcaccaaactgaacaccgtctccgatgtactagaacaaaaggatatacttaattactctacttaatctactttttttgtttgaatcatgggctgcgtgcctgcgttctatggtctgtgcaaaggtttaacgggcactttaacaagggctatgtttctatggtctatgcaaaggttaaccgtgagagcccatttttactcaatcggaaccaggtcttctgatgaagaggatttctacatcaaaggggatatctgtgccggatcgttgtttacccagcattcaacgacagcatcaattcatagtttcctaccctctcctccgtcgtaatttggcccagaatcctgcggcaaaacgacggggtttcttgtagcggcgtacgtttccccctggttggctctgagctaggccgaacgactgaagagaagctaggaaccagtgctgccattggatgcggaatgaacggtgatcctacacggatatccttctaacatatagatatcctctatatactaaatgatctggttttactaagtggtctaaagtagagatggcaacgaactggattgtctcggtggaataggaatacgtcttaacaagcttaccgggtctaaaatggaacaaatatacctatgcctgctcgtcaagtacctaaccgaaagtccgaaacccagtcagtacttgtggatattttgcaaaacgtgacataatatatcaaattgatagttaaaaaccatcaacaaattcagagtttagaccatcttgcaagcatcagcattcaacagctagcacaagcaatgaacatgtcggggtcaggtgatcctgacaattttgacgaaatctgattgcttgtacatagaggataacgcaatggtttaagtaataagtatggtcaatatataatgacaccgtatctcaattttctatacaagccatcgcttgtgattaatattatacgtgtgttttgtttttattgtttcttgactggcccccctctcctatcatgcataatcctgctccgccgttgaggaagggaactgtacagtgtactgttccggaaactggatagctttccctacgttcaatgcactacgtggacatcattacttatccattcactctgtttcagcttataagaactactttaaatttaactaaaactaagtttgttgaaaaaaaataatactctctctgtcccaaaatataagaacttatgattacattaaatatttactagtattacaaatctggacaggcagcatgtccagatttatagaactagaaaatgtcacgtcccatactaggtttttatattatgggacaaagggagtaacatttttaagtcaagataaatttattgtgaaaatatattcaattatttattgatgaaactaatttagtattataaatattacttgtctataaatttagttaaaattttaaaaaattaactttgaccaaagttaaaacgtctgaaacggagggagttctcagtatggtcggtattagtatcttgccccaccacttccattgagcaacttgactttgcagccattgttactgtagataccagtgagacagtgattgcgttgtgtcctgtgtaagggtctgattttgtttatctattctaatcttgtcactgtagagtagacaactactccctctataataaaaacattggtaaactatgtcgagatttaaattcaaaaatagttttttatggaggatgtagacattagtaagactgattttttcattttttgtaaggttggaagagaagccatggcatattttttttgtctatgcatcttgctcactaaataattattaccgaaaattatagaaaaaatacatatacatataataaaattgaagatgagccaggacaaaaaatagtatcggattatcttattcagttggaccacactttaacgaaaaatttcgggctgctcatcgttataagctggtctccctctcaggttgaattggcgaggtgggattattttttgctacagtacatcgctgctgctctgctctctctgctctgcttgctgcgctgctgcttgcatgctactgtgggctgccttttgctgctgggccagctagctactgggctgcatgggctggcctgctagctagctttgctctttttccttcttctcttctcttctttttctttttcttttttctctaattatttgcagggcgttacaagatcttataaatagataatagtactaaaagtgcatgtacagtttatttattttttttaaatctttggtgatatttattactagttgatatgtatagtgtgtgcacacggacacgttcccagatccagaaacggtttggggcaaaaagtatagaaaaaatgtacttgttcgtatgtataagcagatgctggaaattggagcatttttgagacaaggcccatgaaaatatttgggcataatagcatcttatataatgtttttgagagaaataatctcaagcatacaacaacgtcgtcagctcataccgggccttggcagaatacacgagttccttcagaatcctttttttttttaaagaacctagcgagctggttttatattatagaagaagtaagaaaacaaaaatgtataaaagggactattcctgtctacacgctttagaaaaatagaagcctactctcttaacataatacattgcactcccttggcgcctgccatttcccacaaatgaagctcatctatgatcttgctagcaagtgccggcggcgtagactcagtgcctctaaaaatgcaattgtttctttctatccaaatctcccaaagcgtggccaagaatactgaacgcagccttttctgttgcaacttttctgcctcatctgtttgctcgcgccaccaattgaggagagtatcgtctatggtcatattgaggaaacgtgacagcctgatcttgcgaccaatgtcccgccatacctgctgcgtgaaggggcactccatgaagaggtgccgtactatttcaagatttctgaacacagagttggcaaaagtaattatttggccagcccctgcattgcaatcaatccgtcgtccatattctattttttgccagcaaccacacgaagaatttgtgtttacccggtgcccaagtcttccatacaagctcggctgattccgaaaatcgttttgcccatgaactgcatggcatatgctgatttcgccgtatacatgccgctggctgaccaccgccggaggattgtgtcatcagccccttcatggatcacatctcctgcattgtggagcacttcccatacacatatatattcctgaagcaactgtattgtcaccttccgcggatatcttcgatccaagcattattggttattgcctcaagagtcgatttgttcttccttttggagtgcttgaaaaggtttggggctagatatttcaacggctgatctcctatccagttggattcccaaaattttgcctttcgtccatctccaactgttaccttgatggcggccacgaacagtgcacaatcggtgagggcggcggggttcctatccaagatttttccgggcttgtccactcgtaccagagccaagagccaacatagcctcagcgatcgtgaaaatttctcgaagcaacgtagttccttcaaaatctgtttccatgcacatcacaacgtacggatcacgatcattactccagaatctgaattctgaaatttccacaaaatggatgaactgatgaagggaagtccagcctcgatccaagattcaatcacaatgtgccacatcggtttgttaagatggtcgtaaacagttgctggtcagaattcttgcttttccttttacaactttttttttggaacaattctgaagaatccttgtcccctgaaggcagaatccttgccttgccttgccaaatggtttagtcgatgacttgaggtccttctaactgttcattctgattctgaacagtctacagattaaggtgaccataagttttagatattattccaaggcatatcaaggaggcccaacctggaggatgtagaggccgttggtttttaatccataactgaaaaaaggactacctattgatacttcgacaaatttatgtcttcaaatcttacagaattttcaactaatggatatagctagttttaaataaaataacaaaaaagagagacaaatatgtcaaaaatcataaatttagagaaaagaactattgtaaaaatctagttttggtgaattgtaacaggatgcaagtgctatgtaactgagtataagtgcactgtaaatgagtataactacaagttagatatacaagaacacaaatcttaatataaagatcctatgaacgaaaaagtaaaagatagaaatataaaaatctgtcgcaagtgaaatactagcaaaaccgaaaaaaaaaatcaaggagccccaacagaatcctcactaaaaacaaaacgagacaaaggacggagaaacactgtcgggagaaaaactcggaagacagcactgaatgtctgaatttttggacttcttttatctaaccatcagataaaacaggcaactaaaacgaaacagcacaaatttaagagcatggaggactcagtgcacagtacgattgtgatcatcaagggcatgcatatgagcaaatgccatgtttaggttcggcgagcgagccttcgttgtttccatcactgtcctccatggccgtgctcacaaatagcgccaacttaaatcagcaaattaacgaaccactgaaactctgaaaacatacgaagaaaagaagaaaattctacttacaagccagaaattaaactcagactcaaaacatgaaaaaaaaacacaaaattaaacctagcacataagagaggagaggataatgatgaatagatggtaattaagcaggatgggtgatttattactccctgcttaatgaacagagcttagccttcttatatatagcactggtatcagcaggaaacagcaaaagggagagaagggttttaatttcttggcgcctacggatttgcgttaggtgagctaatcgtgttggacttttggtacaaagataagagtttaaaatcagagcatgcagaacacgaactattccatcacctaacctaacagtatgattgctaaagctcaaagtcgatatcatacagtattccctcttgctactaagtgatttctgccaattggttctgaaagatcaaattgccgttgttgtgttaacatcatccatcatgttgagactaattttcttagtattagttgccttttggaatagggtaattttatcatcttaaaaaaaatgccgggagatactacacatagtgtaaattttggtacctcgaagtattttttttggtgtaaaaattagataccttgaagtattttttttttcaaattgctattgttgtgttaacatcatccatcatgtactccctccgtccaaaaaaaaaagacaaaccctgggtttccgtgttcaacgtttgaccgttcgtcttatatgatttttttataattagtattttcattgttgttagatgataaaacatgattaatactttatgcgtgacttgtctttttaatttttttataattttttcaaataagacggacgatcaaatgttgtacacggaaacccagggtttgtcttttttttggaacggagggagtaaaatttaagagcaattttaccatccaacatttggtatcttgagatactctctggtgtaaaatttggtacctcgaggtatcaaaattttgtgtgtaaaatctggtaccttgaggcatcaaaaaattttgtgtgtaaaatttggtacctcaaggtatcaaatgttatatggtaaaattgatcataaaatttcactttggaatatgttcaattcatttccaagaatgcagttggcgtaaagtacaaaggcaggttcttcggaagaaaagcgtaatttgcttgagtca

SEQ ID NO: 60067 - DNA, 17889 bp, Oryza sativa
tcgtcctcgtcacgagtcgggccacttccttgccgccacctccccgatgacgacccagactccggcttcgcgcccgacgacccggacctcctctgcaactgccccgtccccgaccgcctcctcgtcgtctccgcgggcgtagccgccaacctcctcttcgccttcctcatcgtctacgccctcgctcgcccgccgccgccgctctcgtctccagcgtcctcggccgcagatggggaagggggagagaaaggggagagagagagaggaagggaggaggaagaaggattggagagagaggatgacatttgggccccatatgtcagtgggtcctacaatatattttttgtgtgaatgacagatgggtcccataattttttttaattctaatgccacttaagcgccatgtgggacgaagaccgggtcaacaccgccacgttagcgccacgtcagcaaaaccgccctccaataccgctgagggagtcaaattgcaccggttcaatagttcggggagtcgttctatccggttttctggttgagaggtacgaattaaattcggcatacaattaagggagtcaaagtggactttttcctatcacgtattcacgtgtgaaatctaaaggggacctgctctatacttttattttttaaaaaaaatatttagaaaaaaaaacttatgataaatcaacgttgtcatgagcttgtgacgtttgttggttggcctcttacgacaaaataacactcgtcacaataatattgccactagactaggttacgacgatttgtagttcgtctcattgatgaaccccttatttttgtcgctaagttacactatcccatagagagcgaaataaaactgaatgacataattataaatagcttcgatgtcaggaaaaattcttcgcaaaaggtcatgtgtgttgtagtggacggattattgcagaataatcagtgcaaggatcagcattttggtccttttgaaaaacttatttcgtaaatagatccctagaaaaacttatcctaaaaatggtcctttttggggcgcccccctgccgacgttgcggggcgatgctgaggtggctagggggagtgcgccagagtggctgacgcccacccccctaaattttttatttttgttttatttgtttgatatttttttcacgcttagagacacacaagaaccaaacataaaaaaaattgaactcaaatggacgtaatatgtgacatgtagaatttttcctctcctctcctctctctctgaactagtgcagaggaaagagatgtgcaacttttttatttttattttatttttttgatatttttttcacacttaggaactcacatgaaccaatcatgtaaaaaataaactcaaacggacgaaatatgtggcatgtgcaattttccaaagctctaccgaaaaacttctctcctcgaaaacacaatcttacaagcggaatttggaggttttaatatcgccgaacctggcgaagcttgggagaatcggatgtaactttttctgtagatgtccatgcatatattatttgtctgattccgagtccgtatgagaaagttacgcctattttaatagatgacatattttgtccgtttcggtagagttttggaaaattctatatgtaacatattttgtccgtttgagtttattttttatacagttggttcctatgttctcctaagtgtgaaaaaaatatcaaaaaaatgaaataaaaataaaaaattgcatctctatgtactgtttaacttatatatgtcatttcatgtggttatagtggtagagtgcattatgtttaacatgctgatcaaagggttttactaaaagaattatggtctaattttagtgaaggtacaaagtagactaagtggtatgctagatattttcagacttagctaagtggtagttctagtttaaattttttttgtggttggttgtattgtgatcctgagtgtgaaaaaacatccgaaaaaataaaataaaaatgacaccgttgcaactccgcacagagaaacagggatgcagccgccggcgccagcacggctggcgccctcctcctgccacgtcggttcacgtgcgccacggtggcaggaggacggcgccagccgccgtcccgttggatgacggcgccagccactctggcgccccaaaaaggaccatttctggtataagtttttttagaggtctatttgtgaaataatttttttaaaaggaccaaaatgtgaaaaatccagctgcaatcgccatagagcaagtgaacgggagtcccgagaacccggatcgcatagtatacttgtatataaatagaagaagttttcttctaaacttttgtatcctgttattctaagcaataagaaacacaccaggttagccccaatttccagattgagtgtcattccacattttatttccctttgttctttgccattgcaggacaactacattcacccgcaaggtgttcgattgaggttctaggcaacaaaggaattccaaagtattgaaagtaaatgtgcaacatattaattataaactgaaatgtaaaaattcgaaaatgtacatttttctgatcgtttttacaggaatatttttatggattgtcttcccaccgtcaccgtgatattatgcataatttatctacttaatttataatcttgtaggtcctgtcatgccatatgatactacaggacagtgtacgtcgtcaatgcgtacaatcagacgggggcagagctaaaataaaatagagaagggtgacacttgcttaatttactctctttagattaagtttaacctgatgcgggtgtctaaatttgtattgagtgggatacacacataatgaaaataagtgagatatagcttaaaaaaaatttcttgaccgggttcctggtacccctccaatactctagtactcgatgctctccgccttcgacgtcgccatcagctcctgtttcgtcttgttgcctttaaaaaaaaagcgttgccagtaagggtgaaaacggtacggaaatttccgagaattccggctaccgtttccggtttgcgccgaccgtttcagtcggtatcggaaatggaaacggtaatcgcttttcggaaatggtagcggaaatgatatggggttttttccgaccgttttgtcggtaaccgttttttatcggtaatttccgtcaaatttccaacaaaattccgaagaagaaagccgactgggcctggctagcaggagcaggagcagcccattaggcattaagagactaaagcagtcgacatcgctgacgcgggtcgcagcctccttcgccccgatggcctccgtcgctgccggccctcttttcctcccccatcctccactgccggcctctgtgccgccgagccaagcgccaccgcgccaagcgccgagcgacgtcgtgccgagcaccgccgcaccgccccggcctcctcttccccaccggcaccgcccctttctcctctctctccttcccccaccgccgcgctgcgccaggccgccatctccggcgcctctctcctctcgggcgcgcgtgaaggagccgaaggcagagaagagaacgggtgagaaaacagagaagaaattgagagagcaggagaaggaaccgagagaagagaaggataagagagagagaaaagaaaagaaagagagaaaaacaaagacagtgggacccaccggcgggccccactatcttgactcttctccgtgacccccttacctggaaactaccaaaaagtctagtttagcatgaagcttaattacaatggtagttatatagtgtcaacaaaaaacttaattacaatggtagttaccacattgtatgctttagccatattgatgttgaaatatcgttgaactttttatattgtttgtcgaccttattgtcaacttattaatcatcgtataacggtgttgtgtggcagcgtgatgatgcaagggtgaaattataaggtcatcttcatacatagttaaatgtgggatgataccacagttcgttgtttccgacatgaatttttgacttccgaccgatatcggtagattcccgttccgacgattccgtttcagatataccgacattactgatatcgttactgtttccgagtagaccgttccgattccattttcgagaaaataaaatgaaaatggaaatggtatagggtttttccgaccgtttctgaccgttttcatcccttaccaagccacagatgttggtttcacctttccttctcgtgccactgtgaagtgattagggacaagcaatggagaagctgtagtcctgcctgatcatgcgtgttaaatgttgtcaacagcgcttgtcgaaacatgaattcggcaataataaaagggggtagcgcacgagacctaaaagtggatggatgcagagacaaggatttagacaggttcaggccccctcgttgagaggtaataccctacttctgtttggggatttgaatccgccatgtatattatagatctgacgatctagttgtctcatgccccctagagggcctcctgcccaccttatataggatgggggccatgattacaagatagaaaccttaaccaatacggtatcggtttcctaaatctactttacaatcttatcaaaccaggactttaggccgttccataatatagagggaaacataatacccaagtcatgatccgttacatatttcatagatataagttatcccctataaccagtcggataactatgccgtatgggtatggggtacccacaatcttcacagtagcccctgagaccttcacagtcgaaaagataatcttttctcgaactagattactccaaagataagtgcttcaatcatcttcgccatggtctcccgagtacttttaccaaatcagaagactgtggagggctgaaaaataattaaatgaaattttaggtgcatcgactagatgcacctaataggtgtagcccccgactatgtggttagttgagcaaactgaacatatagtcaaagagtaaataatccaaccaactgagtgattcttgataattatagtcaactaagtgacttgatagcatatacggtgtgaatccctaaataacatgatccaagtgatataccgactgctttgtagaatatgatgcgtgcaacctaaagttgactacatcattgaaaattcacatagcaaaatagttataaagaagcttgtatgttgtgaataaagaaatttccaaagtattgggcacacaccatgcgcacactgctttaacagatgtgcttaagtccctaaaagacacatggtttcaccacacatggaaatatatggcatatgtagtgtaacatccgagtaaataaactcataaaggatttaccaaccgcctggaaaatgaccaaaatatataatcagcctaagccataatattggtaaataaaaatgcacacttacgtgacaaaaagcaatgatattgtatccaatcaattgcttgataaacccaaacaacaccttgactatataaaaaagtcagcgggacagctatataaagctttactgttcgacaccttttaagatgcattgtaccaactcctaaaaagttgagtaactgtggtataaaaggattttaaggtattgggcacttgatcacgcgcactttgacctaagaaaaaagtgcctaagtccctaaaagaacgtgacaggtcacacctgaaaatatgggctgcagacatattaggcctaggccaaaaaatatgccttcgacaccctttaaaggatgacgcatgtaacatgctctcgagtaataaatcttccgggtgatatagaccaagtgtagctcatatgaatagcttctaatctgagtgattatcccttatgggatactccaaaatagatataataattgaatcccgactggcgcaagtattcggttgataacccttactgggaataataaatagtccagtctttgagcatagaaaatagacccatgatcatgaattcatgttgcatgtatccggaacaagtccaaattgaaggtataatacttgtgtttgagctagtaagcccctgatcatatagcttgtccttttgtcgtagttacaatggtccattgatagtagctgacgcagttggcatagagacaagacgaccaatatagagataatattgcccaccagaggtggcaaaaatattggtggtggtgaagatagtgataccaatcaaaagtgatgaagttgtacaaccgtggaggcgaagaaaccagtcgacagcagtcaggtcagccagcaatgaagatgaaggcgcccaacgataaagttgtgtagccatggcagcgaaataatcagtcggtaactgatgaggcagctggttaagaagatgaagatgcccattagtggcgacataataagccatccatgaaggcgaggataccggtcggtggcgatgaaagcaagccgacggtgaagatgtagacacgcatcaaaggcgatgacgaaatccaccaatcatgaggatgaagaaaatagtcggcgacgacaaacgcaaccgacagtaatgatgataagtagcaatcatagatgattgactatgatgacgaagttgcccatcaaacagcagtagaataggctatgttgaagaggcttgacaggatattgatgaagatgacgatgtcggtgatccagtcaatagcagtgtagcaactgatgataatgatgaagatgctcatcagcgtttgcatagtaggtcatccgtgaagatgaaataacaagtcggcgatgaaagtaggtgatgacagaagcaaccgaaggtgaatacgtagtcaccccttagcaacagcggagacgtcagggccgatgaagtagaggttctgttgatgatgtcagtgacaataatccttcaaattgttgagaagatgtcgaagctcgaatagtttccttgatgcaagcatgtgcataatgaagactgatgcaacgccccttgatttataaagatggcagtagaacttggtgctataactgttgcagatgctttacttagaggaaagtatatgctgttgttcaactcattgaatctgatctgagttgattgtttgatgactccaaactcccagacatgtaaatttaatcttgacctaccggtgtaataattggagtcgctgaagtaaaatgccagctctgaagcgcagacgaagataataactcccagagttgactcgttgattgattgattgcttcatcttgtcaaattttgagagtcttgtatttgtgtagcccccaactctttgattagttgggaaacaactgaacatagagtcgagaactgtagcttcttgtcgtcgagtagccatcacttgagtgaagatatgtattgaggatgtccggagagaaatcttgaatattggagcaccacttgttgtagtaaaataacacggcatcatatttggtgacgcataccgagatgtcgaagctcttgtagacgtcatggctagtgaagtagcaaaacttgcgaagtagcggcaatagagtttgccggtgccgaagacaatgaagatgaagtagctccaccatggtgacaaagttgcatagctgtgatgaagtgaacacgagtcggcggcgacagaaccagttggcgacggaagaagtagaataatgacgaaaacggagatgttctttaacggtggtaaaataggccagccatgaaggtgaagtcacaatgggcggcggtgaaagcaaaccggcgatgacgatgacgccagtcaatgacgatgaagacgcgcagccgtggaggcgaacaagccagtcggcgttagacaaggcgaccagcaatgaagatgaggacgtccatcagtagtggtagcggtataaatcaaccgtagaggcaagggcactagtcagtagcagacgagatgaccggcggtgaagacgataaggccaatcaacactggcagaatcatgtagccatggaagtaaagaaaccagtcggcagcagacgtagacagcttgcgttgaaggtgatgatgcctgtttgcggtggtggcgacgtggccaaccgtgaagacgatagcaccagttggcgtcatatgaggtggccagtcggagaagatgtagacgtcctacaatggcggcataataaaccaaccgtgcaggcgaagacaccagtcggcggcggcgaaggcgagccggcggtgaagacgtagacacccaacaacggcggcataataggccagccatgcaggcggagacaccagtcggcggcgacgaaggcaagccggtcggtgaagacgtagacgcccaacaaatggcggcataatagaccagccgtgcaggcggagacaccagtcagcggtggcgaaggcaagccggtcggtgaagacatagacgcccaacaaacggtggcataataggctagccgtgcaggtggagacaccagtcggcggcggcgaaggcaagccggtcggtgaagacgtagacgcccaacaaacggcggcataataggtcagccgtgcaggctgagacaccagtcggtggcgacgaaggcaagccggtcggtgaagacgtagacgcccaacaaacgacggcataataggccagtcgtgcaggtggagacaccagtcggcggcggcgaaggcaagccggtcggtgaagacgtagacgcccaacaaacggtggtgtgaccaaccaaccgtataggcgaaaacaccagtcgacggcggacgaggcagccagtcggtgaagaaaacggcgcccaacaacggcggtgtgaccacccaatcatataggcgaaaacaccagtcgacggcggacgaggcagccggtcagtgaagaaaacgacgcccaacaacggcggtgtgactacccaaccgtataggtgaggacaccagtcggcggcgacgacggcaagccggtggtgatgttctgactgatccattcctgtaacataggagataagcttaaagccatgaatccctttgatgcatatctggatctggatcctgcagaacaaatatataggatgagtagtatctgatgtaaatacagtacttgagaaagattcaagtattaaaagtgtttataaatatgtatttctcctctcgtcaattttgatttccccgagcagatgactcattacgtttaaacactctgcctgactagtcatagccaccaagcaccgggagtcggcctaggcacttcccaaacatgcatatgagtgacatgagttcgtcattaatggaacaaagtttcacgaatcaaaatttactactcgggtatttttgcaattgttaagagaagaaaataaataaatttatcttatctctatgcttttgatttattccgaatataatacttagcatcttgcgttactcggtccatccaacgagcccccgggtgctaggaatcggcccaaaggcaactatccatcgacaaaccaaacggaaagcataggaagatagaactccataactcgatagtcacttttgtactcagattatgtcgcaagcaatcaagataaatattatgaaaattgttgaaaaaatatgacatagcatctctagcccccgactcactagtcaatggcgaaccaattgatgtagtgagttagaggaaaagaaaaatatcatataaagaagaaaattaatgatgacttagctttgtaatattctccttggtgacggagagatgaccgatataggaacgaagtcatccgtcaatggcgatgaaataagccagtcatgaaggcaaagacatcaatcggcggcgacgaaggtgaccagtcggtgaagacgaagatgcccatcaacggtggtgtgatcaaccaaccgtataggcgagaacactagtcggcgacgacggaggcaagccagcggtaataacgaagacataggcccttccagactcaacgccatgttgtactgatccggtagtggtttataactcaagctcatgatgtcagaggagtgcttgaagggaaaaccggagcatgttttgatggagtccgagataatatctcctgatgatgtcagccaatatatcatatatcctcacgtaggagtatggtgctaggactcctgatctgattagttggcaaggtagccatatatgctcacatgcgtatgagctggatggaaatattaattggtgtcccttattgaggatagctcatgacaaccaattaacgatgtgtatgcctggcaattcttctgggatgtagatgcaaaaccaatagctctggaattgatcaaatgcatagcgttcgttgcttttcccagagctggggtactggtaagtgttggggctcgtgccgaccacattcccagtgctttccttgcatgccgagtgtatttttgttttgacctgatcatccagtagtcagccgagtccgagaatgatccaatcagctaaatccgagtctggacttctattgtacgcctggtataagatcaatacgatctacccatatagagatgtgtgctcagtgagctgatgtcttgatctcccgtgacaatgatcgaaagactcggaggtcagaaccagcaacagtacatgcaaggcatagattaatttaattagtagttatatcagagaccaatctaataacgattagtagattggaacgacgaacctggttattcttgtaaccacaaagtgtagctcctgaagcagagatctttgtggagatgcacaggagatatcggtgaccccgacgattgaagcctccaacttgatgacgtaaatctttgatcgccgttctctcgactggttaaaacccaagtcgaagagggagagattgttggagtcaccatcaaagaagacgaatccgtcaaaaccgaaagccagccttcggggtgaaggaaaatccggccactcctgatcttgattccatcacacttcttgacggaaaacttgacgcacccctacctggcgcgccaactgtcgaaacatgaattcagcaataataaaagggtagcgcacgagacctaaaagtggatggatgcggagacaaggatttagataggttcaggccccctcgatgagaggtaataccctactcctgtttggggatttgaatccaccatgtgtattatagatctgacgatctagttgtctcatgccccctagagggcctcctgcccaccttatataggatggggggcaggattacaagatagaaatcttaaccaatacggtatcggtttcctaaatctactttacaatcttatcaaaccaggactttaggccgttccataatatacagggaaacgtaatacccaagtcatgatccgttatatatttcatagatataagttatcccctataaccagtcggataaccatgtcgtgtgggtatggggtacccataatctccacagcgctagttctatcaccagaaaccggatgaaatcaattcccaatgcctcctaaacctaaaattgacacatggtatttcccttctttttttttgagacggtcgctagttagatgagggtttgtatgtgtgttacgcgtgcgtactaacacctcgaaggatgttgtctaatttgtcaagtgtgactgtgagagtgacttttagggattgggattttgtggatttggaataaacaaagcctatatatgtagtgaaggaatcatctggtttttttttgtttgtttttgggaggaggggttaaattaattatttcgtatacatgtgtcaatgaaacaaactttttatccagttttactaaaggaactccaaagtattgagaggaaatgtacaatgcattaattataaactgaaaggtaaaatattttttttttgaagaaaccgacggtaggagatctaccggaatattataagaagagagttgaccttgttaataagaaaaaccgggctcaaaaaccttacaactgcatagtttgctaaagggaaactgacgaaaccttacacagaagacagagaaaaaagcctgggacaaacgaccgaaccacaaaagtgaccgagggaagagcaagaccttcaaggcgaagcctccaaggaggggaacaacgacagaagccgctgccgacgcctgcccaaaaattggactgagttttcacccaaagggggagagagtccacaaagcagcacctccaagaaggatacgacacccacaagcgtcgatgttgccgattctggaagacaagacagggctttcacccgagactccctccaaaggaggatctacaatgggccagagcaaaagtgttgtgttatcgttgcccagctcatcggctaagcccgatgcagcagctccgactccgccaaacacaaaactctggcactgaagataagcacaccgctccaactcggcactacgataggttcacttagtcgcaggacactagaagcacttgcgaggcccaagagccctgactacagacagactgaaccaccttcatagacgaacacttctcctcaaccaccgaaagactccacggccgagactggaagcagacggccaaaaaaagggaggagcatcaaggaggagagaaggcatcgaaggcatcggtgtcatccatgtttccggcgaggaccccggccttcgcaggacaccccttacagctgcgacaaaccacctccaacttcaccactagcacagagagaggagcactggtgtaagaagcaaagcaactaaacaactaggcagcagagctgccagggaggaagcgagaagaagggagacaagggtggcggacacccccttctgcttgcaaagaggaagaagccaagagaggggagggtggttgtggctactgtcgacaccggaggggtaggtgtggcgatggggggcggctggcgagccagtgtagccgacgcccccagcgacgcgcctcgccgatcgggagccagcagatgtcgccatgccgcctcgcaagcgccgtcctccgcgccaccacgcgcgcaccggaccacccacgcgcgcgctggacttcgccgcctcgcgccgccacgcgcgcaccggccgccgccaaccttgccgcctccgcacacgccgccccacggcgccgccgccagtactccggccgaaaaccggagaggctggccagatccggcgacggcggcgccggatctgccactgcctagcccagaggcctcgccgccaccactccccgacgccggcgaacgtctcctccaccgcgccttagaagggacgccgccgcgaagaaggccccgccgccgccatcctagctcgccagccggcaaaggagagctccggcggcggcgaggtagggggaggggggagggggagcggcgacggaggcgcggcggcgacgcggggggagagttattccttttcagatataacagatctgaaagctaaaatatacatgttagctgttttgcggtctttgatcagtttgtgacaaaaactcgaacctataagcgatagctagctcttcgcataatatcaaagcgaaacatatgtatcgcaaattgctgggcatcactgctagctccagctgacaaggaagtgcaaactacaaaacactgcgaaccatcaattcctttttggatgaatcctgtatgcatcccatgcctaactgataccaggaaacataatctatgctttttaggatgaagcaggtaaaagtttataagaacttggttttagaaaactctacaccatcatcggacaattcgaagagcattttcagacatggattcgattcgtggtgctcgttcaaatagccaaggataaatattttgcctcaaaatcaatttacacgtagatccctttcttctgactagttctgtttgattgttttatttattcttatatgtgtatgcacagtatactattttggtaattttaacatatttcaaaagataccaggagataccatagtttctaatatatataaattaattttgatatcctcgaatgaagtaccaaaaaatttaatataaaatttagataccttgagatactttctcaaatactgtataatttctcataatattttacgtgtccacaatataagaccatatcgtccactctttaccataaaaaaacataatggattattagaggattccaaaggaagcaatgatacaaataggcacatcaggcacagtgggatgtcaattatacaaatttcacattgggctttatactaacacgtctaaactactaagctggtttttacttgggtaaccagattgcacacttccatccataagtagagggaggaggcttggtaagatcaggcggtgtttttctttaaataccaaaacaagaaacagaactgatcgagaggtggcatcaaatcaaaattgatgtttttgatgcgttgaacgtaacaggattagggacaggccatggagcagtttagtctttacctactagtgagagggttcacactgaaactaaggcacatgctgaatttattttgaaaatacatgagatcattgaaaagatgactaaaaagtatagaattaattgctggtagtaaaggtaagcaagaagtgaagtttgaaccgggtgatttagtttggttacacttgcgaaaggatcaattttcagattttagaatgtctaagttaatgcctagagctgatggtcctttcaaaattattgaggaggttaatgataatgcatataaacttgaattgcttcctgagtttggggttagtcccacttttaacatttagatttaaaaccatacttgagagaagaagatgtacttgagtcgaggacgactctaattcaagagagggaggatgataaggacatcactccttcggatacacacaacaatcctccaccggtcattcaaggaccaataacaagagctcgcgcgagacaattgaatttagaggtaagctcgttcctattcttctttgtatgattttgagaatatattgctacctaataattataggaatcatggagaggacaaagagacacttagggtgtgtttgcaacccctttttctcaacccatctccctcgtttttcgcgcgcacgcttttcaaactgttaaacggtgcgttttttacaaaaagtttctatacgaaagttgctttaaaaaaatcaaattaatccatttttaaaaaaaatagctaatatttaattaatcacgcgctaatggaccgctctgttttccgtgtctattgttccggatgggaacatgaaccagcgaacacacccttagagagggacttagaggcgcggaggatcatcaaggacgtccaagtcaagatggaggcccaaaccaagtcgacttcgagtacgattcggagtccaggaccctctgcactaaaacgggcacccagatcgcatacatgctcggattatggcgttctttatatggctggaaagctaagaagataatatttccaatggttctagtcccacgtccaaattctttccaagtcaacaggaatcgaccgaacaatttgacgtcaagaatctgtcccggtgctgcgtcaccgtatttgggcatttgggccgtgtatcgtattggaacccattagggttgcatcaagggttgtttgcacgaccgtaaactctatatatcagtaccagccgtcacctttagggtttaggtttttcttagattattctgttaagaacactttcgccactagatcggtttgtaagacaccaacttgtgagcttaatcattcatctacaattttagttgtattcttccttgttcttgtttgtgttcttcgattcgcaaacagggattagccttttcggcgaggtcttccgcgtttcgatacgggtgataaccagaggagacgtggtgctacgattgcggggctcaagagcgtgttcgttcagaagccggatcgggctgtgtcgcgactccgctcaaattgactgcctattagaacctttcggaagatcggtaaccctcgtccacatcacaatggaccactatgggctgcagttgctactcacaatgaggaacaaactataaaacttggcgttgtcatcggagaggcagatgaatccagtatggctcccatgcctaattgatggataggaagaggaatctgtggtgctttggtttgctggtatccacaatatactccgcaagctttgtatgttacaggggacatgagaaatcactttaagacgcgctctctaggaattgatgttacagaggaagcaatgatacaaacaggcaaatagaaacaacgggatatcaattataggatagacgatctgaagttctgaacgtactcttaaacttttaagtcagaactatcctctggattgaatgaaagttatgggctataaagagaagttcaattcagcagttgtaataaagacaaaatggtactttttttcttctttgattcagtttaagaactagctagtaagcaatatgtaatagtataataaaaaatacaaaaatttcgtttatacattttcaagccactttctgtactttaccagctcaacttactagttcgttgtaaaattgctctatcagtagacactggataaaatcaattcccaatgcctccaaaacctaaaattgagacaaaggtaatcggatgctggtttgtatgtgtgtgtatgagtatgaacgctcgcatactaacacctcgaagattgttgtcagaattgtcaagtgagaatgacttttaaggattgggatttggtggatttgggaataagcaaagcctataatgcaggcatcatctggggtctttttttgtttttgggagaggaggggttaaattaattatttcgtacatgtgtcaatgaaacacactttttttttccaatgatactaaaggaactccaaattaaagattgaaagtaaatgtacaattcattacttaactgaaatttaaaatatccatgttagctagctgttttgcggtcattcagtttgtgacaaaaactcaacctataagccaaacatatgtatcacaaattgctggcataactgctagctccagacgaacagcaaactacagtacagccaaccatcaagtcctttttggatgaatcctgtatgcatcccatgcctaactgataccaggaaaaagatgttggctaaccgatgactcagctcctctcacgcgagcacacacacgagaatgaaacgcaaacaagattaatttcttacaaaagaatctgtgctttttaggatgaagcatgtaaaagtttataagaacttggttttagaaaactctacaccatcatcggacaattcggagagcattttcaaacatggattcaattcgtggtgctcattcaaatagacaaggagaaatacttgcctcaaaatcgatttacacgtagatccctttcttcttattactccttccgtcctaaaataaatcaacttctagatttcaaatttgtcccaaaataaacaacttctaccttcttacctgccaccaatccgcaaaacgagaaattttattacttcaatacccctcacctatccattattcaatacaacattcacgttaattaagagtattgtggtcttttatttctctccttaaaagctccttgggaagctaaggtttgatttatgtagggatagagggagtacttctgcctgattgctttatttattcatatctgtgtatgcacagaataatatttgagtaattttaccattgttaagaaggtactgagagttaccatattttctaatgtaaattttggtattaattttaatgtaaaacttatgtacctcaagatattttctcaagtactgtataacttctcataatattttacatgtccacaatataagatcatatcgtccactttttaccataaaaacacaatggattattagagggttccaaaggaagcagtcatacaaataggcacatcaggcacagtgggatgtcaattatacaaatttcacattgggctttatactaacacatctaaactactaagccggccggtttttactt

SEQ ID NO: 60068 - DNA, 13155 bp, Oryza sativa
atttttttctctttaacttgtgcagaaattggcaatgcagctctgcttctgtggccgcgctgagctgcgaggtgctgggtgcagcggcgctccagtccatggaggctagcgagacgcttgcgtccgatgccgccattgccgattgcttggcacgggcgctgcggcgtgggagccagcgagtggcagaggctgcctgtaatgctataatggatctctctgcttcttctgctggcagggagcatcttgcgggctctgctgttctgcagagcatattgtaagcatatttactgattgatctgattgttttttcaaattcaatatgtatttcggctttagtagcttgtgctatactgatatatactactaaatgtcaagaaccgcttgactcttatgttcacaagatcaacttaaccaatgtgcccatgtatagatcaatggcaagtctgcagttattatgataaacttcctctggtagcatgttaatatgttatgatgaagatggcttgatagtttataactagatgggaagcattgccaggccttttaaatatgatgaatatcttcgactggttgaattcacttcctgtagatatctattttctcaggtggaatttatttctggagtcattgatatcagaagcactgagtgctcaaaaagtgcttctaaagcaaataaatccttctacttgatggttgacacattggtattcatggtgaattcctgtcaagttgataccttgcataatctgcaacaggatgtagttagaaaagttctgcctttgttgcataaaatctggaagaatgttgataaactgggatcgtcaactgactgcatcaactcgaagaatcaacttcaaaggaaagaacatgagatatctgaagctatttttaggctttcaatgaatattgcctgtccagcccacctggaacctgatgaagtcagacgaagcatttttggacaatcggtatctgactatgaaaattttctcctaaactactgggagaagtcgacttacttggtcactaggaaacagaagaatctgcatgtggatagtgtattcacttcactgcttaatgaatttgatctgaaaacacctgatactatcatccagtcacttgtaaatgggattgtttcttgccccgctattgcttcagatgaacttgacattagttcatttctccgtgaggttcaaggttccttgggtgccactgtgaagtataggcaagatatcagagttgtaagaataaatgaccaatgtgatcagacctcaataggttatgcgatggaggaacatttctttgatgatgggatgaccttccaggatgcagatgcattcgttgaaaaatgtaaggatgcatttaaaaatggtttctcagttgccttgcgtggtatggagttccgttctgaaaagattgctgctatagcttctgctgtagctgatttattcggtcaaccttctgtgggagctaatatatatttctcccctccaagagctcagggcctggcccggcattatgatgatcactgtgtacttgtttggcaactgcttggatgcaagaaatggatgatttggcctgacacaaagttacttttgcctagactatatgaaccttttgaacctttagatgacttggtggatgattgtggtgggaggatggaaattttgcttgaaggagacataatgtatgttcctagaggctttgttcacgaggctcacactgatgttgatgttggtggatttgaagtgaactcaactgttgattgctcactccatttgacccttgctattgaggttgagccacccttcgagtaagtactcttcatatctatgtaaaattctcagtgttccatgtctagtgtttcagcatctcactattactgttgttgcaggtgggagggatttacgcatattgcccttcattgttggacggagaaacactggagctctccatttgttaagtcccaagaggaggcacgaacttcgttatttgctctcctgttgcatgtggcaatcaggctgctttcgaaaaatgatgcaaccttcaggaaggcatgcatggttgcagcaaagcttccaccatctagttcatgtacgacaactcactcgaaagctctcagaagcaaccaaagatcattttttgatgagataattaagaaaatcgacaggagctgcaacttcaaggaggcattgatgtgcattgggctcgcagtgagagagaaaaacgatgagcccttccaatggatgtgttggctccggcatctgccgcaacacggaggcacaaatgaccaagtcgatttctgcaacattttgggagcccttgaagagcttcttgaggcagtcagctgcaaccttgagcaatccttaactgaatttacagacttcaagttgaaattttgtaggtgcgtagcgtacgaagacgcgtgtgagagctttgaaatgttgcttcagatgtatagaacgactaggaatcagtacacgaggggaatgctagcattgcacaggaagcatgaaatttaacttctggagtttggagaattccctcctgacagataaagttcagtgatcagctaggtgtatcatttctccctgactagaaaatctgtctggaaacatttgccccacctcaatcatccacaattctgattagattttaactcaactatcatggtcttttgtcttgtggtcttacagttctgattagttacaacttgagttcactattgtcatgatatgactaatgataaaaaatgaatcacttgctcatgctgcaaagctccacagaatctctctgctcaagtctcacactctcacatgaccacctgatctactgctacaaaactgcaagttgataagcaaacaaacacaatttgttgccaccgaccagatggaatccaatctatgacctctggaccccaaatcaacccgttggcgctgcacctgcaaagagatgacgtttctaaaccgctaatctcctcccccaattattgcaccatctgagggtcagtcataacctcagtgacagtcttgtattttctgaatttctggctgcatccccccccccccccccccaagattataaataacaaacaaatactaaatgtacaatttgcaggtcaatgaacgctgcacataaacaacaataaatgggtcgctgctgcgatcggaggtagacgtgacaaggagagccgcatcttccatatccaggagaagagaaaagatttgataaatcgaagaagaaaaaattttggggaaaattttatcctggggacgcttggattgtgtgctggttgcctccgatggtcgcaagggccagaaatctcgtccacccaaaccgcggggagccctatcccctcagcaaaagccaagatgctgctgttcccgcccgccactaaaaatatttatgcacctcctcgcattaaaaattccatcgacgtcgcctcctctcctcctcctcctcgtcgctgcattccggtgagtccgtgcaatgcctgcattttgtgttttcgtgctcggtttcgtctcgtttttgctgatgacaatgttgtttgtttgatgcaggttgagtgagttggtgattatctgtagggggtgaaaatggcgcaggcggtggtgccggcgatgcagtgccaggtcggggccgtgcgggcgaggccggcggcggctgcggcggcgacgggggggagggtgtggggagtcaggaggaccgggcgcggcacgtcggggttcagggtgatggccgtgagcacggagaccaccggggtggtgacgcggatggagcagctgctcaacatggacaccacccccttcaccgacaagatcatcgccgagtacatctggtactgcaaatgctgcatctcacagtgacgcttctgttcttggtttgacccacacaacagtagcagtagcagcagtttcagactttcagatttcagataagccaaatccgcactttttactagcaccaatttagtactactgctacagtttgtaggttttgcactgcaccgttcgattagggaattggatggttgagatatgaatcataggattagctgtgagcaaacattagtagagtacaagttttgccttaaaatagataaaagtttctcaagcatggtggtggctggtggtgactcacactagctgcttttcagttcccacacttgaataataatacttcaggagtgcgaatccccgatgcgttttcctggtgaaagcagcaatatattaacgaatctgcaatcctttttgccacattctgcagggttggaggaactggaattgacctcagaagcaaatcaagggtatgcacttggtatcatcattatcacaaatgttcttgttcttggataaagataccagtgctgtctttaggaagagaagttgcgtttttaggggattagcagtgtacacagcgcctcctttcgttatttactttctacctctttggcccttgaaagaaaaatcgaatgcctgtatttcagacaatatcaaaaccagtggaggacccctcggagctaccaaaatggaactacgatggatcaagcacagggcaagctccaggagaagatagtgaagtcatcttatagtaagaaaaaatattgcagtacatgtgattcttcagtaaagcattctagatttctaattctgtctcttctcttgcgctgtcccccctgatttcagcccacaggctatattcaaggacccatttcgaggtggcaacaacatattggtaccatcccttctccttaatgttttatccttttcaaatgtgcttttcatactaacctgcacataaaagattagctgtgcaatggttagtggcgcatgtgaaaaatcgcatgctagctgatacaaaatctgttgtttcaggttatgtgtgatacctacacaccagctggggaacccatccctactaacaaacgtaacagggctgcacaagtattcagtgatccaaaggttgtcagccaagtgccatggtaactaaacatcaagcacttttgtgctataaattacaatagaaaacatggtttttccatctacttttgtttacatgtgaagttgagacattttctatgcactatttttctaggtttggaatagaacaggagtacactttgctccagagagacgtaaactggcctcttggctggcccgttggaggctaccctgggccccaggtattatactgaacaagaatggagctttgttgatcagataataataaagataaggatggtttaagtccatgtgttgtgtatgcttaataaaacactatcatgctggatattacagggtccatactactgcgctgtaggatcggacaaatcgtttggccgtgacatatcagatgctcactacaaggcatgtctttatgctggaattaacattagtggaacaaatggagaggtcatgcctggtcaggtatgtgtgttgttatttgtcaattagttttctgaatcagtggatatgttttaacttctatgaagaacaaatcctagtgtttaacaagtgaaacttcacaatccttattcatgcagtgggagtaccaggttggacctagtgtcggtattgaagctggagaccacatatggatttcaagatatattcttgaggtatttcaaataataataaaatatttccctacataatgaaattttggttcaaataataataataaaatatttccctacataatgaaattttggttttctctcttaattttcaaaccatggtttaaaaatcaagctgcatgcatattattgccaagacgtttacatgtgcacattttgtgatccaccttgacattcttacaaatcgcttgttgaaagccatcatctttgttttgttcaaaacatcagaatgttgcatcctatgaatggctatacttttgcttatatcaatttctgcatcagtaaaagcacttctaattatcgtttgctcactgtaatcagagaataacggagcaggctggtgtagtgcttacccttgaccccaaaccaattcaggtatgtcctagtaaattgtccccaactttaaagccaatcaaacgttaaaggagactgaacatatataatgtactgacagggagactggaatggagctgggtgccacacaaactacaggtttcattatcttcttctgatgttaaagtatcctgcagcataagaacaaagcttagaacacttaacacagctttgctgacatttttcctttgagagaacaactttgttgaccgaactaatgcctattcagagacaaaaataaattccttgggaatttgataggaaagaaaacatatgtgtaagacctaaaataccaatccaaatacggaccgaatatcaagtgttcgtaggtgttaaatctattatatctataaagtaatagaaaaagaagcctccacgtttgctctcacggtctagaaaatcccccgttaatcgaaagaaaataagaaaaaaagaaaaatagaagggtattaggattaggttttgtgttaacggaaaaaaaaacaaagagtaaacggacaaaaaaagttggaaacggaaaaaaaaagttggaaacggacaaaaaaaaatccaatcggacaagaaagagagaaaaaagtgaaaagggacaaaaaaaaagaaattccaatgttaatcaagaaaaagagaaaaaaaataaccattgggtcatagtagatccagattataacagtttagatttaatatagggtgtgtttggattccaattttttttctaaaaacatcacatcaaatgtttggacacatgtatggagcaataaatgtgaacgaaaaaaaaaccaattgcacagtttgcatgcaaattgcgagacgaatcttttgagcctaattacgccatgattttacaatatgatgctacagtaaacatttgctaataacagattaattaggcttaataaattcgtctcgtagtttcctggcagcatctgtaatttgttttattattggactacgtttaattccttcaaatgtgtgttcatatacttcaaaatttttacacctaaacaactaaacacggccataatagttatataactaatataaatctttttttacggaagcttaaagtaactataggaatcgaagtaaaaaaagcttgagatggaaatgaccaaacaaaccacatgcacaagaaaaaaggaaaaatagaagggtattaggattaggttttgtgtaaatggacaaaaaaacaaagattgggtgtggtgtaaacagacaaaaaaaaagttggaaacggacaaaaaagaaaaaatagaaacgggcaagaaagatagaaaaagtgaaaacagacaagaaaaatagaaattccaatgttaatcaagaaaaagagaaaaaaaataaccattgagtcatagtagatccagattataacagtttagatttaatatagggtgtgtttagattccaaaaaattttggcgaaaaacgttacatcaaatgtttggacacatgtatggagcattatatatggacgaaaaaaaccaattgcacagtttgcatgtcaattgcgagacgaatcttttgagcctaattatgccatgatttgataatgtgatgctatagtaaacatttgctaatgacagattaataaggcttaataaattcgtctcgcagtttacaggcggattcagtaatttgttttgttattagtctacgtttagtacttcaaatgtgtgtccgtatacttcaaaatttttacacctaaacaactaaacacggccataatggttatacaactaatataaatcttttttttacggaagcttaaagtaactataggaatcggagtaaaaaaaacttgagatggaaacgatcaaacaaaccacatgcacaaagtttatttctaatttaaccaattggattaagaactaatgcattaacttatttaagtaataagggcatgtttagatccgctgacaagttatttcactctgtcacatcgaacgttttaacacctgtatgaagtatattatgaagtattaaatataggcgaaaaaataactaattgcacagattgcgactaatttgcgagacgaatcttttaagcctaattgctacatgatttgacaatgtggtgctagagtaaacatttgctaatgacggattatttaggcttaataaattcgtctcgcattttacaggcggattctgtaatttgttttgttattagactacgtttaatacttcaaatgtatgtcagtatatccgatgtgacatggcaaaaattttcacccctggatctaaacacagcctaagaaaattggactccgcgtttgctctcatggcctagaaattctcatattaatcgaagtccatatagaaaaacaatttacatagataattaaaaaataatgaatattggaagagaaggctagagttcatactggtgtacaatttataactaattgaaatacggaatcagagaaaaataataatagagtccatatagaaatacaattttaaatagcttaaattcgaaattaaaaaaaggaatattgaaagaaaaaactccatatcagtatacaatttagaactaactaaactttggaattaaaaaaagaaaatataagtagaagtttgagtctatattgaaatacaatttataaccttaatttataaaaataaaaaataaaaaatattgaaataagagtttacaatctatataaaaatacaatttagaaaaaaaaatgaaaatttggaatagaaataaggaatattggtagctagccgcgcagtttgcgcgggccaccatactagttgttattgaatacaaatccagaataagcctgtattcacttcgattgactgaatgaatgttctttgtttctcaaacaattgaaatatactgattgtcttgcaaatgtagcaccaagagtatgcgtgaagatggaggatttgaggtgatcaagaaggcaatcctaaacctatcacttcgccatgacttgcatataagtgcatatggtgaaggaaatgaaaggaggttgacaggtttacacgagacagctagcattgacaatttctcatgggtatggtttcagcggcctttttatatctttatgttttaatttctatttttaagctatactaacgaaacatttcattaaagggtgtggcaaaccgtggatgctctattcgggtggggcgagacaccgaggcgaagggaaaaggtatatgttcttccatgtcccctgaaattgttgtgtttgggattcagaaaacactaacatccactggtatattaagcaaccaattgagccctccaaaaccagagtaacatagtttttatagcaaataagcacatcatgtagtaactgcccctattgctcatttgtacttccgtaattcaatacttcgttgttacgctccaaatatttcaggtttgagttgaaaatacaaacatttttttttctgaaactatgaaagaacacaacatcagcaaatgcatgtcttgtaatgttgttttcacaattcacaaatgtgcaacttagtatttgcatttttcaactcaatcttattaacttgcccttacaatgctaaatctccttgctgataggctacttggaagaccgtcgcccggcatcaaacatggacccgtacgtcgtgacagcgctattggctgaaaccacaattctttgggagccaaccctcgaagcggaggttcttgctgctaagaagttggccctgaaggtatgaagaacttggacgatgaatcggggcaaataaatcccagcaaaatttgtttgctgcccaccagtcttgatcttgtatttcttctgtctggggattggtctgtacaaatctgcagtttctagaaaaccacgccaccttccattcgccagttaacattttggttgaacaccacacttgatctgggtctgtattttgagtccatttgtgagtgacagaacggatgatgaaacacatcagggacacttttaagtttcttcagtcctgcgtccttccctcgaaataaaaatgtttccttgttttttatcccgggctaaacctgtagttgcgatgaaaacgtcactattggagacttggagaatataatttgacagttgacactcgaccatcatggactggtgttagttctcagctgtggtcagggttcacctttctgatcgagtgcctgacctgaatccgtagcggaatgacatttttcaccaaatttcgatcaaattttggttgaattttactgtttcaaatttgaattctagaaaaccattcgaaatttcactcataatcttctttcatctaggggtgcaagtgggtcacccacgaacccatttataggtcaaaataagtgagttcgcgggttagtttagcctataaataggttttcgcgggtagccacttgcacccttagtttcatccctcgtcaaaacatctaaattttgcggtttttggttggttttcgtcgaaaacttaaaccctggctgtgtcatctctgcagctagctaacagcaatgcatgaacagagcaatggcaacacatacagaagaagcagcagcagaacatcgatcgatctcttgcgaagaagggtacatgtaatttcatgacgaaattaacagtccaagagagtacttagtactagtagtactcctactaactaagctagacaagaagattatacacggacaaacagagaagctgacagcctatggtttctttgggtgcttgcgtttgggtggagacggagagtgcatcgccaccccgctgtaatcagcgctgtcgatcagcccttctcttgcgccctcatcatcatccacccaacctgccttcgtctctgcagtctccttcgtcgtcgcctccatagccactacctggacatggacacaccatgagcttgacaattatttcttgtttttcatctgcatttctagctgaagatggtagtgcacaatgtgctattcactgacattaaaaaaagattatgcagcagaggcaggcacaagaaaacacataaaaattcagttttgcattttatgaacatatgaataatgaactcacctcatgttgctccttgtgcttgccttcatgccggtattggtgtcctgacaagccttctcctatcagttctctgcctctgcgaccaagaactcgagccacttgatcttgctgcctgctcagtgaagaagcagcagcagaagagacatctgcaagatttgctaggacgagtactcctgagacaaacactaagcagagtagcttctgatcaataaccatggttgtgctgatgactggtgacaactaactactggaaatggagatggagagaagatgaactgatgaagcgaatgctccctctacatgtctcctcgaggtttatatataaattggcgaaggttgcagcgacagaaatgggccatggtgtctgcactctaacatatttgcaaaccaggccccatcctgaataatactacttgcaaggaggttagttcacaaaaggctaagctagccattagcatgattgagatccatactccattatgcaaaacatgccgagacatagggcactattgccataatcatgtgtagtttgtggaccataaacgtcacatgcatgtgagtgagcagatgtttggagtgtacagtagttgtgcttattaggtaggggcagaggggacagcaacatttggctacttgctgtaggcttctttgttactaattttttgctcattagatccctgctaaatctgacaaaggtgaaggtcatgaggacccaacacccaagaaaacacccaaaattctgactattgaccaatgctgtctgctctaacagcatgatctgatgacccatgctagctagctgctcaaacttttcttctcatcacggcatcacgcatggtgatggtgtctgaatgttggcttatctcctccatcctagctgcatggacagcatggtgtcgtcagatagtaggagcttgatttgatgttgtctgtcagtgagtgttgcagtgctaattttgttagtaatcgtagacttctagcattgatagagatgagcatatacaggctgatccttgatgatggcagtttattacatatgatccatgaacatgtaactagtgctatatgagacaacaagttagtatatatgcatcacaagaaatggtcctgagaggctgaaatctgagctaacatgaagcagggcaggtgagtgatggcccatggctacaaggatttggtgcgtgcctaaatgcagagagaaggcaattccaaaatggtgtatctttcgatggacacatatgtaggctggaggaatgcaaggttggcagcatgtattggcatgtcattagctttgtattataaagctgatgcatctcattaatgcctggattatactgattagagtatggcatgaggtatgcagtatggggggctcgagacagggaggtcaagctcaggtagggcttcttttatcagaccccagccttgtctctttgctggtcacggagctggccatctctctggattatgtgtatttatgtatggacatgtcaactaaaatagtcgtcagcagccaacagcgttactgttgattgtccgtttggtcatcactaatccatttcctggctgcttcccttgtgctttagaatagagtattaagcgagaaactaaactaaactaagaaatcgaacgaattgtttggtgttgattgacgccagtgttgattgattcgcaacggcctcgcgcatgtaagtaggacgaggggggtttactcgaacggtagtcgcatagtacatggagagttgttcggtgtgagacgagcacgtacgcacgctgtcatgggtggatgggagcacgcacggttgccgttgcagttgcaggcgtgcagcgggaattttttttatttttaattttttttattaaaagttttacaaaaataattttctattttgaaaattgacggaagtagtcgcctaccgccctttgggaaggcgatttttaaaaatcgccctcccagagggcggcgaaaatgacgtggcagacggccgttcgctctcgggcgacggccgtcaacgaaatttgcaggcggcccccttgccgccctccgcgagggcgattttgtactgtgcggggggccgcctgcaaatgggcggcgagggggggcatggaattttgcag

SEQ ID NO: 60069 - DNA, 17383 bp, Oryza sativa
ctagttctagcaacaaacgcaggatgtaatcgattcatgatgcctcctaaacctagctaaaacctgacaaaagcgaaattaagttcattatggtttcagattgaaggggagagggaagttacagaagcagcaagaggcagggtggtggggaagggttttatattgagatgtggtagctggatgaagggtttttttttttaatgtgtgtgtatatatatatccatgcgtgcatggtaggctctcgattggtgttgtcaaatttgccgaaggagaatgaattttaggaattgagatttgaagtattcaagagacaagtgggaaaagaaccaagggaggtaaattgggggcctacatgtgtcatgtaaccggaaaaattcgaaaatatacatttttctaatcgtttttacagaatatatgtgtttatagagagaagtgccaaaaatataccatcgttgcagttaactgctctacgagttcgcttggctgctcagtgaacgggctgggcgcagcagcaagttcgcttgactgcccatcgaactggctggctaatggctaatgacaccgttaaataccatgattacttgttaattactttataatgatattagttaaaagaaacttggaaggaaacctgtgcggatgcacgggcacctcacttattatttatgaaaaaatgctaaaagaaatcatatctcagtacaaattatttaaataaatagaaaaaatatctatgttgtaaaatatacgtagacttaaatatagtaaatattactttgtcttgattatgaatggcaccaaggctttctttcatgctgcctctaaacatggatctcccattgatgtagatctactccttaaaaccagcatgaaccataatttcatattgtctaattcactatcggcatcctcatacataattgcatcgttaagtaggaagttgagttttatcgccaatcgatttaactatatgtatgttcttaccatacttataaaaatatagtaagctctgttatccatgctcgaggccctttagaaaagaacaaagagaaaacgaagatgatgacaatatttttttaatgttatgagttgttttgcagaatagcgtagacgtaatttatttatggtgttaatttatcaataatacttaagtttttattttttaaaatactatacaaacgcatgtgctcataatgccaacccacttacctccctatgtatgcgcaaccacatatcctattcttataatcacctccgaaagattagatcagcatatcttaaaattggtgaagtcagcaccaaagcaagtattcataatgcgcacacatataccttaccctatgagcaccttcaaaagattggaccgatatatcttaagattgatggacctagtcatttgtttacttaccgggtgaattgcagggaaaatatgaaagacatttgttgctgaaaaatcctgtgcgtgtgtgcaggtgcgtttcctttgtgtccattccggccgtgaactcttgagttcgtgcttcgattcagccgtgagtgttcattctcagttgacgcctattggtggccactaaaaactccaattcgagtacaaaaattttaataaaataaatggagataacatgttaccttatcgttgtttctttacactaatgggattctatgagttttgttggtctaacaggttttgcaagtttaggtcataaaatgtaaacatgtcgggatatttgggcttattcccaattgaattttgaaggagcaccaaaactacctataagatatgaaaccaaatcacatatttgagtataccacattgaagtcaacacgacgatagaacagatatatggtttgtctgatttggaatctggacgaaggagatacgataaccagaaaaacaagccatcttgccaagctgagggtggagagtatggggtcaattggaaggaagagaagtcacatggcaacccagattaggaagaaaaacttaactctaaattttcttctcaccttacctctatctctatcgtattttcaaaactaggaagttgattaggtgacgatacttaagaaactaccgattgaaagcaacagtgctatccatggccgccaacgtcgtcaacaaaaatctcatccatctaccaacggtaagttgacatgggaattaaggatatgcattgcggattattgagaaagcagttcacaattaattcataatgccatcaatatgcctgtaccggacagggccatcattgatgtcagtgtcgccgccagactgcggcgtgatctgttccccgaaagatctggtaggagtagccgacggtgatccggggggcgaggaatgagcaggtgtgctcggtagtgatggtgacgcctccagtgagcttgccagggaagaatttcccctttccaccaccaccggttccttgcatggacatctgccgggtgatggtgcttggtaccgcggtacgaagcctaccacagatgtcgtcgagccagctggttgctcgacggtctcctccacatcaaattcagcagagacctactcgcctgtagctctataccatggtcaaacaacattttcttcaaatatgacaccatgacttacatggatgcgacctcgacgaggatcaaatagtcgatgcaccttgctcccttcttccacgcccaagtacacatacggtgcacttcggtcgtccagcttctcgaggtgtggtactgtgttcttcgcgtgtgcagtacacccgaacacacgcaaatgcgcccgcaaatgcgccaagtgcggcttcttaaccatccacgcttcatacggagtgcgatttcccatcgccttggttggcggccagttgagaattgaaggtacactgtgtggcgcactgcctccccccaaagccagcctgacacgctcctccccttcaacagtgagcgcgccatcaccatcattgacctgttgcggcgctcgccaccccgttctgctgcggcgagtacggcactgtcaaatgccgctggataccagccgattcacactgttgtgcaaactcgccggacaggaactcgccaccgtgatccgatctcagcgtctttatgcgccgcccaaccacgttctcagccaggggtttgaacttggtgaaggtttccaaagcttggcccttggatttaatcacaaacacccacatccaccatgtaaagtcatcaacaatcaaaacaaagtatcggttaccagtcattctcgccggtgagatccacccgcataggtggagcaacgactcgcattctcgccggtgagatccacccgcataggtggagcaacgactcgcggcttaacgctccaaaagaaaacttctggatttttcttgaaattttccggcaagttgaaaccagtcatgtactaccctgtttccataagaaaagtgaaaacaaccaaggttagcctgcaaatgacagtgattatatagaggtaaatataaagtattagtcatggtaatctctgttataaatcctccccggcaacggcgccagaaatgttgttggtatttcttaacgacgttactagaaatataattcccagcaatagcgcagaaatacttctggtatattatggttacagagttcatccgcaagcgcacggatataccattgtagcatttcacccgagagtattccaagggtatcgtatttgtttaatcccgtgggaagattataatagagataccatactaataatttatatattaattgtaataatcaaagtctaagcatgagttaatataatccaaagggtagagtgacactaagcacaagcattcatactcttactcataattatctaagctaagtggaaagaacatagaaagatcatattcctatacttctagtatacatacatattatacatacatcctagccatattattacttagctaataacctctttctgataacctactggtgcttcgagaagccaaccctgattgccaagttccttacgacaatccgtcatgaccatccaatcagggctaaatacggaggactaccctccccaggaaattaacttaggactatatacacgcgcggaggaatacatgtactgagctgtcaccatcagcggcccacctcgcttctacaacatataaccccaaataatgatatccagtaatctaaacaccatgcttaaattaccaaatactattctaatatcatcgtcatgacatagagtcatcgtaaatatgatcattatactcacaccattgtatctcccagataagctagcatcataatgaatataacttgaacatatagtaaagtagatattcatatactcgaaaagtaatacaataccaaagtagtataaagaagaatattctaaataaaatataagtcttacaaaagaagaaaaagctactagagtccccgcaaaaaaaaaagctactagaggcatacccaaattcttccgaagactccgaggactgaagattctattatatttctattccgctatactccagggactatactaaatttgagagatgaaatgatcttcttgtttgaggtgtgtcttgaaatggagagagagtgagccttttacagacaggtagtgatggttatggcggttggaaaggttggtaatacccttcaatcgctatagggaagccatccacaccatccatcaccaaccctggatcgagcggcgctgaggagggttcgaccgaaccatgggtcggcccaaccagcccaggttttggctggtggcctcctcttttgctcccatgtgcagacttgtgaattttggcccaattggtcatgtcatttctgcatttttggcccattcgttgataagtctgattcttgacatcgtccgattgaacgatcgcttgttttgatgttgattctcgtccattttttggtcattctatgcaagaggttagtaatcctagtgctagaggactatttattattaaacataaatatgcattgcaagtataactagttctcatttattttagtaatattgacggtcaaaactgatcgctaacgaccgtcaataaaaccggatctgctgccgccggaactatggacatggtgtcagatcagccctcagcccgagtgctctgataccacttgttggcgacaaacctcggatcaaacactttgtgtgcacactgcagcaatccgacacggcaacagacgagaacatagaatgcagaaagggatcttcagaggaagaacagtgaagtttcagagaacaatcgatgtactggaaattgtggggttgattttctgtggtttttattcaactgaatagagtaacatacaactcaaataacatgactagaatccaaggctcaaatcgcgccatcccacgataccacttttcgaattcaatgactcacacatccgcgctaaactcacgcacgcgaaccctactgacacagtctgcttaaggacttgatcgccgcatcatctgcatctgctaacaaactccagcagacttattccttcaacctttgcaactgctaacttctggaacacgtaggagccacagctgaactaacaaactcaacaacgtgtgactatattcatcgcagcttgttagcaacggccaccggcaccgacgccggcgacctagccgatgtagtacatggggtcaggcagcttgaaggtgcgagcgccctccggtgcacccaagatgtcactccactggtctccgatgttaccgacgatgatgaagccggcgtcctgcagcttctgacgctcgccggacttgtacgccacagccgataactggagcccgccggcgacatgagctgccggcttcaacagcagcttctcccatccagtgtagccctgccggcggaggttcgcgacggtgatggccctctggtcctcggtgcggcctgtcaggaacactggcttgacaccgagctccagcagccgccggtacaggcgcctcgtctccggcagcgccggcgcgctcccctctgccacatactcacgaaagctcgtgtcgttgtacggcgtagctctgccaagggattagtaaagataattataattaattaatttcttcatatgcataaacgtatgcatcgttgcatgcaaggcaaagttaattattcgaataaaacagaagctttcaatggaactgtcgaactcatggtacaggaccgaattcacgaataaataaagttgcaagtttgctggaaactgtacaaacttaatcattagtaaaaagaatttatagcatatgagcgtgcagtgcgtccatagctccatacttgtctaggattaaattttcgatatgatatatatagcatgcagacaaaaatgtatctgtcaagttatcttgtcttcactgttcatatgcatacatgcatcatgcatggtcccagggctatacataagatcccgatgctaaatataaaattaggttgtacattgaagaatttccaagatcaaactttttaattctgtttacttatggaattgcaacatatatattttgtaataatactaagaattgcaaaggatattcctgatacaagtgtaaaagatatgctctcttcacgaaattaaataaaggatgttatacgggaaagcgtaacatgtccttgttcaaacaaaagaaagagcaaaaaaaccttgttcgatctgcttgagccttgatgcaatgttgttggaaagttgtaatatctaaagatttcttctatttactgacaacataggccggccgatttcaactttttccatgtagttcatgaattttgattcacgttcaatagtagttcatcctagtttaacactgtcatcagcaagatatatatccttgttgttcatataatattccatatactttgtcagcaagttgaggggtaaatatattacaagattattaaagtcccaacttcaattaatgaagagtatatatacctactgaaattaaatacgttcaaaatactaattccgttttttatttgacaatgttgaattattatataacttttcaaatagaatgaagtgcacgggcggttcttaaacttgtacagatgtgtcatctagatgactagatttctaacatctcaaaaatgcatttttgggtccccaaactcgtcatgtgtcatatagatctaaatggactccaacccgctccgtgagatgacgtggtataccacggtgatactttcgtgtcagtgggatccacatgcatgctagtcatgtagaaaaaaataaaatttaaaaggagatgagaaaataatgttttcaattttgaaaaaataaatgaaaaaagaaaggggaaaaatatttcctttttttttaatatgtggcggacatatatatgagttctattgacacgtaggtgccaacatggctgccacgtcagcacacggggcgggttggaacccgtttggatctatatgacacacgagacaagttaaagggctaaaaagttcattttgagagtttagtgacctagtttagtgatctagttgatacacccatacaagtttagagaccgcccgtgcactttactttttaaatagtaagaccaataatcaaactgtgtctatgtatatacatatatacgggatgccgggccccacgcggcagccgcacggtgcgcccgaaggcggccacgccggcgcagcggcgggaggcggccccccccccccctttgggcccccggcggcggccttaggcccggcggaccggcggccgaaaaaggggaagggaagggggaaaagaagcggcggtccacggctcaccccgggtcgacggcgacgacggaaacggcgaccggagcggaggaaggcggcggcgcggctcgggtggacggggtcgacggtgctccggcggtcggcgagcgaaacggaggggtggacgaggtcgtcggggatgcggtgaagccgaaggtggcgacgccgaggcgggaggtggtccggggcgacgacagcggcggaccggagctcggcggtgacggcggagagagagagcgacggcgcgagctcgattccgacggggagagagggcggcgagtggcggaaacggtggagggtggcacggggaaggtttatataggattgggagggggagggagctgccggacgagggggaaacgggcgcggaagatccggtcgccattgatggcgccggcgaggttaggggagaggtttccaaacgaatgcgagggagagagggagggaaaaatggggggaaagagggagggaatcacggggaatatttccccccactttattgcgcgcgtggacggcgggaggcggcgggattcgcggtggcggcggcgctagggcacgggcgaggcggcgggagcggcgggaggaaggggatgacgggtgggccccacccgtcagtgagggtggcgggcgggcccgcccgtcagcggcacgcgcgcggggaggaggccgaatttgccgcgggggagaggagagagagggagagagatgggcgagccggcccaagagggggagggggggaaaaggactttttagggtttttctttttataaaacctttttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacacggattttaattattctaggcataatttcggggatgtattttagagtcgttttgggacgcgacaagggcgctctccccggtcgcgggaccatggagagggaaccaggaggtactgaacctgaacctgtcctaggtcacatggttgcggtggaggattatattctctgtggttttctccccccgccttctgagtttctacagtctttctttcctccatttgaaccccaattccatcaccttcctcaatatcttttcgcatctttgtgaggcctacattggggtagagccatttctcgacctttttcgcttctactacaagctgcgttggatggaatccaccagggtatctggatgcgtcggtttccgactccgggatggcctaaagtcgcgctatatccccttccaatgcccttcttctcgcagcaagtggcaggcgaggtggttctatcttcaggtagaggattcagatccaatctttgttgttcctgaggaacaaccagacaagattccgtcttggactgccaaacccgccttgaccccttctcttcagttcttcatcaatcccatcgatgacctccgagtacgaggtttgtcgaggtatgaagtcgctgccgacttcattggtaggcggatccagccgctccaggctcgagcccacccagcctttgactattctgggccggaggacgcgacccgagtttctcctcgggtatttttctttgtgtttaatttgacttccttatgtgcatgttcctcctgacttaccgaattctggttctgtctacaggtttgaacagcgagaccatggagcgttgcgtcggacaattgatgatcagtggcccgacaacggtgagtaacgtccccatccccctttgcgagaaggggaaggctgagcatgaagccgcaattaacgtgagtgtatttgacgaccccctttatttttgctcctagatcgcataatgacttcacgcggtgcaggctctccctctgaccgacgtcattggaccgctcttggaccaccaggcggcggcctcgttgaaggagggcgtcgcccaagaggcgtccgacgcggccattgctgctgctgccacgactagtggcagccgtgtcccgaggaaggggaggaaattcacctccgtgctcggcagccgccggaaagcgtcctcccatcggtaagtctcttgagttgttaactacgtagtcggaagatgtccccctcacgtcgtactcggtttacttaggccttggatgcgtctccgccacctccacgacggcagaatctggtgacacttggcgagaagtaagtggacaaaatttgaggtccttcccttggttgaattctggcgacttgtcttgagggccagacatgttaatcttctgtaggtcggcgcgggcgaaggcggtgcaagacgggtccggagggaactccagcacgtctcctgcgatggcctcgaccgatgtcgtggtcgtgcccaggagccgtgaggtgacgcccaacggcccagccagtgatctcgtgcctgctcgaggcctgcctgctgacgtcctcacctggggggagctccaagtcgagatggggcacatccttgaggttggtgctcatggcataagtcgcgagattgcggaggcgaggacggcagcagcgtcgtcggcaaatgagcgtgccgataagctggcgcgtgacctggcggaggttcgtgaggacctccagaaaatgagggaactagtggccggcaacgagtgacaacggtggggactcgagaacccgatgtcggaactcgagaatgtcacgtccggaaataacccaacgggcgttccttacgtgtgtgtattattccttgtcccaggaggcaaggtacacccaaaagttgatacaattcagagtttaacaagcggaagcgtatatagataatttattacatgggcggcgaaggcccagcacacaagaagacaaacgaaaaacagcagaagactagggcgacgaccacaggcgcttgacggcaggcaccagctagacaccaaagccttcatcttccgggaactcctcttctgggtttgggaaaaattgagcaagactgagtacaaccaccgtactcaacaagacacacccacaagtgcagaataaatgcaagggagtacaagggagttataacataggggttaagttttgcagtaaacagcatttaaaagtcacttagttgccaaaacctattttatgaagacgatcctagagctatacaagattattaatcaaggccgtgaacccacacaaacctgccttaacccaaggcctacgatgattcaaaccgaactggcaacccgaccctgggtcccagctcgtcccaagccaacccaggccaaccattccacattttagttgttaagcaggttttaagaattaaaacactaacttgggtacattgctaggcttgcccataaccgagggcgcggctatttgaataggttttactctgatcagaggtgtacatctttacccacaagacatgtcttcctcacgtgtaaccacatgccacataccaccacggcatacagacggaagacatgacatagtttccaacccatcctagccatagacaagagtaccgacccaaccccacctacggcaggaacctccgggacaggtaggcaggactgagcccctagcagcaggacaccagccccgtgccatgacatctcgactaccgggccgcagctcgtgtagccttcatttgccctagagatgtccatcgacccccgacttcgtccatctgcatccgtgtacttttgtttataaccagactgagccacaaactaagccttacccactagacatgtggaagtacggtagtgctttgcaacagaggcccgaagaccggtccttatgtggccgaggtgctactatcaaaaccatgcaccccgagcccagcctaaaaccattttgagggttttgaatagagggggaggtgtgaatccaattccacaataatccaaccattccaatgtccatgtgatatgaatattcccaatccttggcgcgaagcgtcacagtacaacatgaagtccttgcgagtatccggtaagattaaaaccggcgaggaaaccagcctttccttgagagtttggaatgccttctcgcattgcgggctccacacaaatttctcttctttcttcaacaactgtgtcatgggtcgagcgattttggagaagttctcgatgaacctccggtagtatcctgccaaacccaaaaaactgcgaatttgagtgactgtcttaggttgcttccaatcagtgacggcggtcactgtttcggggtccacagcaactcctttagcagatatcacgtgccctaagaatttgacttcggacaaccagaactcacacttgctaagtttggcatacaattgatgttcccgcaactttcccaacaccagacggagatggtgctgatggtcttcctctgattgtgagtacaccagaatgtcgtcaatgaaaaccacaacaaacatatccaagtattccatgaacactttgttcattaagttcatgaagaaggcaggagcattggttaaaccgaacgacatcaccgtgaattcatatagtccgtatcgcgaggtgaatgcggtcttcgggatatcttcttcacggatgcgcaactggtgatatccggaacgaagatcaatcttggagaataccgtggcacctttaagctgatcgaacagatcatcgatccggggaagagggtacttgtttttgatagtaacttcattgagagctctgtaatcaacgcacatcctcttcgtcttgtctttcttctccacaaaaatcacaggagcaccccagggggaagtactcggccgtatataccccttttctttcaactcttccaactgtttcttgacttcggccagttcatttgctgccatacggtagggtcgcttgtacagaggagtggttcctagagcaagatctatccggaactcaatctctcgcttgggcggcataccgggtagttcttccggaaacacgtctccgaactctctgatgatggggatttccgacagtcttatctgatgaagttctgaactaccgacagaggttgggggtgcaaagaaaacaaccggttgttccggccctcggtacagagtgacagtgcgtcttgcacaatccactactccttggaattgagccaaccaattcatcccaaggatcacatccaagttcttggtgtctagaagaatcagatccgaggaaaaaggaattccctgaatttctataggaacggcagggctataatactttgctgtcataacccctccaggggtggtgatgagcagagggttcctaagcctttctacccccaactgatttctccccacgaatggcacaaatataaacaagtgggaagctccagagtcgaacaaaatggtagcagggatggaatgaatgaggaacgtaccaacgatgacgtctggagttgtcagcacgtcctcggccatcacgtggttcacacgaccccgtatgacatccttaccaccgtggttggagcggggaggcgcttggccttgctggcacctcggctttgggcatttatccgcaaagtgcccaggctcgaagcagttgaagcacagacactgctgaccttgaacgtccctgcggccttgaccaggctgcacggctggcgtaggaggacggggcgcacgagtcccttgctgactctgctgttgctgcggctgtgggacgcgcaccacgaattgaggtcggggcgcggagcgaggttgctgctgctgttgctgctgcgaggaggatctccctggatagggattggtgtagcggtgtagcggaccttttggttagccccctgttggttgcggaaattcgccaagcgacgcttgtgcgactccagttccttgtgcttggcttccaagcggatgctcttgtccaccagacgttggaaatccagatagtccccggagaccagacgcacggacagctcagggtccattcctgccaagaacttctcttgcttctcctcatcttcacgaacatcctccagggcgtaccgggccaggttgttaaactcatgcaaatactccatcacggagcggttgccttgcttcaactctcggaattcccttttcttaagggccatgactccggcgggcacatgggttctccggaaagcggcggtgaagcgggcccaagtaataggctgcccctctggctgcatagcctggaaatggtcccaccatagagatgcgggcccctgcagttggtgggcggcgaagatgacttactcctcatcgctacactgcacggtgtctaactttttccccacggcatgcaaccaatccaacgcgtccacggggttattggagctagagaaggtaggtggacggatgcggaggaactcggcgagtttagagtgttgtgggggtggtggtggagcattatgttgtggcggattttggatgtggtggaggaaagcagccatcatgttggcctgctaggcgaggatttgggtgaggatggagttggtgtctggtggtggtggtggaggcgggggaggaggtggaggtgggctgccatggttgttgtggttgctgccttcggggtgactgccttcaccggtagcagcacttctcctggttgtcaccatctgaaaaccccacacagaaccagcaaacagagagagctgacaattaaaactaaccacccacgactaccataattcttgaatttattactgctattaaattggttcattaaagttcaagttgcttaagcaaataaaataaagacaagctccgacacagttataccacacaccggcataaccatgccccatacgactctagcagaaaaacaaacgagaagaacacacacgcaagcctactaactgctcgtctactactgcgacgggccagggcggaaggtgagcagcagcacatcctccgtgctgccaacgccggaggctccatcctcctgaggaaccacgggcgcgggctcagcacgaggggtctcgacgaagcaggtccacgccagggactgacgaacaagctcgggcctggaggtactcttgcgggcggtgatcttcaggctgcggcagacgcggcgacgcttggggcgacagacctctccctgggcgatcttgagctgacgcagctgcgcgtccactgcgtctaggtccttcttcagctgcagattctcctgacgcagctccaggatcttcatgttgttctcgaccaacccacgacgcaccatctgatggaagtcgatatgggccgcgtcgtacgcctccaccatgcgcgccaggtgcatgatggtagcgtcatcctccgagctagcatcccggaaggtggcgtagtcgcgggctcctccgcggcaagggtggtagcggtagggcgagtgctgcaactcgttcgggtagcactggtggagagtgccgatggcgaggagtgcggcgttctggcaagcggcagagaaggaatctccacccacggtgactaccaacgaagtcctctcgggtgagccagtgaggatcactgcagtaatctcccaagcagcgtggggctctgcatcgtcaccctcctgctccgggagccgcttgccctggtagtccactccatgcggataccccaggacaacgcacatgccccgcagctccaaaacgaagccagtcaggtccagaccacgacggttgatgctgccggccatctacaaacaaaagagaaaagcaacattttaaagatcagattttgacgataaatgaagcagcaggacagagagagactaaaggattttcacaaataagaaaggatttttattttgaaaatattgctaaggcttgggatctacggctcgtcctagggtcaagggggctctgataccaacttgtcacgaccggaaataacccaacgggcgttccttacgtgcgtgcattattccttgtcccaggaggcaaggtacaccaaaagttgatacagttcagagtttaacaagcggaagcgtaaatagttaatttattacatggccggcgaaggcccagcacacacaaagacaaacgggaaacagcggaagactagggcgacgaccacaggcgcttgacggcaggcgcgagctagacaccaaagccttcatcatccaggggctcctcttctgggtttggcaaaaattgagcaagactgagtacaaccaccgtactcaacaagacacacccacaagtgcaggataaatgcaagggagtacaagggggttataatatagagggttagggtttgcagcaaacagcattaaaagacacttagttgctcaaagctattttgtaaatacgatcctagagctatacaagattattaaacaaggccgtgaacccacacgaacctgccttaacccaaggcctacgataattcagaccgaactagcaacccgaccctgggtcccagctcgtcccaagccaacccaggccaaccattccacattttagttgttaagcaggttttaagaattacaacactaacttgggtacattgctcggcttgcccataaccgagggcgcggctattcgaatagattatactctgatcagaggtgtacatctttacccacaagacacctcttcctcacgtgtaaccacgtgccatataccaccatggtatacggacggaagacatgacatagtttccaacccatcctagccatagacaagagtactgacccaaccccacctacggccgaaacctccgggacaggtaggcaggactaagcccctagcagcaggacaccggccctgtgccatgacatctcgactaccaggccgcagctcgtgtagccttcatttgccctagagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttgaggattttgaatagagggggaggtgtgcatccgattccacaataatccaacaattccatagtgtccaggtgataagagtattcccaaagtctagagttgtaaaccacctaatgttacctaattaaccagcgaagcatctaactaaaatcatactagtggtaccttgagtagagtgtccactagttggggttttgtttattctagggtgaacaaggaaataataacaataacaataataaggtcataacaaaggtacataggcatggctagataaaacagtgataacgcgggaatttaaataaagcgataatgcaaaaatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaagaaaaggcttttactctaataaactccatataacaagctggaacaaagcacaaaaatgggttcttgacttcttaaggaaaaattagagacttgaacggtccaattccgagttcaaatggccaagttatggtcatttgaagtttatatgctctttaaatgaatatttgcgaatttcttcatttaaattttaatttta

SEQ ID NO: 60070 - DNA, 16586 bp, Oryza sativa
  unsure (1)..(16586): unsure at all n locations
catacctcatctcaatgatcttttgtttggctctccaggcctttgcatagcttatggtgtacttgaatttgttctcgatgtgcctaataattgattttggttcaaagccaatgttaccaacaacactggtgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcatatcttgcaccctcaattacctcgttctccttatactcccagggtacatgatcaccctctgatataacaagtccagagaagtcctcatttgcccaatcagtggccattacatcaccttcctcatcggatgatgcgtcgtcgtccacttcctcattatccgaattttccctctccatttcatcaacaattataccgactctctccccctcatccgccatgcccatagcctgctcctcccttggttgattttcctcattttgcatcgatggtccaacaacatcccctgcattgataggaccctctacatcttcggtttgcattgaaacatttatatctttctcttgtaccgacacaaatataacgaggggtcatgaccgttcaaaagccatttccacataccgtctccaagcatcagtgctgtccatcggcattagttcccaaaaataaccttctgttgcacgactcactacaactgacactgacattgtgtagacttcttggtctattctaaatcctctcaacaaccaactataaattgactgaaatgttctctccgcaggcctatcgatgcccttagatgtcattacaaaatctaacagatcaacaccatctggaccaaatctaatatttccttcaccgtgaactatctgaaatgtgaccttacttgacattgtgcctgatgaaaacaataactgcgttaacctcgcatttctgtactacgccctaagttacattctctacaatattgttctctaaatttctaaaattacgttacattctccagatcaaactaaactacatcttacaattaacactactgtctatgtctcaattcatactattatattctatgctctggatctacacatatgtgctgtgtgctacagatgtgctaaaatatatggaactaaaactaaaacgcaacatatatactcaaacataacatattagtacaaatgcacaaaagatgtatgggagcatacctgtgatgaattgagcgaaccagcagggcttcgccgctccccttctgctgccctcccctctctctcttttgttttttttggatttttagtgaatataatgaaatttcacagaggagggactgggctttatagggggagaggcaaaaatcgccctcctccagggcggcaagggggccgcctgcaaaattccatgccccctcgccgcccatttgcaggcagccccccccacagtacaaaatcgccctaacggagggcggcaagggggccgcctgcaaaattccatgcccccctcgccgcccatttgcaggcggcccccccacagtacaaaatcgccctagctgagggcggcaagggggccgcctgcaaaattccatgccccccctcgccgccaatttgcagccggccccccgcacagtataaaatcgccctagcggagggcggcaagggggccgcctgcaaatttcgttgacggccgtcgcccgagagcgaacggccgtctgccacgtcattttcgccgccctctgagagggcgatttttaaaaatcgccctcccagagggcggtaggcgactccttccgtcaattntcaaaatgaaaattatttttgtacacttttaataagaanaattataaataaaanaattcccgtgcagcggcatgggatatttgattagtgggaatccttgggccgattccacgtacgtttccactcccagccttgcccatatatggtgggctttggggctttgcaccgagccgtttggtggtggatcatcggcggggcacagcgcgcgggtgggtggcgaatttcgcgtaccgcgccaaagcgtttgacgtctcgtttctgcacaacccacacgcgagtccaggacggacggcccagcggctcgcgcccaggacgaacgcacgcggtccaccagcgacgtgcttcctgccgtatgggcttcatgcgctgcacccggcccctctgtttctcgcatgcacagcacagtgcagcgtcgtcgttgtaaatgcaaagtcctgttcggcacggctgctcaagcttcatttttcttatagttgtaaccttttcatctaaaataaaagtaaaactggttagagagctctcacgaaataaatgagagaggtggagctggattcatactactctatagatctacttcaaccctaacttatagatctactccaaccccaaacttctaaaattaaatttaagggatagagctttaccaaatatgtccgtactaaaggagaacccagctcgtagggggtcacaggtgaaaggactggattccagccaagcgtacacataactgtatgtattctaggggattgtccaagcttttataaactggattttcttcgtttatgaatgaacagatgatctctgatggcccgggaaaagaaaatgcaaggctaacgagaaaagatatccgatggactgaacaaatgcaaggcctggccggcttcgtctctgtggtcaacggacaaacagtgcgtgaaaaagcagctagtgtccagagcgcagctgagcggctgacacgaaacagttatccgaatgcgggcctacacagtcacagatcgcgtcaattcaaggcttccagttccagcccatgaagggtgtacacacatctcgtaaaagggaaaaatatagtaaatgaagagttgaaatggctgcagtcctacactcctactagcatgaaagttgaattttgttcctcgagataatattctcttattttatgcacggtgtttaaaaatttataaaaaaataaaaaaaaatactatgatagatcaatactccctccattctataatataagacacaactatttttttttatgttccataatataatacatacatgcatacatacaattaattaggacatattcttcattaaattattgttttttttaaatccttcaccctcaagatctcaaatttattggatacatgcattatatttattaggttgattcaaactaggagatgataataattgtttcttgatctttgggttaagggtggttgtgccttatattttggaacggatggagtatatgatatatctttgtatgcaaatatgcaagatgaaattcgatttatacgatttgaaacaaaaacgatcatgaattacagtttcattcatagttaaatttattatttttgtttttttatgagtcaaatttaaatatgcaggtttgataaatgatatactccctccatctatttttgatagtcatatttctaaatctgaaaaatttatttttgataggcatatttcaatccaacagcctattctcttaatgactttcttggatttaacgcatgactctctattcttccacacatgattggttacatgggcattgagaaatgtaaatattaatgaatcgtttgtttacgaggaatgactagtaacatgtttaaatggatgataagtaaaattacttattattggtatgtgttgtcgattacatattgatcgatcttactaaattattttaaattttttaatgatttttgagtgacatgtaaaataagagaatattctcttaaaggatgaatggagtttcccctactagtatgtgtcacccccaaacactttcagttagcaagctgtcattcactgatactccactatatcagaaaattttggtggaaaaccacttggccctgccgctaccgccgctgcttctaccgttacgtgaatgccgggctacacgagtcggtgttttttggccccatattatctgatacccagcacgcctgcgccgacaggcgatcggcagctgcgcgtcgcgcgcatggtcggtgggacggtgagcgccagccaagtgcccaagaagcctgcagggtccgcagcttctgcacttgtcttcatctcactcacccacagtacgatgatgctgatgcacagcacaacgacttgctaccaatgcttaaagctttgaaatgcctctgcgtgacatgctatatgcgcctttatttttttctttttcacagatggatctcatctatccggttagtggcgctgcatcatgcaatgcatgcgaccgtgtgctgtgttgtttgcttccatccgttcccttagccaacctctgcacgatacgtggtggacgacgactccactacccctgcattgcagcagcagtgtactagtgtgtgtctccacgaactcactggatcgacggaacagagagagtatccatgcattgtactactaggattatttagctaggtccactctaatcgacaactgctcgatcggttggcttgtgctgctgtgcaacgcatggctgccttgcccatttgttgtaagcgattactctgtctcaagataagttaatttttagctctttctattgatctcaaactaaaattggtttttaagtaatcattgcatcaaaaatttatgaaagtagaagataaatatattgaaagtagataaagtggaaataattgtattgggatttgataaagtggaagtatctaactttttaaattttacacacatgtgtggatggatgaaaaataaaattattttgaaacggggggagtagtaaaattcttcccttatctatactattataaaaattgaagatgtttttgctggtactttggtaggtcattcgtgtttgagtcggtttttaagtttattcgtttttggaaatacggatctgtgtttgagtcgatttttatgttcgttcgcttttaaaaatacaatagatgttttataagaaatctctttaaaaaaaactcgcatgctaactcgggacacttttaaaaatataaaaggagtcgtataaaaattattttaaaaaaacttgcatgctaaattgagataagagttggactcctaattataacttatgattttcaaaaaaaatatccaagcaaattcccacaaggattttcaccctaactaaaccgtataacagtgataataaaactaaaatagccttcatccgtcgtaatgcatggcattttttctagtcacctaaaaacgaaattgaaacggttcggtttttgcagaaatagaggggagaaaacgttgtaccaaatgaattaagcctatgtttcacagccaggcagttgggtcgtctctgcaacagtgacattaggcccctcgattctaggcccatgtagattcaattaagcaggccggcctataaaaaacccgagctttagatattcattttctaactgatgatcacatttactcacagattcacagttcaccattaaaaagatgggattgatgattacagttctgtcttctgccatcatatatagagataaaggcgtggtttctttttatcgctctaaggtgtactctttacgtactttccgtcccttaattaatttgcttatatattcagcatttagaagatcataacaaggacaagacgacaaccaaaaagaagacacgcaaaatgtgcaaattaaagatgatcataataaatgtacgagatatgatataaagatgcatttaaccaaaagagatttactggccccaaatcaatcgaaatgatcagcacgtactaggtaccactgtggtacggtataatgtggcagctgacacacaaaacggcggcagaattgtcatactacttggtgatcatatctaataatcctagctttgtctatgtatgggtcctcaaggttcttgaaagggataacacattgtggtcatagtcatctttgattagcaggtacctaatatcataccttagcacatgcacgagtacctagcatataagggtaatatacaaagtataatacatagactctccacatattcataagaatataaatgaaagctaaaacaatcgagtggcatgactaactagctcaacccgtttgatttagggtttatttgatacagtttcagcttcagctctatttatctatcttagagttgaagcccaaccaaataagagtggagctggttagagtactctcacaaaatgaattagagatgtggttgagtttagacagtttcacaacttcacttcaaatttaacttatgaaattaaatttaggtgttagtcctaccaaataggcttagatcgtcgaacgtgttattgctacatattatagaggtaaatcaaatattttgaaaatcatcctttcaaaaaaaatattgaaactcaaatttgacaaataaattaaaataaatattatatataaagaatacaatagaagaaagttttttagaaaatgtatttttcaaaatttagagtaaataatatatttaaaaaatctaacgaataaccccaaaagatcacaagacaccatggaatcccgtagatcttctggattagctgaacactgcatgcatgttgttgctaacgctatcttaacagtgcagcactgcagcacacagtaagtggtttggttggtcaaaaacgtactagagccacatttacaaagcaaaatgccacgagtactaccgcttgctccaccttgatgttggattagaccacagggctgacctagctaaaatcaattccactgacatggacaactaggcactagctaaagaaaaccctacatattcatacacacgtacagtacatgtatagtagtaccactgtacatatgtgtaccaggtaacaggaaatccttgtacatatacagcaaacagtaggcattgcatattgcatcttttgccagtaaaatagcctgcaaataatgtactagctagtaccaactgaatgaactgataagttcaacccaacgctacatacttactccctccgtcaaaaaaaaaaactaaacataagaggagatgtgatattttctagtataataaatctgaataaagggctatgattcattatcatagaagatgtcacatccttacctatctaggttgtgttttttttacggagggagtatgtccggtgtttttccaataaaaaaatatatatgtccaacttagagcagatgaaaaaaccatcaataagtaaaaattcgtgaaaatcggatctaaaaattctctaatatgaaaaggttctagagatatgtatagacataagatacattcccaccaaacctaaaatccaaacttaactttatttgagagagagagagagagagagagagagataaatttcgatgaatactgtccttttactatccatcttgtatggcacagctgttctcatcttgtatggcacgttctggatcgatcgatgggagaatgagacagggaccgatggatcatggtcgtctcatggatggttgctgttggtttcgttcacctacaaaagcctgcagaaacgacccagaggaggaggaaacggggaaggtttctctgttttttttctctagcaaaacaagctgcttgctagctactcctctctgcttgctgtcgcactcacaccgtgcaatctttcatcagctcatcagctgcacagcccatctctcgctgacccgtttttgtcccctgttttaatatacacacatctcccttttttttagcttgtgcttgctatattgtccaggtgtgatagtacttgtgtctactacatgtaggagcatatgcatgcaagaatttgtgtgtgtgtttctctctatctctgctggattggatacaagaagtaacaggcttgtaccagaagcaaaataaccggccgggatggccataaacccttgtctgtggcattacctctctctctatttatgaaccatgatgcttgtatatttattggcatctaaaagtggtgagaagtgcccatggggcatgtggcattgtggcaaccatcggcagggccttttgaaagcttgttttgaccatgcaccggcgatatagttttagccacaggagtcattacgacccagcctttactactactactacatcgatcgatacgaaaagagaaaattccctatatacccttgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcatcacaaatatttagtaatttattccttattggttttcacaaatcaaataatttacacataaaacatttctagcttttaacaatataacaaggacaataaagtaatttctacaataactaacggtcaaactaatggtcaactaacggaatgggtatgtaagggatccaaataaaaactcaggggtatataagagatcaaacaaatttcaggggcgtagaagggattgggtgaaattacatgggcatatagggaattggcccataagaaaatgaacagataagcacaagtattttagttaccattgttcatagacatattcaatggaatagttgtctgatattaagtcccctttgaatatcagaaataaaaaaaacaaaacaaataggaaaaacacatggttataataggattgcaaaacacggaaaaaacacaggaataaccgcttgattggaccatagaaaaaacaaaggaatcgggagatagactgaaggaaattttccaagagctttgagctcttgctaagtttcctccaaaatctctataggattatccattccataggaatttcaaaggactatatatgattcaatcctttgattcaaaggcatttatagaaatttttcctataggattgaaatcctccaaaattcttatgtttttcctccaaatcaaaggagcacttaggaggagaaaacttgctgttagatcctatccttttctgattctgaatttttgtttccgcagtctccctagctaatcgatatgtttcatgtaaaaatatatatatatacaaattttcatctattttttttgtaaaacaacttttcaacttcttattcctcccgtatcaaaatatagcaatatagaattagattagatatatccctcgtacaccctgctctgaatgatagtgttgatatacggcgtaaatccggatgattgatgctagggtatgtctattttaggatgaaggaagtaataattaattcatttgtttatacacttaaatagctaatagaaaatcatatgatccatcaacctatcaatttcagctatccccttaaagatgaacaccttttttaccattgtgtgagatactgaatccagctctggatgagaaatagagatgtggagcccctgttcaccaaactttccatttcctccccacctttttgctctgaagaaagtggcctttgtgtagttgtgtgtatgggtgtttccttctcttctttctctttaccaatccctccctctctctctctctctctctatacacagcagctgagacagtggcagggaggagcagagaattgaagatccttaaatgcggtttggtggcatccccccactggcccatcctccatcctttgctcccaatatcacatttgcgttttgcattttttgcactgcatttcattgcattgccacaccagtacaccacccccacctacataaaaacccaatggcaatcttgcaagaactaacctttgccaccactgatccctgctgctactcctcccatcttttacccactttgactccactccacctagctacctagctagctcgcaccttcttcttcgtgttcgttaagcttgccgggcttaccggcaaagaaggtcgtcggcgacgcgatgatgaggaggcggtggtctcgcgcggccgtcgtcgcctgcttactgctgctcgccgccgcgtgcgcggagtcggcgcgcccactgccggccccggccaaggcggcggcggcggttgtcgtcgtcaggccgaggagcgcgttcgacgtggtggtggccgggctcgtcggcatcgggctcgggcaccggtggcggcccggcggcggcgacctggtcgacgacgagaagcggcgggtgccgacggggcccaacccgctgcacaaccgatgagtactacgtggtacgtgtacgtacgtatagctagctagctagcctgccgcggcttggagagacgcgtccatgttatatatatttccgccattagcgtgggcgcgaggagcaagcaaagctccatcgcagagtcgtcatggcggcggcgacgacgacgaggaggagaagaggaggagaagaatgggaaggagaagagaggagttcgtccagtattgtttcccttctgcttccctttcttctttgtccctcttctgatccacttaatttggttttttttatttttttttcttgattttattttgatttttttcctctcttgtattgattggtttgtgaagtggacagcaaggccattctgttgatcgaaagagagatagagatatgagtatagtgtttcttgtttccatatccatctcttaatctatagttttcttgatgattgtgttgttatttggtagtatatattggtacatgcatgctcttgtgtacaatcacatagttgacttccttgcattaattttgggtacaaaatgattaattagctaggctaaattactcaatgaaaacaatcagactactgcatctttgcaggggagtcgtagtgggaaaaagttcacaaaagaaacatcttggattgaagtatacgatagcttttaaaagagaagttcgtcgagaacgcaatggattaaaagggaagtcttgtgggagaagagatgactgtgtgaaaaaaaaaatcaaatcttttttccagaagttaggaaatgatgaacatcaatcgatcaccccaatgtgatgaattcccttttgaatttagcatgaatttcttgtgcctcttttctttattgacgaaagttttgaaccccatttaatttctattgagtctttcatacactcccttttcccaatttttgcattatcatttcctccaattaatttaaggcaacgtcaacgtggacaactaaacaggaaattaaaacaggaaaagcaatgagtgcatgcatttttctctcgaattccaaatatccagtgcatttttttatacgtagatatataagttcagagatacagtttactactaaatcctaagcccttatggatacaaatatcaggaaaaaaacaagaatattgtcaagaagtgaagaaaaacaaaaggaaaatccaatgcatgcctgtccaaatttatttcatctagttggaaattctgcaaggtttcataaatgttggatgtgattggtgggcagataatccagatgtgcgactactatttcagcccagtaattgctccctatcgcccacacaaatctctatcacacatcgatctcttgtcagcactgaagcccagcgtttgttgatatctcaacgccaagactgaatcttcttcctccagggattagttgagactgttcggggaattatgaatttatgatccgtcgtttctgtcacatttgagtggcttaatctggtgaacgatcgatgaagtggaggtgtttgatcgatgtgacgccgttgcaattattttgtcatccttggtgctcgccagaggctctccaagggcattctcaacccaataattagatggtgtccatagcattatataagctgtcacctagaatgaaaaataatgtggcaattgaataaacgagtaaagagaaggaaaccatatcttgtatgagacatagtttctacacaatatccaagacatcatgtgagataagtagcattaaatttaagtatgaaatagtggtgtttgcattagaagagtagtttcgtactagtttcgtgatgatgtggagtttataaaaaccatgtatagtgtcttgggttaggaatagcctaattcccacggagtatcatcaagaggctgtcctcctacagcactcggacaacgagttgcattgatgtcacagctgcttgctgtgcaggttgataggagtgtgttcttggttaattaggtttgcttaaccgtgtaatgggtctaatcctactttaaattgttatattttataacggagggagcatatatttaaatatatttttttctatggtgttgttcttttcagcgtatttattggattattaaaatagattattcgctcaacacttaattttttttataaaaaaaatcttatgttctattaattatatcacttattttgagctatttggtacatttatttctcaaaatatttaaccgatccctgtaattaagtagataacccatggcaataatccattgaacaatctaagtccatgtttgattcagcttagaattatgataatctaaattattaggagtaagctgaaataaacaaatagcttattatgatatattattataatctataagctagattactataatctgataatccattataaatgtgcattttctagattattgggtgactaacagctaataatccagagaatcaaacagctaacaacttattctatgctggcttattataatccaacttatagcaatctgattcaataatctagattataataatcttaagctgaaacaaatagggcctaaatcaaatggtagagacagagatggaatgctattttgttgttttaatgaaatatctgatatcttttactagtaaaaaacagaagaataagttgcaacagaatgacagatgcatgacaattggcaaggacttggcaagaaatacaaggacgagtacgtgctagtacaacaccaattagctggaggaggtagctagctaaccaaggccttgtttagttataaatttttttttaaaacttttaactttttcatcacatcaaaacttttctacacacaaacttccagactttttcatcacatcattttaatctcaaccaaacttacaatttttgcgtgaactaagcacaccccaagtgcagtgcagtgtcaaacaaacagctcaggaatctcatcgacatggacccttctcctacatgggtacgaacagtatccatccatccatccttgaagccagcaagctgatgcagcagtgctgctcgcatcaattgcacatgtctgcatatatatctgtcccagcctctccccagcttacatctgaagtctgagcaacatacatacacatactacacgcgtttcagagattattggtggacggatgcagcaagcaagccgggaaagactttacagaggacatcatgatgtgaaaacggaaactttacgctgcattttcgactgacgatttcctctcgcagctgctattcaggagagtcttaactactagcgcagtagcgctccgctctctatctctgctcgtctctctactgtaccaccggtgaggtgaatggcgtgtagtaaccttctccatttttaaaatctcgcaatttctaatggtaaccgtacagtttttgttgtaaccgtgctattaccgtatagtatatcattacaccgtgagataatgataacccgtaaccctcattaccggattaattagtaaaacaataagagaaattcaagacgaggaagcaaaggaggttttcagtgaaggtggtatatatagatcagaagatatagatccttcgcataactgccaatgcagtagcagtgggccacggtttcccttaccgccggtaaccgcgcggttaccaggcttaccgcgggggtacggtaatataaataccgcggtaacctctttaaatttaaataaatttaaaaaataatttgaatttttgataaattttacacggttttgtatgattttccacggttaccgcgcggtaaccgtgcttaccgccagggcgcggtaaccccggccccaacggtttgagaaaccctggcagcggctgacatccgagttcatgtctataaatcaatagtatttgttactgcaccaacattaccgtagacaatcctcactggtatatcaggatcagctgcttgctgcagtagagagggaggccgggtggccagtgagtcaatacggtagcattgccatctcggcagtgctggctggctggctggctggacctctgccttttgccgttgctccctgcgactgcgagtgagtgcccccatgcttcggtctctagcgctgtctttaatgggagtggggcgagcaacaaaatgtgtttaactagatttgtttcaccccttgttttttttcttggaatagtactactaataatgaattatattttgtccagatatgacatactttagtactataaatctgaaagtatatctatttagaattatagtattaggatatgtctaattcaatattagggcatgtataaaggtagagttagatatgagcgctacgttatctagagactagcatcctacaacagttagagacaatatggtctctaattattaatatatcaaaataccttttcatactcttctattcagacttgtagtattaggatatgtctaattcgatattagggcatgtacaaaggtagagttagatatgagcgctacgttatctaaagactagcatcctacaacagttagagacaatatggtctctaatcattaatatatcaaaatactttttcttactcttctttcctttttttcactaccatgcaacaaaatttgctctaataaatgctaagagtcgactttgagccgttgtcatgcataacaaccatactcatttctctttcttccatatcatcaaatttacttgcatgacaatatagagagaccactaataaatacagttgtatatgatcttagttagtattttatgagacgaagaaagtagaagtagagaaatcatcgtcaaatcttaagcggccctcagattcaaagtttcaaaccagtccttgtctccgataaaaagaaagattcagggcaggagcgttaaaacaggaggagtaattactgcctacgcccataaatggcgttagattatcctgtaatggtaaaaatcggaaccagaggtacggtcgatgctcttctctcttttgccgtgctacattgtcccgttgtgtttcgaactaatcccgagtattatggagatgtttggtacagtaagatattgtttcctctcaacacaacataggagtacataaaaattactccctctgtctcctaataaactcaattttctctccttccgtttattttaaaataagttcatttattattgtatagggtttattaaagtaaaaaataattatagtggaagtgtataaaatagataataattgcatttggaatttaataaagtaggtatattctagtcttttttatcagtatgtgttagatgcgtgaaaaatgttttttagactaagggagtaacaacaacgtgttacttatatttatgagaggcagtaatattatttaacaagggcaaatgattgggggaaaacgagaatgctaaaagaaaaatatataatattgatgaagaacttaaatccatgatgggagcactggtggagaaaccatctttggtcggtcgaccaaatttcacaatagtctcgattccattaaaaaccgggactaaaaacgatttttagtcccggtttaaaaacttttgatctttagtcccggttggtaacaccaaccaggactaaagatgatttgtagtcccggttcatcccctgtcagatgtatgtcagggggtcgagaatctttagtcccggttgatactaccaatcgggactaaaaattaccacttcaccaaccgggactaaagatcgagtgatctttactcccagttggtattaccaaccgggactaaagatcgatctttagtcccggttgaagttatcaaccgggagtaaatatttctctcccacatccgatcggttaagtcccagacagatatt

SEQ ID NO: 60071 - DNA, 9921 bp, Oryza sativa
actagccattagcaaatcaacaacaaaataataataataaaaaatctcgaggaactgtcgcttcccctctttagtctcggttggtacccctctttactcccggttggtaacaccaaccgggactaaagattgatctttagtcccggttatttaaaccgggactaaagatagcgatttttagtcccggattcgtagtcccggttggaaaaccgggactaaaggggggttatcaaccgagactaaaaacagtttctccaccagtggagaacatatttttcatcctccattactctctaggcaatgaatactggatatttcggcacggtattctcaaaagcaactttggtcagtagtctattagataaatatccaattttgttaaagtttttttaaaatcaattatacaaattgtttctatgtttttaaagtaaatactttaaaagttatttataatgagagttttaaaagtttaacattagttttgtttaaaacgataattatttttaagctgaaaggagctcagcacgcaaaacaaagctcgtattattacatgattatttaagtattaactttttttaaaaaatagattaatatgattttttaagataactttcatgtagaaagtttttgtataaataacatcatttaatagtttgaaaaacgtgcgcgtgaaaaatgggagaggtggattgggaaaatgggtgaagaacacagccctagagagaagatagaggcgctagggtgagttaatttgggcagtgcataggtgaaccagtgaaggccggccaaaaatagaggcagcaaccagtgggagaatgattttgaccatgatttcaattctttaatggttgttgaatgcatcaatgcaagtgtgttcaaactacaaaatctgtcatgtcgtcaaccttccttgtagctcactcaaattatcggaaatgccaaccatcattttggagctttctctgcttgtattgaccgtttcacaatcacatcatgaacaacaatgctgctcccaacttttaaagcttaaaaaaatattcctcgtcctactccttccgctgagaaacattaagcatttcgagctccagatatcagattacggtagatttgaagtttgtatgttaaaatatatcagagtagtttaaaattttaatttttatttaaaataaaaataatttgatttatccaaatgttatatacacgtaatatgtatagatttgtgagttaggaataccctgttttataaaatcttatatctgaagttgtgctaaagagggcttaataaaaaatatcttactcactgtattctaaaatataagacacattcgccttttccaatgtttataatacaagaagcgcatgtattaactatgaccttctctctcttttattccctccgttccataatataaggcataactattttattttggatgttccataatataaggcagacatgcatgcatacaagagaccacctatatatttgtcgacaaattttctactaaaaatttaatagatgtaattatagtacaatcgtagtgtaattacactgtaacttgtatgtaattatactgtaacttgcatgtaactatagtgtaacttgtatgtagatttgttctggtgaggaagaaaaaaatcatagcacacacatatgtgaaaagatttgttcccacgacctctattttactgaaataacatgttaccgagagattcttgaaagttacatacaagttacaatgtaattacatgcaagttacagtgtaattacactacgattttactataattacatatgataaatattagggggagaaatttgatgacaaatatctagcaaaatcgtgcatacaattaattaggacctcttcttcattaaattattgcttttttaaatcatccaccctcaagatttctaattctattagatgcatgcattacatttattagggtgatccaaactaggaaataataataattgtttctttgtctttgggttaagggtggttgtgccttatattttggaacggagggattagttcttttctaaaatcctctaccctcaatatttataatcccattggatgtatatatgcattattgggttaatctaaacaagaaggtgatagtagctttagattacaatatagcagcggataacccaaattatcagtccctagtcattcatgaagaatgcagtttttttgaatgagcaatacaaatttgcctctccttccttttcccactcttcttatttggtagtagtactactctgtacaaaactaatactattgtgcaacaaaaaaagcaccatataatgtatagcatttgtgcttgattgccagcaagtcagcaacatccatggcaggtattgctgagacacgatctcgctgtaggacgaaacagttcttaccattccatcatcaccaatggcgacttcaatatatgcgtgggtgcgaccatttatatgccacagctcatgtcgtacggcctgtcgaccatcggcgacggcgtgccgagccagtacgccgtcgacctcatctccgccgccgtgtccgagccgccgccgttgttcttgtccttgaggctcttcctgtccaggaacgccggcctcaccggcgcggggatgacggactgctccgtcgtcttcatggtgagcattagcaccacctccgacatcgccggcctcaggttcgggaatggctgcacgcagagcagcgcgatctggcacacctgcatcacctccttctcgtcgaacccgtcggcctgcagcttcgcgtcgaccagctccagtatcttggattgctcgtacagcctccatgcctgaagaagattcagaatgagagagattcttgtgacagtgtcgtaaactcgtagtaatgtggagtttgggttcagaaaaaagattcagacatgttcaggcaggtactgcatttcgttcgggagagagagatccgtgttcttcctgctgctgacgatctcgagcacgagaactccgaagctgtaggtgtcggctttcactgtgagctcccctctgatggcgtattcaggcgccgtgtagcctctgaaaatccatggatcacaaagttcttcagaaacaaaatttacaaccttgtcatggctcaggtgttcagagctagctagctacgggttaagcgagctgagtactatactttcttcagtacttacagtgtgccggcaaatgccgtgctgaggtatgtctggtcctcggggaagaatcttgccaagccaaagtcactgatcttgggctgaaacttatcgtccaggaggatgttgctcgccttgatgtcgcgatgaacaatcctcaggttggactcctcgtgcaggtactgcaggcctctcgcgatgccgatgatgatctggtgccgcgtcttccagttcagaaatggtgcaccatcaacacctgcaaagttaatggatgtgtaaaaatgtggatcaagtaaacaatgtttttgcttgttcttgacagtttttaggttcaggatgtaatgcttaccaaacagtatcttgtccaagctcttgttcttcatgtactcgtagacgagcagccgttgctggccctccgagcagcagcccacaaggcgaacaaggttcttgtgctggatgctggttatcatgttcacctcgacgaagaactcggactcgccctgacctgacttgccgacgctcagctgcttcacagcaaccttcctgccatcgtctagtttcccctgataatgaacattagcattgcaaacaaccataatgcaatcagaaattgctgtagaatggtaggtgatactgatacagattcagtattgttttgtggcgtttcttggcagaaaaaagtgtaccagataaacaggtccaaagcctcctctcccgagctgattcttctggtggaaatccctcgtggccttcttcagtgttgcataatcaaagtatgttattgtgcgcagattgccgctcatgttgccgctgaaatactcgggtacctctgttacatggacagaaagagaaacagcagagttttatacaaaaattatggagcagtttgtgttttattgttgatcagcaggtttgatgagaatgataggttcacctgacggagccctctttggcctcatcaatctcctcatgatatctggcctgaggaacttccagcagataccaagtaggatgaagatgactatgatgagaatcacgatgaaggccaggaagaccgcactcgcatttgggttcgccattgttgctgtctatttctgcacattcatccacccaaaacctaacattttcagctgaaacttgttctaaaatgttttcgtgccagttacttagttgcctgtactccgtacaagcaaagcagaggtgaattgcacatatgctcagtgacatgccaaacaaaaaaaatacagtaaaaacctgaaaactacttaaaaaaattactcattgtgacatgaacaaatctcatatatccatttatgtatcctatgttagttttcaggttaactcaagcctgaagtaattaagggtaggaacctaataaacaacatgatagaaaacgccatgaactaactaataccacagatcagccatgtcgaggagaaaatacttcctctcaccactatactagactcatctatttagttcaaagaaaactgtagttaagtcatcttgtacctactgtacgtacctttgcagaacagtcggtcgatccaacggcgatgatcaccggacgcgccgccgaagccgtcgccgccgccgccgcttcgtcctctgtacgcagccgtaacagctgcaagtctgcaagattgcaatgcgaggcttccaatgccgtgtggcgatggaaggtaagcagagctatcggtttctccgaggcgctcgcgcgtgtcgtgtgtccgatccgatccggtcgtacttcgcgctggctgcatgctgccactgccggccgctagctagcaagcattcggtaggcaaaagctcgcgaggatattagagtagcgcgacagcgacgccaaaggcatttgttaagctcaattgctagaaaacttatgcaagttttttttttatgtctctaaaatttttagatttgtgaccatatgatcatcttgagatttgtactagaaaattagcgcgcccgttggtgcgcttgctaatctaacctgtatttttctctagcattatgataatacttatacctttataagtagtatttttatttttacgtcgtggaagaattatagttatatacactacgaatcgatgaagatcatattttaaaggatataaaaatttatttttacgtcgtgaaagaatcatagttatatgcactacgaatcgatgaagatcatattttaaaggatataaaaatttattttcttttctaaagattctgcctcgcttctaaatttaagagttttaaacataacctgttagaatttgtagaatttagaagtaaacaatttttatagtgtttaaaattgccactaaatattctaccttttctagacacaaaggatatatagggttaagttacctatttctaattctaacatgtctcatgtcgtatttatcggaatttttctccctgactttcctaaaactgcaaaagttttgtaattaaaaaaaatttaacaccttatgtatttgtttataattcatattcctttttatatgtaaagttttttttaacatgtttgtagagcgtactctctctttttatacatattgtagcttttaaaatgatattgaagttgcactttaaacattaatttatttcataataatcgatacctatgaagtcgaaataaatttcacgttacagcttatatgtgcctaagtaaatatacttatatttcgctgagcttttgtattaaaatattacgcatggcatccaaaactgctagacagtgctgtactgctgtagctgtttcatcacacacactgttatgggccaatttggatttttttggctgtgcgtgcgatggaattttggcccagccatccaggcaaaaacgtattacgggagagatcgagaagggtaccctgccggcgcgtccgcacgattacgtgcacgatttaattcacaagttgcccgtcttattatcgttgctccacgtgtcaacaaattactcgaccatatggaccaatcagattgtataaaacctgccggctttagatatatagatagatagatgtcacgcgtaacatctacgtactaaccaaccaaattatggttgaatataagttttaaataagttataccacagttacagtactataattatcgtgtagtaattatagtatagttataatttaatttaattatattatagttacatcttaatgtttttcgctgaagaatattacctcgaacaagtttggagtttttgttggcgattgattagtggatcgcgcgacgaacttgttccaggccggtagttgtggcctgtgggccggccggtgaagacgcatggccttccacggcccacggaaatcttgagttggtgtccgcatacggcccatcatcaaatctacagcgcgtgatgcaaaattggaataaggtccatgaacagtaacagcattttccaaccagcaaccgacaaaagctgatcgttggattgaaatacagagcatccagccacaggcgccgcccccactcacgcgacgcgaaccggagaaatataaaaaaatcgagcaaagtcatttcaaacaacgaatccccttccccggatcaagcagctagggtttccacctctccctcccccaaatcttctccatggccgccgccgccgccgccgacgcatcggccgaggccgcggccatcgcgcggcgcctggcctcctgcaacggctccgcacgggagcgcgcggtgcggcacctcctctccaccttcctcccggcctcggctccgcacctctccgcctccgacctcctcaagctctggaagggcctcttcttctgcttctggcactccgacaagccgctctaccagtcctccctcgccacccgcctcgccgccggcgtctcctcgggcccctcgccggccgccgccgccgccttcttcgccgcctacctcgccaccctccgccgcgagtgggtccacatcgacacccaccgcctcgacaagttctacctcctcaaccgcaggttcctccaccacgccttcctcctcctcgccgccaactccttcgccgccgacctcacctcccaggtcgtatcgatcctgtcggagaaggtactccttcccgaggccgacaacgtcgccgccggctcgccccgtgggcttgggtaccatgtcgccgaggtgtttctggacgagctgtcgcctgtgctccctgtgagcttacagacaatggaggtgttgctatctcctttcttcgctgtgttggagaagtcatctgatagggtgatggtggctaaggttaagtctagtgtgtttgagaggttcctcgagagcggcaaacaattgctcgagatggcgaagaaaggcgagggggtggagaaggggagcgcagacgagaagattgggaaggttggcttgctgtttgggttcagcaagaggttctcagatattggggcgaaggcggagaccgtgcaagcaaaccgaaaggtgctatttgggctgagggatgcgtttgtgaaggttgagaaaggattggagctctctggggtcgagattgctgtgccagagttcaagagtaccgaggtgacaggggtggagaatggcatggatttggatgaggtgaaggtggagaagaagaagaagaaaaaggcgaagaaagcttcattggtggaaggtgagacagagggggccaaggattcaaagcaagagaaaaaggtcaagaaggagaagaaagagaagaagaaaaagaagaaggtagaggttgttgatgagggagatgtcacggaacagagtacagacgctcctgcagaggaggaccaacagatgggtgatggtactgaggctgttacatttgatgagacattgatgtccaatctccagaagcagtttgagaaggctgcagcagaagctggtatggtcaatggaggcagcagctcaagtgctttgcccgctagtgggaaagctgcaaagaaaaggaagagagcaaaatctgcagataggttatcggtttctgatggagacgatgttagcagcgaaggtacaattatttcccaggatggggagaagagcggtaagaaagtgaggttctcgatgaagaataatctagtttggaagcctcacaatcctttgccgccgcagtgcttgaggctgccaccatctgctactccaagagggagtgcactaaaaaagggtgttctgcctgggcctataaaagaaacgcctacgcctgtgaagaagactaagccaaaagcgaaatctgcaaagaaggtcttgaagaagccttcctcagccgcgaagcgcttgcggaagttgcaaaatttctctgcatgaactcttttatgaattgacactgcagtgatcatgctttctgcatggtgtgtcttttcaaccgtgttctattattacttaattcttcacctaggttagtcttatacgctgttgactatgcaccaaatttatatttatggattgtttaatgttgtgttatgtcatagcgcattcatgataatcatgtgggtgatcattctttggaattagcagtagcaattttgatctggatagtacaagtctgaattcccatggatgtcctttctgttccaactatatatcttcctccattaaaaaaactatacatcttcctgttttctttcacaactgtggcttagtacagagtactggttcagtgattctatatagatgaatcgcttccacaagcttattttcttattgatgatcagacaggcggattcttctgagcattatgatgttccatttgacataagattgttaacatcactggtgtttggcatgaaggcctttagttactagtttgcatgatgaagatagctgttgacatagtttgtttctttcagtacccagtaactttgatggggaatgttctgtctgcatatggtacacaagaatgagatgtgtatgaatgataattagcactacatgtttctgtatgtgaaaccgacctactactgctagatatagatatcatgctcaattgtttctgtccaatatctccgtgatccaagaaagttactgaaatcaagattcaagagcagagcgtttcgaagaggtgagttgttgggagaacatgagcagcatatgttatactgtattgacttcctcagaagttctgatttctgatatcttgtctctgaaaatcccttttggctaaattgcgcctgcactggcaatagacgctgtgctgtcgcaaccggggctcgtcagtattaatttctgctactgatttcacttgtttttcttgtatcagtatcaactcattaattttctcaacagcacgttgcagagacagctatcatcggtgaactgcgattgtgatgcttgtattataattcgtattcgtattattggattctttcttgtggtgaatgatactgctacttggccgcactatttcgtgaaatgtgcatgttgtgaatgtagtagtatgatcaatgtcaagcaatccagaaccgaaaatcaaccactgaaaattgctgtgatcaaagatagcttcctagagagagcgcgcacggatcacgaggcttcagcagcggtcaagatgacactgtgatcgttggcacaagtcgctcttgcttagagagctagagttagttattgtcgtcgtgtagaatatagttagcgaaatgccaggatcaattcatagacgaaattgtagattgcttcacttggttgtaattccaatgtgccacatgaagaagaagaatcatcacaaaggtgaaaaaataagagtcagtagtcacaccaatccacaaccttggcag

SEQ ID NO: 60072 - DNA, 34851 bp, Oryza sativa
ccgcaccggttaccttcctccccggccgccctctcccccttccaaccctatataaaccctccccgcgcctccctcgcccttttccgccccttgccgcaccgtctccccgccggaatcgagctcgcgccgtcgccctctctctcctccgtcaccgacgaccttcggccggctctctccgctcgccgggaccgtctcccgccccggcgtcgccgcctccggctttgccgcaccaccgtcgaccccgtccaccccctcgccgagctcgccgaccgccagaacgccgccgaccccgtcgacccgagccacgtcgccgccttcctctgctccggtcgccttttacgtcgtcgctgtcgacctagggtgagccgtgaaccgctgcctcttttcccccttcccttcccctctctcggccgccgctccgccgtgcctatggccgccgccggcgaccataggggcgcgggcgcgccgcctcccaccggccgcgccgacgtggctgccttcgggcgcgccgagtggctgccgcgtggggcccggccgtcagctgcccgcgccctcgggtgcggctgacgcgtggggcccacggtgccggccggagtgagcccgggtgcaccctgtccaccgtggaccgtgaggctgctgggtgggccccactcccgtggacccggtccgcgcgccctcccccgtcggctgacgcaataaatcctttttttaaaattaaaatttaaataaagaaattcgcaaatattcacttaaagagcatataaacttcaaatggccataacttggccatttgaactcggaattggaccgttcaagtctctaatttttcctcaagaagtcaagaacccatttttgtgctttgttcctgcttgttatatggagtttattagagtaaaagcctttttcctttccgttagtcgtgtagacgctgcagcttcggaagatccgctcttcgtggaggttgaagccgacgtttgggaaagcgagcaaggcaagtcacatcatccttgaacatattgaatcccagtttataaaattattttgatttaaattaatgcattatcgctttatttaaattcccgcgttatcactgttttatttagccatacctatttatcattgttatgaccttattattattgctattgttattattaccttgttcaccctagaataaacaaaaccccaactagtgggtaccctatgcatggtaccactagtatgaatttaggtagatgcttcgctggttaattaggcaacattaggtggttttacaactctagactttgggaatattcatatcacatggacattggaatggttggattattgtggaattggattcacacctccccctctattcaaaaccctcaaaatggttttaggctgggctcggggtgcatggttttgatagtagcacctcggccacataaggaccggtcttcgggcctctgttgcaaagcactaccgtacttccacatgtctagtgggtaaggcttagtttgtggctcagtctagttataaacaaaagtacacggatgcagatggacgaagttaggggtcgatggacatctctagggcaaatgaaggctacacgagctgcggcccggtagtcgagatatcatggcacggggctggtgtcctgctgctaggggctcagtcctgcctacctgtcccggaggttccggccgtaggtggggttgggtcggtactcttgtctatggctaggatgggttggaaactatgtcatgtcttccgtctgtatgccgtggtggtatgtggcatgtggttacacgtgaggaagacatgtcttgtgggtaaagatgtacacctctgatcagagtaaaacctattcaaatagccgcgccctcggttatgggcaagcctagcaatgtacccaagttagtgttttaattcttaaaacctgcttaacaactaaaatgtggaatggttggcctgggttggcttgggacgagctaggacccagggtcgggttgccagttcggtctgaatcatcgtaggccttgggttaaggcaggttcgtgtgggttcacggccttgattaataatcttgtatagctctaggatcatcttcataaaatagcttttggcaactaagtgacttttaaatgctgtttactgcaaaacttaacccctatgttataactcccttgtactcccttgcatttattctacacttgtgggtgtgtcttgttgagtacggtggttgtactcagtcttgctcaatttttcgcaaacccagaagaggagttcctagaagatgaaggctttggtgtctaactcgtgcctgccgtcaagcgcctgtggtcgtcgccctagtcttccgctgtttttcgtttgtcttcttgtgtgctgggccttcgctgcccatgtaataaattatctatatacgcttccgcttgttaaactctgaattgtatcaacttttggtgtaccttgcctcctgggacaaggaataatacacgcacgtaaggaacgcccgttgggttatttccagtcgtgacagagaacaacctgtcggagatccgtggctcgttacgggtcacctacaccagcctacaccagctcgctgggaaatgtggtgttacgaccaccatcccggtgaaccccgacaagttctcgctgatgacttcactcgcagaactggccacggcgatggaggcgataccctccaagcatgcggccatgatcggggaggagacgtccaacgggatttacaccggggcatgtcacgtcctcgcgtgtgtgaggttagcgcaccctgaacttgatcttcagtggatcttggatcagggagcgactaacgacgcacgtaagggcgtgatggaggaagtcggtgatctgggagagtctgttctcccactttttgaagagtaagactttagttcccttgtactctttaatcagtcatgctttgtaaaacttttgttggcttcaactgcctttgcgtgcgcaatcatcaccttcattttctttagcattttaatcccaagtactttgttgtcgtttgtagagatgtcgatgtcgaggatgtccagcagcgcgggcagcttgagttgccggtgatcgttccgacgcttgcgtttgaaccacgtgtgtcgcaggacgatgtagatcaaaatttgcccgcggacacgggtatggtgacgacttccttaggttggtcatctctgtttccatctcctttacccttccgtttggattgacttgatttgctgtgttctcggaagagaagagcggcttgatttagtcgttttcacgctgagcagatctcgagagtgcacctgctgaccaagatcatcgcatccaatattggaagacgaaatttgaggtagcggaactcgagaggactgtgctggaagtaaagaaggagctggctgtggaaacactccgaggtcgtgaggtgaggttcaactcgtatctgaagagttgctgcacgtccatgacaagagtctgtagggagctccgagtaccccgtggggatcccgaggagtcggcggccggatacatctcgtggttgaatggggcctgcacccagctcgaaggcatcgacaagcgtattgacgaggctctgaagcaggagtgccgtcgatcgagccgatatgccggagggcatgtattggcttgcatacgagatcatcgcccgcaactgcacctcgagttcctccacgaagggttttctcgttctcagagaactccggtggagatagatcacctggcgaagtcgatggcgccgctggcagagaaggtcttctagtctatggactggcgttggccttcctggtagtctctgtaccctgtgacaaatatcttagggaaaagtgtaatatagttttggatgtttacgggattgtaagcagtacttgtgaaatagaaaagggatctatctaactaagcttccttactctagatgtagtgtgtaagagtgtcttctcacttcacgacgtcgatcagtcttttaagtcatacactctccctagcccccagccttgtcatcggagaatacttctcggaagataaggctcttggacctttgacctgccttggttttacaagcactgatcctagcccccagccgtgaagttggaaagttaatttccgattacacggcttggttaatacgcacggcaagaactcttacacgaccagatcttacatggtctttcgtctctacaggatccgacaaggccttatcggctctaggcgtccccagccgaagatcccttaggtttttcggaggccttgtcaagacggcgtaaagggacaagaggataggtttcaatgctaaatgtcatctgggtaagggatcatcgggaaggaacactttggttgtaatccgtacctgaaaataggctttattgaagctatgagatgtcttacaagtatggatacgattgacttatacatagaatttacgtaattgatcaatgttccaggaatttgccaactcgcgaccatcgctgtctgcaattttgaatgcgcctggccgcaagacttgtgtgatcgtgtatggtccttcctatttgggtgagagcttgtttcgccctgcttggctttgaacccgtcagaggacgtaatcaccgatcgaaagcgtgcgtgctcggatgcgcttctcatggtaacggcgaagggcctgttggtagctggctactcggacggcaactcattcgcgatgttcctcgagtagattcacatcgtcgttccgctgctcctcctgaccctcatcggaatactaattctgtactcgtgtactttgatgtcgtagctcggtggggagcatggcctctgagccgtacacgaggaagaagggtatttccttgttagacgttgtcggtgtggtacgcactgcccatagtactaatggaagttcttcgacccacttcttgtcatgtgacaagagcctatcatagacgcgggtcttgattccttgtagtactatgccgtttgccctctcgacctgtccgttgctctgagagtgagaaaccgaggcgaagcagatcttgactcccagcccgatacagtaatcctggaagtcggtgctaatgaactgggagccgttgtcggttatgatgcgatgcggcagtccatatctgcagaatatccctttgatgaatttgatggcgttgtcggccttgatttcccccgtgggtgtcgcttcgatccacttagtgaatttatcgatcgccacgaataggaacctgtagccgccctgtcctcatgggaatggtccgagtatgtcgagcccccaacacgagaacggccaagtaagagggatagtctggagcacttgcgctggtagctttgtgtgtttactgtgaaattgacaggcttcacatcgctgaaccatgtcgcaagcgcctttgagggtggttgaccataaaaacccttgtcgaaaggcttttccgaccaatgtgcgaccggctgcgtgtgacccacagatcccttcatgtatgtcgaggaggagatgtctaccgtcattggatgagatgcatttgagaagtaccccatttggcactttcttgtatagatcgttgccgatcatacagtagaattttgctttacgggttattttctcggcttctgcgtcgtcctcgggcaactcttcgctacctatgaatttaatcagtggggtgcgccagtcgtctatggtctcgatatcaacaatggcgcgctctgcctctgtagcccccgagctgatgtcgggggcgactgggctatcttcgctgcttgcctctttgactgatggcattgtctggacgtccagaaaagttccgggttcaagtagttctcgtctggacgcacgccgtgctatatcatctggctcgatgttgtccttgtggtatacgtgtcggacctcgatcccatcgaaccttttttccaccttcctgacctctgcaagatacttggataactcgggattagagcaattgtaatctttgtgcacctggttcgcgactagttcggaatcccctttcacgaccagtcgcttaactccgagtgcagctgcggctcttatctcggcgagtagtccttcgtactcggctgtgttattggttgccctgaagttgaggtgaattgcatgcttgaattgatctcccgaaggagatgtcaagacgaatcctgcccttgctccttggctgttgagtgcgctgtcgaacgccattgtccacgtttcgttgtcgatttggttgtctaacctgttatcaggtatagtccaatcggctacgaagtcggcgagtacctgggacttgatgattgttcgtggcacaaagtggacatcaaactggcttagctcgactacccattttgcaatgcggccgaccacgtctttgtttctcacgacttcaccgagagggaaggaggagacaactgtgaccctgtgggcttggatgtagtggcgtaactttcgtgatgtcatgattaccacgtagagcagtttttggatctgtggatatattgtctttgcgtcgtggagagcttcgttgacgtagtagactggctgttgcaccttctctctctcgacaacgatgacagtgctaacggaatatggtgtggcggcgatataaagaaataattcttcattaggttggggagcgacaagtacagggggattcgataggtagcgcttgagtgcaatgaatgcctcttcggcttcctatgtccatacaaatttgtcttgcttcttcagcagagcgaagaaaggttgtcctcgctctcccatcctagcaacgaacctgcttagtgccgccatgcatccagttagcttctgtacttgcatgagtcttgtgggcgacttcatgttctcgattgccttgatcttctcgggatttgcttttattcctcttccagatacgaggaaaccgagcagcttgcccgatggtactccgaacgtgcacttctctgggttgagcattaggcgatatcgtcggaggttgtcgaacgtttcctgcagatcgtcaatcaatgagtcgcttgtcttggtcttgacaacaatgtcatcgacgtaggcctcgacattgtttccaagttggtcgctaagtgcaccttggactgtgcactggaaagtgtttcctgcggttatctgtccaaacggcatcttaacgtagcagaataccccgaacggcgtgatgaatgttgtcttctcctcgtcctctttcgccttgctgatttggtggtagccggagtaagcgtcgagaaagctcaacaactcacacccggctgttgagtccaccaattggtctattcgaggaagagggaagtgatccttgggacacgccttgttgaggtcggtgaaatcgacgcacgttctccatttcccgttggccttccgcaccatgactggattggctagccactctggatggagtacctctctgatgaaaccagctttgagaagtttgtcgagctcttctcgtatggcttgttttcgatctggtgcaaatctccacagtttttgctttactggcttggcgtcgggtcgcaccatgagtttgtgctcaatcacctccctggggacccccggtatgtcggacagctgccaagcgaacacatccgcattgtcgcggaggaaggtgatgagcgcgagttcttatttctcgcctagtgatgccccgatcttgacggtcttgtcggggttggcactgaagagtggaacgatcttgattgcgccgtccggttttggtgtcttgtttgttttgctcactttcttgggtggctcagctgtggcgggtaggctgggcgtgtgctcgaccatgtcgaggctccgcttgtcgcattgtactgccagctttgtgtttccttgaatagtgattgttcccttcggtcctggcatcttgagcactataggtgaaaacggtatggaaacggatggaaatcatctttatcgttttcattttcatatttttttcggaatcggaatcagaaaccccggaaggtgatttgctccgttcggaagttatttgcttggccgaaagtcacaggcaacgtaattttgcccaatggtttggacgatgactggggagtgattccatggaagggttgatcggtgggtgtcaactcgcttcgtgggatccccatcgcatccaaagtgctggcgaagagaaggttgattgagctgccaccgtcgatcagaactcgcgcaactttgatattccgaatactgggttcgaccaagatcggatatcgtcctgggataacggcagtcttggggtggtcttcttccgagaattctatcttctgttcggaccacttcatcttgggtgcagccccctgccacgtcgaacagacttcacgttccactttcttgtattctcgctttgaggagtatgccgtggaacctccgaagatgtgcgagacatggagatcggagtctaggtatgttgagtccgattcctgagtagccgcctcagcgtccttctcaaccacacgtactcgcttgcctttttccgatgccatgtgctttgcgagcgactttttgaagacgaggcaatcttccaaagaatgtctgtccgacttgtgtataaggcaccatgcattcttcgcgtcgctaccttgtgggtctgggcgtttggcagggtcggcgtattctgctgcgagaacttacgcttgagctttccttttcccactcttacaatttttctttttgcttgactcaggtgcgtccttcgctggtttcttctctcctccggtcttcggcttgtcgttcttgcgtctcagtacgtcgtccgcgtgggcgcatcgatcgacaatctcgaataatctccgagtagtcgtgatgcgcctcgttgccaactcttgggtagtatagcgatctctgacactggacttgaaagcgcggattacagaagcgtcggtgatttcagggattgtatttctgcactcattaaagcgccgaacataatccctcaaggattcacccgggttctgtgtcaacacatgtaggtcgtcttcgatcgcgtggcgcttgtaagttccttggaagttggcgacgaactgctgccacaggtctgcccacgaagaaaacaagtagggcgggagatgcatcagccatgaatgcgcagagcctttcaatgcagttggcaaataattcgccaacacgttgtcatctactccggcagcgtagagtaccgtggagtagacctgtaggaattcttccgggtcggtactcccatcgtacttctctattgctcctggtcggaatctttcaggccatcggacatcacgtagcgaacgactgaaagctctacaccaagcgttgggggcggtgggttgtcggcgatcatacgtccttcgcggatgtctatctgatgatgaggatgaggaagatgatgacgatgatgatgggtcacttagttccggtgtacgattctgaggacatcggccgggttctcgagaatcccgtcgtcgccccccgttgttgtcccggcgccgatctccatcgtcgtcgtcattatggcggcgtccttgacaagtatcgtccggcacccgccgttcgtgatcgtcgtgatcgtggtggttgcggcggttatcgcggtctcggtcttcgctcgtgtggcttccttgttcttcgttatcttgacgtcacgaagagacgcgatgttgggaacggttcccattgtgtcgtgcgcgtcgcgcctctcggcagccattcaggtgatcgcggagatcaccggtgccgtgaggtggaggggtggctcgatgaggcgattcctgctgttcagggttttcgccattagcaccgccaaattgtggctgttccaggtgcgctgcagcggcggcctcttcgaacgcgttgctgaggttggtcactgattcccgtagccgttctgtccagcgtgcgagattgtcattcagaacggggtcatagggggtttccctcagtatcactgacggtccagcattagcgccatcagggctgatgtgctgatgtgcagtactgtcagggcggtgggttgtccagtgatagcgccatcagctctacaaccagaacggccctgatgtgctgatgtgttgtgcgggacagaacgactgaaagctctacacccagcgttgcctttcacttgaatttctgcttctgcattagcgcgcgctgacgtgccgatcccgtcgatagccaacacctcgcgtggcgtacttgttgacgatgagccatagtcttcgagcaaatgtagaactgatggctcgtgagggtcgatgtagattaccccaacgaatcgatccgagatcagtgtcgctccttgttccttgtccgcatccctaagagagatacgtgactgatggaccttaggaagcggcatcttcatggcgttgagaaagaccttgtagctttagagttcgtgattctttgtcttgtgaataggacaatagatatcacgagttggagaaatacgttgaattccacgctctttgcaggcacgaatttcggtgtgtacgttgagaaaaacccagcaagcttgcaaggtgtgttttctggttttgtggataggacaccaggaccttgtcgcctcggaagttatcctcgtcggctcatgattcttgtcgaaaagacaaggtttggccgcactaagatccttctcaggctcggatgtcgtcgacgttccgttctccgcttcggcgggaggatccttcgacatggagtcgtcttgggttgtagccaccgtgttctcgcttccggtcattgatggaccagctgagatcggcaccgtggtgtaaaccgggaagacgatttcgctgacttgagtccacaccagcattgtcgaagtaggaactccttggttgaggttggtgttagcgctgttgtcgacgaaactggatgacatattagtagatccttgagcaccaagtccccctacctggcgcgccactgttgacgggggatacccgtagaccggatatagagggtattggggtacgctggtacgaggatctacgtaatacgacatcaagcacacaaagagcacagattatactggttcaggccccttgataggtattagccctaatccagttgatatgggattatataatggaaatcacaagttacaaagggaacaatggaactcgatgataccggcgagatcgtaatcgagctggttcaactaaatctcctggcgacttggctcctgtagactccgacttcataggctgtggtggatgtgttggctatgagattcgatgccttaggtccttcctagggggtcccttttatatcgcaggtcaggcggtttccaagtagaactcgaagatatcggaccctgcatgatacagtgacgacccagtcctgtccgagtaggactccttccatctgtgaactccgtgatgaatttccttaatgtatgcagaaaatgtccgtatacacgcaggtataccatatcgatatgtgacgtataccgaaaggtaaagggtataccttacccgtaaccctaacagtttatatttataccccgagtacaaaataagttcattatggacacgactcaaaccatacgaacaagacctttcacggccgtctcttgacaaaactaacaaaactgtcgtaactaacctaattaatggatacaattggcttcaatgagccttatctctatttggcaatatcaattattccaaactgggcttatgctaaacccaaactgtgctgtatcggctgaatcggccgttgactgtcctggtcaatccgactcttggcttttgctttcagccgatacagtttccatccgacgcgcaatttgatctcaaatccttcatgcttggtcataaaatactgtaccgatttattcccttctatctgaaccccactgccagattttaccgttaacacattgatattgaactttgatttaattgaataatgaactaatgtgtattttacactaaaaatggtgtatgagactaatacgcttaaatctgtcgctgttctttttacgctgtagtccaacaatactctcaaatgcacggaggcacgcagtcaatcggttcaggacatgaatgtatgtggaagctggctcgacctgcatagtgcaagcattggcatggctcatgaccataggcccaagttgctagctgaggggctactcccgttggacccgtatacatgtacgcgagatatctaaatacaggaacagcagacgctcgcgataggagaagagtcacgttaggagcgccctaccccgaatgctgcatggacatgtgtcagtaaaacgaagggacagcaaatgaaccaatcagctgctagcacacccgctagctttaactcccttaaccagtgaacaaatataaacaaatataattcgtatccctaaaccataacaccggatatctcgacccctatttattaaaacctgtacaattaactccctcaatggttttggagagcggtttcgctgacgcggcatctatgtgttagtgttgacctagtctgtagagttaacatgacacttaggtggcattagaattaacaacatatatgtgagacccatttgtcatctaaaaaattatgaggcccacatatcatcctctctctttattcttcctccctctctctctccttccttctctatctcatgcactgttagccggtgaacggaatcccggcgtcctcgatctctctgcaactctcaaactaaaacactcaacaatgcctctgaacttgaacacacatgaattggcgctgcaacaccttcagcagcttttctgggttatattcatctccttttatttggaaacaacgctagtaaatcggcagtagtggaccatcatgcgcacgacacgatccgcaccgacgtgcgccatcccacacgtcagatcgtgccgcgcgagactcagactccacgacttcgacgtgaactcgcacgcctcaagtcttacacacgacgtagctgctatagctagccggcccacaagcaacacaaagaaatgaacgacacactacctgacgaggaacagtgaaaacagaaaaacaaaaacacctaaaaaaacaatgccatagacggcaagattgacaacatgcaccccctctctctcccccatgttttctcccaatttcaacggagaggaagtgcaacagcgatgacgaggagtggtggctccccagcgccatctggaacctgtacgagcacaacagcggagatgaggagtggtgactgaggcggttcctcatgcattagcgctatccagcgatggcgggagctcagcagcgacgcgactggtgtgcctccccctcatcagctccgtccccctgcgtcagcgccatccgacggcggctgaagcatagcagcggtgacgagaagtggtggctgttggaaatttggtcataattcggcatattttaatccaaaatattaagacaataaacatgacatacacaatgagaagcgatctagtgataaggctaaacataaacataagcatgcttaaggtaaaataagcatagacatcgttgacattcacataggattgaaatcctatggataacattgtgaacatgtaaataacaagaagaaaatcaaataaagtacatggtgcagaagatgttgaggcattcgtattgcctccattgatattgtctcctccgttctctccagtagaagccatggtgaagcagaagtagaggaagatgcaacgttgtcgtcgaagaacgaagaacaggagcagtcacgcttgaagcgctacccaaaaacttgatcgctcgcctacccgtgcaagttctcaagcggacggagttccggaggcacctgctcgtcccgtacacctgtgcgcgcaggtgaacagaaccggggaaggattctgcagctcaagaatagaggaggaggaactcaaagtgcaagagtcagcaagaacttcataagtccttctggtcgctgcggagtatatatatgcaagcgcgagagtaacgttcggagtcatcagccgcggtgtttaatttcgtaaccgacgcgctcgttaatacggaatcaattcacggcatttaattccgtaaccgacggaatcaattcacgacgtttaattccgtaaccgacgcgttcattgatacgaaatcaattctccgtgtttattaccgtctgttacaaaacgagagagcgcagcagcagctgtttgccttgcctcgcctcgccccgcctggttgtccatgcaccatctcaaccggtcaacagagactctccactagttccatatttaagttgagacctcttcacttagatttccaaggtggtattattacccatagcacttaatgtgggccaatggaatttattaggatttaattagacctagcccattaatctaacaatccccaccaaatttcgtggctcataggaaatgctctcgattctgatcctgtttgttataccagtgtttcggtggagactgttaagttgaacttccacctaggaaaagagctacaccagatcacaactgaacaatggactatgccttgaattgtcagtcttgtgcgattcaggtttcactcatacccttaactggtactaggctgttgtttgcatcccctctgtttggagcatataagtcatactcctggccttttcatgagtatctagagatcacccagatctcatagactgtgactagcagtcggactcatataggtgtgttccttctaagatgttctgtaggataacatctctgctttatgaaaagccactcggatcacattaaggtgtataccatcctaccatacagaatagaagagaagtgcatcatgaagataagctcattttagggtctcttctctcagttacccaatagtttgtttcgccatccaaattcacgggatctccgatcacaatggacaggtttccaccattgtgcaactctaagtgggtctcaagcccatctccctcgatgcaccgtctatcacattacgtggtagccccttggtaaactgatctgccagatttttagccgtctggacatagtccaatgctatcactccaaagtttttctgctttctaacagacttcagtcttcttttaacatgcctagatgacttcatgttctccttcgaactattcactttaataatcactgtttgattatcatagttcatcaggattgttggtactggtttttcaaccaccggcaagtccatcaggagctcacgaagccattcggcctcaactgtagcagtatctaaagctgtgagttctgcttccattgttgacctcgttaagatggtctgcttgcaagacttccaggaaacagcgccccctccaagtgtgaacacatacccacttgtggcctttatctcatcaatatcaaatatccagtttgaatcactatagccctccagcacttttgggtacctggcgtagtgaattccatagctcattgtcccttttagatagcgcattactctttcaagagcatgccaatgatcatctcccggatttgaaacaaaccggctcaacttgctcagagcaaatgagatgtcaggcctcgttgcactagctaagtacatcaatgaaccaatgatctaggagtatctcaattgatcccttgctattcttcggtttttccttaatagcacactgggatcataagaactaggagctgccttacagtcactataaccaaagcgactcaggaccttgtccacatagtgagattgcacaagtgtaatcccaccctcatctcctctcagcagtttaatgttaagaataacatcagctactcccaaatcattcatttcaaagcgtttggacagaaagtccttgatctcctcaatcacattgagactggtcccaaagatcaatatgtcatcgacatataagcacaagatcactccctctcccccaccatagtgatagtacacacatttgtcagcttcgttcacaacaaagccagcagatgtaagtgtattgtcaaacttctcatgccattgcttaggtgcttgtttgacaccatataaggacttcaatagcttgcacaccattccctcttgaccttctaatacatacccatctggttgatccatatagatctcctcctccaactctccattgaggaaagctgtcttaacatccatctgatggacgagtagaccatgagaggctgccagagcgagtagtactcgaatcgtggtcaagcgagcaaccggtgaataagtgtcgaaaaagtcctcgccttctttttgggtataacccttggccacaagccttgccttttacttttcaattgtaccatcaggcctaagctttttcttgaaaacacatttacatcctataggcttgcacccatttggacgctcgatgacttcccaagtaccattagacataattgagtccatctcactgcgtaccgcttccttccaataatcagcgtccggagatgaatatgcctcttcaaatggttcttggagtatcatccacaagatatacaatgtagtcatctccaaaagactttgcagtcctttgtctcttactctttcgagttgctacaatgttatcctcctcaggattttcctcaggcgtttgatcaatgtgttctatcggcgcaaagtgcttaggggataaaataggttcttgactagaagtgctaggtgtatttttcataggaaattcattctcaaaaaatgtggcatctctggactcagtaattgtaccaacacgcatgtcgggtactccagaatttactattaagaacctatattccacactgtggatagcataaccaaggaacacacaatctacggtctttggtcgaagtttacgctttttggctatagttacatttaccttggccaaacagccccatgtgcgcaggtgagagagacttaatttcttcctttcccatttctcgaatggtgttacatccttatgcttagtaggaattctattcaggacatgacacgcagtaaatattgcctcaccccaccattccttggaaagtcctgcggtgtctaacatggcattcaccatctcagttagagtgcggttctttctttcggctaccccgtttgactggggtgaatagggaggcgtcctctcatgaataattacatactcttcgtagaaagaaataaactcattagaaaaatactctccacccctatcagacctcaatcatttgattttcctttccagttggttttctacctcagccttatagatctcaaagtaatgtaatacttcatcctttgttttcaataggtacacatagcagaatctagtgcaatcatctatcagtgtcatgaaatatttctttccccctttagtcaacacgccgttcatttcgcacagatcagaatgaacaagttctagtggtgccaaattcctcgcctcagatgccttgtgaggcttgcgaggttgtttcgattgaacacaagtatggcacttagagcctttgactaaagtgaattttggaattaaactcatgttggctaagtgtgtcatacaaccaaaattcacatgacaaagtcgcgaatgccacacattggactcatcatcatcatcgcttacatggttcacaactttattacacatatcatccaaggaaaagcggaataagcctccgctgtcataaccttttccaataaacgtttcatatttagatacgacatatttattggattcaaacacaagtctaaaaccatctctacatagtagagagccgctaactagattcttctttattgaagggccatgctgcacgttcttcagttgcacgatctttcccgaagtaaacttcagatcgaccgtaccaacaccatgaacagccgcaagcgatccgtttcccatcaacaaggaggaacctctcccaacttgataagaagaaaacagggaaatgtccgcacacacatgaatattagcaccagtatcaacccaccaatcaggtgagtgacagacagagagaactgtaggtaaaaatttaccataccccaatgttcctccgccctcactaataaccatgtttgcagacttcttgtccttgcgctcaggacaatccttggcccaatgcccaggcttgccacacacaaagcaatctccttttgcctttcctttgcctttcttcttaaaattggtagtagcctttggtttgacatcaggcttgactttcttgttgttgttgtgagatgcatgagggttcttcttctgcaccaaattggcgctagaacctccctcgatctttttgccctggttgtcctttgccctcgccttctcctcaacacccaaagagacaataagatcagtaacactgaactcttgcctcttgtgttttagagaagtagcaaagtctgtccaagaaggtggcaatttggcaataatgccacccaccacaaacttgtccggcaactcgcagttgttgttctcaagttcctttgccagcatctgaacttcatgagcctgttccactacagaacggtcatcgaccatgttgtagtcatagaactgctccatgacatacagcttgctaccggcgtcggaaaccccgaacttggcctcaagatcatcccacatgtccttccctgaaggcatgtgcaaatacacgtccacaatactgtcggcgagcacactgatcaatgctccacggaacaagctatccgcagcctcgaacttagcctcctcctcaggggagagaggcggttcactcggtttgccccgtgaaacaaagaaacaatgcatcgccgtcaaccacaaaaagtgtgtgtgctttccatcttttctaatttgaaccatcgaaagcatgtggttttagtgatgcagcaaagccaactaccgaaaaagacctatcaagtttttggattgttggaaatttggtcataattcggcatattttaatccaaaatattaagacaataaacatgacatacacaatgagaaacgatctagtgataaggctaaacataaacataagcatgcttaaggtaaaataagcatagacatcgttgacattcacataggattgaaatcctatggataacattgtgaacatgtaaataacaagaagaaaatcaaataaagtttgaatcttatacccagataatggtgcagaagatgttgaggcattcgtattgcctccgttgatgttgtctcctccgttctctaaagtagaagccatggtgaagcagaagtagaggaagatgcaacgttgtcgtcgaagaacgaagaacaggagcagtcgcgcttgaagcgctacccaaaaacttgattgcgcgcctacccgtgcaagttctcaagtggacggagttctggaggcacctgctcgtcccgtacacctgtgtgcgcaggtgaacagaaccgggtaaggattctgcagctacagaggaggaggaactcgaagtgcaagagttgggaagaacttcgtaagtccttctggtcgctgcggagtatatatatgcgagcgcgagagtaacattcggagtcatcaaccgcggtgtttaatttcgtaaccgacgcgctcgttaatacggaatcaattcacgtcgtttaattccgtaaccgatggaatcaattcacgacgtttaattccgtaaccgacgcgttcattgatatgaaatcaattctccgtgtttattaccgtccgttacaaaacgagagagcgcagcagcagctgtctgcctcgcctcgccccgcctagttgtccacgcaccatctcaaccggtcaacagagactctccactagctctgtatttaagttgaacctcttcacttagatttccaaggtggtattattacccatagcatttaatgtgggccaatggaatttattaggatttaattggacctagcccattaatctaacagtggctagagcggctacccttgcatcagcaccgtccagcggtggcgggagctcagcagacgcaactggtgcgcccccccccccccccttctccctcatcagcggcggtcggccagggagatggccgaaggcacgctcgccgtcgcaaaaggcggggtctcatcgtcagggatgcggtgcaggttgggggagctattgggcatgatgattgagcgcgcgggaggagactgagatcctagtggaggagcgcgttgtgagcgacgggtcctccgtctcttcgcaccgcctcgaaggataccgctccacgccgccgctcctcatccccgctccccgctccccgctccccgctacccctcctcatccccgctccccctttcttctttgctgctagacctgcggaacgacggtgaggatgatggcgatgtgcggaggagccattgataacagtggcagaggggctccagcgtcaaggtccccgcactcttcgccaagctttcctctggcttggcatcatgcgcttaacgagaaagcccctgcacagccgtctcctctgccgccgcctcctccgcacatcggtcagaccggtggcgagcaggcgatcagaccaacgggagtaatgcggtcaaaccagcggatatccaatggtgtgaccggtgtaaattcgccaaatccaagggtaacttttattttcactaaatttttttggtttttagtatttctaccgttcaccctcctctgatagatttggttcgtgtactcgatcctagagttgcatcataaactatgggtacatattgcagaagatctgagtggtcaagatttttaaaaggaaggtaaccatcatttaatttgctgcggctgggacggcacaatatttttcttaatcggtgttgattcggttgaatgatatgttattctaatttaaagacaagacacctatataaggtcagtgccgattgaataaacccctcaacccaatcgataaattgattctacgattattgttctgttctttttttctggagtagattaatctatctctctttgccgatttgattgaaaatcggtcgctcgttgtcgaaaaacgcaatggttatcttgttatcaatttgttcctgacaaactgcgtgttgcctatttttaacgcctaacacatatccggcaaagtggagctatatctgaatatgtggaagatttgatggtattatacatcagctgctggcttacaataatgcaccaactctattgtaatttttttaacgaaatttgtggaaaattttagggatgatattagggcagtcgtcgtgattcagaagccacgtgatttagatattgtgcctgtttaggcgagattaagattctgagaaatagctggttggtagctagcttctaagaatctaaaaatgttgggtttcgcagattctgacttctagttcattttcagattctgactttcaaaagctggactgtttggggagcttctaattttgaaagaaactgcagccgccaaaaggtcccccaaataggccaattatttgcccattaaccaaaataaccttatagatatacaaggttctacaatatattattgggtatggcttttctttttttctttcaaaaatacccaaataccatgtatacttatttactctttgtggatacaaatgtcgggtttctgtccattataaaacaaacaattccatgttgtttagataacatattaacattgcggtgagccactgatgttcgatgatctgttacgtagctccattctggatgcagcagttttaattgtatggatggtttacagggagagatcaactgctagaaacatgctgctgctgttgatctgttgttgtaagctgacattagtagatgatccatttattcatgatcaatgccagtctaccaaacacagacatggacatgcttcagaaatatatgtattcttgtgtgtgcgcagctggtatggcacacgtattatcatgctagctgatagaaataagacactaaaagacagagcagggcagttgagcagagttatattcctgttgacagcaacagttaatttatggacggtttggatggaatggaattaggcaaactaagttctttagttaatcaagctagagctagaatgcctaaacaaacacttgcccgaggggaatcagaataagcagcattacaatcttagtttttttttttcttttcaatcacagtatgtgttctctagctctgagctaatattcagacacctgaatattttgttctgtctcccttcatcaattcttctctaatttgtcctaaatatttagctgtcagtctggtagtatctcttcttaaagatgctcgtgcgtatcttgcaattatcatatcgggtcgacgacgagtcggcgactgctgcgcgcctgcgcctacgtataagaagagaatcgaagtgaaaaataggtcattttgcgaaacacaatcagtagttggtagctcagttgatagtgctattaggcagcttctcttgccaactcaattgagactacgacatgagaattagaattgcagagcaggtgaagatgcagaagcagagtacataacgatggcgttaggactcgacgttcagagagtgagctagtcagcacgccattgatttttgtgcagagatcgatggatagacggcggattcggccagatgtggagatcgaatctgtcgccgacgactctgccaattatgtccaggttaaatctctcgactcagctgaagtgcatgcaatttactgttgattagtatgtttaattaatggtgattagttcattaattaagctaattatgtgtgtatatcaattgcatcgtgtagaacatcaggttggtgattgacatcggcgacaggacgatccaggtccctctcaatggccacaccgtcgtgcagaacatcggccgtcaggctgccgcctccgtcgccggtgattcgtcgtcagccggcggcgttagtgagaaagccggtggcggcggcgaggagtggctgcaagaacaggacggcttgctgtgcatgcgcgggtggctgatggcggcggccacgctgttcgccgccatggcgttccaggcggcgctgcagccgccggcgtggatgccgaggccgcgtgactggttcgcggcgctgctcgccgccgacccggcggcggccgccgtcacgagggaccaggccgggaaggcgatgctgtatctgatcgtcagcacctgcaccttcgccacgtcgctcgccgtgctcctgatgctgctcgccgtgggcggcggcggcggctgcgcgtcgaggagggtcaccgcgaggctgatctccaacatgatgacggccgtcgcgctcttcgccgcggcgacgttcgcgctctgcgtcgctgacgactaccggctcatggcgttcgtcggcaccgtcgtcgccgtgtacgccgccgtcacggtcgtcttcgtcaggtgcaaccttgctctaccgtttgggagaggcggcggcggccatggttgttgtagctgggtgccaagaatgtaaaaagaccgataatactgggccggccatgcgtttgattcagccatatattattactatatacacgcgcggcgcaatgcacaataatggagttttgtaccacatgaaaaatttatagtggtagagacccgcattaaacaggacgtggtagtgttgctcccgcggagcttggtgatgtgagcttgtcaccccagctgtggcgggcgggagttggcaggatttggccgatgttgggtggatcgagggtatagataagatatccctggtctcgttgggttgcttagagccctgcgttgtttaacgtcagtgaacttcccagctactttaacgagagaagcccacggccatatcatctggtccaactctcctcttttctttttatgatgctatttttcttttacttttcccttcaaatatcaagtggggtgaagatgatgagaattagaattgcagagcaggtgaggtgaagatgcaggagcagagtacaaaacaatgacgttaatcatgttaggattccacattcagagagtgagctggagcacataattgatttttgtgcagagatcgatggatcgattgattctgtcgccgacgactctgccaattctccaggctaatcaactcagctcaagggctttcaatttactgttgatgaacatgttcaatggtgattaattagttcatcaggctggtgatcgacatcggcgacaggacgatccaggtccctctcaatggccacaccgtcgttcagaacatcggacgtcaggctgccgctgccgtcgccggcggtgtcagtgagaaagccggtagtgctggtggtagcggcgaggagtggctgcaacagcagggcggcttcggcttgttgtgcatgcgcggatggctggatggtggtggtggccacgctgttcgccgccatggcgttccaggcggcgctacagccgccgggtggatgccgaggcccagggactggttagcggtgctgctcgccgtgggcgatggcggcagcggatgcgcgtcgaggagggtcaccgcgaggctgatcaccaacatgatgacggccgtcgcgcagttcgccgcggatacgttcgcgctctgcgccgccgacgactaccgcctaccggctcatggcgttcgtcggcaccgtcgtggccgtgtacgccgccatcaccgtcgtgttcgttcaggtgcaatcttgctatgccgtctcggagaggcgacgccggccatggttgtagctgggattccaagattgtaaacgcgtctatgcaaaaattggctcattggctttgtatccaaaccacacaaggacacattgattctgcaacgaaaattacgatgaggacgaaacataataagaccagatatgataattactgggacgccacagcccatattagtgcacgtgtaacccataagaacaaagtttcgtaccacatggaaaatctacatcggcttaaaccggtataaaaaagaacacgatcgagatgctaccaccgagctcggtggcgtgagcttgtaaccctagctgtagggggcgggagttggcagggtttggccgttgttggggtggccgttgttgggggatcgaggtatatagggagatatttctccccccgggtctcgtgccggatgctagcattctatatctccttgccattgtgttcgggtcggcccttgagccgccgcctaacgaaaatgttctaggtgactccctttctactcacgagagaagccacgaccctatcctgtccaacttctcttttctttttccattgtgttcgggtcggcccttgagccgcctaacgaaaaatgtctaggtgactccctttctactcttgagagaagccacggccctatcatgtccaacttctcttttttttttgaattcatggtacattcttattttcgcacctcttttctttttaaattcatggtgcattcttatttttgcatcctttccaccgacgagatcatccacggattcatggtgcagttcggtgccgagcggattcgagcgatctcgtcctttaggcggagggagcgattgcatcgatgcatgcagccgtcaggcctaagggaagtcaaggtggaatatttttttattgtttcatgttgcgatggattagaattcaaacgtggatccctcttctaattttatttgggtggattagagtctgattccttttagttttgtttttgtgtttgagttgggaaatttggaatcttgagaaggcgctaaccgcgcgaggcagagaaggtgctcaacgacggatgaaaacacattgtgatgatgggaaaaatccaaagttttaagtagggatagatttgattcagactctagaattctggatgatatttgccgcgactggcttttcaatctatctttgatttgtgatttccccaccatacactatcaagagtttgattcgatctctgatctgtcttttttttcctttttgctttagccggcttgcgtgtcgctcgtgtgtggatggagggcgccgctcggtcggatttacgggcaaaatttttgtgtgacaaaaggaaaattgtgaatattttaattagtaaagatatgctgttgttatttattgttgattggtacgataatttctttgtgtgtctatatagacttgatgtgatgccacatcatcaaaaccgatatttgtttgtttgagtcaaaggatgaaattaatgacaatggttttgagagttttgagagttaacagaccaacagtaatcggtttgaatgctaagcatgaaaatgggtaaataaaaaaaatcatatcaacgataaaaagtaacatttttcttataaaggcacccgtaatgttatataaaactaggtagtatacttggtattaagtactgtggaactggtacataacataccgtatagtagcactattaccagaaacaaggagataaattatgtatgtacagtctctcacacaaaaagtaaataaagcaagtggtagttctctgacagaaaaagtaaataaggcaagtgattgttgcttctatgggcctcaacttattggcatcttgcagaagtaagcaatgtggagtgtgtctattcctactacccatgtcgacaatgtacgtaatgtacgttgttgatgccctaagttataaagggtccttttggagagcttcaagttctaaatttaatttcaagagctaagtccaaagttgatttgtaattaatttgtaaaatagcctgaaccctgctctacctttctagtttattttgtaagatctatcatcctagcttgttacgctattcttttttatgctaaaaccgtttagttacacttcagcttcaagagagatggagctaaagctgaaatttcatcaaataggcccaaaggaaagagactcattttacgactcctatcttttagagaagtttggaaaataatgctatatttcaaaattgccctatattcaaaccttaaactaataaaactatttatatctcatttatagagttggcgttcacatagaagttttgcagattttttctgttaaccccaatgaccatgggtaactaccagtattcacgatgctttgtcactatgtatatactgtatcacgcatggtcacacacacatggcacaaacatgtgtgtgacgaataacgactgaccttgtgaagcatgacaagccgcaggtcactcccaaccatccatctcatctggtttttcatagcattttaagcatattatcacataattaagcaaaagattgaggtggatagagagttaatgaagtgagagaaaagatgaggtaactatttctcatgtaagaagctagttctacacataaaccaagaataaaaacaagaggatagcttccttgcaaaaaaaataaaaaagaggatagctgaacaaaatgagacagaagagaggttattggatgggaatttactatgaagaaaccattcattgagtatatagtttcttcatatagtgtttatataacatggcaagaatataaactacttttgatagtttttgacttgggatttgccctcatcaggtccatttggaattccagtacatagtgagcagtgttgggtagtaattaactagttaaggaagagcacaccgcacaccggtactactatttcaagaaaaaaatggagatcccaaaatctttgttcatccgtatcaaaaattagtttttctatatgttttgaaagaccataaaaaagctaagtgaaattaagaagattgctagacggatattcaattttcctttttgtttctttctttgtgtgtgggggtaggggagagagaagagaggataatagatatttttaaatgtcacaccgtgcattggcaaaatatacttacaattactataacttctagggtaggccgccagttcctcccaaaggctaggtacatagcacccctaccgtatggcaccactaccaaatcaattttttggacgagacttcctataggttgcacatggaccataactgctcccacatataaaaatcgctcttcacgggatcgattcaaggcatcgcgggtagccgcttaagagacccgcctgtgaaaatagatttattttcgcaggagcgcctcttaagcgactgcatgtgataatgcattttcgcatgtgggcctcttaaaggcctgcctacaagtatgtctaaccgtccacctcttttccctctcaacatcttcaaacttttccaaggcaccttctccctcacctcctcacttccttatccttaccttctcacgtccgctcctccttttatttctcacctatgggactttttacctttgttatcatatgatcctaatggttcatgctattgtatgattcatgaatcgaaaactaatggatctatttcattttcgttaatgaagttgcttctgcgtcccactgcattttcttccttctactcaggggtggatttaatgtagaaatgatgggggccttggaccccagtcaaaattacactccttaggtgtatccctagtagtatgacctatgggcccccactttaattgggaggaaggaccccagtccccaagttttcgttcctttcatcgcaatcgcgcgtgcgtggagaggtcgaacggtcgctccctttctcttattctctcagattccatcaactagcaaatccgcaaattagggattagggaagggaacaggaagcgatcccaccatcgtctcaccccatccgtcgcacttccccgcatgccacagttcatcttcacccgaatcactgcttcctgccttcctcgaccgcttgtcatcgtcagcgccttagcctcagcggcactgctcgttctctcctctctgcctccctggtacgcactcatctccttgaccctctcctccctttcgtgctgtcaatggttatagtggatggatccataggtctccctcctcatgtgctctatctaattagccttcccaagatttggtaggtgagataatgaacaattttttttattaaaaatccagcagctatgaacaccaccggagaaagttctagtgcaaatgcatctggaccaatactgagaaaaatctggagtgcctcaaccaattgatatggacaagtttcctcaggatacagtaaaaggaagagagtggcagttatcatcccaacatgaagacataagaaaatattagacacgatcactaatgatgtgattgtccatcgtttccataaaatgaaacaccgtcgtgaaaagggtaaaaaggatgccatgtactatatttataaacattatttcttatctatatatactactttcagtaatatttatatggcttgtgttaacttatgttatttctatagacaatgacattatttgaaaggtctatctatatattactattaaagataatgtaatatctcaaagtttttagaagctgcaataaggtaagtttcacttggctttctaactattctataagttatatagatgcatgtccccagtcatttttttatcctgtgtccgcccctgcttctacttgcattcttattcctccatcctatcacgatctggctccaactagcattcaggtgattgcttacgacatatttagtcatttccatccttccaaattgcagtgaaaacagagaataaggaatcaccaatgcttgaaccattcatatgcttaacacataattcaagtccgtcaaaaccgtacgaagttttctaataacacctcacaaataccgctgatactttatcccatctttacctgtttagtatcaactttctaaatacaaacttcgcatgttcatcataaaccatgaaacctatcacagtggtcatgaaattaataaaaaaattcctaacacataaaaatttcttatcatatgatatttcttcacaaatatgaaatagttgagctagttgcactgcatgccacaccaaaaagccaggcgtggcaaacaccagctaccacgctaaggagccggccggaacaggtagttgtgccacgtcagggactaattaaccttgtcaatggcaacgactgccacggggcaccctttaatttgcgacaccatgaccaatggcgcggtagctcagattggccacgccggttaccatggtgtggcgaaagggttcattttagaaataagttcctgggaggtctattattaaaactaggaaggtagcccgcgcgaatgcgtgggcatgcgttttatacactatgtttgagacagttataagagcgaaatatcaaccgtaaaacatctaccatgatttcttcgtaaattgttttcgtcgacattaattgcttttttaattttctaacctattagctttatattataggagtatcatatttacctgatatttataagcaattatttataatcttcttcatcatttgaaaagaagaaggtagacttattttctttagaaaacatgtcaacaaaaagtaagtgtaaggtaaaactaaggtatttttctttttttcaattgcatatgtattatcatggtttattcgatgatgaattgggtgagacatgaagctccactaaatatatgggtttatatagcctaatatgattgatgtagtttgagagttagtcaatctatgaacatttcatgtagagtgggtaagaggttccacgcaagctaacttgcatacgataacgatgaaatataattgtacaataatatttttgaaatgtgacatactatgaatacacacttgtgtttccttttataagatagttctaacggttagaaataatggttctactggtttaaaagatataggagtactccaagaatgtagcttaaaaattatggttgttttaatatccaatattattacgaagtgaacgtagctcaaccggttaggttccttgtgatggaacttgcccgagttcagacttcacaaattcttttagtggtaggcaacgtacccgtcgatagcgagacgtacgtggtgacttcgtcaatctcaaaatatatcaggctagtctcttgaaagtactcaaaggggtatttgcatgtgtgcgttcacagaagtaattgtgcgcgttgtgagcgcccgcgtttgtactttgtttcaaaaaaaatatcaaacattacttattatttctcttttatttaatagataaaataatagggaggggatgacagtgttgtgtacatgtgagggtgaggcggtggagattatatttttttaacttttttaaataatttaagtgaaagccaatgacgaggtgtttcatttttttctaagaatttctaaggtttttccgtttttataggacgtgacacacggtgacttaagattttttctaaaaaatagatttaatggttaaaaataatggatacatcaaattaaattgatttttcttataatttaattacaagatctaatctattggtttattatagatctagatttacatgcatatatatacttccgtatattatgtagtattgtattttatcttttttatattatacaaaatcctatttttagaccgtagtttttttcacggatactaagtacgcttttttttttgctttattttatcgtagatagatgtctatttttttcttccagctaacagtaggtagctttatatgtttttttaaaaggtagtagctatatttatagcgccatatttttcaccaaaaaaatagtaaaataaaatagtcggtatgtatttacattgtaattccctaaattatatatgtaattttagtgtatttataatgtaagtctcaaaattagatatgtaaatcttaaatttatatactaattatatatataaatggggtgtaactacggtgtaaattcgtataaatatataaataattattaattttacgacggaggtgaagtgctaatgagtttagagcttgattaggtgcatttggttctttcgcataagctgtaagatgggatgcagcctgcaagtgcttgaaacgaatcttaccggacgatctcacggttaaaacatccgactgtacacaaatttagcaataccgtttaacgtagggacatttatttttctttccttttcccagccaccggttgcatatgtttttttaaggaaaaactatcaccttttttaataatagatctaatctaatggtctaaataaacgggtccaccaatttaagtgaaaatcgacgatgagattagatagtgccacgtggcggcctaggagcgtttgtaggagtcccacgtggcggcttgagagcgtttgtaggaagtttcatggacttttagtatataatagaaatagatagatagatagatagatagatagattatttattaaaaaggtctaaaatataaaagttttccccaaggggtggttgtcttgtatcgttatgtgtagtgtcccacatgggattttctggtactgctactgattaggaggatgctattgtacgagattccattaaaacggtatgatacttggtaggtaggaggtctgatacctacgtactacggcctccgggcatgataccacataggtatcagctggtactatttggtattagttggtcctgtgtgttacaatgcatgacaccttcaataccacatattcccagttgatacttggttggtatcaggctagatccctgcataaagcacgtcggcacaagcaaggaggctttcgaacaaggacaaagctctggcaacactggctatatgacgccttgtgcttcagtgccgctagcttgtttgcaggaactcgctgccgcgctcctctgtatcaaccagttgttggcgaaaatcgagcgctagacctgctacgagctccttcggaaaacagaggccgacaacctcctagagctgctcctccaccgccgagtcaatgacctgctggacaagcccctccaccacatggcgcatgaatagtgaatgcatgcggtaatcaacagtttgcagcggttcagcacgcgtcgagtcgcgcgagcgcataccgtgcgcaacaccgatagtgaagatgggatcccgtccaatagaccaatagcttttttcctattaaattatagatttttaattaaaaaaattaacctgccttctgtcagcgcttagaacgggcaatcggctccagtaggtcactaaggacaacttaaaactaataagaaatatccccacttgagaatcggataaggaatctgtagcacttcagaaatgagcatgctgattttgcattagagtactagaacttaatatatgagactattgatagaacttgtgaggagcgacatattcactgcccggccagcgcgggcagctgctcgggctctgcgtgtgccaccaatggtgatcgagtgattgctttgcattaaaatccaacgatttttttacttcgtagacataattagaagcatcggtactggcagctagccatgcaagcagtactgttgcacgatgcaattaggcctagccagacttgactgcttcacaatggatgacaatgatccattcaagtataatatggcatacgtccgttttaatttatattaaaatcaacgtagtttttcaactagtgaaaaattatatgcatattaaactaaactatgcttttattagaaaattgttctgccttcgattggtagtaaaatgagcacataaacattatataagcgggtagcagttttatcttttcatttacaatttgcccaccccttcaaaaaattctagctctgccactgcttgtgagaaatgtacttggaatgtgatattgcgcatcaactttgacagagttcctacaaaccaggagtttctaccggtttcgtggtcaaccctctggctctgtatgactcgtatagtagcaaaatactactccgttgtatggacttatcgattccagcaaaaacagaataccgtaggagttcacttccctaagcctcccagacctaaaggcctttttctgactggttggtgtttgtttttaaactccagtgtccttagcggtttaatgccaagtgaccatcgactagaggacattactgatgagtcccgattgtagtgtaatgcctggcaatagaacatgtttgccaattctctgcaaattaatgttgttgaattagtaaaaaaaaaaaaaggtgtacagtgttatttacaggatgaagctcttgggctgatgagcttgtaggatcaagatcagatgagcattgcagatcaaacccttcaaatggactaccccccatggcctagggaccaaatgaactgtaatcacaaattaaggtataagtagggttttggtttggagtttgtttgtctttctccatgtcagcttgggctttatattcctagtcaataaataaatatgtactaaaaacatcctagtaaatcctactataagtatactccattggtcgtatcttgctgataccaatcctccaaaatatcccatgtatccatgggacaaccaaccataaacccctctaggtttgggaggcttggggaagtgaatggctgaccacaatagtttagcattttcttggttttaataccaagatttatgcaattcttacgaactactccctccattcacaaatgatcaacatatatggcttgtgcagtgataccaatacattctcacatgccacttaaactcttaaactgatatagatcaacttgcagcaccgttttgtgtgtcctgcacatgcatcaagggtaatttggaccaatggtattgcttgcatgcatgcatgcaccacaattacaattagttgaatggtacatggaacaatgcatgcaaatgaccatttaataatgcatagaaaaatgacaagtcacatgcaaggaataccaaatatgttgatcatttttcaataacattgaaaaacttatatgatgatcatttacgaatggaggaagtattgatttgcccacaacttggcatcgcttctgcaaacgagaagagtagtgcaaaacgaccagcagtagtacattaaaagccaacatagtgaccaaatctaacactataggtgatgaatttactgtagatgatatcctagcgtgtaggaacactcctatgtttgagctgaaatacttgttat

SEQ ID NO: 60073 - DNA, 32819 bp, Oryza sativa
  unsure (1)..(32819): unsure at all n locations
caagttttggttcttgacccgtctctgattcctgatgtggtggatgtggttattggtgatcacttgtatgagctgtcttttagagtagaacctgaaaataggcctgaggagcctgtgcctatggagatggagaatttggatgatggggatttggaaaagaaaaaagaggggaacatgaatcaggatctggggaagggggctggtttatttgattcaggtaacagctctaagatgggttctggtggtcaatttagtgagaggggtggtccttctgctccctcttctcagctaaatctgatacctgaatctgatgacttgactgtttctgatgaagaatttgatggtttagatgaggagactataatggttgacaaggcccagattcaggaaagtcttgtggcaaagctctctgctatccctgaggcagtaatctctccatcaaggaagagtaagagaagggcaagtgatagcgattagcttgttcttgaaagggccgaaaagttgaaggctgataagaacttggagaacctgcaggctaaaggtaattcagttaataatgtttcttttacacaattttcaaatgatcaaatatctgcacatcttcataatcttggtgttataccttctagtaaaaatgttgttttagatgatgtaattaatgatttgaaatgtgtagaaaataataggataagcggatgtgcttgttcttctattaatcaagtttgtacccctaatgttgatactgagtcattagatgaccagttggaggataattttttactacaacatttatgtagtgaaattatggaagaggtcatggattttagcgaggactgtgagaatagtcttaaaaacactttaaatcctatggcatcttctcctaactctaagaaaaagagtaaaagggggaaaaataagaaaaataataaaaatagtttcaaatgaagggaatcttttggaattgtgatgggtttaaggacccaaaaaaacataagtttatttctgacttgaccaaggaacatcagcttgactttatagcattgtctgagacggttaagaaagaatttactccagctgcacttaaaaatctttgtgctggtaaggagtttttgtggcattgtaaacctcccagaggtaggtctgggggtcttctgttaggcatcaatttactaaacgttgatattggtttaattgatgaaggtgatttttatattaagttccaattatgtaacaaagttgataagttcaagtgggctttagttttagtttatggaccggcacaaaatgaacttaaggatcaatttcttgctgaattagttaatttgtgcagtcatgaatccctaccaattctcattggtggtgattttaatattttacgtagccctgatgaaaaaaataatgacagttacgatgatagatggccctttctttttaatgctattattgagggactgtgtcttagggagttacaaatgtcaggtaggatttatacttgggcaaataacttagcaaatccaacttatgagaaacttgataggattttgatgtccactgagtgggaacataaatttcctttatcctcggtggttgctcttaatagagatatttcggatcatactccacttcttttaaatacaaactccaccttttcaggtaatgcacaacatagttttaaattcgaacttggttggttattacgtgatggctttgtagatatggtaaaggaggtctggtctagtgtacatgagggtaatactcctatggagcaatggcaggcgaagattcgccgattaagacggcatttgagaggatggtgtcgacgtttgatgtcacgactacggtatttggacagtatggggatcgttggtgctaggatatacgcgagactgaggtaaaagagatggagacagggatttttatacaggttcggacccctgagttgtcaggtaataaccctacatcctgttggccggagtcggagttgcttttattcaccataatcacaccagtacaatatgtggggtagcctatctaactgttgtcgacatgtcggtctgaagatctgactcgtagtcgacaacagggtagccttcctcctcgaatccgtgcccggcgaggtcagagatagtgctttcgtctctcctgacggtatccggagacaccgtaggggaatagccatgcctatccctgaagtcgatatccagcggcgtgtcttggcgtatgtaggcttgtatgttgtggcttctggtgggtgtatgttgattgtcatgggtgtcttccatggtggttcctctcccctgtcctcctaggggggcttgtatttatacccataggtgtccccttgtccgagtagaactagggaaaccaatatggatacaatccgagtagtccttgtcgtttcaatgtagaactctggttgtctttccttatccggaactccctcctatatccgtaggttgtttccgtataggacatggtatgtggtgggtcctgccgagatttagtcaactactattaggtatgtggtatccataaccataacagatgggataaacatacaagtggtatgtataaaaaacaaaaaagggagattttggataggttggatttgttggataaaaaggctgaatctattcttctaactcaggaggaaattgattttagatggttttgtaggaatagattatctactcttatgagagaagaagaaattaagtggtattaaagggctaaaactaaggatattttggagggtgattcaaatacaaagtattttcatttggttgctaacggcaaacataaaaaaaccagaatttttcaacttcaagatggggatcaattgataaatggtgatgcaaatctaaaatcacatattaccacttattataaaggcctctttggtcttcctgatgattctgatctccagtttgatgaaaataattttgtggatatcccacaagtatctcaattagagaatgaagctttaatacaagaattcactgaaaagaaattaaagaggctattttccaaatggaacataataaagctccgagtcctgatggatttcctgctgagttttatcaggtcttttgggatgtcattaaggatgatatgttggatcttttcagatattttcataatggtactttgcctttattctcccttaactttggtactattattcttttgcctaagtgtgatgaggccatgaaaattcaacaatataggcctatcttcttacttaatgttagttttaagatctttaccaaagttgctacgaatagaataatgagtgttgctcaaaaagtgattagccctactcaaactgcttttatacctaggagaaatattatggaaggtgttgttattttgcatgaaactatgcatgaattacatcgcaaaaataaaagtgctgtgatttttaagatcgattttgaaaaagcctatgacaaggttaaatggtcttttgtacaacagacgctcagaatgaaaggtttctctcctaaatggtgtgagtggataacttcttttattcaagggggacatgttggtattagagtaaatgatcagaccggtaataattttcaaacttacaaaggtctaaggcaaggagatcctttatctccaattctttttaatatagtagcagatatgcttaccttattaattaagagggctaaagatgctggttcattgaatagggtagtccctcacctagtggatgatggtttatctattttacagtatgcagatgataccatcatatgtttggaacatgacttacaacaagcgaagaatcttaaattgattttatctgtgtttgaaaagttgtctgtcttgaaaataaattttcataagagtgaattattttgttttggtcaggcaaaggaatattatgatgagtattctaacatctttggttgtaagtttggctctccctgttaaatatcttggtataccaatgcatgttagaaaactgaataatagagattggaaaatgattgagaaaagaattgagaaaaaacttagtagttggaaaggaaaacatttatctgttgggggtagactggttttgattaactctgtactttcaagtttagctatgtttatgatatctttttttgagataccaaaggggttcttcaaaaaattgattattataaatcacggttcttttggcaaggagatgaccataaaaaaaagtatagacttactagatgggatatcatttgtcaacctaaggatcaggaaggtttaggggttcataacttggaaatacaaaacaagtgtctcttgagtaagtggttgtttaagttgattaacgaggaaagtgtatggcaaaatctattgaagagaaagtatctctacaatcagtctataacccaagtgaataagaaacagggcggttctcatttttggtcaggtctcatgaaagtcaaagataccttcttagatatgggttcttggattgtaaataatgagaaacaaataaggttctgggaagataaatggctaggaaacctggcttttaaagacaaatatccatctttatactctattgtccgaaggaaaagttctactattgctaatgttatgagatctgttccactcaatgtttcctttaggagatcattagttggtcagaatcttgcatattggcatgaattgtgtgcttctattgtacatattcaattgaatcaatcctctgatagctttagatggaattatcatcagaatggaatattttctattaggtcgatgtatctagctttaattaataatggttatatttagagaaacaagattatttggaagcttaagatgccacttaagattaagatttttatgtggtacttgcttaaaggggttgtgctaaccaaggataatttggcaagacgaaattggaatggcagtttaagatattttttaatgaaaaatgagactattcaacatctttttatagagtgtcattatgcaaaatttgtttggagagcagtacagttctctcttggtttataccttcctactaccatatctaatatatttgatggttggctcttgggggtagacaagaagaagagtaaactcatacttgtaggagcttctgccatatgttgggctctgtggttgactaggaatgatatggtttttgacaaatcaccatctatctcatatatgcaggtaattttcagggcaacatattggctccgattttgggcacagctgcaaatgtgtgaagatgatcgagagcttatgaaggttgcatgtcgtagacttgagacaacggtcatgcaactccttgcaaactatggatggagattcacaaatagacttgaataaatgtgctctccttatcttagtttgatcttttattttgttgggtgtgtttaattcatttgaactacactcagtgtttgggtgttacttttataataattggctgtaactctgatgagtaaaggccgggatgttttatttcattatctaaaaaaaccaagggttaataaacctagaacaagttggtgactattagagtgttgacaatataaaattagttatattattaaatttaacatttaacatatatttataatatgtttgttccgtattgaaaatattaatatatttttctacaaacttagttaaacgtataaaattttgactaagaaaatattcaaaagatttttaatatgaaatggagcaagcatgagagagtttatcagttcagacaaagaaaaaaaggaaaaaaaaacattgttcagtcggcggccatctccttcctgatgtcgtccaggagatcgtccctgtactcggcgaacgtgccgtcgtacggcctcaccgtgccgtcctgcaccacccacagcgcgctcctctcctcgtcgtcgcagacgcgggacaccagcctcgagtcatggctgacgatgaccacgccgccggcgaactcgtcgagcgcgtccgccagcgcgtcgatgttctgcnnnnnnnnnnnnnnnnnnnnnnnnnnnnnnnncaacacgtgcggctccccgagcgcgacggaggcgagcgcgacgcgggccttctgcccgccggagagcttgccgatggtggtgaggtggctctccttggccagcccgaacctggcgagcttggcgcgcgcctcccatggcttgctcttcaggtggggatgcgtgtcgagacactctcggtgacattctggtgacattgagtcactgacatgtgggtcatgggggaatgtcactgaatctacgtccgtgctgcacggggctcttctcctccggcagcgcgtcgcagaagtgctgcgagtagagcccgatcctcagcttggggttcctcctcgcctcgccgctcgtcggcgtgagctcgccggcgaggagcttgaggagggtggatttccctgccccgttggggccgacgacggcgacgcgctgccccatggagacgtcggcgtcgatggcggacagctggaatccgccgcgggtgaacccggcctcggcgaggcggaggaggggcccgccgccggcgagctcggtgggcgcggcgaagtggaactcgacggtgtagtcgtgccacttcttgggcgccctccggccgctcttccgcgccgccttggccagcctctcgctctccttcatggccttggccttcttctgctcgtagctgccgacgaaggagtcgaagccgccgcggtaggcgtgcagcttcttgtcctggaggtgcacgacctcgtcgcagatggcgttgaggaagccctcctcgtgggagacgacgacgagggtgctcttgcactgcgcggtaaggtactcctccagccacaggacggcgcggaggtcgaggtggttggtgggctcgtcgaggaggaggagcgttggctgcatgaagagcgcgccggcgagcgcgatgcgcttgatccagccgccgctgaaggagctcgccggccgcgcctggctcgcctggtcgaaccccagcccggcgaggatcttggccgcgcgcgccggggcggtgtcccagccacgctgcgtgagctcctcgtacacctcggcgagccgggcgccgttggcggcggcggcggcggaggaggcctcgagctggtcacgctcggcgcgcagcgtggcgagctcctcgtcggcggcgagcaccacctcgatcaccgggcgggggtcgcggttgtcgtcctcctgcaccacgagcgtgacgcggatgccgcgcggcaccgggagcttcctccagtggaggagcttgagcagggtggtcttccccttgccgttgggcccgacgaggccgtaccgccgcccgtgcgcgacgcgcagcgacgcgccctcgaacagcgccaccccctgcacccacacgtcggagtcctccacgacgacgtccctcacgttgtcagtcgcggcgtccgcggtgccggcggcgccgcgtcccaggacgcggccgccgatggtgacgacgtacgagtcagggtcgtcccagagattcgccgccgccgccgccgcctcgtgcttgcgccgctcctccttcttcttcgtcttcacctccttgcgctgcggcggcggcggcggcgcggcggcgttgacgtcgaccggcgcgaacgacgccgccctcggcgtggcagcgccagcgagctcgtcatcgtcgtcgtcgtcggaagggggggagatcgatcccagctaggtacgacgagggctcggagttcttcgtgggcctcgatctaccggccttcgccttggaatccggcggcgcggcggcggaggggttgggcttgcgggcggcgtgtaccttgtgcaccattgtttcgatcgtaagttcgtcggttttcctttcggctcggacttcgggggatttcgcggggctcggcttttggtgttcgccttgtctgtccctactatatctaccgtctcgcctattcagattcgtaacgagtcttctctgattggattcaccaaactgcttcttcacggtaagacggttatcggtttcatgaattgagaaaaaggttatcgcaagtgatcaagagcggaggcaagcctatgacaactagggcttacagcccaagccctagggttgtcttcaaaatcatgtataaattgttttaaatcaccatgtagttttaaaaaaaaatcaacaacttattagttgagccttagcctagccatactctttaataatttctagcttcgccgctgcacgcgataatagtgatacccgcatgataaccgggcggttttgtaaaccttgctgtgtcgctataatttaagaaagtggaaccgatggattatatataggtttgggctactggattgcgcgcacttgggccagcctgagccttcttcgttgggccattggcggatttgggcccattacggatttgtaatgggccggtggaaagcccaaaaacgtgaggtgtccttcactccgaccgttacagataagccccagcgccgtacgagacggcacaacacgacggccgctcgccgatcacacgctgacgcgcacacaccggcgatttctcagccgcaatcgccatggccaccgccaccgccacctccctcgcctcctccgccgcgcaccgccgcctcccgccctcgcgctcagccgctagctccatcctgagagcccccaaccggggccgcctctgccccggctccccgtcggtgctccgcgcgtcgtcctcgtctccgtcgtctccccagcccaccgccggcggtgatgagggggaggaggaggaggaggggcggaggctgtcgaagcagtcgtcgtgggaggcgaaggactccgagggggatgactacctctaccgcctcgggaaggaggccgacaacatgaacatcgccgtcggcgcgcggagcggcatcgtcgacgacctcttcgtcggcaacttcctcggcaaagactgtacgcgctccagcacttggatgccccgttcgatccaaataccatcttataataaaatgtcctgaattgtttggttcctgaacatgagattctgtatactaacttcagcagtagacgatctttccttggttacagctctatatatatagttacttgtgaaatgtgtttgcagcggatattgtgttcgattaccggcagaaagcgaccaggacgtttgagtacctgcaaggagattattacatcgcacccctcttccttgtgagtgtaattttagttcatcttcagctgatctttttttttttactgcatcctcgtacttttatgctgttctaggtacctgattgacaaagatttgacactgcagattcgttgtggtgcaggataaagttggtaagcaatttaatgtaggaggaagcacattgttataatcaggtatctcactcttacagtttgaagagactacatctttcgtttcacctgcataaacagtggctactgaagtatcagtgtccttctgtataagaaactgaacaagttatacaaaggtgtaacagttgccgaataagcttaccaccatataccaacagtccctagaggcctagactgaatatatatatttttgggtcaaactatcaaataatggcatgcaatgttggcagcatgtgaaatatatgcaaatcttacatttacattaattgtgattatgctaaactcttccttaataatatcttgaacttttatatggtatatattcttgtggctatagtgtgcatgacaaatttattttattctttttctccaggcacacatactaaaaggactgcttgatgtttgcagcatgtcatattgtgaagaactaccttgcacatattcttactatcaagattccccttatacttggtagtgcacttctctttgtttctctctgtgtaattgggatatgaaataatacatggttgtagttcaatattattctttagttcgttttcaatatttttgaggaacattgcacaatgcaggaatctggggtggaaaaggccaagggaaaacattccagactgaacttatatttagagcaatgggtgttgaacctgttattatgtctgctggagaactagaatctgagaaagcaggtcaaagacacttgaatttgtgcttactgtttacatgctttatgtactctgctatattttgcaaggttgctatcaatgtggtgctccgtagatcatcaaagggtctcacgttcattagtttctcatgtgtgtttctgctattgttgcaggagaacctgggaggcttatacgtgaccgatacaggacggcttctcaagtaattcaaaaccaagtaagcaggtgttttcggctactcagtttcagatatgtaccttcaaattcagttctcagttttgagcacaaaacaaaataatgtctcaatttttaaaacttgagtgttatttcacctgtttgagttttttttttttggtatgtgtggaaagctccagtatctgactagcttcgtaattgacacttgaaatcataaaaaaagattgtcgaaaattctattactactgtcactcagttctgaatatggcaaaaatgctccttacatattttagttttctattaccatcttttcaaacagctgattcaatatttggtgtttcctttttcttttttatacatcaagatagcgcaaatgttcctgaatgacttgatgcttgtccgttatgagaaatacaagtgctctcaactctgtagtgctttactcttctgtgttattactgtattatcatgataaagttaacagattaatgatgcctgtgggttttgttaattttcagtttacttcaatgattcctgttttcacaatttttttcatggtataggggaaaatgagtgttttgatgatcaatgacctagatgctggtgttggaagatttggtaagttttgtaaacatattttgtatggtaattgttgatcacagtgacctaggatattttgtttatgcttcctttttgagagcctgtcaacaatactacaatagtgtattcatctggtgtattaattattttccaaatattcttcagaagaagagcaccttttgtaggaagagatggatcttagagttttatttttcatcgaacatatggtgatttctttttgacagcaaactaagtgctatatatcaccgttgttttcaggtaacacacaaatgacagtaaataatcaaattgtgattggaactttaatgaacttggcggataatccaaccagggttagcattggccagaaatggagagaatctgatgtaacacacagagtgccaataatagttaccggaaatgatttttcgacactgtatgctcccttgattcgtgatgggaggatggaaaagttctattggtatgttcgttcttgcatctgaataaattttgttgcaacaaagtacagactgaattttatttgcaacaactagtcggatttaatttggcaaaaaaacttcaaagaatgatacttgaatgtgatatgtgattaataggcagcctggccgtgaagatataattaacattgttcaccgcatgtatataaaggatggtttgtctttcgaggatgtatcaaaagttgtagacacttttccaaaccaaggtaaccatttctccagaactgtaatttcattttgcagcatatgaaacaaggtctatgtttctttttatacaaacatacttagatgatatgtagggaaaagaaaaatagaagaggaactagaacagtaacatagccatcattccctcaagcaaaatacctattctttttttccttttctcaaacttcattattttccttgttcagttgctggtggaaactagttattattattatttagcatagaaagtatccatttttcaactacatttgaaaagtatattcaagagcgaactcaacccactgcagctctggacttttatggagctttgagatccaggacatacgatcgggcaatcttgcaggtacctgtgttgatttaggacagagttcgcaattctattttccagttcgttttagaaaaaaaattcacctgattttttgtatgtgaaacaatgtcatgtctgttactctgtttagttgttgaagatgtacttttttgcaaatactgttgaagatgtactggtgtgcaccaaacagcgtgtatggagacagcgtgcaccaaacaacttgacaagcagacaatttttttccaaaaagttttaacagttgtatttccgataaatgtaccattagggtagtagttactgtattgtacttcagacatacttttctgtaaactggaaatctcctgggtgcagtgggtagaagagattggtggtcatgaacaactaaatgaaaagcttctcaagcgaaagaaaggagaggagcttccaacatttattcctccaaaggtattcagtttttcaggccacataactggcttgcgttgtactgagatttctttgtcataatcagtttgctaaatgtctttccctaaaaaaaaagtctgctaaatgtcaaaacagcaagctcacatactgattcttcattactctactgaatatcatctaagtagtaattgttgtttctttcattgatatgtataatatcctgatgttattttgttcatcagaccactgtagatgcgttgattgaatctggggactctctggtgaaagagcaagaactgataatgaattcgaaactgtcaaaagaatatatgaagaatttagatgattagttcaaaacaaaaggtctaatagagaaagtactcgaggtgcctatctcaacccgattttgtatatttttgcatctctgaaaactgcacctttctttctctctctctttggtgcccctgcatcctacattctacagaacagttgcatgtgcaagtatacgatagtgtataaaagaacatgaaaaggtatacaagaattttttcggctgtgttttatgtattttagatatctttatataatcgtttgtacaatggtttgcaactctgaactatatataatgaacttcatatattatagtgaacttcagacagtgtttcgctttcagaagttgcccacaatatgtggtttcagatatccacgactggaagaacagatgtcatcgtcgtctagctctcattattgccagaaagttgtctggtactccagtcgacttgatagactttttaggctatggctatggcacaaggatacaaaaatacaaaatggtccatgtattccagtgaaacaaaagtgtccaaatgataagtcttaattactacctccatctcagaatataaaaagttatagagttgaatagggttatcaagaaagtagtaaaattaaatagagcaaggttgtgattggttgagaactgaaggtgctgagaaatttgaatggtggatggttgtaattggttgggaagagaatgttgatgaagaatttgttatatttttagacaaattttaagtgcttaaagagttaaaagtagttatattttgagatggatgaagtatttctctagaaaggatgtacataattactcacgtgatctacttcgtatttacaaaagatgtgcttatatggaacaaagaattcacatgaaaattccatgtccatgctaaggtaggttagagaattcacatgtacgctaaactgaaacccataccaatccttagtgtttgtgtccatcagtggatattttacaagggaaagtaagaaattaaggtaaggcctcctctaaaatgaaggaattttgtcgaaactgaactaatttctatctagaaaaaaccaacttctaggacgaatatgaacaaatgcatatctagattcatccctataagtttaatctttttggaacggatggtgtaagtaatatatagacaactcaaataatatgttgtctatatattatttgatagttaaagatagttatattttaagacgacgccattccttatgtcctatataaaggagtctaatcccatcaattaaatagaaataacaaagaaatggaaaacaaaaaacaaaatccagttttgcaccatgtgtccattcggcgggaggagatgcctgcctgcctgccaaagtgccaatatccttatgaaaaatactataagtacgactaaatttgtccgactttagaacaaccttaacgccgtgagcttgtgacgttaatctccgtataaccaagccatgttgtcaccatactcagtcacgtattgagttgttttaccgtttgatcgtacgctggtcggacataccagtcgtacgtatagtattgttctattcttatcttggaatactaaacactagcaatactcgatttaagattattcacgcgggtattactagcatcgaggggccgcaaccgcaattacaaatgggctgctggcgctgccgccgaggcaacgtggagcgcagccaacgcgattaggtggcatcatctcatatcacatcacatcatatctcatatcccctcgctacataaaagaaaccaaacactcactctctcctgatcttactctgctaccgctattccctccctatctgtctcctctctctctctctctccttgtgactgtcagtagtccgtcgatcgccggcgactagccggccggccgccggcggcgtcgatccatggagtggtggcagagggcggtcgtcgtgccggtcaagcgcgcctgggtcgtcgtcgccgcccggctgcgtcgcaagaaacaatacggtaagttatccattaattctactgaatctttttttcctggttcatgtcttcatgagagaagaatcgaattgtttctgataaaattcgccgtcatgaagcattctgatcttctcctttttcatcgttctgcattaaaacaaaaatcacggtgggatggtaattaccgctgaatgcaatggggagacgaagtctgaatatatttgaaaatgtttttcatcccaaacatgggaaatcgcacctttaataataattaaattagtcaaatctgttcttcgcccaaaaactgaatgcatgtacacgtatggagccgaagcaaatagccaaatacacgtcgttgggggacacgtacgcgtggcggccgtcgtcgtcgtcttctgagcaacatgccaagccacgcaatctgcatcctagtacacaacagtagtgcagtataagatcagatgcatgcgtgcaaaatgtagaaattatctgaaactctgcgtgttatttttcttaattcgagcgagaaaaaaaagagagattgttttcgtgtcacgtggctgcatgtcggttgtcgtacgcctcactgggttccactccacacaaacatcactagtagactactgctgcagtactcatcagcatcactagctaagctatattggttttcgtctgcttcttctgctcgatctccacgtgtggaaattaatcaaagcgtgcctgtttatgcttgtaagatagtactgtcatgataatcttatttgctctgacattaggaatgtagacatacattgattataattactccctccatttaaaaaatataattggcttaacctatgaacctggacatgctcatagccagaaattcatttgttttaaaggacaatgttcatgagattgatcaaatcaataaaggtttctcggttccaaaataaacaaactcagtataaaactaaaacgtgagatgggggagtaggagtaggaggcgaaatggcacatagtgtagttgcacagtgatctgagtagcattttaagatcctgagattaaaatcttcgtaggagtgaatttcagattgagttatttgagagactaaggctgtgttcggaggagggggttgggaacccctcctcgacggcacgcaaaacgaagttcgttttattgcatgattaattaagtattaactatttttttaaaaaaatggattaatatgatttttttaaacaactttcatatagtaagttttttttttgcataaatcacaccatttagcagtttgataaaggtgcacacgaaaaacgagagaggtgggttgggaaaatgagggaagaacacagcctaagttccccatttaaaagactgtaaatattcggttagatgtggagaccgagtaaaaaaatacccttctaaacaaataataaaaaaaggaggttgtcaagcagcggcgcttaaacctggaatttatcaggcaaataaagtaatggacagcaactggcacttcttgacatctagtttgtgatgagatatttcagtgtcgtattatctacctccatgtcataaggaatgcatatatataattaaattacacgtagacatatactatacatatgggttggtacttggtagaggaaccagccaaattaggcagcgagtgagtgacatctgcatgcagtatatactctcaccaaccaaccgcccctgctctgctcactctctcggcaatttggacggacactcatctctgctcatgcttaattgccttctagaagcgtcgacgtggcatgcttatgcacttacatttcgtcctggccatgattaatccaggatacgcatgcccgattagtcataactatctgcagactggctgtgttgtcaccatgtttgtgctcattcaggtacaaaagtgattagctgccattgcatacttgccttctgctcttgctaattgctatatacatatacttcgttataaaaatataagaatttttaatttgtttagtaaaaacttaggttgataaaataaataatttctttcggtcataccattagtggtcaaattttgaattgtttaggttggattttcgtacattaaaattagtattctagaaatatttgtataaaatttgaatcctactatagtttgaaacggagagtgtgatgataccatgatatgttcaggcttctgggtacacacgtgtagggtgtcgaccgccgatctagctagcgacctcttgctatttgacaacagtgctaactgacagtgattgattagctttgatcgactttttaattgtgcaacgtcacccatgcatgcatttgtttagtctagctatcatattgtgctactaccacatgactaggtaaaccgcttacttatttctcatgccgatcgacgaggtacgcgtcgcattgtggacgcatgtatacgatgcgttcatgcagtgtcatcctaatccattacgtcattgacaagcaatgaaattaattaaggacatgcttaattaccttaattagcctctagatagcaccgtattaatgatgagtatgtcaggtgtttgtgtatgcatggagcacgtgcggtatcaattcgctcttggattttcatcagtataaaaataggatttgctttctgcatggatccaattctgcagtcggctaaccacccaatcatacatatagacagcatcacatattcattttttgcaggaaaaaaaaagaaattatagacaagaattatgactggttattagctcatctagattctcaagattcagaattccttcagagcttgtgtgttatcaagttctgcagtttcaacaaattggacttgagaattgacactaagctaccttttctgtaacaatttctaccatggtacatttttttacagctacaaactgtagcaccaatgtactctctccaaattcataaccataaattagtgcttcatttaatttggaacggccgatgaaatgcttatatttttagaatcaggtggaatataatactctctccgtttcaggttataagatgttttaactttagttaaagttaaactgctttaagttttgctttaagtttgatcaattttctagaaaaaaaagtaatattttgacccaagataaatttattataaaaaatatttaattattcatttaataaaactaatttggtaatgtatattactatatttgtctataaacttaatcaaacttagcagtttgactctaatcaaagtcaaaacattttataacctgaaatgaaaaacattttataacctgaaatgtgaatgaagtactacgtaggtagttgaattttgtttgctttgtcagatgggcgcggcgtgctggtgaagctccacgacgacatccagacgtgcgcgtacgaggacgtgcaggtgatgtgggagatcctgcagcgctcggagacggcgaggctggccaccgcgccgccgtcgccggggagcgcccgggcgctcatctggcccggccgcgccgcgccgcctcgccgccgccatcgatgacatggacctgcggcggcggcggcggtgctgagagtgagtgaacatgccattgccgccggccggtcgagcatggccgtctctcagctaaagctccggccagctctctgccattgctaatgcgaatcccctttcttgctgtatagctctagatgcttgcatctttctttacttatgtaaataatatttacagtttcaagagaaagtaccagttttgtattttgctgcagtctttctcttggtttcagaaatcagaactgctatcatcagcctatggggctgtaggcatatcgctctcacactgaaaaaacaaaacaacatattcagttcaggagagggcagtaagcaggctgagaaaacattggagataccttgtaaaaagaaggaaagtaccggataatcaacgatgcatgcaattaaaagatctgcgtagggtatcagagcttgtgtcagccaggtgatctgaatttaggatcaaagaacctgaagtggaggtctaaaactgacatatggtacaatgagcactctgagaagcagctctgcaatcggtgaaatggtagtcatggcggcttctcaatcattttttccattcaaacgaccatatattttgatagtctcgtttcattcatactgttctttccatcagtgtctcagctgccaaccaaatggatgtcagcacaagcataggatagcaaatcaaaatggcattgtagcgtcccagtggctcagtgaatctcgagctgtgctacagagaacaagattttacctatcagagggccagaaataaggttcacaagatgctaaacccaggccgcgtgtatcataacttcaaaggtgacttctaacagttttctggctttctgcttgaaaaaaaaggtgattatgcaactcaacagattatatttaaggatactcaaacgaaactatgttcacaagtaatcagcagaagaaagtacaccagagcaaaaccaaatacaggtatgaattgtccgatccttgagagcaagaagttttgcatgcacccaataatctgcagcaaatatgcacattcttatacatcatattagcacgccatagaagaagttttgcattcacaggcattaagcattaacggaatccagtctaatttcccccaccttatgatgaaaaaaatatcactccaatcaacaaggcaaacagctaaaaaaattaatgacattatgcagaccaacattagggaaaaggaacaactaaaaatggagagacagttcaggcttaccatctacagcttcttgactaatccctccgttccatctggtactaggttcttatattttgggacggagggagtaggtctccttcaaagcaacattagatagaacggaagaggaaattcagacacagcatacttgcaggttgcaacatgtagctgtcattgtcaaaatgcttcctgagatatttctacaaattgcctacacatacagatctgaaagacattcttctccccattcagaatgaatgtggaacaagaaattttagattaaaaaaacaaatatatcataattttcatcaggaacccattcgtttaaggtgataaagtgaggatcacaatgatagtgcacagcttggccataaacatatctacgttttcatatctggagtgaagatggaaacatctacccactcccaagcagacaaacacatcaagggagaggagaggtcttagagatctaacatataactttcaaaaacacagttacaaaagaatttaaataaaattaacgttcaacatccctgaaattagtactgaagatacctagaaaattttggaatcaataatgtacatcctgacctagaaacttacagaacattttcctataagttacaggacagctcttgcattttgctgtcttctgtccccttatgccagatgttacatagaagttgggacttttggatgaacagtctccatctcaggagagctaatgaggtctaagcaacgtcaacggaagatattcttctttatgagggcatttatcaggagaaaagaattggctttctttcgctgcaaatctgacagcagaattctgccttatccccaaatgcgcatcttctgttgcttgactgcagtataatcgcttcagctcaaatgtacattagatgggcaccaaaaacacattggtacaaaaaatctatttgaaatagcactttccatctgtcagtcatgttcttctggtgaacataagcatatcttttaaaggaggactggccagtcctccccgagctgttgaggatttagctgcatagctaccttgaaatcatcaagggagatcaagtggtgatttctgatatcattcgttgctccggatggtccactgcctgattgcatctgaacatgatttggcaaccaaacaccattcatatgttttccatatgcatgctgcttgtacaattccccttttcttgcatcactttgaacattagctcctattaactcaactgatgacctaatcaggttcttcaagtacttgtccaaaccgttattcagaaggtcagcacaatccaatgtgacaccagctaggcccagtgactctgctgttttctccatccgccgatgcaatgcctctgtatttaacaattcacgatgctcacaacagctggtacagtgatcctcacctgcactaattagtggtggtggtaatttccttgccccgcccacactcgctgaacaaaaaggaattccaagtggtgcccgtacagggctattcgatgcttctgcagaatgatccgagacattgctcatgcttcttctcaacttgattatgtttccagttggtgactgctccacacgttggtgctttgccaatggctctgcagattcatgttgaaaatgcactgatctcttgaggtcagaagaacttagggtgccattctctggtactgccgcaccaccgtgagtaatctggctgtgattggcagaagcatctaccctacaactcaggcccgtgcttttcatccgatcttttgactgatgatcttgcattgtgctcatatgccttgacccctgcatctgtaataacctgatgtccccattgcaagaattcaatgcttcgccgggctgacaaaccttcttcactgttgctcccacagacctcccaacatctggtgctggtgttggaggtggacacttcgcatggtaggcgttgtagagaactgagcgtatcagctgattatgcactcggaggttctctctccccaatgtttggaggcacaccttgtcgaaatccgccttgctgagcctattcgacaggtagcccttcaagtagctgaagtacctccttgacctgtcaggaccaagcctcttctccagctgaagcttcacctcgcggagatcgatacggccattctgctgctgcgcctgcggctgcggtggaggagctgatggctgctgctgctgctgctgcggtgcagcgagcggccacgcctcctccctcaccatgtccataaaatcaccaccccggcgaaccccaatatcggattcagagcacagaaaccacgaatcggtgacagcgcgccgcaccaacccagctcggatcaaaccactatggcctccgtcgcctcctgcagagcgcgagcccgtagcccaattcccagctcgccagccatggaggcgatctcatctccgccggaaccacaccaatcgccgcggaagcaaccacccgccccgggagcggtgcggctggcccgaatcaagcatccagggcggcgagtcgtcgggcgggagccaaattggattacccacccaaaccctagcgcaatgggggcatgatcccgaccccggcgagctccgccccgggcccgcgccgcctggatctccggcgaggagggcgaccaaccgcctcccactccacgaccgaatcgaatccgagaaaaacagcaagaattggagctgacctcgccgaggggggcagcaattgggattggcggaatcggattggaggacgccgccgccgccgcgaggaattccgcttctgctgctgctgctgctcccccgcgcgcgccggagtgcgcggattgctgctgctgctgctggtgggggaggtgggagatgggttcttgcttccgtttggtttgcttctctcttctcttcgtgttcgtcttggcttgggctggctggctgtctctcgcttcgtgtttttttttttttggtttggagtttttttttttttggttgggagggttttttttttgggccgttgaattggatttgatcgcggaggcgacccgagagggcgggagggggggggggggggtgcaccgcagcgaagaggggagagccttttggctcccggcctgtctctcctcctctttgcggtatgttgtgtgccagtgtgcgtgtattggtcagtgattagttgctgatctgcttctgcttgtgattattcaatttcgttgtttttgactttttttcaaagttaaaccacttaagtttgtagaaaaaacagtaaaattttcaacggaagataaatgtattatgaaaatatattcaattattaatttaatgaaactaatttgatattgtaaatattactatatttgtctacaaacttagaatagtttgaccttgaccaaagtcaaaccgacttataatctgaaacggagggagtactcatttaaaatatactccctccggtttcataattcttgatgttttggacaaggttaaggtcaaatttttgtaactttgattatcaataactttaaaagtatttagtttaaaaaaactagaacaatatatatagatttgtctttcaaagtattatgagaaaagtaagcatgcatttatttattgtgtatattataatagaaaaataaagtcaaacatatattttggagaccgtatcattgtccaaaacgttaagaattatggaaccgatgagagtaactatttttacaattaatattttatacaaaatataagtattatatgatgcattggatttaatgcacagtagtccaaacatttttagccctagggggagagtaagcaattcaaaattttaccattgtgatgattaaaagagaatattctctcttatatttatttttttatccaacaacatagaaatatatttataggagtgtttaggaacgaagggaatacttgtcacttcaaatacttgtaaccagtaatcaagttgtttcaactttcatcactgataatttttaaatggtcaaattaagatggacgaaagcttaatgtttatatttaaaatgcaacataatttgatataatgcaccttttctaaagtatttatatattgtttgaataaaaatgataaacaatcaaaattcaaatataaataatggttggaacaattatttaggaagtgaggggtatatcttatgcgcaatgcagtataagccgatacaagttttgatgcacttgctgtagctataccaccgaacacacccgggtatataactatatgatcatttctgattctgaatgggagcatgaactgcaccggatagaatttacatttcagaacagtaaaattgtttggagtatatgtacatgcggtacatgtatgttatggtaaacgtaattttattgtttgactaactgtatatcttttaatcaaagttgtaaaaggagatacagtattatctaggagtaagtacgactcacgtactaatgtactgctgtactccatcgcgtttatttaaaaggagtctaaataagtccatcgcgtttaaaagaagtctaaataagtccatcgcgtttaaaaggagatacagtattatttaaaagaagtctaaataagcccatcgcgtttcctcttaaggttaaaggttagaaattgatctgttaaacggaattttgtatcacaagtcatggtggatccggataacaacatatcatacaactccatattgaagttaacattattctcaaccaggcaaattttggctattaatgtttatgaaaatggaacaagcacgagaaagaaaagagataatcacataattagtctaaccataatttaatttggttcgacagaaatttgtggcaattcattttacaaccgcgttttcatatcaacttggaaaattaatcaaaacacggcgatctggagctaactctaaatagctgacgttgataatgtccagcttcgctaaacaccagatacttcattttctcctactgcaataacagctaccctgaagcatcaaggtgacttcacacttctgcatccatctccatcaagaaaaaggtgttcaaaccaaagtacaagcacaggtaaattatggatccaaacaagtcctggttttaaccaagctcagaatgtttatacctcatatgcacgttcgtaggacaggtgactacgttttgtaggtgtactattttacttgatattagaatggaaaaggtgccgatcaaaaaagagatacagtattgatttttattttacaacccaatgagatgtttctcacttcaaacatgcatatacagggtattaataccgacccgtccccttacgttatgtagatatcaaaacgtaaatcaattttgaaattcctcagttcagatatgcatgccaaaaaacaacaaagatttgaatagaatggaataaacgttttgacactccttgttgccaatgtcccttatgcatatgatataatagtctacctacaacaaaagaacatgccaaggtcagtacaaagcaagtaaacaaaattttagcgaaatgtgcggtgaaaaaatacatgtacatgcccaaaaggccaaaagtgcagagtttacagcatcacttcattcacaactgcaagcaaataaaacaataatgcgcactatttggcatccccagatagtatgcagatgccattttaagttagcctcgagtctcccctaggccctaacccctgattttgataccctgaaggggaaaagactgaagggtaggtaacccatgaacatgcaccattccttgctgtttgagattggtgcaaaatgccccccatatatctctagattgcagatttaactccaataggagacacttgatgatagcgcaacagctttcttcactgttagcatttccaaatattctctgtctccttcaaacattacaaacgctaaaatttcaaaaatttgcaggtactggactaccaattatgcatgaaaatcacattaaaaggaaaaagtcaggcatggttttaaatttccgaatctcaaagcacactctacagtacagatagagagagtacccaccagctcaagcacaagagctttttccttgttaatataacctcctcacaaaaaaaactggtctgcttgccgtcaaattctgggtgtttatgtatatgctactgaccacagaccactccaaagccggacacttgaactggtctagatatcacaattacaatgcatactctggcaatctggcacgtcacctaagaatttctataaataatggcaggcttccacaagaaaacagtacggagatgattagattaaaaaaaggattctcgtcaatataatatgggctatgcatggtacatgcctattttctatgtaaactatgttgaaaactttatgcaggaccatcatacgtcttctagtctgcatgcaatactatgtagacattttttacataggaccatactactagaagaatgccgcttacttgcctgcacagaaatttactaatctatgttcacaactcaaagacaggaccaagtctgatactttagtagaaatgttacctggacaaatatccactaaggactagctgattgagtcctccgggacacttgaatcctgaagaacacgatcaggatccagctgaccactgtaatagctagatgggacagcagacagttccaactttccagtccactcctcaccaggcttcaaagtaatcggcttttctatagcagctgcctccacacagaccatgcgtttatattcgtcatccccaaagtctgacatagccttagccttcttgtcccaagggttccaaacaactacaaccaggaaataaccaacacaatccatttttttttcatttattataacaaagatagtttattatggttgtaacttgtaagcaaataaagaccatcattgactgtaccagcatcaggaaggccacctttcctcacaacaaatgttcttttcttctcatgatcaataatggcaatttttgacggtgtgcccagatatattctgtccaactgtacaataagtttgcatttgcttccttagttagaatgcaaagaaaaatgaaggatagtgtaaggttcaaatgttttgttaacgcacttcagattcaaaaacaattgcatccccttgttcagtgtatcgatttctctcttgtaagttgtctaggtaatccagagtttccaggccttctactcgcacctcgctgaaatattagcataaagttatgcacaatgaagaaattgtttctgtatgtctatggaaatacatttgaaatggaaaaggaattcttcattgtggataaacatacagaaacattttccattaattaagcccacattttagacaaacatattaggtggataataaacatgatcacttccaatactgcactgtgcctttgaaatgaatttttcagaactgatgggctttgtcgagagttaaacaagtgtacctgatatcagatattgaaaagtatgtgtgatatgcaaatgtaaatgagaatggctttccatctgcattggtatttcttatacgtgaagtcagcatcagatctccaccaggtccaagtgcaactctcagacggaactcgtaactgaaataaaggatttgcttttactgatccatgtgaacagctaccttgtcttctactaaaacaattatatgataagaaatagagggaaaaaaactttcaattatcttacaatggtaattaatttactattaacatgtaattatttagtatatgcccacctatgtggccagatctttagatcttcttcagtatgcgtaaggattaaatcgacgtaagctttattagaagttggtactggaaatggtggtggatcattttcaacactccaggtcctgttccttgcaaagccatgtgggtccagatttccgaagttggaaaactagaatacgaagtactgagcaaaattaaaatttgagaaagcggaagagattacgagcaaaaaaaaaatgcaggaaaggaaaagcacggacctgaggaaaagcagatggtatccctncacgtatagcttnttgaggtttgaaaatagcctgagagaacacaggcatcagccaagcaactcttaggcaattaaagaaatacatggnataaaaaaatccagtaagattcataatcaaattttattgccatgtcgaggtcaaatgagtagcagggatgttgtaatacaatctttgtcacatcattaccacaaaaacatagggtggacgataacaaagaggtacatggtttatgagaataggtatgcatgtctggatgataatgaaattaagggtaaggatcatattctaccagttgaattagcctagtatcagtctctcagacaggcttatggtacagccaaaacaatgatggaagaattttagaggcactgagatgtgcccaattgcccatactaaagataggaaataatatcaccttattactaacaaaaagcagctcctctccatgctcatctttccatgatgtgacatggccgccatacaggtacacctgaaagcagcaagagtagaaatactaaataaccatatgtttggactttggaacaggatacatacaagaaaaaagaaataagtcctatgtagccaggacagaagcaaagaactagatatatataaagagatgagtcacaaaaatgcacatgtggagttctaatgagcttattatgctgattagcttttggggcatgtccttctgatgcccatccactaactatgtttctgataatcaataactattcagaatgatataatttctagtaattcatattcttgatacccaaataaaataaatatgttcagtggggatatctcctattgttcccataaaaaaatcgatagatagatgtattacaatatctttgaccaatagatagatgtactatagtatcttcattttaaactcaagaatgaatagtttagcttactgttattttgtcaaaatcaatgtggaagtcttggcattgagcttccaatagtcagaccttatgcaatagcactatagcatatatgcccatgatttacttagctccatatgccttcttggtatacatctgattcaacaaacaacatgggcttcttgttatacatctaattcgccaaaaaacatggggctggcctagttaatgtcaacaagcgaacatccaacatccaaattgtaggtgaagcaagttttaggatgagttctggaaagtctaagtgggataataggtatcggatgaatataggaggatatttcctcagtaaggccgactagttgagtcacaagaagaccaggaccagtagcaaacatgaccagttagacaccggcgtatcgtttctccatcaactcaaaccatcctctggcgttctcacctctcttctaccagtgttgatccatgagcttctatccgtattggactgaaaataataccatggcaacagcacaaatggtggccctgctactcatcatcagagatagcataaagcaaagtatgcaactggaggaaaaatgaaagaggctcctcaagtgacgtgatgaatggtagcatgggctccatcccaccagtttggcctgataacatccataatttctatggaatttgcgtcaaaaattatttctatggaatacggataatacgattttggaatcttgtactaagcgtacaccaaacaacatagtagctagatatttgacccacaaatccagaagctacaataaaacgcccatgatatccataacatcagccaaagaaacaactcgcttgccaaaatcgctatgctaagatcgagcaggctgtgtcactatcatttttatatacctcctcaggtaaaattccatcatttattgtctcctaaaaggccaagtgcatgaggtcccacaatccactcttcagactctttagtctttagcagctgagataatcatgaaaaaacctatctttcttgggtctaccattttaggccaaaagagcactctcaggctgtaaccaatatgaggcatccgcgtacccaacaacaagaagtgttgattataaagggtcactagcaagagtatgaagattttcttatgttgctttttaagttgactaaaaaaaacattttattgcaactgaagtgtataccccctccctgctaacctggattttcctcagaccccagatatgagtaaattacccctctataaagagaatgttcaccaccctcatgtgttcaggggttatagaagcaccattgtacactgtattgagccatttttataatcctatttgttactcccaccatttagtttataagaaacgcacataattcattgtatctgttgatcaacgggtagttgaaatatttatatgtctatggataagacagtggtaccaacagnatcatcatgttctaaagtacttccacgtttcgcacaatcaaatatgttgcaggggaaactagaggtccaaggtcaagttttgacaattgcgccnttacaaannaaaataaatanatggatgatgtatttccaaccacaactcgtcaatggaggcaaagtgagaaggcaaatactctccactctgaatgcaagagacccagactgatttcagaacaccgatctgtcgcctacaacgagtcgaaccacaagcttcccggcaatcaaaccactcctatctctcacccaaaaaaaaaaaaaaaacactgcaagagtagtacttgagcatggtaagcgatgggaacagcagttgagcaactacaagcagcgccatggatctgcggcgagatctgacagctgaatcgagagagtggagggggcagtactagtcttacctcggcagagctgcctcggacctcccggaggacgaccttgtcgagcccgttcacgcccttgcaggtcaccaccggccccttctgctgcggctgcgcggcggcggcggcgccctcctcgcctgcccctccggccgccgacgccgacgccgccgacgacatccccgcctgagcagtggaggtggagatggagatctctcctggggaatttcgcgtcactgctcgctctggggacttaaataattattctcgagatgccttttcctgatcgcgattttttcccctcctcctcccaaactccacaattaaaaaacaaaaaacgcaagctttagtctcaaaaacgcaagctttactttctcctagaaacgcatgcttgcgacgcggggaattagcgttgctttaaccgaagcaaaaaaaatattcctcatcgagaagcagcagcagcagcgtgtgaggtgtgagtgagcgagtgagagtttatacgtgtctcgctcgaagaatttggcgagatttggaggaaaaggatttgattgggttttgctttgctgttgcgttctgatgcgctaaccgctaaaggcgataaaaaaccttggcgtttcttcgacgcattttgtcggtgtacaagcctttttggtggtttccatgctgtacaatcgcaacctgctggtttcccatgtagcatatgctgtgaacatcagggatacacccccactgatcgcttgttgtatatgcagaattaacctgtattcagataaagaaatgtcttgcaaagtaattaactgatttcagataaggtgccggttgcctgaatttggctttggtgttggaaggacataaaggaaagccgaatggtacgtttgatttggattattgaacggactattaaagcggattatcgatttgatttagaaattttaagaaataaacatgatgaatagtttaaagtggtccaagtaatacagtagaaaatgttttttagaatgtatttttttcaagcatgaaattaatagttaaataatatgatgaacaagtaaaaaaaagtatcatatgcacataaatctttttgtgtgcacaccacctaacaaatttcactaaaaattctagaaaaaatatatatctataattttagtagtattacatatatgtataaagtttcatcttcaaaatcattatatttagtgagtaaaaaaaacaaaattcagatacatttatactcttaaaattgtcagaattatcatctttttattaacgttaaaatataataaatttgaggctaagtatttacacataggtgtagtactggaagtacataaataattgttttaaatttttgataaaatttattagttgatgtgtctgatgtgtacccgagaaagattctgtgagtaggattacaaataaagcatatatagctcttttccccctgtcttgtaaattagttatgtaagacgatttagcacactagctttgaccagcaagctgtgtgcagtcataggatcatcgattgttccaacatcggatgataataacagcgtgttacttccagtaatctatatactccatctggctaattaagacagatagatgggttttgatccagtgatgttagcggtgactgacgcgggcgcgccacgccgccgtcaggtgaccgatcgatcgattgctcgtacgtcgccgtcgtcatgatgcgccatgggtcaatcactgcctgccatcatggtggacggccggcgccggcgacggcgacccgtagatctcgattgaccgattagccggacaattagtgcagtattcagatccataagcccatttagaattttcgcttatatttatacttatcagccaaaatttaaatttaaatttttaattttaaaataattttaatgttttttcatcataatttatttttcagcaaattttatttttcgtttgcgatacgccgtttgtcttattcctcgaataagccagataatggggctgtttgtagggggatgaacagtatttcgggcattggttccagcttaaagtgattatctaattactgcaattccttgtgcaatctgactgctgctcccggtatatggcagacgattattgcacggataacgctgaagttttttttttaagcaaaggataaagctgaagtagtcgagtgggctgttggcctagggccaatgggcatctggtcaggccaccagaagatgggaattgggccgatcctgaaacataatgggcctaggaggccataattactttttgggccacttaaatctcatcgtttggcccattcggacttcggagtgtactccgctgccgtgggcgggccgcagggaagcactgtgaacctgtttgtttgggagaaaagtccggagatggtgagaagtcgttgatgagcattccgctggtgaacgccaaaagctaagaaattccgattccaagctgctagttcaggttttttggattttgtagctagaaattcttaaaatatgaacggaaatctgattgagttcctccatgagatttatttggaattgtattttcaggtcaaaccaaagtcgcaacaaagttatcgatccagggcagctattttctgcaactttgaacttgccaaatttcaatacaaaaacggatgagatggaagaccagtactgaaa

SEQ ID NO: 60074 - DNA, 9001 bp, Oryza sativa
ctgagtgaatgctctactattgccgcacttcatttccccaagcctctcaaacctaaaaggcaatccaccaaaaacctaaaaagggttctttgaatggttgctacattttcagttggacacgtgggttttgaaggattagaagctacaagagacatgaaatcaatggactatatttataatgggttttaataggatattttcttactacaaatttatttattgactatagagataaaaccaaatctgacacagataacggcattcaaatattgaccaatccactaattatacctttacgattatagttcatatggtcatatgccatggatttactactacaggaaacggcttcagtgccggttggggactctcatatgtgttgggtccccaaccagtaccacaattcctgcactgattacctccccatcatcaatgccggtttaacaaaagtatgagccggttagtccaaatcaatagcatgcctagattagtaccaaatatccaaatctttcatatctaaataaatatcaacatctcatagatcaatacatatcaatgaacacactcacatatccacattcatagatcaacaactgacaaatctaaataaacatcacaaattaaaaattaattgatgcatacaccaccccaactgtagaactcaaccccaccgaggctgtcgatctccctcttcttggctctgggtcatcattgtcgtcatcaagcctcctgattgtttgacacttttgaccaaaatatttgttctcgtttacttgttaatccacacttctcaatgtaaatttttccaatcttatcttttctttcacacatctagtagtatataactatagcctaactcagtttgcaatttactaacaggtgaatacaaacctcctgaccatatatatattaggcacagcttcttgcccaccttctttcttcactttgttgccttcctttctgacagccattgactgttttacccagtgaaagtgtgatgcactgcttgtggcacaaggcacacttgtacaatagatattttggtcataaattttggaacaaatcattgcctagtttatgtgctagaatttatgtgtcaatttgttgacgaaaaaatcgaacacaccggcctaggagatctgcttagctcctgtgcaggtccaaatataatgagatgcgggcgtgccagtcagtttgatcctgcaactgacaagatatgcaaatagtagatcaaaacagccgatcggctgacaagccgatggagtagttccagccgatagccgataatagccaatgccgatgccagccgatagcgatagggtttaagcaatcggctatatgtccaatgtggatgatgatataaaggcaatcagctgttgataatgtaataaaataacaatataaccgagtagaaaccaatcggctagagacaatatataataagcacttatccaaaggtcaaagcatacatcggctagaggttcgatgtcattaaatccataggattagataaacagtaaaatctatgttgcgatcggttaattccaatatgtatacaatccttgtaagccgatgcaacgcctagataactcatcggttgaaaccccgatgaaacccttattggcagtcaaaagcaggctagagattatggttctaagcacgacttagtagatcaaacttaactgatgcagcactgagtatgaaaagaaacataatatctagacaatcaagccgttgactgatttttcagggtggtagatgtccaagctaatctaatctagcaatgtgatttagctgataccggcagaaaccctaaaacgagaagcagccgatagagctaaattgatatgctaggactagattaacagaaacatatgataaataggtaggcaaatatatcatctaaaccagagcaatccaagacgtcgaatgtactgatgcagccttgaacgacgccgacgtagacgatacaattgcctggaccggcagaacattggacttatcccttcgccggagatcgaagacgatgcagccccgcgtcgggtgccaagtcccgccggatgataaaataaagtagaaaaggtaaaaggtggcgatgcgccgaattgtattgatcgtagcgatagattacatagaccccaggtgtacatatttatacccatgggttgatacaagtccttgtcggacaagaaagaaactaacctaaagataaaaggaaaatataaagtccttatcggacactaaacacactttcctaaagataaaaggaaactaacaaactattcctaattaatagataaactgccatgtcgcatcctctttaaactcggtcacttagggataagcttcctttagtagattgatttccttagccgaatatagcaggaatccgactattggcgacttgataactcccatcggctgattccgagatgctgcagccgataatgattctaagccgatgacgtctttgccgattaccaaatttcactgtcaacacaattaaataaaaacagagagtaacgttgagttctaaactgcttcttagatttgtttctccctcattttttgtgatcatgtttccctaattgttaaactatgtgttaaaaaattcaaacaatattattttttgattcgtattacttaattaattaagtggtaatggcttatctcgttttacgtgccactcaaaatctaaggtaagaagccttttcaaacgaagtctaagttacaagggccataacatatgaactgaggcctccaaaggtgccgttgacttgggaagcaaatcctctaacttatatccctataactttgagtctctgatataccagcccacttggtggagggttcacatgtcaatgactgacatcagagggaaataagttataggatctcaattcagttgacttgtattagttgtcccacatgtgattttctattactattattaattgctaatgaaaaataatctaccttaatctgatgtataatgttttgactctggtgatcactaaggactattaagaaacgaccttccttggggatgggttaaggaaactgtagcacttcagaaatgagcatgcgtatgctgagtttgcactacaataatagaacttaatacatcagactatcgatgaacttatgagaaatgtacttttgatctcagcaataactggtattgcgcgtcaacttcgactctttgagaatttttggtgtagaaatcatcctctagagtgctctggtggttctaccagccttgtcagcttgtctcttgttttgtatggcttctatcgcagcaaaacaccagtccactgtatgaacagatcaattcccaaaacaatgaaacaacgtaggagttcacttccatacctaattaaaggttatcgatctgactggtttttataagggtatttgggctacaatagtttggaggatatgaagttgcgagcaatcatgtgtgtgttgttactacaaaattgtaaactattggcagcttagctaatataatgctttcaaatctaggtggcttgcttcatgatacaaggaaattctccaatgtgaactgatattttagacgaacaattgcacgagcatgaatatcttctgtaatgttaaccgaagtctttggggccatccacatatcatgctatcagccattatacactacagttgatatgttcacttggtgagttggtgatatgttaagtcgttaaggattctatagttcagaaacaagcacatgcaatgattttgcagattacagagtaaattaatggatcgattagattactaacaaactattaggcaaatggatcaatttgactattgacgaactattagagaaggttaaagcaacaagtatttcagctcaaatccggcagtgctcctacaagccaggagatcatctactacaaattcatcatcaatattgttagatctggttactatgttggctttgttgcactgttgcagctggttttgcactcgatctcggtgccagagactgagcaagaagtgcagtaatcatgaatacaactaagcaaatgctgaaccattgtagcagttcacttcaccaagcctctcaaacctagaggggttcataaattaatggtttgttttcagttggatacatattggtttttttggagcataggaacccacaagaggcatgaaccagtggagcatatttatggtgggatttgctagtatttgttgttactgaagatttatttattgtctacagcaatataatgccgaagctaacacagagatgggcgtacatcaaattccagaccaaaaccctaattatgagttttttttactgtcctgcaggtccggtaccaaatcgtgaccgtttagggtgcataatccgatgatccagaaaagctggtacttggtggtaccactgctccgtccattaggtaccaggcatccgagtccgagtaccctaaaaagggcataatggtcttatcgtgtcaaaaagcttaacgcgtgagcaggtcttgcaccgacctcttcagcctttcttcttccttcccagtgcggccgcactcactagaagagctgtcgccgacagcaaggacaattggacaaggtaaagcaatgtgggagcaagaagaccagatctactcccctcaaaactagaggcactagatcaggtcgctccaacctcggggggaccagctttgccccccagtgatggaaggagctcgacctgccaatgaaatccttgccgaccactgccttccctgcactaggccaagctctttcttctcatcgtggttgtatggtcaccgcatcaccaagccactcttcctatggccagaggctggtggtgttgctcgtctggagacttgagtttgagggccttggcctcttctaccctgacggcgatagcctcagcctcagccacagcgagtaacgagcatagctagaggggcggtccagcaacggcaaatccccttcttcaccggtgacaagaagaccctcggcggctgtgcatatccatggcttcaccagcagcagctccaaagtccagcgttgtccctgtcctcaagatcagaggtcactaaacttcttgcaaagttctccagtttataaaacttcactgaatttctatgcatatgcagttatcttgtttatgtttagcgaagtttagagaatttaatggcatctcttatgcaaaagtcagagagctttcacaaaatttgaatcttatgtgtgttttgataccccacatagtgttccttgtttccctcaccctcaccacatcacaaggaatcctctcttccatgacaaccggtgatggacattctcgtacacgaagcgagtcagtgcagctggaggattcgctaggaaatcagggtttccgctctaggtggcggcggtttctgaacaagcagaaggatgaatgtggcagcaccgaggaacgatattggggcgtgtgcgaccaatttagtattggacgcaattttttactcattcccaatcctacccccaaaacatatggtaccaactgctggacggtaaaaaaatcttcctaattatacctttatgattacagttcagatggtgataagccatgaggtttttacttctgaaatctgcatctttcttaaggctgtgtgaactgtgtaaatccttggactttttaaacacacataaaaaaaactttttgctgtagatttagcccagtgttaacttgcatggtgatttgatttctgttctctggaattgtatcagctgagtgtagtctcccacttgtgatttttcctatattcattaactgctaataaaaagataacctaccttctgctagccattacacaccagcgatcacttgcgacaaccattaagaaatgaccctacttgcactacagcatttcagaaaatgagtatcactagtacagatcctctcatctgtgacggcccctcacatgcctgggcaacgtgggccgtcagaacaaagtcatcccaatcgggcctaaattaacaccgttgtagatgtactcgtccagacataatcgaggtgcatatacctatagcccgtcaccgatggcactcatcggtgacgggctcatagttaggcccgattgagattacacctatatctcaatcgggcccaactactaggcatgtcagcgatgagtgtcatcggtgatgggcagcaataaaggccgattgagataagttgaatgcccgtcacagacatcggtgacggtcttttatttatgcccgttagagatgaatgtgcgcttgttagagatctcgtttatttggcccgattgagatatattttgcacactataaatactccaccagtttgttgtctgtagttatcccactattcaatattcactattttggtgggaggttgaagggggcgaatttttgccattttttccaagaagaacatgaaaatcataaaagtaagtaaaatggtactgatcatttcttattaatttagtagtacttatcttataagatgttaactaatattttgtgtatttttcaacgatggatcgaagttggatgtatacgacttctttgaagcgtcagtataaagagtatagagatggcgtattaagttttatgaataacgcggaggaggataggagaagaagaaacaacaagttttatatatgctgatcttgggtttttggttgggtacattgaggtttttcttttctgatagaccataaagaaatgtcattacgaactgcagcatttccgaaaatgagcacgttgatcttgccactacagcactagaacctaatcaggaacagatcaaatttaagctgatgtggatgtctaaatttgctttgagagaggtgtacatatgttgaaaataaacgaactacagctaaaaaatatttttgatcaggttcctagcacccctctctcaacaagtagatccgcccttgaacctaatatataaaagactactgataaacatgttggatgaggtaaaagctagaaatgttctttgatcccatcaacaactggtattgcatctgaacttccacctgcctcgccatgcatgattgcaaaaagaccattgccaaattgtggcggaacaagtccccaaaaagtataagaatgtagcggttcacctctccgagcctcccagggctaaaattcctctggatcattttgttttggtgtactacatatggccattggggtacaatggctttgaggatataaagttgcaagggtcaggaaagagacaaagacatatatttatagtggaatttactagacctgctgttactacaaatttatttataggggagtgtatatagcgaaagctagtgtcgcaaaagaaaacggaggaaaagacttgtagaaaggacccttccaatgaaaaatatattattttagcaagtttgagaagtgtgctcaataaaaccaagggagtatctctaggacagcagcagtaatgaatgctgcctgtcctcctaagggcttccttcaagttgcagttggtttcttatgtgatttttatattattatggcattcatctattacaactttacatcaaaagtagccgacagattgtgaacggtgatggtagatcgtagagtttaagggaaagacaatagtatattatggatatcgacaaagtcagtggcatattgttgaactgtgacgaacttagtagtactaagtagattttctgagtggtctttcgttgttattccgtagggttatttttgttaaaaagaaaaagaaagtagttcatgtagatagaaattttttttaccatcgtcgggtttgtatgaatgtgttaacctaactagcaagattcaaaatgtgtaacgccttccacgcacatctgctatggtacaacttagattattttgaccagtaattgatcacttgtaaccaaagtatgcagatttttaatgatgattagaattgaccaggaatcgtgccaccatgatgcgagtcatcgtctctcatctaggtacaaacaagatccagcagtggcaccaacaccagcacgcatgaacgagtcccaattagaccggattaactcacccacaaaatactaggaagccctttccagtttttttataaaaatccacaaactttaactttaagtatcatatagaaaactttaaccttaggctgtgtcctttggacaactttcccaacttcactccctcattttccgggcgcacgcttttcaaactattaaacggtgtattttttgcaaaaaaaaaagtttctatagaaaagttgttgtaaaaaattatattaatttattttttttaagttttttaagctaatacttaactaatcatacactaataaggtatcttgatttccgtgtggaggaaattagttcccaacacaagcaaacaaacacatccaagacttggccctgtttggttccatgggctaattattagtctccaccttttagctatgaattagccccaaggatctaaacaggtgggctaatttggggctaaagtaaattcactactagaaaaacgatttttcatgacatttggaaaatatttttcatggcggctacaagaaaaaaccgctagcgtagaaaatcgggggggatcacgggcacattaagagatccaccatataaaatactatatttttcgatgtctaccagcgaaaatcagtatttttgctggcggctactaaacagatccgctagcaaaatgaaaaagattcaccagcgaaaagcaaacttcgctaaaaaattttcgcagtatttaaaacgcgcgctagccttcacccacccacccactgcatttatctctcatcttcccctcacctctcccagatctagccgagcctctccccttccctcccacctcacctctctcccctcccctcccacctcaccgcagcgacggcaggcagacctggcgggcggcgacgctcgggctcgggcgaggaggccggatccgcggggaggcggcgtcgccgggctgcgggaggccggatccgcgaggaggcgtcaccgcc

SEQ ID NO: 60075 - DNA, 8047 bp, Oryza sativa
gacgatgaccacgacgaccacgacgacaggcaaccggagggcctcctcctcctcccctcccctccctctccctctcccagatctagccggagggtggaggcggcagcgaccgccgcgacggcgatggtaggcgggcgacgacatgtattgctccattttgtttgtactgatgtttcatatatgcatgtattgatgtttgtttgttgagaatgaagtgagaaattgatgtagtgttctcttgatgttggatctgatgtggatttgaattgttatggatttgagatttggggatgtggatttgggaatgcaggtagcagcatggagtttttgctggcggctggaggccagctgcatatggtttttttttctcaaaccgattatcgctggcggccagtataacacagctaccagtgaaaatcgattatcgctggcggccgataaccgctagcgaagattgatattttctctggcctttgctttgtggcggctgcaatttccgccaggaaaaaccaaaaatggccgtcacgaaagatgattttcgtagtagtgattagctcccctcgaaacattagcccctctaagggatgataatggggctaattttttatggggaccatcgaaaagcagccctatctccccccatctctctcctctctcttcaccttttagccctcaattaactcatggatccaaatatatcattctaggctaatgtttagcctaccaattcaagactaaacattagctctcaaaattagcccggtgctaatcttctaaacagggccttaatatcgaaggtaccaaattttggtgtctcacaaattataatgtttggtgactcttagtacattttgaagaatggtaaaaagctgaaagaaagagagagaagattgctaaagtgttattctaaatctggaaaaaaaagtatgctatcatttttaagagaaacacatctaactctaacaacaagtaactcagccctaatctggcagcgctcctacaagccaggatatctgttattcaagagttggatgttgtctatgtcggctttactatgctagctgaatctggttttgcagcattcttgtcgttgacaaaagcgatgttagcactaatccaaacttgcatattgtttttagtcttgcatgagttgcatgtagataggcacgtgatatgtttatgttgatccactagatagatgcatatgtgtgtcatgtaaacaatggttagtccaagctttgcatgtagagttagttagtgctagtgattggaagatgcatgtgttgcagcataactagcaactgaacaagtctagggaataagaggattagtggcgaattagttagctgcatgcaagattagtggagcatgtttgtggcgtggtttagtcagctcggaggagcgattcttgcgcgtgagacgcatagatcgtgtgagtgagtggctcatggtcgtgcgggcgacccggtcgggctgttagctactccctccgtttcataatgtaagtcattctagcatttctcatattcatattgatattaatgaatctaaatataaatgtggaaaatgctagaatgacttatattgtgaaacggaggaagtagctatatgtgcatgtacgcgaggctacataagccgtgtaatcatcagtttgtaagtgagtgaagaaaagaaaaggcatttgttgccaagaaaaaacttgtgtgtgtgcttgtgcacttctgtgtgttcatccccagagagctattgtgtgtgtttgttgctccgtgagtgtgctgctcacgtgaatttgatccttggccaaagctaaaaagcgacaccctattgtggatgagccagtcagccaaaaatgcaccaaacttagcagccgctaagccaaaagatgcaatacagtagcagttcaattcctcaagcctcccaaacctaaaggggttaatgaatgattggtttttggttgcatacatggaattcttttaggataggaacctgcaagagacatgaaccagtggagcgtatttataatggggtttgctataccccgcaaaaaagaaaaaaagaggggggtgggggtttgctatagttttccttttgcaaagatgtgctaggatttatttattgcctagtaatatgaagcacaagctgacaccgagaagcacattcaaattcaaactccaaaaccctacttatacctttgctattaccctcaaggtccatgctgcagattcagccatttgttcacttgcatggtgatttgattttttttattattatttctctggcatagtggcattaacatcaataaaacaacaaatcctgctcaaagattggttcagctagcagtaggaggacatattaagatacagattttacctaggtttttgttagcacacttttcaaagtgttaaatagtatatttcgtgtgaaaactttctatataaaagttccttgaaaatatcaaataaattcacttttcatgtttgaaataattaaatctcaaataatcatacgttaataactttctcgttttgtgtggcatcccataatcttcatcttcattagacgggacggggtgaacaaaactagccacacaatgttgtcctcgaggtccattcagagtatatatagcataggcgtgtgatcaagcattttctaatcactctcttgagtactgactgacgaaccatgcatagagtacccaagaactgcacatccacggatgtactgaccacaaaacttgcatcatggcattaaataatttcacccgagacatggatatgctatagaaattatattcaattagatttcggatggtatcttaccataaattttgaaaagtgtgttccccgcaaaaaaaaattgaaaagtgtggtgcgttcccctagtactgaataacaaagcaccggtagtcactcccataatgcaactatacttacatatggaaacaacatattagtatctaccacataaccgaaaggtaattccagttgttggtaattcataattgtcgatagcaaaaatcacttcatgatctgtatgtttatatgatccagattattgatgaaatactcgatttcagattattgacaaactagttaggcgcacgctcaaaactcgatcagcaacacaaacaagtaattcacctcaaatccagcgttcatacaactaaaagccaggagatagatcatctgatatcatctactgctgattcatgatcatctatggcgttcgatacggtcactgtagaagctttcatgtactgcttctattttttccactactcttgtcattgccgatagtgatgccctattgtggacaaagcgagtgagcaggaatcttcacaccagctgagcaaatgatgcagctgaaatcttcgcagcagctaagcaagaaatgcaagatagtagcacctcacttccccaagcctcccaaacccaaaaagggttttatgaatggttgctccgttttcagttcgatatataggttttcgaggacaaacccatggattttaatttactgcagaaatcagcatcccttgcctaaggctgtgaactctctataaaaccaaagacatttgtaacacataaaagatccatgcagatgagccttggtcgctggcatggtgatttgatctctgttctgtggcaatggcatcaacatcaaaagaatgctgcccaaagattgaacatcgaactcaacagtactagtagccacaattcttgtccttgtggttcattcagattaaatgtatatgtgatgaagcatgttttaatcattcttcggtcttttgacttattaatgatacaatgaatacccttgaactgtacattcaaatgtgccccagggagaagtactgaaccactagacttgtatcatatgtagcagtaggacactggcattgtctcttggaaatttcaaggagatcataacattcaaagatttggggctgatggaagtgaaggagctagttgagaaggcctcaatcattttgaaacagtcactcacggaggagattgaggcaattattgagaagataaaggtagcattaatttggaagtcatttctttgcaagtgacaataaagcctcttaccaaagtatttagtatcaaatttggtggttagtgggctagaggctgcaacctaccaataagttcaacaatagtgtgattttctaagaaattattattatgtgattttggatgtggtatttgcataaatattgtgattacatgtagcattcttgttttttagtagatgataccccgcgcattggcgtgggatatttgaatcattgtggtagaacaaaggaatcacaatataagtttacaggactgtacaatcagaacaaaagggcaacttaataaaaacgtacatatgaatccaattcatgtaaagccatttctttataaaggaataaaatttagcttctacaattgatgtaaactataaacaatcaccatgaatcaaaaagaaatcttggtttatgttgttggtgattactccttgatgaacatattttatatgccaaatacattgaaatctcgaccgatactcgttatgcattacaatcaatcaccacataaaagaactcaaatcatatacttcaaatggaaaaaaaaaagctatactttgcaaggtagtccagtgaataattaaattgtagaaagaccaccaaattaattaaaatagctacggtgtaaaattaaaataccttttaacttacatggattgttggatggtgtgacgaaaaatccacactcggccgataataccggaactgtgttaacacgaactaagtcgacgaacacaacggcctaggagatctggttagttccaatgcaagcccaaaggttgatgagatgcgggcgtgctagtcagtttgatcctgcaactgacaagatatacaaataacaaatcaatgagccgatcggctgacaaaccgatggagtaattccaactgatgccgataccaaccaatagcgataggattttgagccatcggttatatgtccaatgtagataacgatataaatacaatcggctgatgataatgcaatacaacaataatataatccagtagaaatcaattggctaacaatatgatagaataagcactaatccgaaggttaaaacatacatcggctggaagtccgatgtcattaaatccaaacgattaaataaacagtgaaacctttgttgtgatcggctaaatccaacttgtatgtaatccttataagccgatgcaacgtccagataactcatcggctgaaacctcaatgaaacccttgttggcaatcaaaaagtaggctagcggttatggttctaagcacgactaggggtgatgcaacgcaaagtataaaaagaaacataatatctagacaatcaagcccttgattgattttcagggtggtagataccttagctaatctaatctggtaaagcaattcagccgataccggcagaaaccctaaaacgaatattagccgatacaagtaaattgaactaccaaactagattaactaagatatatgatagataggtgcttatattgacaagatcagagagtcgaagccctagccccgccgatgaaaatagccatgcatgacaaatataaactcgtcaaaaaagtagaaaagtaaaaaagggtggcaatgcgtcgaatttgtattgatcgttgagataaattagaatgatctcctggtgtacatatttatacccatgggtagatactagtcctttttagataagaaagaaactttcctaaagataaaagaaaaacataaagtccttatcggacactagaaactaacaaactctttctaattaatagataaattgtcatgttgcatcctccttgaacttggtctcttctggataatcttcctttaattgattaatttccttaactgaatatagcagaaatccgactatcggcaacttgataattcccatcggccgattccaggactctaaagccgatactgactctagaccgataatgacttcgaggcttaccaaatttcattgttaacagatggtcaaatatttcataaggtctcacaatgacagtgatcagtatcgaggtgattgaacaaacttagctgcatagtagcgatggaaacaaaacaacaatctaatatctgcatggcaacctgaaatagaaaaaaagaacagggagaactaacacaatgttgtgcatattagagagactcggataatattggaagataccttttgcatgccttgcactggacataggggaagctctaactggtagaaacaaattggcggatggaaaaaatgattccttcaaatcaatcgtatattggcatatctcctagaacaaaagagactgcaactgaacatgtggtgtgatcaatttgtttttatgggctggacggtgacttctgagctccttttgaggaaaattgtagtgcggtattatgtgcatacctattagtgtgcagcattagtggagtagtgttttacttcttgactccttgattattttgccattactaaacacatcaagcagcggcacctgtagaggaactgataaagacaggtaacaatttgttaggttgaagaaatcggtggcagcagtccgtctaatgaccgatagtgaatagagagtctaatctaacggttaaaacaattcgaatgatacggctgcacctcaaagcaagaaattgctattagctacactaagtgaggatgaactatataggattatatgattcgtgtgagatgtatgtgttacatatgatgatttgaccttcggagtactttgttgtaatcttgaatctatagcttccatgaacaacaagatactaattgcttgtgaatattttggattttttttcagattttgggccatattttgggagtgtttgttgaatttctatcgtcattttcatggtttctgattttaaaaacaatatttcattcgttttgtgattttttattctttacattaaattttttaatggtattactttgataaattgtaagtacaaatctaagccagtgatttgcttagccaaaaataacttgcttaattagcagggagacttgtggggggattgggtgagagtatagggatcaaccccatccccctggatggatctccctatgtgaatccatccatagtagcccaactaagccttgggttaacgccagaatatgcaatggaataccaaatagcaggtagagttgcttgtcattgttgcaatggtcttgtgagttgtggattgttatctgcgtaatgcacgtatacccaccgcgagttaaacttggatcaagctgacaagttgctccagcatcggtgataaatattctcgttctctctatgcatgtatacgccaataaaaagaaaatgcttaactcgatgagttggagcgtcccattcctgatacctcacatgcatatagcgtaacaacactgcaacagtaatccgctgatcttaatattggttattgcatgtggaggttatgaaaacgattcattgagaggtagagaattcgtaatttcagtagtagtatttacatttcaacattgccctggatttatatatagtggttttggaggcgatgtagcttacagtttctgtacgtacgtttttctgtttacttcacagaccatgggtgagtgccagaattcactattcttgtccctatctatatcatgcacatctgaataatcacatggcaatatataccgcaaaggtctgaacttggaggatgaatggtgaccggccttattaatgacgatataactaccacgaaaaaaatcgtagcatcaatgctaaaattgtggcaatagatacatgttgttacaatcttaaaatcgttgctagccgtggtaataggttattgcaataatttttatttagttgtaacaaattttgatattgccataaaatggatgtggcaaaagaatatattgcaacacttcacatcgttgcaatagataactattaccaccactccatgtatggcattagttctacataccaaactaaatatttcaatattaatttatcattctaaat

SEQ ID NO: 60076 - DNA, 6985 bp, Oryza sativa
cagaagagatttcatcaagcccatcaaggtgccaaattcaaacttggttcaagatatcaattttattgaatgggcatctcaaaaatcgacaaggaaggtaactcgatgatccatagcttgttatttaaattggtatgattggatcacttgccttgtctgtgcatctaggccaagtttcattccttgctaattagcctaatttgcaaaatgttgtgacgacatgcttgtttagtcaataagtgagtattagtcacaaagttgttctaagtgaatcaatgtgctcggagacctcattctatgtgaattttttatcttaacacaaactatgagattcatacatgcgaaactcatttgtgaaatgttttgtgaaaatcttgggtgagatttttttttttaaaaaaaactcttgaatctcactcgaatttgtgaagaagtggtttggcaagttcaaatctcgatgatcctcttcattgtatattatgtcctctccttaccatgcttaaataacaaagtaggagcgaaggactaagggggagggatacattaagttaaaaaagaagaagaatgtctttgacatgcaaagggtagactttcttcttctatgctttaaaccctttgcatgtgagctttctatgcgcaaaatatctcaatgcctattgatttacttgtgatctttatgtgaaattgatcttcatttcctaatcacaagtgatgaaatataaaattgagaggtaagtactcgatgatccctcatcaaggatcccttttcttttctttccttacttatgccctttttggtgttagatgtcaatgggggagaagtatactaaaggggataaagaaaagattgatcaaagggtgagatatttgtgagaacttatcgaaatgcatgctttaaagatgccatcgaagggtgagatatttgtgagaacttatcgaaatgcatgctttaaagatgccaaagagtaaataagaaagggggagagtatttgaaagtgtttatcaattgttgtgaatgcttattatttgatcaccatgcctcatgcaattgagattatcttttaatacttgaaattgttagtgtgttgttttacttttggtatctcgttcacacacaatacaacccacgaatgcaaagagttagggggagctctctcattttcaaaaatatgtgcatatgtgctcacttcataaacttgtatgcacacatttaggggagctcaaactaacctttggattcaaaatcattttttattaatcttttgtaagctttaatcgtgttgtcatcaatcaccaaaaagggggagattgaaagagcatctatgcccctagtgggttttgtgtactgatgacaaacgattaagggattaatgcacttattgagtgtataagcaagtgattagtctgatgaagaagctaggaaatggacttatcgatggattataattaaagagaagatgttgaacatgcgggtatgaagtgactacctatcgcaagacggtgaagcgcaagcgacgctcagctgcgatggaccatgcggtggtgaagggcaagcaaggggcttggcgcagacaaaccgaaactggtggtgaagggcgagtgaagactgtgtcgtgatgaaccgtgtgaggccatttgaagccatggattatccgcattaatcatttgagaaatggaaggcgaaatctaaaaaatcaagaagatgagatcttcccgatgatcaaatgaccttgacattggtaaccctccaagtgaagaaacaatatggtgtgaaggtactcctattggtataactttactttttaaatttgagtttaggatgccgtactattaagagggataccacatgcatataattggttgaatactagtgcataaaatgcttcatctttgtgtcaaaacacttatatcgggtttctttgcaagtttttcaacatctcttgaaggttttggaccatgttttatgttgggtttgatagcccacgaaactagctttccatagagtccaagatcttcgaaatcggagttcagagtaaaaagttattgcatttttacttgagcaacatatgactatccgatgtatcggactatccgatttttcacagaacttcactctctgtcttgatatgaaaaaatcctatcgaatgagtttttctaagtatcagagtatccaatgtcggatcagatagtccgatgacacagagactctgaaatttcatggaacttgagtctctgtttgaggacgaagtttttgcttctaaaatatcggatactccgatttaacatcagatagtccgatgtctcggaaagtccaaaatttcatagaacttcgttctctgtttgttgttgccttggaggtttaaaatatcggactatccgatattgtatcggactatccgacgtgggctgaaagattcccctcgaacggccacattttggggggatctatataaacctcccaccaacccttttctagggttgcccaaactcatttcattcaaatcttgttttgggttgagctttgtgctaagtgctttggatctttgagctctctccctctctatctcaaatcccccttgttctttgtgacctggatctttttgtgtggatttggagtttgggagtctagtgtgtgtttcttttgatcttgagcactaagatttgtccaagagttgtgtggtgtttattactcttggaggttgaggactcctagacggctaggtgtcgttcttgggccaccgatctacgtgtggttggccaagagaagtttgtgaaggccggatctcgcctccgcaaggaaagagatacccttagtggaaggaggagtgcatttgtgcaacctcacgaggatagggttgaaaaagacccggctctttgcgagcccctcaacggaaactagaatcccctcaattgaactccgggaaatacatcgacgcgtaaacctcggtgatattctcactctctttaccttcttgttccattgttttgtgctatgctaatattgttgttggtcgagctcacctctttgcttgtggattgaatctagagctcttaggttgttctcttgtttgtattattgttgtgcaggtcagatagtctgatctcagttcagactatccgatcacataggactatccgacctgatatcagacaatccgaccctattttgttttagcttccgcatttattttaaaaaaccgcctattcacccccctctaggcgacatcaaggtcctttcaaccatgaatagagtacccactagttgggttttatttattctagggtgaacaaggtaataataacaatagcaataataataaattcatgacaaaggtaaataggcatggctaaataaaacagtgataacgcaggaatttaaataaagcgataatgcattaatttaaatcaaaataattttataaactgggattcaatatgctcaatgatgatatgacttgccttgctcagagagaacggccttccgaaccttcggcgacgaccgcgaaccacgcttcggaaacctctagaacaacagaagctacgcgaagcacacaagcaaagctacaagcctataaagaagcaataacaatacataaaaagaaaagcacaaggttctttaggttataaaaaacattaggagacttgaacggttcgattcggagttcgtatgaccaagatatgatcatccgaagtttaatgttgttacatggagatttatagattattgtaattaggttttgcaactataaaacatgtgtaagcgctagcctggaaaagacaggaaggctgcgctattgacatgcggaccccacatgtcaacctaagggaccacggtagaccgagtacacagagacggtccacgggtcgacggaagcgtaccccgtgtgtcaaccgaggcaagtggccgacaaacggactccactagacaccacgtgggctgcacatgtggaaaccatgcggctaccgagcaggcacactaacacggtcaccacacgcacacacaaacgactaccgacaccggtacacgggtaccggggtcgacaaccgcacaattgtcacgggcgacaccgaaaggacgaggacgggggcagcgagaggacagacccttaccaccacgcaacaaggcgtgggaacgacgacggcgaatgggcgcggcggagatggctcggggacgacgtaggcgaacggcgagggaacgactttggcggcgatccttggacgaaggcgagacaaggccggcacaaggcttgacgacgcggagccgaggacgaagacgacgacggggctgcagcggctcccttgacggacgcggacgacgaacgagcacggcttgacgaagggagggccgacaacaagcgcaaccgggaacgatgagaggacgacgacaaagaccggcggggttcggatggaggggaggtgaggccgaggacgaccttgccgctgtgatgccaaaggtggtggaggtgcggccgaccgttgcaagggcgaggaggaaggggcggccgaccgttgcaagggcgaggaggaaggggcggccgaagggactggcgagagggcggatgggttggcggcggcttgcagcggttttccgggcgaaacagaggagcagccagaggaaaggacgacgctgcgacgtcgacggaggagacggcgacgtcggtcggtgctcgggcacggcggaaggggctgctggaggtgatgcagtggcggcaacgccactgtttaccggtgaggacgcgtctccgatggtttccccgtgaaacggaggcgacgccggggaagaggatgcacctgcgaggccgagggtggcgacagcgcaaccggacggtgcacggtcatggcaggaggtgcggctggaggtcggccggcgccggagagagagaaggagaaggcggggagaggcggggcggccacgggagagcgcgggatggggctaaaactggagaacgggccgagggggttccattttttagatgaggggagggagccggccacgggggaggtcggaaggaaggcgggaatggcggccggcggccatggaaagcggctggggttggcgcgttcgttcccggcgattgggggcacgaatcaagagggaaaacagaggaaatcaaagaggaatcaatggggattaaaaccccccaattaatttggaaagagccggcttgaatggggtggatttggaggaggaatcggcgctagggttcacgggtgagagaggaggccgtgcgggaggaaggagacgaccgggtgggtgggacccactggtcaggcgcagtcagcccgcgtgcggcgtgcgtgagggtcgctggagggaggcggccgctcggcttgggccggggcaggcccaggcgggaggaggagaggagggagtgggccagccgggaaggagggaagaaaggaaaagagagggagggaggagagactttgggtcagctttggcccaaaggaggaaggaggattatttttagtttttctttttaataaactttgttaattgttgttgttgcttaataattatttccggcgttctgaaaatttaagtaaaatttgagagctccttttagaccaaggagaatttaacaaaaattctccgggccacattcaaatttttcttgtatgtattttagtgtttgccaatttcttttcgaattttaattaattctattattccttttaaagaataatttttatttcgggatgaatttatcaggacgtgacaactgagctgtcaccatcagcggcccacctctcatccgcagcatataacaccaaataatgatatcccgtaatctagacacaaatgtatatagaaaagtattctaataaaagcacaaagcttacaaaagagaagagaaaagctactagagccatacccgaactcttccgaagactttcgtactcctgatttctactctattcctattccaccagctagatactactaaactaaacttgtgagaaatgagagagatcttgcttgaggtgtgtgagtgaagtgagaaggtgaagtccatatagaggtagttatgatggttgtgaaaggggaattgttcgaagtgccctccaaccgtcattgggatgcaattttggacgtccacgccgaaccctgcatccaacggtgccaggatgggctgggccatcctggcccatcttcgggtggcggcctcctctattgcttcactatgcagacttgtaaattttggcccagatcatcgtgttaactttgagttcttggcctattcatgcataaatctgattctcgacatcgtccgattgattttatcgtttgtgttgtcaaaatgacaactgcatacatcgaaagacatatttactcaaaggtggttggaagaaaacgaagtgtattgaattttgatttttcacttgggatccccctattacatggccctaggggactatttatagccccattacaggttcttactactagggtttaggttatacaggggaatttacatgattacccttacgaaagagacatttacaggggtacataatgttataggggctcatgggcccctgatgggccgtctggcgattgccggccctatagcccctaggcttgatgggccggaaaggcttcttcagccctcgcgggggcgaacttgccaaggcgaagtcgccttccttcggcagatagtcttcgccttgcacccttcgcccgagacgcctctggcctggcaaggcactcgtacgactcttcgcctcacaccgttcttgctccatagccttcgccacgggtttcggcagatgtggttgaagggcctcatgccatccgccaacaagcctctcacgggcaagggtgagattggagcttcggccgagaccgtgcaaaccatgtggtatggtatgcggcgccccctttcgaccgatgctcctgccgaaacctacattattctgcgaatgaagtttgttatttgtgcggcttgtattattttgccgcactttgcctcctgcgttgggc

SEQ ID NO: 60077 - DNA, 4873 bp, Oryza sativa
atgcttttatgcatattttctttaagaataatctatctccacttgtacttggaattttatttggttgcagagaactttacataattggaggagaatcgatggaaattaaccgaacaatcaatcgaaatccgtcgagaggtagacttatgggtgatgggcttacaaatccagtaaaataacatcaaatggcccaaccactacactactggaccgaggagtcatcacacaacgcacctgcaaatttgtgggttgattgggccaggctagggttcggctgaacccccaccagcgccggtgatcgcctcctttcacatggacgtccaggattgctccccaatgacggttgcgggtatttcggaatattccgaccatcacaaccgtcattggcagcctataaatggaggtcccttcgctctactccaacacacactcaagaaaaagatcaagaagctctctctcaagtttagtttactgttctagtgctagtggagtaagaatagagtagttctcttagacctcgagtctttaggagatttcgagtaaggctctagctcttccttcttttgtaagacttatagtattaataaaatattcttctttatatagctttggtcttttacttaattcatactattcaagtaccgactttagttcgtatttgtctcgatataataatgtagctagcttacgagagatatgcattggtgtgggtttaatgttcatttctatgattgctctatgtctgctgcagtgatatggagtagtatttagtaatgtaagcgtgacgcttagattattagtaccattaattggggttatatgctatgggtcagtagaagtgggctgctgatggtgaaaactcagtacgggtattcctccacgttcgtatataatactaagacactttcctagtatgggtactcctctgtattcaataccgatcggatgtccatgacgggttgtcgtaagaaaaatggcaatcagggttagtcttttgaaacaccaggagggcatagttagggggtttggttggatgatcgtatattagtaagtgtaaactaaagatgactatatattagaagtacaggaatgaatcttttgttcttctttctccacttagcctagattatagttcttagttatttcttttgtgtgtcaatcttatcctaccccttgaattgattaacccctgcatatactttggtgaatacaagtaatatataaattattagcatagtactcttttagcatatctccccttgagattaaataaatacgataacttggaatacttccgggtgaaatgctacaatggtatattcgtgcgcttgcggattatatctataaccgtaaaatatatcgggaatatttcaacgccattactaggaattatatttctagtaatatcgttaagaaataccaacaaacatttctagcgccgttgccgaggaagtttaatgattaagagtttactacatgctaataatcttatatttaccttggtataatcactgtcctttacaggctacccttgattgtttttgttttattatgaaaacaggatagtacatgattggtttcaatttgccgaaaaacttccatgacaacacaaaagccttctttaggagcgtcaaaccacgtgttgtccctccttagaagactctatcgacagagaaaccagccatccaagcgtcaccaaccttcaataccatggctcagaacactctccgcgagttcgttgctcactctgttgacaatgagcccattgggccgcaagtcaagttaggagacggtgactttgacttgaaaaccagcgtaattacgatggcacaagctaacccgttttgcggcaagcctaacgaggatgctagtgctcatttgcaacagtttctcgagatcagtagcacctagaccatgaaggagttagcccagatgccattagactccgcctgttcccgttctccctccttgggagagctaaacaatgattctatgccaaccgtgcaacggtgaacacgtggaacaaatgctctacatcattcctctcaaaattcttctcgatgggcaagaccaacgcccttcgcgagagaatatccagctttcagaacacgagagatgagacgattcctgaagctcaggaagggttataggagtacgtcaccgtctatcctcatcataggatggacaagtggcttatcctgcaaagtttctataacagactaactccctcgtcccaggatcacctggatgctgcagctggaggagccttcttctacgagacggttagaggcgccgtagatttaatcgagaagatggtctcgaacatgggttggagcgaggaacaactccaaacccgtcaacgcgacatgcacaatgttaaggagacggaaatgcttgctgccaagttggatctcctgatgaaacgactggacgatcaagagaagaacatgcctcaaggcaccgtcaaggccttggactcacacatcacatgtggagtctgcagcaacgcggatcattccgggactagtgttgtggataacggttggtacggccgtatattcagatgtcaagacggtggcactgacctctccgccacattttagcaaaacggtgcacattagtcgtttcagctagtgttgtggatgacggaatacggatgtcgtcggacttcctccgaacataagttccttgcttccgatgatgatcatgagactgaagtttcagataatgatgttgcacttgatgatgattctttggagtaactcgtatcttattaatttgggaccttgttttagtgtcacttatatagtgttacctgctttcggtattcctttatgcattacgaaccaaacctatcactatttgatgcacaactacgagtgttcagacctatattttactatatgtcgagttaacatcatgttatccttatttttatttaagaataataggtatatacacagttatatgcatttatctgtaaaaaataataagctattatgagttatgtacatatatttgttcaaaacgttaaatttccgtcaaattccgattattcgtccgtactccgattaatcgtttagcggtaccctctccatccgacatccgtattccgattgttacaaactttgcaacatgcatatttaaattgtagttcttattatttggtaaaacattcataaacccatttataacaaaagaaaaatgctaactgccgtattccatgcccaggtgacaccggccgcagggcccaagaaccatcaggttaacgctgtcagggactttcggctcaacgtacttccttgcagcggcgagggctgtctcggcctcccggagagcctctgtactcatcttcctgcaccgatcataggaggagcacttcctgtcgtaaccaggggaggtgtcaagcgtcaggtgttcgagcgataacgctgcgatcacgaggatatggcatgtcagctcgaccaggctattcgccgagcagaaaccggtgatggtcaccttcctcaggttgccgacgatgccaccattgcggagtttgctggcctcccgccccctacatgaagctccatcgtcaggattcccacggttctggtcgttgtaccatctgataccatatgcaatctgtaaacatgaatttgattaacatgtcataagttacaaattaattatagagtaaatttgagaaaaccctatattttactgtcaaagttacagaaaaccctaagtatattacggttctaaagttttacataaccccacccacgtaaatgctgagcatggatttaattaaaattctaaaccataattattaatttcttcactaaggtagatagtttaactcttcactacttcgcaaaaaaaaaaaaactgcttcagatattcttgaattaatcaagatttcaataattgtggggatttataaaacatttagatcataaaacataaaaactatggttttgtgatttttttttattttgcaattttgaccataaaatatggggttttctacataaagagttgagagttgtgactgaggattgactcgtaaaatgaaggtctccaaggcaggacaagcatcaacgaaactagccaaagagagaaagtcatagcctgcgcaaaacatagttgattggccaaggcagatgacgagatgcttgagttgttggaatttgtcatgcatcactggtgccttcaacctctgaacaaaaaaagaaaagagatcaaaacattgaattactgagcacgcaaccatgcatgcttaacatgcatgattgcacaaaatagtctcaaccgctcattgatggcaatggtacctagtaaacagtcgacagcacaagcgtttctagattcagcgcggcggaggggagcttggagccggcatactggataacgtcccccattcgagtggcatgcacctccagatgcgtcctctcgagcgcgccaccgagccagaacctcagcagcggccacccgtcgtaccagaccgtggcgagcatcggcgcgccgctctcgatggtccgcagcatcctgcacgagcgcacccgtagggaccttagccgccggagtgcactaggtatcttgagggcgcctatcgaattgcagaaggacagatccagccgctccagcacaaggcagccggcgaggaagaaacccagctcctcgtccgtgatggcgactctgtgcaagcacaccgtcgacatgctcttccagcagccaagcagtgtggtcatcccttctgtagggtggaagccacaggaggacagtgaaagagactgaagcgacgttatcttgtcctcatcgtctgagagaagcgagcagggaaatgtgtactcaggcagacaatcatgaccgtagtagtagtaacagtcgt

SEQ ID NO: 60078 - DNA, 7063 bp, Oryza sativa
agaagtccatttctccagattaactcccttgcttagcttgctagccttctctcctccccaaaaaaggactcctttgccttcttcaagaaaaagacatccatccttcctccaaaaaccaaccaaatcaaacccaagaaaccaaaaccaaaaccaaaaccaaaatagaagctcgatcgatcgcacaaccaccatgacgaacatctaaatgactcgccgccaccgacggcgacgatgaggaggaggagatcgagtgagtatgagtagtatatacctggtgttggaggtggaagatgtgggcgacgcagccgtagacggggtcgcggaggcgggcctgggcctcgtagcagatggtgacgacggcgtcgaggcggcggtgcgccgggatctgctgcagcagcttggacacgttgctggcgccgaacaccttgtgcaccgccgcgaagtgcgccgccccggcctccgagtcgaagtagggcgcgaagatgcacccctgcacgcacttccgccgcaagaacttgcacgccccgcacggcccacctcctcctccacctccggcgccgccacctcctcctcctcctccgccgccgctgccgctgccgctcgcgctcacaaccaccgacgagctcattcttggaatgagcccccaccacctagtctctagctctcttctcctacctgctagatgttgttaccttggcttgtgtagggttaaaactaactcaagatcgaccgactagtagcaagagagagatagacagcgaaaattgtttgtttctctctctagaactgaatcgattttctttctcacaaatggtagagagagagagagtgtgtgtgtggagtaagaatggaggaatgaggtgggggcggctgtacatataggagggaagaagggcaaaagcgtaaatacagcagcaaagtgataagtaggctgtttgcaatcccattggtggaggctggtgtatatatccatatatttctatactagtccctacttaattactgccaattttgggcctagctagctttatttactttatttttatttctttctatgttttcttaaatgcatttttatttctttatgttgttgctggaattatacatattaatggaatttttttatttaggtcatatataaatgtatatcagctactaggtggttttctatctctgtgttttctttttggtgccgttgtattgatgagactttaaagccaaggcaaatgcttgcaattggccttggcaacaagtacacttctctttctcaaagggttagaatattgcgtgaagcaaactggcctggctgggggagaacagcaaagaccgaaaattaatgccaattgcatccatccattcgctctcatctctctttttttgtttttttgggttagtttctctctctgtcaccaccatatatattgatcacatttcacaccacctgcacagaccaacaaggatgatctcgtcgcatgcactctctcccatgtgatcctaacatgacattcttccactcaatacgccacacacaaaattgttagtttttttaatcataccagaacttttatttagataaattatagtgtatgtatatattatagttaagcacaaaaataaattataatgcagacagggtaaccccaaatattgactaggatgatgtaaaaatcttattttagcacaaattgagggtggataatcgggataatataccaaatagaaccgctaatgctatcaatggtagcttatcttgtccattcagtataaaagtatacttcaccgatttattaccccatacaatttgagcgagtaaccgacaaaagtttctaaacatagattatcaattgtaatatatcattatttatattttttaattcattccccaaataatactaatgctacgattatcggaggcatcttctaagtttagcgtattggcacactgacatgatggtgattgtccagataaacttctaaacatagatagaactaatgttacgaatcgtaacgtaactatttaatctatttcaattcattcctcacagaaaaatatattcatcgtttaataatcccacataattagagcgattgtggatgtaaacttctaaatatagatagcactagtgttacgaatcgtaacgtaactaattatttaatctattccatacctcttaacaactatatatatcatcatttaatcgttccacataattagagccgtggatataaacttctaaacatagatggataatgacatatatgatacaccagatcataatgctagtgctatatgaattgtaagataacaatttaatcttttgcaaaacatgtagttaaaaagaataaaacggtaggtttatcggtcacatattctaaacttagagctctaacacaaatacattctattaatcatgccatatctagataaacttctaaacatagatatagttctagtgtcatgagtcgtaatgtaactgtgtacgtaatctatttcattcctgatgaaaaaaatattatatatcatcgatggtcctataaaattagagcgattgtgggtgtaaacttctaaattaacatagatagatcaagatataatgacatatcatgagagcgactgcatagatatagactctttaacatggatttcatctaatatggagtggtttaattagtagatttgatataagatggtaatgttgttttacttttatcttagcaaggactagtagtgtcaaggtagaaagccaacttctccaatttactgtttgaatgcagtggtgtaagtaaatggttttattgttcttttagtagacagcataaaataatatatgtaaaactatagcttgtaggtggcatcctctaatcgacaatatcagttttttgttctatattttcgcacattataaccaatatgtggtgatatgatttttcagacatagatataatctataatgccacatatatacattcaatcaaaatttccgcaatataaccgaagtggttgatatgaacatctaaagttagatggagagcaaaatgggctggattatgtatcagtaatatattaccatcataaatagcgtatataatttattattttttgctggctttggattgtatcactaaaaaagtgcagttatttttttcgacgtatctatctagctaacgcaaggatagaaattcaagagctccaaaaagttattctttgagtatgaaggcttaattaaatatatagctagctgccagctgcgtccgtacgttgtcaacgtatgcatgttatgaactgctgcctagctttggactctcttcattcagtgatcgatcgatcaggtgagaagtaaagtaaatgtgtggctctgatctgcattctgcaacgcgctagctaccttaagcttactgcattgctcatctcacatccgttacaaagtgtacgtaccacacatgttaagccaaacagagagaagaaaattaaagcaaatgaaagagaaaaataaaaaggacacgacaatgaccatctgtatccggaaaccgttgcagagcttgcgtgaatttcgaggcatcgatggatcgatccatgcatgcccagacatgcatgggaatcaccgccagccatcagctctagacacttcaccgcctgcagttacgacttacaaaactttatgtttccttgaggttacatttgaccaagatcatatacgcgtaacacgtatatataatcatgcagtagtttaatttttatatgaaagattttctcatatacatataatacatgtataatatgtatgagatatcaagataatgggttacaaaggatgtgattgtgaaataaaaatagatgcagggtcgggataatatggggtgcggtggaggttaaaacttatcctttaaagagtgagataatacttctcaaacccaattttcaaacatgtcatacataaatatatgtatggacaatgattttatcagtttttccataatcacatgtgttattacagcaaagagtacctcttccttgggtaagatatagtaacatgtaaatatgtgtgaatgatgtgtgcacagtttgaaccaaagcatatgctagcttctaggtagatgcagcactagagctggcatgcatggactgtgtgatcactgtacagtatggcctgattgatcaggagagtgtgtaccaagcaaacccttctttctctctctctctctctcccatacacacagagaatataatgtgcatctgagatctatagatggatgcgtggaagccaaaagacggcaccctggctaggtaagaaacttgcatgcttgaccacacctctcaaattcaccacttaaagttttttgtgactcaaacacacaatcttatcacaatttaattaattaattatgggccaggtgtccattgatccatcgttaatttctagttatactaatcatcaaattaattgtcacatcaaactggaattcatgatcaataattgacaacgtacaactgtatcactgataaaaaaaaacatggagtcctagctacaaaattcttcaatgtcagtactaaccatccatatggagaatgctgctaaatagtactgcactctttcatatggagaatatgcgtacatatttagcttataccctaaatatatacatatatcaaaaatacccctggagttgaagaaataccatgcatcaaatagatccaaaagtggttatttcctttttgtcctttcttaagttctccatttccacagaactactatagacaaattaaaccactttttttggttgaaagtatccattgctttattagttgtgcttatatatattacacattaattccttagcaagcatctgctgaattatttattcttttatgcaaggaattaagataattaaaatgaattggtcagcaacagaatttggtactactactttacaggtcaagtgaactccaggcatatatatggatgtacatacagttgagatcacatttttttgtcttgcattgctcctgaaccttttgtcctttgcaatatatcttggacggcagcaaagcagttacttcaactttattctgatatttaggagaaactgttggatggatccatgcaggatccagaaaacatggtagtgatttacaaaagctgtactaacgtagctttctccttggagcagctccaatgtgatccatcgatatgagaggctccagtttttgtcaaaagtattataaaaatatatatgtggctacgtaccagaagtattgtacttgccactgacgccaaattaaaccattcaaactaatataattaaattaattaactgtgtaacgtacgtttaattaatttattcatacatttttaattaactttagtcacgatagtagcaagcttgatgcgttgatcaggtgacctgtttcttgcagcgtttgttctatctggaagctagctggttaattttgactagtttcttgcagccgtacacagccaatgtttccattcatgtttgtatatgtagtctacgatcgacttgatgtatttattcgcatacaaggaatgtaggcagagcactagctacaggacaaaggcaccatatttttccatcgattttaacaatttagcaacttcttaacttaatatgatgcaagagaggaagagactgcatcgatttctgtgtattatatatgaaaaaaaatgttttagtaataacttcttaccgctgagttttctgaactttttcctcacggtcacaattaagcaattttaggggctcctttcaaacgtggaattgaaaaacggagaaatagaaaaagcagaggatttcgacatgtatactaaaggattgtaaaatacagaaaaaatataaaaatagtcgtttgattagacctgagaaaaaacatataaatcagatataagaaagatagtcttgaaggataattaatttttaagatgttggagctcttgctaacttattttgtttttaaaacctctacgggattgactattccatagaaattttaaaggacgattaaatccttcgttttaaaaccattcctaattatttctccaatagaattaaaatccattaaaatttctatgtgtttttccagtaaaaaaaatcaaatggaccctaataacatgaaggcccgtagaaacacagagttagatcatctaggtgcatgcatgcaagaattttatgatagtattgtcggaataaacagtttttgtgattttttttagcataccttggcctagtaacataaaagcccgtgtggcccattgtttagtgttggtgggattaatctccacaaagtgagtttaattaattaagcaggttgggccagtatacgatcgacatgttccaaacataacacatgttaagccttttacatgaagaaatgatctaagtataagtacgtcccaatagctaattagacctagttttatttcaaattttgagatataagacgaatttctttgatagatttgacttaggtacgtttagcgagttttgaggaatttgacttagatttgacatatttttatatcatttaagttggatttgatatacattttttaacagatttgacagacttagatttgtaaaaactactaaacatactcataatttgacagcatccatccttatctgtatatagtttctttctttttctttcttttagaggtattttggtctttttatcctgtatattccatacactcctaacacttggttagaaaagggtcggacagcgagttccactactacatgatagattttcctagacgtcgcccccttttgtttccatgcggtccgtaagtggaaccgcatagaaaaatagggggacaagcgctgggctgtcacccgcacgggaaaatgcattatcccatgcgggctactaagccaaccgcacacaaattgtcacccgtacgggcccacctcttttaaccacgcccgcgcgcaccatctcccactccacccgctcctccacctccctctctcccactccactcctctcctcctctcatcccactctcctctcctctcctctcatccactctgtctcggccgg

SEQ ID NO: 60079 - DNA, 648 bp, Oryza sativa
ggggccgggcagctgacggccgggccccacacggcgcgcccagaggcggccacgtcggcgcggccggcgggaggcggcgcccgtgccccgatggttgccgccggcgaccatcggcgcagcggagcggcgaccgagaggggaagggaagggggaaaagaggcggtggtcctcagctcatcccgggtgatggcggcgacgaaggaggcggccggagcggagggaggtggtggcgcggctcgggtcaacggggacggcggcgttccggcggtcgacgggctcggcgtggtggtggacgacgtcggcggcggcgccgaggcgggaggaagtccgaggcagcgacggagggcggctggagcacggcggcgacggcggagagagagggcgacggcgcgggctcgattccgatggggaggctgggcggcaaacggcggaaacggacaagggaggtacggggagggtttgtatgggatcggggcgagagagggcggccggaggagggggaaacgggcgtgggagacccggctgccttcaatggcgccggcgagattaggggaggggtttccaagcgaatccgagggagagagaggggaaaatgggagaaaggaggagggaatcgggggaaataattcccccattcaattttgaatg

SEQ ID NO: 60080 - DNA, 1150 bp, Oryza sativa
agggttagtccacataggttatgatcagagttgaagaattcatagagaaaatcttactggtggagctggcttgggtggtgctgctacagatttcttctttacagcagtcttctttttctgcaaatacaagatttatgagtaatcggttacgaatataataattgcaaaaggaaatcaatgtgagatgtttacccttgagaagtgagctggagcagcgggagttggagcagtttgcttgcgtgaagccaatggtgttttttctccttcactcaactcggctaccgcctaatcgacatcttccccgatttcttcttcatccaaggcttgctcgatagatggatctaaggcaggcaagtcatcggctggtttgggcttatccttcttggtttttttcttgggagctaaagccgatggatcaatagccgatgttttggttttcctcttcctacccacatcggctggttctctcatttgcccttgaagtagacttgacgtcctgggggcatggtagccgatgacagggggagctagtccacctccatttggtagaaggcttggagcatattctatgtccctgccacggttgcttttgcgaggaggggaggattctgctgtctgtcgaaagagggaaaaagttagttaagatttaagtcgcctaacaattattcaagcaaaattgacaaagtaaagatgtacctgagggacaacatccggatatagatctgtcatgtacatagaggctggctgatggaatatatgttgcttccattcaccccaccatctgtcaaggttcttactcctgaaccttgccagctctatgttctatatactgcctaaaggaggtcctgggatgttgatcagccgatcaatcatcaacattgatgagatttctcctctgcactggatcttatcggcaaagaacaagccgattggtagctgtcccattccaaactgcctagctgagcttattggatggtagaactcataagacacctgtatgtttctcccttggtggatgtcaacagaaaggatgcatggactaatggcagccgagaagacttctttggactagtaaaatttcttagagttgatgtcttcgaatctgaagtccgatggaaggtcgaaattcactgaatcctcatatggaaac

SEQ ID NO: 60081 - DNA, 5809 bp, Oryza sativa
atgaatttgagtatttaaaatatttcaaatgaaaaagtcaagttgtagagctctaaatttcatacaaaatttattataatccgtgtccatatgaaaagaataagtcaaattatgagatgataatttttttatttcaacgaatttgttgatcgtggcaacagaaaatagtgaaaagtaccatgtactatgtaaattgccacataaattaaaattgtggcgatagagtatgttttttgcaataataatgtttttgtggcgatagctcatttcctgttgcaacaaaaatattgaataaaacaatgattgtaaatcgttgcaccaaaatatagttatttgccataggaaaaatatcattgcgatagtataatatattgtcactaattattttttataataaattggtggcgatagctcaattatcttgtaaaaggtgactagtattgtccattagccagatcagcaaaagttcaccatagagccaagaaattaagcatccttgggtaaagatttgattggtgtgtgtcaatctatctatataactatataattagtgtaaagttaatggatacgatgtttaatatttgatgcggaaattaaacatcctatcatttaactttacactaattataaattttctataggatactcaaaatttgtagtatgtctttgttgttggatacctcaaaaatatgacacggtgggtaggacacccaaaaatatatagtaatttgttgagggggaacacggcaacaattatttttttttattttcgagtcaaatgaagagagacggcacgcgtaaaagatgattttgcccctcggactagcaggttgtaacacagctaggcccctactttccctccccaatcgatcccctctccaacacctagaaattgtaggctgcagcaacaatgtccatagcgatggccattacaagatgttggcctaagggaaaagttgtcttccaaatgtttgtcctctcgatttggctcgaaaatgataaaataattgttatgagtaaattgcacccacggtacaataacttgtcaggtaggtgcaatttggtgtaataatttaaaaaatgagcgttaagtgcaacaacttggcaagaaggcgcaatttagtataagaactttataagtaatcgtataaatgcaacaatttgtaaggtagatacgattttaatacaataaattaagaagttgtgtgacaacttaattatttggagcattttttatataaattcaaatttttaagtacttatttcgacaatatactagtgtggatttgtataaacatatttatatttttatcctaataactaataactgaaagtcaatcaaactggatgtagaaattattatatttcggttgatatttgaggagttgaagaaaacaaaaaattcttaaacgttactgaatgtaaattgtatgtgcaatataattctcaaagattaaattcaatattataaggctatgtattggcatattgacatcgggaaaacctcacctagcatatgtttagccaaattgatccaccaaaatactaaattgtcaagttcttgtattagaacgcacccacttgtcaagttgttgcactcagacgttcaattctcaagttcttgcactacatcgcacccacttgccaagttggtgtaccgtgggtgcaatttactctaattgttatggtatcccccagtagattactaggaacatgtcctatagccatgtcatattttttttaaggtgttcagcaataaagatcataaattgtaagtgttctatagcaaattttgtcctaattataatatgagagatactaagacttggtaggtaccaaatttagctctcacaaattataatttttggactcttactgtacgttttgtagtgccattaaaagctgaaagaaagggaaagaagattgctaaagtgatgttctagatttggaaaaagagatgctatcatttttaagagacatcatatgaagaacaaacatatctaacccctttacaacaagtaccttagccacaatatggcagcgctcctacaaaccatgagacttgtatgcattgtatctgcctatctggtattacggtgctcttctcatcgacacaagtgacaccctattatggacaaagcaaatcagcaaaaagaaatagcaccaaacttagcagccaacgagcaaaaaatgtaagttcaattccccaagcctcccaaacctaaagggtttacgaatggttggtttttagctggatacatgggttccttttagaaaggaacatgaaagagacatcaaccagtggagtgtatttatagcaagatttgctacaatttttcttttacaaaaatgtgcccggatttatttattggctagaaatataaagctgaagctgacacagagaatggcattcaaactccagaccaaaaccctagttatacctgtgctattgcagttaacatggttcctaggccatagggttttttactgcagaaatctgcatcgcttgagaattctataaaaccagagatattttgtaacacacaaaagggtccatgctgccagtttagccctttattcacttgcgcggtgatttgatctctgttctctggcatggtggcatcggcatccataaaaccacaactcctgctcaaagattggttcagctagcactagctaggacatcggctaatcattcttgagtctcgactaatgaaccatagagtacccaggatcggttgattgatgaaccatgcatagagcacccaagatcggcacatcaaatgtgctccatggatgtactaccacaatacttgcatcagatgtactagtagaacactggcataaataatttcaacagacatgaatacactatagaaattagattttatcagatttcggatggtatcttaccataaagtttgaaatataaaagtgtgatgcattcttccccagtacctgtataacagactgccggtaggcactcccatagtgcaactttacatacatacgaaactatgaaagcataggcattagtgtgtccagccacataactgaaaggtaattccagtcgctaaatacagaaattgtcgatagcaaaatcacttcatgaatgtattttacatggctgtcgtgcaacactgcattgacaaacctgcccatgcatatcaatgtccacagcaaaagacatcaacctcctctgcatcaggtaacaatgatcttggccttgtcagacaccctcggcagagccaatagcttcttaagaactttactgcccaatgaaaaagccctagtgcaatccacatttatcttcacttcctctaaaaccggtgcccagctcagtagctttcctacaaaatcaacttcgtagtccaaacccaggaagtcattcacgcttacagttacgaggtggtccatttgaagggttagatctgcaatgctcgtctgatcttgatcccacaagctcattggcccaaaatcattatcccatgggaaactctgcacaatcaatttttaatcaacgtatcaaatgtaaatagtaccaaaatttcagtcattcaaggagataaggatagagattgacgaatatataaaaggcatacccatagctcaagctttttgaggataggagcattctgaaacaatgacacggccggtcaggatttccctttggtcccagaagcatatctctaataacatcatctcgaggtgatcaaacacagcagggatcttcgtcattatgcacccttttgatagatactgcaaccagaaaaatgaatgatgagaaataccaacacagcataatcaggacaacatcatcataatgctgaaaataacaatgaatcaccgtcaagaaatagccgttgatgacaagtttttcgatgtcacttaggcttcccaatgcctgcttgaggtaacttttcccaccatgcacaactggaacagattggtattcttgagctttgtgcagagtgacatttgcagtctccagattaggggcatccaaatggaagtcttcatacttcccatcaacctctagaatttcaagttcaggagctcgaatgttcagacagctgatgccttcaaaggatttcaaaaccagcacagacaactcagggcagcaggaaatcagattatcaatgtcactgtctgtggaggagaaattttccaggtccaaagtagttaaccactcaaaacctttgaacatttggggcaaactgatgatgcagttctttatgtccagatgctccaaatcactgatggagaagaagcatgatggtatcctataccttgacgcagaggtcaatttgattgtaactgaatttggtgacttcattgacagcttgtgcatccacctaccaaatacgtcgtggtaatttttgctccctaaaattgtaatcccatgcagaggtcccctgtggagtgataacgccatatcgaccaatgtaataaacttgggtggtgcacttgttactgaaccttgacaggaagtgtaggtgcaatcacacagcaacatctctggaatagtagtccatgtgctcctccaaacgcttgacaggatgttagttctgacagcatcttgaacattcagacgagagaggatatcggcttttatctctagaggtagactgctcaatctgtctgacttcgcggcacgtctagacttcaccttggccttctttgagctacccattactttgaaaatgccctgtcgttaccagaaagcagcaaacttagatgggtatgcattccatcgccagcctcggaggaaaaataaataatagaaatcacaaaatatagtacagtgaagttgattgaggacagagtaaagtactgatgactagccagcattcagagaaacaagactggaaaatttttttaaccgaacttaacacgccgactcgtgggtccttctctgaaagcaactctaattgtcagttaaagtgtgtataaaccatctggtaaggaatcattatcaactatcagctgcagagatcaaacttgtgcacagctgcaagtatggaaccactggatcggtaagcatagcacagtttctgctgttgagatgaacccatcagaccaaggatcaagtggcacagcacatgtttggggtatcacatcaaatacatatgagaaaatcccttatgtacccatgaattttcgcccaatttcttctgtgcccctaaattttgtcttatcccctacgcacccttgagttttcatttttatccctgatatacccattccgtgagttgactgtcaattgactgttagatttttccaaaaatgtctacattacccttgtgtcttacttattgcttagtacagagtagttgattaaaaaaacatggctctcaaggtaaaagttgattcatttataaaaccaaacatgccataattacttaatctaaaacatagatttttaaataggtttcaaatcagatttgatgaaatttattgaaaattttcgctgaaatttaaataaaaaacagttttggtttttcgaattccgaataaaacattttttggatttcattatctttaaaaaaatgtttgaaaaattaattttgttttcgaaatccaatgttaataatcatgtccctttttttatttttaggttaagctttttttattaacaagacttatgtttttaaattagaaagcatgaagtacaagcgaagggcaatatagtcattttgggacaattctaacggtcaattcacagtcaactcacaacatgggtatagaagggatcaaaataaaaactcagggacatacagaggatgaggcaaaattcaagggcacgtga

SEQ ID NO: 60082 - DNA, 1609 bp, Oryza sativa
caaatgcatgagaatcaggaacggagttaaacaaaaaggggaagtctaaccctacatgaacaactctgcatcacaaatttcacccggtagcatttctttcttgcaagatccatcgaagaacggacaggttcttgattatggccacaacgacaagaaaactaaaacaaacccttcacagcccagcccccatggcgtctgaatcatcatcagcagatcgcatacgaaaattctctaaccaatcccagccaagaatcacacatctagaatgaactagcgtagaaaaggtgcaccatcatcatcatcatcagttcatcatcaccacacgaagtcacgaagaggagaaaggggtggttacctagaaggaataatcaatggaggatcggtgggtgaggcccttaccaggagagacgacgaagaggcaatgcgaggggcgcggccaagcgcagacggggagagggagggagggaggcggccggtcgtacggcgcgaggcggcgatcggtggcggcgacggcgaggttttcgcttccccctctccgccgagagaggatgagaggagagtgaagagaggctgggccggataggcgcattttgggcctcaattggatgggcccatatgtcggctttgattttttttttcaaacttatttttttggtttggttaagtttatagaaaatttgacaaaatctatatttcttttatttttcataatatttttgttttgtgctgaaaatattattatatttttctataaagtcggtcaaacttttaggaaaaagtgaaaatagtccctaatatgaaatggagggagtacaattataggccaaatttgggcccataaagtggtgggctgagatttcggtccatctaaaggaaggacacggatggacctccatcccagttaaaaggggccgactggacattgaccgtacgtccgtattgcagtcatgtgttagaatttgtttctcttttttttaagcaaaaacgaacaaggtttattatttttgtttcagaaaaagcaaaaaaaaagagaaaatttcataaaactacatgtattttgaataaattatcaaacaaactatatatttaacatgatgtatcacaaaactatagatttaacactaaaattattatagaactatagaatggaatatcacaaaactacgcatttagtaacacagttatcaccatattatagaatttaaatatcataaaactataaatttagttacaaagttaccataaaacttggacacctttaactctaacataacattattgattattgttaatgatttgaactcaaaaatatatagttttgtgataattttattattaaacatgtagttttgtgataaatttagtgttcaatctgtagttttgtgatatatcacattaaatctataattttgtaataatttgaccaaagcatatgtaattttgtggaaattataattaaaaaaagttcacaatcgctgccggctgccgctgtcatttttgcttgggatcacagctgcttcagatacacccacatctcaaatgcaaagcttcatcatcaaattaaagaaagaaaaaccttcgaagcatttcattctacaaacgttgggct

SEQ ID NO: 60083 - DNA, 8590 bp, Oryza sativa
ttttttaataactgtacctggaaagcgttgccgtctaaaagaaacaaacacagaaagcatgtcacccatgtcatgtcatgtggtggttcattatccgcaatcgcctcttgtacatatgtcacgtgcataccaccaatcaatgacaccaacgcatcaaagaccacagacaataatcacactgctgttttttttatgtgcatatcctggttgaccgggaaaattttgttccatcttgacacataagtaaattctcttcttaaggatatagaagggtaaactcactgttatcaaagaaaatagtgcttgagaatctatgcaacataatagcccaccaccaatcacttttgcacgttctacagattaatccctgatattttttatatcatgcgatagtcatgtgtttgtttgaatcaagtaaataacatatatttaaataaacataggcattttaccgatagcaaagcatgggtatttcgctagcattcaagaagaagagaaacttggaaagttaagccatcatgaactaggaaggataatgtgctagagccaacagttcaacacttgattgaactaactgagccaagggaaagaaatagtttgtcactctaatcacaccaataatttttatacatgagaaaatggccgagttaaattatttaatacaccaccaaattacctcactatatgctcctttagctacaacactgtcctccaactttgatcttctcccgtttaccatatactcacaaatcactgaaagctagtataaaaatacacttgcagagaagaaacctgggatggaaacaatatgcatattattgggactaaaattgcatcttggagttgaatttacccgctgggtgccgcaattactatttcttccatactcttctggaacattatttctgtaggttttaagcacccacgaatgtactcctgcccaagttgtgcgcgctcgttgtccccaaacccaaatacaatgcctctgtttgtcactgcaacagtgtggtacaggccagtgctaatttgtgaaacatagtgatcacgcagactatcgaggactcgaggcctcattactttgtcggatgatcctcggtcaggaaaccctaaactcccaaagcccatccatccgaatgcaaaaactgagccctcatcagtaagaacaaatgtctttcttttccttgcacagacctgtcaaaattaaaggaacatacttaagcctttatacatgaaactactactagttctgtttcaagatatgattgttattagaacaagaaactcctatatcatattagcatgtagcaatgcataacttttgttttaaatacgaaaaccatagcaatgccctatttcttgctacataaagtatattacctcagcctaatctacatgattgatgatagtttaaaccaggtttattcttcgatgcttaatgaagtaagaaggaaaatggtgcaaacatatggaacacacctgcacagcaacttgactcttcaaactgctgatcaattctgggctagttttgtcattctcatcaccatggcctaatgctccacagtaacctctgccccatgtataaacctaaaattttcaaaccttaacttctgtctgaagatacataacaatcaaaacatacaacagatagttccttgaacagtgtatacttacataacccagtgcatcaagagctacagcatgctcatcaccagcagacacgcgaaccacatgaatattcctcctcttgaatgactggattgcacgtggacgaagttcatcatgctgatctccatgtccaaggcagaagttggtacaagagccaaaggaataaactgttccatcatccgttacagcaaatgtatagctggcaccagcagcaacctgcactaccggagcaaggccttcaaataattcaacgatctttggagtagccctgtctattgtgtcaccatgaccaagctggccatgtgtgttacttccacatgtatatacttgcccatccgttgtaagaatgacagtaaaacttaaaccagtggcaacctgcaaaaaggggaatagatagaattaagaaaaagaggaagagttttgcagacttgactagaccagacatatgaaacaactacctataaggctataacagccttattgtctattaacaaatttagttacaaaaagtagggtcttccctccattttatatcaacaaataaataaatttgaccacaaaactaaaacatcgttcctgttgcatcaaataactagagcattgttctgtttttacaaaatgaaatataataattgaaagaggcatttattccattgtaggagatatggaacataaaaggataataaagatgattgggtccacctgtttgcaagaaattccttttagggcctttatttcggttggtcgaaatatagttcgccccacctcaccgtgaccacagcataatgatgaattatctccacaagtgaagacctatttgaacaaaattcacagcgttcaaagtattagaaatattacaattgacaatatacagtgtttaagatgagcatcaattacctcccctaactctgtgacaaaagctgcatggttgtgagaggcagagatgttgacaacacgagaaagtgatgggaagggaaccctgctgaatgccgcacactgggttgtatctgggccatgacctagcaccccacacaaactggatccacaagaatagacagaagagtcatggaccaaaagtgtgtgatatcttcctgtcgctacttgcatctggaaacatacagcatgttcacatatataagaaaccaggttggaaatgtcttctaacattaaaaagaaaatctaactttccagtttcatactaaagatagaattgttcatgagggaaactattcccaagtgcaacaatgcaacttttgttgatcatttggtcttcatattggcaagcatagcagaatggcaataagtaacatgtccaacatagagcatactctcaaactggtagagcagatgagctaggatgttaataaaagaaaaaaaatctagaataaaagtaaattaggcaccctccagaacaatctgatgcagtaggcacgccaaataattatgcgccatatatttttaaaatgtctgacttgaaattcaatcagtgtaagaaaaacaactaagatatgatggattcaaagcaactgaggcatcagcaacatattcccattcagccaagtgtgtcgtatctaaaagaaaatgaaaaaacacaaggtaccatatgtttattataaatcatttccaatgtccacatatcctcctcattcagaagcatgccaacttacaaatcaataaatcatagaattgttagtaattttgttcatcaggaatgagctggtcaacctctcttaattctataacaagcaaaaaaaaaaagaaaaagctcacaatagactacaaacgcatgccttaacttggtgttaagatgtttcattgtccctagtgtaatccaaatgtggatatccgattcctatcacgaagtttccgaattcacaaagtcatgcatgcatgatcaaacatggatccctaaaacgggcaaaggtgtgaggcaagcacaatcatctctaccaggctatcctacaccacacaaagtcaaactaaggttgcatttactagtatctcagaattcagatgcgaagcaaagaaatcctcacgttgccggaggaggtgtggacggtgccggaggactgctcgacggactgcaggaacctgagcaccttcttccagctgccgccgcaccgctccaggagctccccgcgcgcggcggggcccatggccgcgaacgccgcccgcgcggcgcagagcctggaggcggcgtgctcggcgagcgggcggagcgcgcggcacgtggcctcgagccgcgcgaggtccccggcggcgaggcggccggaggtcaggacctccccgatgaggtggccggggagctcctccatcgagaaagcccgcggcgccttctcccccgtcgccatggatccacccctcccgccgcgatccccgcctccgcccgacgaaatcttggcggccttgcccctggatcgatcggaatcatccaaggacgacgccgaccccgacgccgccgtacggatcgaaatggcgacgaactccgcggcgagctccccccctcccctccggcggatcaaatcgaatcgaatccaatcgaatcgaatcaatcgctcaccaaatcccgccaagaaacactaatccagcagcagagcagagcgaggaattgggggagtaaatccggggtgcgatttgagggcgggggaagcggagaagaatccctccaaatccgaaaatccgcgaggatttatacgctctcgcgcaagcgcatcaacgcacgaacacgagcacgaaccgaaaggaggacgaaaaataaaaataaaaaataaaaaagaagaggaggagcaggagaaattttcttcacgcaagtaaagactaaagaggggctccggaaataaaaaaaaatgcttggatccagaggctcctccactagtagctggcgccgtcacccactgaccagtgggcccagcggcaggtggcctcacctgtcagaagtcacactcacccggtggtggcacgtggcctcgcggtgactgacgaggtggggacagtggagggtggggccggggggtcagtggggttggagggtgcgcgcgggggaaagaaggttcgagatcccggggggaggaggagaggaagaggacgtggcgggcactatcgcctacaggggtgacgtgtcaagccgggattgggcgcgagttggcgatggggacccggcacggtggcacggccaggcgatcggtttcctcggcaactcggcgccacggctggacaaggcgcaggcagcgacaggcgaggggcaatgcaaatggcatggtggggttgcaaattgcaattttgcattattagcggagcaaaagcaccaacggctcgttgattttgttcgctcccatctaatcacattattttttcgtccccagcccgggtggtgttcggtcacaggagtttttgtccaatcccttgtcaacatagtgtggttacagctcgagacttttattgtgctgtgattctttcttttcttattacattatttccgttacacggcggacacaccattatacgtgaaacatgatacacaccactgcgcatgcaacaccacgctcacacttccacgagtgcgtctcttcacacacgctcagagagataaaaactggctgtatatttatgatcacactaaatcctattgatatttacttacgtacgcgtaatatttatgggtagcaagatttgaaccctaatgggtaaagtcatgcactcactaatgactctatcaccaccccgtgctttccttactgtgtagtgattctcgtggcatcatgtctcgatgtttttatgtttatacttggagcacatcctttagtgacataaccttttattgcacactccaccgaaaaccaactatcacatgttcattcttttcaaacactagcgaagtgacaattctttcgtgataggtgatacccctcgagaatcataccatggtccattcttgatgctaccaccaataaattatgagagaatttcttttatgtccaagtcttcgctgctcataatatttctatcaccattatacttacaagagtgaggaagagatgcgggcgacggcggcacgagaggaagacaaaggcggaggcgaaggcggcgatgcgaggcagaggtgacggcgtgagaagaaagcggatacgacagcggcggcgagagaggtaaagggcgagatgacatggaagaggggatgcgggcggcggtggcgcgaggggaagacgaaggcggacgcggaggcggagacggcggcgcgaaacgatactgacggcaccagacagaggtggcggcacgagaggaaagcaaaggcggcggcggcaagagagggagagagcaagagacaacggctagggttttggatctgtgagagccactttgcgaaaaaaaaaccttcagttttgacaattttaagcacagcccttattcacttttttctcttcttcgtgacgaatatctggtttatgtaagggcttaaacgtaaaatatcagttcaaagactgtttgggagggacttagatcgaattaaactcaaactaaagggttttttcgtaaaacttcaagcgcgtactgttcctatcctacgtggatactggatagcgcgtctgcgcgcctaaccggacagccttgaagagtaaattttcatatatttttttttacccacgagtctcaaaatgccctctcgcttgtgaataagtgttgccataaaaatcatgatcctcaaagtgaaaacgagttcaacttaaaattatttgacccttaatttaaggaaaaaccagttcgaaaagcattaaaagttccctttttgattttatagtaccagaagttctcaactcaggggcaacccacattgaaggtatatacaatggtacaacctagtataggctcctaattaaaacacattagttatagattggcttttgagacaacatagcctgcacaaaaaaaaattacttttctttcctcttctctacctccatggaacaaaatttccttcattcaatgttaagagtcgatcttgagttgagttggtgtcatgcgtatgaaagggtcaattaggcctagaggggggtaaataggctaatttacaacttaagaaatgcggaagcagtaattttcagaactaggctgggaattttcggaacttccgaaaggattttcggaacttccgaaaatgcacagagcaatgcacacaaaagaaaaatctagatctagaagtctattacagggaatacaaggcacaatcagcaactagaccaatagtggcacaagcaagcaaagctagaggagagggataaagaaatatcaccaagatgtagctcccaaagttgttcccggagttcaaatccttgaggggattctactctccgttgaggagctcactaagagccgggtctttgctaaccctttcctcaagaggttgtactaagtactcctccttccactaagaggtatatcttcccttgcggaggcgagatccggccttcacaaacttctcccggccaaccacaggtagatcggtggctcgggagtgacacctagccgtctaggagtcctcaacctccaagagtaaaagatgatgtaaagaactcccggagatgatgcaagtgctcacaaatcttcacaaagaccacaagtagcatccacacaaactcgaatccacactctcacacacacacaccaaatctgaatcaaacacgagtggagagatgaatcgaggaagcaaggctcaaatgaactagagaaagagagcaagcaaagggcacaaataattggaatagaaccagcagccctcacaagtgaggggaggtgggtatttatacccacagcacaaatctgcccattggagtgcaataaaagtaattttcggaacttccgaaacaattttcggaacttccgaaaattccagatctgagaaaaaaatcgaagtcaacgcaatttttggaacttccgaaaaacattttcggaacttccgaaaatttccagaacgcttctgtgtattttcggaacttccaaaaatttccagagagctctcaaacggttctgtgtattttcggaacttccgaaaatttccagaacgctcaaaaacggttatgtgtattttcggaacttccgaaaattcttttcggaacttccaaaaattttcagaacgctccaaaagagaaatgcttcgaagaaaaattgattttgagcacacgcgtcactccttatatgtctatgcatcatcctccttaatagtacagctttcctacgacacaatgcgaggaaaaagatacaatatactatttgatcattgccgcattgcatcgcgatgtcgcattcacgggatatgcattgtattacaacacgttgaggacttaacaaacttcacatttgcttgaataaaaatgttagtcctctctaattgtattgtaatcaatcatcaaaatcattaggggcctagatgcactttcagcgtagcaacaatgtttctctttctcctatctctctctttcatgttaccaaatttacttagatggcaacaaagagagcccgctaataaagatcgttgtatatgatgaaagtgaatgacttacaacaataggatgctcctgtcatcaagttcatcaagcgccgcccttgagcctatctggcggttgcctatgcaccgtcacaataccataacttcgcctatgaaacttgacgaaaaatgttgttccaatacatatcttgctggctagctaaccaatcttgattttatgtataaaaatgtgcacatgcaaattcaaaatgacaattaagtgttttaagaaaaacgaggtgattttaacgtatgattaattgaattttaattattacaaacttgaaaaatagattaatatgatattttagagtaacttttatattaaaagttttcgcacgaaacacaccgtttagcagtttaaaaagcgtgccacgagtatccaaa

SEQ ID NO: 60084 - DNA, 52488 bp, Oryza sativa
  unsure (1)..(52488): unsure at all n locations
tttttttctttgtacccatcactgtttttcctgtgcttctaatctgcaatactgtcccagcaagctttgaagcgttgttgctcagattagctgctcattacagccattgtaaatgaaagctttgacgtaattcaggtctgattacagccgactgatagaacaaaagcaggtctgctcggaggagcagccacgggatttatcatattttgatagctaaaatccctggctaaaacgaacatggggtttaagagagagcaaggaatttcaacccccatagggattgagtgacatgggagggattcactcaatccctccctggatatattccacttggagattaaatcccaaggaaccgaacaaggcctcaagcgggacaagctgcttgagtagcacaagttcactcaaatagaactttaccacttgaatagtgttttcccaatcgctagagtcttttccgagttggatacttagaattctcaagacctcctttcccttagtgttttgaccgaatgaggagaacggtgtttaccccctgctacaacacaccggactgggggatttttgccattgcataaagggattcattccataatgctcaccacacatgtggagagggttgggaagttggcgctgtgaagtgggacgacaatcatcgacgacgaggtgaggggcgtgatgctaacccgccgattcacgtccacccaccgcatgggactgtgagaggcaacaaaatgctaggcgttggctggcggctagttctggggtgaactacaagctaggggccaatgatgaaagggcaaagctgcagacagcagaccataggaacacactcatcgagttgcatcggttgcaggaaccgtgagcccaagccaaccgttagtggctcttgtgtgcatcataggcctagtgcgcaaaggctggtaggatggtgacatcgtggttttggggccagcttattgacttaaccggtttaactatggtcaacgcgccatgtcaaccgaaaccaccttcaaaacaacaggggaattgttttgcacttgttttaatacttatggaggcaataaacccggttttatatcatagggatgcgaattggattcgactgatagttgagagagccaaatagactttttcctaaacctagctgggtggcccgcgcaattgcgcggctagcaaaaaaaatcatatatttttttaagtatgattttacttgaaatttattaaatagctatctcattcttaagactatgaaagaccaaaccttatcatcatcatgtttctaattatatagtttataaaaatcacactagttgctaccccttatgtcatctcctttatttgcttgctcgatctatcactatttctattcattcttctgggaacttttaaaaattggattttacagtttttagagtttattgtcacgttgggtttcatttttataatttctagatgtctcgtcaaacgttgctattatactcctctacggctcgtccactatctcttctctttattgtcattaattgagattttaaaaatcgaacataattatagtttgggttcatttttactttctagaagtcccgccaaactgtcagcggttttgctattgtactcctctacgactcgcccgctgcctcccttctttattgtcattgggggtttaaaatcgaacatgattatcattggtttttttactgtttagaagttccgaacctttaaaaattggacttatagtttcattttttacaatttttagaagtcccatcaaacgatgccactatgcccctctgcagcccatccgccacctactctttatgtcattgtgattctagaaatcgaacataactatcggtgcaattcattttttattttctagaagtcctgtcaaccgtcggaggctctgtagctatactcttatataccccgtccgctgcttctcctttttattgtcattgagattttaaaaatcgaaaatgattatcaatgtggttttttttttactttctagaagtcccggcaaccgccttacttgtttgcttcacggcatgcccgacgtctccttttaatcattattaggattctatttggtgttttattaacagtttttatatgccgtatcaaccgccaccaactctattcttttataggcctgttacttaatttatctcgtcatgtgttttagatagtcttttctttcaatagtctttatttttatcacaatttttagttatttataaattttattcctaattgaattttttttttctaatttcagagtttatttttttaaaaaaaattagttaatactgtattgtgttcttttaatgtttttattttttattttcaatttaagttgttttaaaattgtattcctacttgaactctgttttattttttctaattttagatattattatatttttatttgaaattttaattaatctcgtattgggttcttatatggattattctttcaatattacttattttaaattccgaatttcatctaattttaaattgtattcctacttgaactcttctttattttcttttgctaattttggatttatttttatttttattccgaattttaattaatcttatatggactcttcttttaatattccttatttttaattccgaatttcagctaattgtaaattgtattcctacttggactctcgtttccttttctaattttggattttattttatttttatttcgaattttgattaatctcatattgggtttttatatggaaatttctttcaatattggttatttttaattccgaattttagctatttttagattttatttctatttggactcgccttttctttttttttctttttctccgattaatgtgggaatttctagcccccacagcagacgtggtggctcctttcaaagctgttttaataatatataatagatagataaaataaaaggtgccgctgctctgggtttatttgggctgaaacatagccaactggacttaacttaagtaggctgacgtcggtatgttttgggctctattgggccgcgctttctattgggctgtgaacagtgggcctatggcaggttgcctttccctaccatttattcaatctcaatcatgacaccgaatcaattgtttcacatttttatttatcctacaaatttaatctattcattgctcatccaagaaaaaaaatgactgacaaatattaaacctgaaaattttaatggacatgcctaatcaaaacacacaagtcaaccacattaaagaacaaaaacctgttgttaattctttcctataggtgctatacatcaaaaacagggtgagtgatattttgaaaggagaaaggagagggtgagtgatattaattttgcagctctaaccacatctaatcatggttgattaatcatctctatgttccaactccctccccagaagccattttcagctacttcttgttgttccccctaaacctgctcttcaccaccctcgtcgctgtcgttgtcacctccttcagcttctttctggctactctctctgtctaaattcggggctttgatcggcagaggctcaacgtcatcaggaggatcatagtttgggtcagctagaaacgtgagcgccgtcaccacgtcgctgatcagaggccggctgctcgcctcttcttgcaagcacatcgatgagattgccagtgcctggtacagccctttcagtgggaacttcatgtccagcagtggatcagccatcttcacgaacttcttcttgtccctgaacagtggcgctgcctgcatttcagacatacagtataagatcaccatcttgattctgaactgaacgagaaattttcattgactgaattctgaatctctgatctttttttcacgaacacgtcaatatattagaaaaagagcagcatacaactgtggcacactgaggcgaatataaaggaatgttacccagtgaacaagaatctgctcgcgagtgggcttggtggtgtcgatggctcggcggccggtgatgatctcgaggaggacgacgccgaagctgtagatgtcggacatcttggtgagcttgccggtcatggcgtactcgggggcgcagtagccgtacgtgcccatcaccctggtggtgacgtggctcttgtcgccgacggggcccagcttcgccagcccgaaatccgacagcttcgcgttgaacccgccgtcgaggaggatgttggacgccttgagatcccggtagatcaccggcgggttggctatctcgtgcaggtactccatccctctcgccgcgcccaccgcgatcttcatccgcgtgtgccatgacagcggcgacgagttcggtgtcagatctgcacaaaaattcagaacaaaaaaaatcatgaactttagctcaaacccgtctgcattttgctatgcagatgtaatgatagttactatacctaggagatgatcttgcaatgaaccgagtggcatgtactcgtagaccaggattctctggtcgcactcggtgctgtaaccgagcaaggtgacgaggttggggtgatggagaaggctaagcatcagcacctcgacgaggaactcgcggttcccctgcaatccatccttgtccagctgcttaaccgctatgacctgtatgaacatggacacaaattcacatcagatacatgctactgatgcattcatcagtcatcactgaatctttcagggtgtcaggttgatgaagagactgaggaaggacagttcacagttaaattccgttcaaaaaaaaaaacagttcacagttaaatggtgcttacttccttggtgtctgggatgaatcctttgtagactctcccgaatccaccttcaccaagcaggttttccgggctgaaagagccggttgcatcggccagctgacggaacgtgaatactctgcttggaatgttgtggttgccgatccgtagtatctctcctgccgctgccctgttcctggtactatctgcacgaacaaagtttaggatcttgttagcttatcagccgtaaccaaattttaaatttcgacactccaattttagaattgattttgaagtttcttttttcaatgtagatttttttttcaaccttacctaacacagttaataatacaaatataaaggttttactcataaattatttttagttgctttcctttatttttctctgacttataagtcatagctcaaaggtgaaactaggtcaagagcatggtaattttcagatgaattatacatatcacattttcgcctttataagatataaaaggagatatttttgctatttcggcacgaagaaatcaggaaaagaaaaaagggaagaaatggtagtatattttattactctcgagggagatctccttgacgaggctggccaagccggtcggttgggtcttgcccttcttcttcttccaattcttcttggtcccccacttgttcttctccagctccgggctcgtcgcggcgctcttcctcttcttcatcgtctccagcgtcagcggctcctccgcctcccgcgcggccttgccgaagacgccgcgcaccacccacttccgcttcttcctcttcttcgcgtccgacgccgccgtgtcctgcgccgacgtcgtcgcccccccgccgccgccgcagaagccgcggatccacgagcagcagctggcgcagccgccgcgcacccaggagcagcagcagcacgacctgctcgccgagctcagcagccccatcgccggatcgacgcgagagtgggcgagcaccctcgtgccgacccccgcgcgccgccgccgacgccgacgacgacgccgcggggtgacgatctcctcccgcggcgagaagaacacggcatgcaaggcgctggaaaaataaaaatgatgttctatttttttttctctgtggatgggaatgagcctgccagactctgtttttctctggattgataaaaatggaaggcctgaagccaagtgcgtctctgtgtttttaatggttgttaattttagcaacactgttatttccattccctaatttttcgcattaaaaattggtgttagtttctttgccatggttgatggttagccgaggatgtttgcatgatagggattaaaacattggaaaacagtctaaaccatttccataatcatatttttctcgaaaataaaatcaaaaacagtaaaattggaaacgaaaacaatatcgaaaatattgaaaaattggaaaaatacggaatgaaacatgacggtacatattggaaaacggtagcaaatacagaaacattaaaccataaaaacgtatatttaactttgcataactatgtaatatatataaataattcaaatttatactatataaattataaattaactccattttagacatgcattcaagttatgtatttgattgaatgatcaatcaatctaaattgtaggtcaagtagagacatactctataaatatataaatatatagacatatttagaagtacaacaattttaattttcacaaaatcacgctaaatatggaaccatttccattttcaatattatttattatttctattttcgttttggtcgattaccattttcatataactcggccggcagaaagtcagaaacgaacgccgatcggccagaaatttccattacctttttctgtgattttataatccttaagtgtcgcaccccaatctaataccgccgtacaacggcacctgacaggagcatgtcatagggaaaacggcgcgaaccgcttcctacgaaaccgcgatctcggtaccagtcccaggacatagtgctggtacccacggtgacaaatatgaatcatagcaatccttaaaataaatagaggacttatttaccttaacaccaacagcagcagcaacagcagcggaaccaacggtctaacacccaacaccacaggcgacggctgggaaccaggacgaaaccctaatcttcacttcactttatcttctcttcagggcagaggaactatatatatatatatttatatagagcaagggtgagtactttcgtactcagcaagtcacgggaacttaggtggttaatgcaagcttggaagagaggcaaggttgttttgcaaatcttttgtttgaaatcattttgaaaccactaagtgatttatttctttctaagtttgggccgaaaagagacttgcgtctcgattcgactttaagagatgtttttcaacagctcatttagtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttatccacaagatacgaacttattccgaacacccgtcggtatcggaggttcgcaacaaagcctttcccaagccgacccagggatacctcatgccacatagaaggatcaaatcctcacataaacataggccattttaggcgttcacaattcaaactccaaccacctcgatcggtaattcagcaagcttctcgttcttgcattaccaggaacccggtttggctccaaccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacataggcacaacccccgcatcgcgagttttcacaattcattttattttcaaacacaccgacaccacatgtcgggttttgaaggcttcacaaacccatttcccaagttttcgacaaacaacggtgtatgtgggatatttggtatacacgcttagagagcacgaataccgaggtaccacaagggtggagcgacaaggaatcagggtagtacgacctacggaaattagtgcgactactgggtaggtccgtcggtttgtcacgcaaaccgaggccaagcaagttaagtgtgtgattctactaatgcaagttgaaaacaaaataataatgaatttccaattataggagcaaatgatcaaagggtgactttccttgctcaaggtcttcacgaagcttcacgaatcttcgagaaatcccacgatcgacaaaaatccggtaaccgcaactatacgcaatcaatcaaaacctaaacaaaagaccaagaaaaggatcctatttagactaaataatagtgccattaaatagatctcaattttacgggaatactggaagtggaacggggttaatcggaattacggatcgggagatatgaattttgggagtttaattggaatttctggacaaggaaatgatttgtcgaaatttttttttgaatgcgggcaatgatttataaattttatagaaaagaatattcttgagaattgacacgtgggaccaacatatggtgagagaggtgaattgggagggagcagatatggacttttggtcactgcatttgggaagggagcaaagatggactttagcttttgggtgggggtactgggctcggcatgagggaatataactggactttggttgattggaccgggggagcagcgcagcccaacggctggcgaggccgagagagggggggggctggctgacggggcgtcagcttgacccggtcaagcccacgtggacagccacgttggatggaggaaagggaggggaggccgggcggccgatctgacggctgccggcgagcggtgcataccggcgagcggcggtaaaccgggaggggcggcgtgcaccggaagcaagcggggatcaaggggagctaattcaacggtgcggatgaaggagaggtggcgctgcagcggctgccgaggcgggcggccgcggcggcgcgccggggaggctcgagagggctcgggggtggtgacggcgccgggaatcggcgagagtccggccggcgacggcgcgcgacggcgcacggcggcggcggaagcagagctacggcggggcggcacaacactgagtggggcgtcgccgggaaaacagagagggggcgcgagaaattacgggaggacgacggcgagctggttagacgagagagaagggccgacgacggcgcgcgactgctcggtggcggacgcagcaccgcgtgtggtacgaggaggaagaagccggtgatgcggaaacagagcgcacggcgagctacgcgagtgcggggacggcgaaaaaggaagctgaggagctcaccgacgggaggaacggtgtcgccggcgaattggggatgggaagggttggaaggctgagggtggcacgcgaccgagcggcggcgcacggcggatgacgccgagccggcgcggtgtcgaggcgtgtgcgccggggaaggagagatggagtgcggcgatgggcggcgcagagctcctcgttgactcctcgtgcgcacgtcggcttcccggcacgcgcgacggcggaggaagggcgacaatggcgcggcggcagagggaagtaaaacgggaagaaaagagggggagctcgggcttgggttttataggtgaggaggagaggtcggtttggaggagggaaaccgaccttggcggtcgagcgctcggctggcgctcggcgggcggtcacgagcgggagcagcgttttcgcgggctgcgcgaaacgtggcgacggcgaggatgcgaaggggcggtggaggcggtggatcgtacggcgggaattgaatcgcgggcgcgggagcatcggcgtggcgcggtcaaggtgggggcacaggcgcggcaggacgttgtcggcgtcctctgcctccgcgcgcaagaagacaagggcgagaggagagaggccgggtttagaagggaaaaagtgagggaggacggtggaaagggaagcctctcccttccgttttgggcggcgggcaggcgaggcgcgtgggagcggcgtccttgccggtcggccatgcgcgcgagaatcggcagcgtggctgggattttgggcggcgtcggcgggagtcaatgagagagagagggagagagagagagagaaagggtgagagagagcgaggaagaaggagagagcgagcgcacacgcgcaacgcacgtgcgagggggaggaggaggagcggctgagaggagatgggccgagggaggcaaaatagactttttcggaggagattgattcgaagagaatttgaacttggaatttgacttagattttggaattgggatctggatgagaggaaggagtagacggaggattcaagatggggttttggatattttggatccggggaagtattttggcgatgattcaaagagagggatagaatttcagagtttgatttggagacttgagtcggaagaggaatttcgaggaggcaatttttgatggtgacgagagggatcaaggacggatttgaattgagatcttggcacaacttagactcgcatacaaagaacggaaattttcgcatataagattttgccgaattagtttttaacgtctcacgaaaagcggagcgttacattaaggtactaggaagtaccatattttctagtataaaatttgatatctctcaatattatttccagtaataggagatatcaaatttacattaaaaatgttggtgcccgttgctacctcttaacgccggtaaaatttctctttgttttttttttttgtcaaggttctgattttgataattgtcaagaactattatccagggattattgcagtagtattgaagaataaaattgtccagaacgcacaaaatcatatatagtactttatcaccagctattttgttttcaaaacatttcattattcattatttgttttgatcactatctcgttgcatgcaacacagcaacggtgtgatcctactagctatgaggcaagccagctaagcctagtactggccggcggcgaagatgctgcactgctggggctcaacccggcacatcgacggcagctgcgccgcgtactgcctcgccctggtcagcctcacgcgggtcatccccggctgctgctgctgctcgccgtagtagccctcctccgacgacccctcgccgtagtacccctgctccgacgacgacccctcgccgccgtagtactccgacgacgacgacgaccagccttgctccaggggcatcggcatgctctcctcgtagctcctcaccatccggcggatggcggcgcagcggcactcgcggctcacgtcctgcagctgctggcagcactgcatccgcaggccgagcgcgcccgggcggcggaacatcggctggaacctctcccggccggtgagctgccggtcgagcacctgccggcacgcgtccagcgggctgtcctgcacctcccgctggcactgcctgtccctgaacctcatctccgactcgctcagctgcgcgccggagatggccaccatggccgccatgagcgccgccgcgaagaagacgaccttgctagccattgatgatcaatcagacaatcactagaagtgtatatgttttttttcctcttttgtttgttggtgatgaactgatgatgagatgatggcgatcggatggggttttatagggtttttgtggccatggttgtgtgcacggtgagcttcgtgtagatcaagtagaagcttgagggtgacatggatcggttggaaaagagcaagagagcaatgctgcaaagagtgaaaaaggtttccaagatttggagcttgcaaaaagatttttttttatttttctcttggtgttgggtaatttctgaagttatgtatgtggcagataacacttttgtgtcacctatttttgtcataaagagcggctttacgtttgcctctgataaaagattaatggatgtatctacactaatgagattgtcctagggataactcttagctctttgtgacgtggtggaaatgtgcagaaaatgtgtgtaactgcgcatgttgcttgttggtagtagttttgtacttttatgggtgactgaaagaaggcaattatctattttaaaaaggccctttaatttgaggaggattggaagcccacggtatatatggctcacagaatattttgaaatggaataagttcatttaaggtcccttaacttgtcaacaaatttgattttcgtccttcaatcgaaaaaccagatacaacgggtccctcaactatcaaaaccagtgcagatgaggtccctcggcggtttggatggtggttttggctgacgtggcgcttacgtggctaatttgactcggtcttcatctgacgtagcattgacgtagcgcttacgtggcaattcgatccgaaaaataataaatctcatgggacccacatgtcagtttcaacaaaagaatgaattaaaaaatggtggggcccacatggccccacatatcattgtcacccctcctcttcttcctcctctctcaccatctctcccctctcctccctccaggcgccacggggccacggggaggtccggcggcggcggccggcgacgtgggagaagggcagtgggcagggcgtcgcggcgggagcgctgggtcttcgctcacggcgtcggcgcggaccccgcgcgggggctcgtggaggagatcggggccgcggcgcgccgcccgtctccgacgagctagagctcgtgcgagcgcagtgccgggagctgcacgactgccgacgagaagcagaggaggttcgaggtgtacaggagcaacgttgagcttgttgagaagttcaactccatgtgcaatggctacaagctggctgacaagaagtacgttcgccgacctgacgaacgaggagttcagagccaagaagatggggttcagacctcatgtcgcaattcctcagagcaatgcctggagagagcagtgatgatattctgccgaagagcgtagattggaggaagaaaggagcagtggtggaagtgaagtaccaagaagattgtggtgtgtgagcaatagcatggtaaagaaagattcaaacctgtaaaaatgttggagattaatcgatggaaatctgggtgttgtgtggatgcaggttcttgctgggcgttctccgccgtggcggcgatagaggggatcaacaagaacggtgagctggtgtcgctgtcggagcaggagctcgtagactgcgacgacgaggccgtggggtgcggcgggtacatgagctgttcgagttcatcgtcggcaaccacggcctcaccagtcaccacggaggcgagctagccgtaccacgccgcgaacagcgcgtgccaagcggcgaagctgaaccagagcgcggtcagcatcgcgggctaccggaacgtgacaccagcagcgagcccgacctggcgagggctgtggcgacgcagccggtgtccgtcaccgtcgacgccggcaacttcatgttccagctctacggcagcggtgtctacacagggccgtgcaccgccgtccgccgacgtcaaccacggcgtcatcgtggtgggctacggcgagtcccccaacactcccgccactgacggcccgcccttcccccgcgtcgtcggccgccgccgccagacctccccgtgaccccgtggcgctggagagaggagaggggagagatggggaaagaggaggtgtgagaatgctacccaccattttttaattcattcaaactgacatgtgggtcccatgagatttattatttttcggatcgaattgccacgtcaatgctacgtcagatgaagaccgagtcaaattagccacgtaagcgccacgtcagccaaaaccgccatccaaaccgtcgagggacctcatctgcactggttttgatagttgagggacccgttgtatctggttttcggttgaaggacgaaaatcggattcgttgacaagttaagggacctcagatgaacttattccttttgaaatctggatcaaaatgtagacttcctggtagccccaacattaccgctatgggccacggatgggcctactgtttgggcccaattgggtctaatattcaggcccaaccgcccaagagcaacgtccatgttgggccggtttaatggtcacatctgccttcagactgctagcaatcggcctggttaaccggtttaacttccatttttttaaaaaaaaaaaaatcctcgtcaactaaaaaaaaagtgactcgtcccagcctcgtgaagtattaccagttcatactttggctgtgctaatcattggcaactccgaaggtgaaatctcgttgtcaaatgacaaaagtgatttaagtgatcaatcattctactcgtgtgtgcaggcagctagcagaaggccaccggccacatgcactgatgcaccatccagtttctttaattcttagcatctctccaagcagcctgcagttagcagagtgtactggggacaaaagaatcggagttagatagcacaggttaattagcttccagaaactggaaaaaagaaacggagcaagtaagctagctagctaactaaaacagttcagttcactgagatgatgagtcgccattgctgctgtttctgaactgtctagtgtctactagttgcccatgtggccatgagagatgagccccccgatgaaagctggtgtttgtttctgcttctgcctacctgctatgccttttctgaacaaaatgataccacttcaactacctaacagtgtgtccactggtccatccatctacgagttgttgcaggcttagccggcgacccggcgtctctcgtgcgtgcggatgattgatcaattccagcgcggcgacgccgactccgccgccggatgttcgatcgatcgcttctcatatcatcgtgtattcgtggtgatcgctgatcagagctctctttcctgttagttgcacatgtgcattccggctctgacgactcaaaatgcatcgtcagctgctttgagttttcagtttgttcgtttctcctttttgttggtgactggtcgtctcgcttgattcaacctagctagctatagctttcaggtgtaaacttgagctggatcggagcactctctgattggattttcagctcgccggttcactgtgttcatttatttcaggatttgaaaaaaaggggatagttagctaggaatggctcagctgacggacaacgtgttgtggactcatcgatcaggcctgtcgcgtgcaatgaacgatacgtaagttaattcagtacataagcgtagagtttgtactttttgcctactactacttcggttctgctcatgattcagggttcaggacatcgtctggatttctacattcaaacaggcaaatataaccagtacttagtgtagacggattctaatcacccagtggacattcacttgtttattatatgtcaactaaatagttataaaaaatttttaattttttttgacaagatagattaatatgtaatatatcattccacaaacatgcaagttgaaatttaatttctataagtcgtaacaaaaacaacaaatttaactgcaaatatacatatactaatttgagttttatttgttatttttcttttacaatttgtagaagttaaattttaagttgcatgttacgtttgtggagtgatatattacatattgatttatcttaccaattttttcataattatttagatgacatgcattaaacagtgcacatccattcgggtgattaaaagagtttccccataataatcctaactctcgttctagaacccaaatattaaacttatagcatatttgtcatttttcactccttaaatggatgttccctcgtttctcgcatgctatctaaatagttatattttttaaataataataataataataataataataataataataataatatagatcaatatgtatatcattctacaacatgtaggtttaagttcaagtcatttttttcataattgtttatacgatataaataaaacaaggggacatctgaacaaaagagaactatctcagaagaaagcagcattttttttaactcccattctagtactgaatcttgaacccaaataggtaaagaggttaaacggcacatttgccatttttttactacattttcacataactaacttatcagaagcgcaggatggtacatgttctccctccgtttcaaaatatttgacaccgttgactttttagcacatatttgaccgttcatcttatttaaaaatttttgtgaaatatgtaaaactatttgtgtacatgaaagtatatttaacaataaatcaaatgatgtgaaaagaataaataattactttaattttttgaataaaacgaatgattaaacacgtactaaaaagtcaactgtatcaaacattttaaaacggagagagtagttaattaaggtgtgaaatggtattgtttcctcgggcattaatctttgtcagttgctacagcctgcaacagtgcacatggcttgaaccgatggttacaggccacagaaaaaaaaaagggaatccaagtactttgtctgatcatcacctctaaagttaatcaacatgacagcatgtggataatctcccacgtcctctcagttgcggttcagaagttcacagcgagaaataaattactcttcaaattgaccaactttgctttagattccatgcaaagcacacgcctacaggatcgatcaagcagcagagacatctcgcactgattttgtcagtacaacgtacaaaaatacgttctcgatcgacgaattcttctcctcatctctttcgctgctgctgctggcctgctgctaacaaccagtaggtgctgcattcttgactcctgcccggcgcccgcgatgatcagaactccacaaccaactgtttccgtagccgattttaaaaaagtttttgcagtacaattggtacttcgttcttggatggcaattagtatctgaatgcgtacctgctacaagaaagattcggcaaagcgaaaacaagaacagctcattgtgccatttgcataatttgcatgcgtgattcttcagaaagtgcagctagcaggtagctaagccagcctaccacatgggggaatagggacaggatgggccaggacggcgccgcgctataaatctcgcgccaattcttgcccgcaaattcagcagcagcagctaccagcaacaagcattctcttctagccttagcctagctagctagctttgttgtctagctctgatcgaggttggtggtgatcatggcgtcgtcgagggtgatcctagcgctgctgctcgcggcggcggcggtgatggcgtcgtcggcgcagctggacgagaagttctacagcaattcgtgccccagcgtggaggccgtcgtccggaaggagatggtgcgcgcgctcggcgccgcgcccagcctcgccggcccgctcctcaggatgcacttccacgactgcttcgtcagggtaagctgtgcatgcagtgtccattctccattgcgtcgcggctgctggtgtatagtagtagtgttcgatcaggtcgcctgacaacctcgtcgccggccggcgtcgactgtctgtgcatgcagggttgcgacggctcggtgctgctcgactcggccgggaacagcacggcggagaaggacgcgacgccgaaccagacgctgcgcgggttcggcttcgtcgagagggtgaaggccgccgtggagaaggcatgcccgggcaccgtctcctgcgccgacgtgctcgcgctcatggccagggacgccgtgtggctggtgagtagagtatagtacactgcaatgcacgcatgacacgtgtactctgacacagtttgcagaagcaaaaagttctcacctcgacttgtcgtcgtcgttgtcttctcttccagagcaagggcccgttctgggcggtgcctctcggccgccgcgacggcagggtgtccatcgccaacgagaccgaccagctgccgcctcccaccgccaacttcaccgagctcacccagatgttcgccgccaagaacctcgacctcaaggacctcgtcgtcctctccggtaaccatcaccattgccaccacacaaactctcttcacacacgtacacacatccatccatggtgtctgacacgatccattgtcgatgttgatcagctgggcacacgatcgggacgtcgcactgcttctccttcactgacaggctgtacaacttcaccggcctggacaacgcccacgacatcgacccgacgctggagctgcagtacatggcgaggctgaggagcaagtgcacgagcctccaagacaacacgacgctggtggagatggacccggggagcttcaagacgttcgacctggggtacttcaagaacgtggccaagcggcgggggctcttccactccgacggcgagctgctcaccaacggcttcacccgcgcctacgtgcagcgccacgccggcggcggctacaaggacgagttcttcgccgacttcgccgcctccatggtcaagatgggcggcgtcgaagtgctcaccggcagccagggcgagatcaggaagaagtgcaacgtggttaactaatcatctctcttaattatcgtcatatatcatcagctgctcgccgagactgtgattatggatttcagcttttgattccggccgtgaccatcttataattaatttccatgtagatcattatcgtaagatttacctgtcccttctttttttttcttgatttcaatcacttcattaattaattgttttgtttatatagcgagccatgcatgtatgtaacaaagttttctccaagtacgtgctcatcatgatcatatgaataaacttcattttttttcaccttgcattattatacatttattattttttatcactcattggtgcctctatctctttgtcagacagttactcagttatgatgccactgtcgtcattttaacatgaaaactagtaaaccaaaatgagtcattactaaagctgtaacacacagcaacgcatcacatgggttgcacatctgatcattcgcaactgacaactataattggaggaacaatctggtcaagaatggactcatctatcatgcgtgccatgacaagtgttccagggcaatttgataattgatatgctgttcagtactgtcagcagagtcccacaaacctctctggcgccctgcattttgttaaccccattgtgcctgcagctctctggcctgaatgtctgtccaaactgaacgacagaaacatttcttaagtagctttggtcacatggcatgcacttacgaaaatgcaattgattattgctgatcatgatggcatctatgacaccaaatcaaattaaggccggtacgaacattggctattattatacgcgaccggcctgtatagtatgagatgggtactgatcagtcctgacaccctgagtgctatctgcgatctatatttccgtattgtaacttcatcaagcagttaataattcggcaaatttagcatctcccacgtttaactgagcactggcacacgaacctacacatatgccatttacgcgggccgacctattcaaaggaggtatcaaaatttataattataaaaaaaattatatctctcgatatctctctgggacagtaaatttttttcgaaatgatttatatacgcatgttcaagggtccttacttttatgctcggctgctcagggaccttgaaattggaagaattaatcttaacaacagattagaacgacaaaaccgttgatggaagagctgctaacgtgttgtaaaccaatacgcttattagtggatcattggatctgttccttgtttttcgcacaacagtagaggcgtaagaagatgtagaacacatatgtccttttacttgtcctcgagaatattgcagaaatagacaattgacatagagatatagaatagaactctctcttattagatttgttctcaagactatctaaaaaattgctggaaaaaactttcaaatctaactatagtataattataatataatttccactataactatagtatgacatgtatataagtattaaaataatatatgcaactttatatctaacttatatagagattacaatatagttacactatagttataatattacactacaactatactatagttacatttaaaagtttttttgcccaaaaaacttgggacggttttttagcaattccgtttgttctcgtgtacaatcaaccatcaatgtctcatcctactctctacatataatatacaagggtcttaataggagataaatattactatctttactcggctttaaattggtccagaagaaacgaactttatctccacaggagatattattttccaactttgaacacacacctttcaacataaaatccccacttgagctaactagcttgtccatctaggcccaatatggttgggcctgggtgacccaattcggcctgtctctcccaactaaaagaaacgtacggcctcatctgatacaacccaactcctcaaaggccccaacgctttccctcgcgaaaacgccgcgccaccgaacaccagcagcaagacgcgtccgcgaacgcgcgccctgggccgaacggttgccgcactacagaatttttttcggttttagatcttttggccgtactttttttcatctgggtcccttgccgtcctctattagggcggcaagggatccagatgaaaaagtacggccgcaagctctttatgggcggccaaaattgtaattagccccttgccgccctctgtatgggcggtaagggcctaatcgcaattttggccgacggcggcagacggcgcggtcgacccaccgtctgccacgtcagcttgccgcccaccattagggcggcaggggctatttctacaatttttttggtcgatagattattcctgtaaatattaaaaaaaatctaaaaacgaaaaaaattcttcccgcactacactgcactccggcgcgcgcaccaaccaaccaaccaaccaaccaaccaaccaaccaagcctcccaactccatgagcaagttgcagcagccgcaggccacaggctcgagcttactagctaggcggagtagagtccgtcgcactcaacgctctgtttcacacacgcacgcacccatctgaaagcacggcgcgaccaaacgcatcgacctttggtttgcccgcgtctcgtcgccatctttgtactacgccaatggctctccgctgcctagctgctgccgcagtacagcttgatcgttgcccgtaacctcccgtggctccgatcccgtctccggcgcggcgcgcggctcggcgttgagacagtttgccgcctcatgtcccgggagctggagctgctgctgtttttgctggccctacgggcgagcggcgaggtcgtcgcgggttcggcggaggcagcggcagcggcagcggcgtggcccgcgctgcaggtggggttctaccatgccaagtgccctgtcgcggaggacgtcgtgctgggcgagatgaggatgatcctcgaggaggatcccacgctcgcgccgtctctgctccggatgcactaccacgactgcttcgtccaggtaattaacaatttttaattgccccaagctacttcatgctcgtccatggcgatcatcgtggttgggttggttgcaggggtgtgacggatcgatcatgctgaggtcgaggagcgggaagggggagagggacgcgacgcccaaccggagcatgcggggctacgacgccatcaatcggatcaaggcgaggctggagaccgtctgcccgctcaccgtctcctgcgccgacatcatcgccatggcggcgagagacgccgtctacctggtacgcgcctcacggaacaaatccatggcttctttgcaaatcgatatcgcgctctgcttctgaatgctccttgattcgcacagagcaaggggccgtggtacgacgtggagaccgggaggagggacggcgacgtgagcgtggccgagtacgccgagaacgacctggcgccgccggactccaacatcgtcgacgtcaagaccttcttcagcgtcaagtctctcaacgccaaggacatcgccgtgctcttcggtacgtatactaccacgccgtctccttttccccttttgcttctcgcgttggacgacggcgacagcttatcagaacgccggtaatggccattggccgccgccggcggcggcggcggcgtcgtgcaggatgccacagcatcgggacgtcgcactgcggggcgttccagaagcggctgtacaacttcaccggaaggatggaccaggacccgtcgctggacgccggctacgcggcgaagctcaagaagctctgcccgccggggcacggccacgaccacgaccacgacggccatggcggcgccggcggcgcggccaaggtgcccatggaccccggcagcggcttcacattcgacctgagctactaccggcacgtgctcgccacgggcggcctgttccagtcggacggcagcctccgcgacgaccccgtcacgaggggctacgtcgagaagctcgccaacgcgtcgtcgtcggaggagtacttcgccgacttcgcggcggcgatggtcaagatgggccgcaccgacgtgctcaccggcgatctcggggcggtcaggccgacgtgtgacagcctcgtcgactagtttattcggcgtcccgccacatttgtgatctgtagaattttatatggttttctctgtaacatatatgtaatttcgatttagattagggaaaggttgagacttgagagaagttgcagtttctacgcttttgaggagactgattggaacagcgtatgaatctagagttaaacacttgtcagttgtcaaactactacaaactaatgaatctgtacagatgggcttgatgacgaaccttgcagggtgtaggttggttattcagctgttcttcgtagtagcattgttagtttggtgaatccaccgtttggtcaaccataagttggtcaccaaatctgaccagattgtatagattacttaggaacaaagactgcatcaaccttatgcaagctaacctatgtgaaaaaataagcacggaatgcttttgctagttagaagtctctttcatgagcagctctgttgctcactgcttcaagcttaagtacaatgccaggatgcagaatatagaagtagcgcccttctgtaagggaaggagaaaaaacatagcattggaagcagacaaatttcaaaatccagaatattggccctttcattggtttggacctccagaatcgaaaaatggcattatttggtaaatttaaatttatttgccaaaaggtaaaaccaatgttagccattatgccagnatgacagagaataatgaggaccctgtccttttctactccatatgtagattccggttgctattactacaccacctaatgctccaatggatgccaaaattttcatctttgaagcaccttgcttagtcactggtaataccagtaaactttctatctgcaggaaaagttgaaaaaatggtgcatataaaattaaaacctgcagaacttttctgttgaataactacctagatggatgatggatttcctattggtacgaagcatatcactgtttaaaaatatctaacctcgattggttgttcccaatttttctttattccagaaacatgcccttttcctacaactgccaccaccgaggaatgttcctttgctaccttcaataatttggaggacatatacctgcaaacacaatttcaataattcaagcacaaaagattgtggtggtaatcgagaatatcaacacaaacttttttaagtaactcacatatcacgttcatgtaggagtgtctccatcaaggtaggaaatgccttactcatctcttgaataacaagtgttagcatgtcaacatcctccatgtccttcagctgtatagacaagcattgtcattgctatgcaaatggagtaaagtctggttaattgtctatctatactaaagtctagaaagtatattgagttatatgaaatcacacactagaactgtacatttcaagtcatccaggaagacatcataccattttattaagttcctccgggcttggtaaaaatatggactggaaaacaatgtagtacaaaaactttgccctgtgccataatgacattctcccccaagtccttctcaaagtgatcttcgaaacagataaagacgatgataagatggcaccactgctaatgaaatataagtactgaccaaactattgtttattctgtagaaagttctaacgatatcaagattcatattctattaatcaaatcttctatatgatagagatcattgtaacaagatatggagtacatctcaacttttgagttaaataacaaaatatctaacctcattagtccatatcatatagcaaaagattaagacgcaagcaaacagtggcaactatcttttattccatccaatcagccagatgtgatgaacatttgaaaaatatgtagtttttttccagatgtcatgtcaaaagatgcaccattatgataaaaatatctcatcacaattcaaaataatgacaagtgaaaaagtcaatagcatgaatacgtggttgcttaacttgaggtaacataataaactgttatcatttgtttgtactaggttcacaaaaaaatccacactaaaagtttatcacatttatccacgtatgaaccttaaattggcacagccagtcagctgttatgaatatcctctcccttcttcttcttgcatctatctataacctgtatggaggttatagacaaccaaattcaaccactagataagtaggttgcatacctggacagggcgatctccaaggataactttgccgccataactcattgcttcctcaaatgccactcggaattcggccccaggtaacacatcaagttggctagcaaccttggatgccaaaaacatagcccaccatgtaaattttttttaaaaaaaaacttacctaacaataagtacgaactgcaaaacaagcatcaaggcatacctttgcaagaaaccagctgtagagtattccaaaagtgttcatcttctttttcttccacatgtcaatcatttcgttcatggtaggaacctatgatgataacagaatgataaaacaagttaactacgagtagatataacatctcgaacacttatgtcaatgatggctgcaaaccattaataaggctaaagtctgttgctacacactagcatagtgctataagttatatgcacttaatcaaatactgatagaaggcatgtcagcactggctcctatttatgattgatcagatagtctttggcatggccatccatgccaattgccaatacgaaaatgcaatacaatgccactgccataattccaacttctaattctctcgcgtaaataaatcttaaccagtgttgtaagagatatatccacaagagatatcttttcccagttgagcttaattccatgaagtatagaaccacattatcactctaaatagtttgtattcactatttgagggaagataacagacaaaattcagacgacaatagacttcagcactctcatagtgtattctcatggttcataattcattcagtttttacatgtacaataacctcaaacaaaaaaaagaggaaagtgttcccttcctcgtgcaatgtacataggtaacaaacatgacaacccaaaatgaagtaaattctgcatgatcatacctgaaggttttgtggtgtcagaatggcgactctgctggcacagagctccaagaaaacagcctacatttgttaaagaggtgttaaaataattagtataaggtgttccggatcaattatcaataagcactccacaagaaggcagccaacctgccaaatgattcaccaactggtaaattatcggtgatgagtaaaaagaggaagaacctgaggtttcaggtagtcgatgacggcttttacttggtcacatgattcctacaaagtgaatcaacatacgaatattcaatccacagtataatcatagtaagcgcgactttgatgcatataagttgaaagtacaggacacaacaacagttaactaaatttgcatcggtcatagcgctaccactaccactacaaatacacgtctatataaattactataaaggaaaaaagggtagtcttttgttggtacagttcgtgttcatgaggattttacgagcctgtttggcacagcttcagcttcagctccacctctcttctagagttggagctcagccaaacagttttagttccacctaaaatgggagcggggctaggtggagcgctctcacaaaatgaactagagatgtagaacctggtttaggcagctccacaactctactccagacccaactcctggagttaaatttatgagttggagctctaccaaacaggccctacatgtttgctgtgtttcgctctccagttttttcttttttttcactggtaatctcaaccctgcaagttcttcacttcctaaataagttactaacgaaatttgaactaagttactagtgaaaacttaaaatttggactaatgcgaacccgcaatccaaataaatcgagaccagatcgtcccctaggtgttctccaaaaagttcgaggctacatcatatatcgagctgacgaggaggccaattcacctgtgaaacatgggcggtgccgacgacgtagacgcggcaggtcccgcccgcccccggcggcttccgctcgggcgacgtctcgcactcgaggcacaccacccccttggcgagctcctcgggcagctccttcctctccctctccccctccccctccccccgcaccacctatgtccccgccgtctccgcgtcggcgaactccgacgcgtcctcgtagcccccgccctcgccgtcggcggccggatccatgagcagaccgagcggtgtgaggccgcggccgcctcggatcgggccagtgcacagcagggcctggaccagtgaggcctggagcggcgacaggcggcggcggaagagaggcggaagcgggaggcggcggcggtggatcggcggcgacgacgagtctgggaggaggcgacgaggagcgcgaatcatgcggcggcgggcgtcgaaattttttttttgagagggatttttttttttttttgatgaagagaaagagttcgtcgtgcgggccggagatggagtggacttgggggaggaggtggggcgatgtacggtctggatttgtttcgtcgtatcgtagaagggatctggcccgtccgttcggtacactggactccgagtcagtgataactacggcgcagccagttttgtcttttttattgcttcatcgggccggaaccggatgaccgggcgatggaattcagggtcggtttgtgtcatttaattacgacgttaacgttaaacatgtacaacaataataaactgatcaacgttaatattttgtaaagtaaatttttagagtaaattgtacccacggtacaaagaatttggtagatacgtgcgatatagtataataacttgaagaaaaacgagtagactggtatataaacttgacaatcacgtgcattttaatcaaaaacataaatatatatctttgattaatcttaactgctaggttttggctcatgaattcaatttcgtgttttgccatgttcataacccaatacaatgaatatgttgattaggcgagtcgctcgaaaattatgttatttgcatgcacttatttttgataatcatatatcttttggtttcaaatagatagattattttattgttacaactaacagataaagcaatatataatacatctaaatccttgtcaagatggctggcatgagtggctgctttttttatatggcataaaaagtatggtgtgcaatattgatatttagccaaaatgcacgcactagccaagttgttcccttatatactcagtttttaaatttttgcactagattacacccacctaccccaagtttacgtattgtagatgtaatttactcaaaattttaaaataagatcatctattgaaaaaacaaagatagtatgtaaagagcattataaaataatttatcgttctatgggagaaaagaaatgaaaagaggagtgaaatgaaaagaggagtgcctctgcgtcggtggtaaaaaagaaatgctgtatgtcagtggtagatatcatcgaccaagatccgactgtgcccaataatcaatactacacatgtctagcatgccggttatggttgaaataaagttatttaaatgatgcattcgttttttttcaagttttattgagaaccttttaaaacaaaggattaatgtataaattttgtaggatttaaatcttatagaatttttatatttgaccttttttgatataaaggattgaaagaatatctaacttaattgcatgtagatttgttttaccgttatacttattttctccgtcaaaaaaagacaaaccctgagtttccgtgtccaacgtttgaccgtccgtcttatttataaaaactatgaaaaaaactaaaaaagataaatcacttataaagtattaatcatgttttatcatctaacaataatgaaaatactaattataaaaaaaaattatataagtcggacagttaaatgttggacacgaaaattcactatttgtcttttttttttttttacggagagagtatgtatagaatcatgtatttttttctgcttctctgttatccattcatggaattcagacaggccattaattcgacacatcatcaatattggtcccgctgatatttactctaaccaacaccaactagagtgtcaagagaagagtaggaaagcttgaagaaatcaaacacatcatcattccaatttccaaagaggagagtcgcagaaagcaatggcttctactgaccgcagcaagaagcttcgcgtcctgctcatcccattcttcgccaccagtcacatcggccccttcaccgacctcgccgtccgcctcgtcaccgccagaccggacgccgtcgagcccaccatcgccgtgaccccggccaatgtctccgtcgtccgatcagccctcgagcggcatggctcagcggcgaccagcgtggtcagcatcgccacctatccgttcccggaagtggccggcctccctcggggcgtcgagaacctctccactgccggcgccgatgggtggcggatcgacgtcgctgccaccaacgaggcgctgacacggccggcgcaggaggcgctcatctcgggccaatctcctgacgccctcatcacggacgcccacttcttctggaacgctggcctcgccgaggaactcggcgtgccctgcgtttcgttcagcgtcatcggtttattctccgggctcgccatgcgcttcgtcaccgccgccgccgcgaacgacgactccgattcggcggagttgactctcgcggggtttccaggggcggagctacggttccccaagtccgagttgccggatttcttgatccggcaagggaacctcgacggaatcgacccgaacaagattccccaggggcaaaggatgtgccatggtctcgccgtgaacgcgttcttgggcatggagcagccgtaccgtgagagattcttgcgcgacggcctcgcaaagcgcgtctacttggtcgggccactctcgttgccgcagccaccggccgaagctaacgccggtgaggcatcgtgcatcggttggttggactccaagccgagccggtcagtgctgtacgtatgcttcggcacgtttgctcccgtctcggaggagcagctcgaggagctggctctcgggctggaagcctccggcgaaccgttcctgtgggcggtcaggaccgacgggtggtcgccaccggcggggtggcaggagcgcgttggtgataggggggtgctggtcagagggtgggtcccacaaacggcgatactttctcacccggcgacggcggcgttcctgacgcactgcggctcgagctcgctgctggaagccctggccgcccgccgtccacgctgcctgacgtggccgctggtgttccaccagtttattcaagaaaggctggtcccccgcgtcttaagattggcgaaaaggtgtgggactggccaacgaacctgcggcactaggaggcgatggtggtgccggcggcggcggtggcgcgagccgtggcgaggttcttggagcctggtggggcaggggacgcggcgaggctcagagcgcaggagctcgccgccgaggctcacgcggccgtggccgaaggcgggtcctcgtaccgcgatctgcgcaggctcgtcgacgatatggtcgaagcaagggcggccggcggcgaggctgcggctgcaccgcaacctcagtagcctataatgccaatgcgttcgtctgtacgatgtcgagtcattccactgttgcaggctcccagttcatttcgctcagttgtcatgatgcactgatgcaggccttgttgtgactttgagaaacgtttattcagagtgcaaaccgcagaacacttcttcagttcagttcaatgaaatcagtatattgacttggtttgtaatttgaagcttttaggggtagtttggatatagggactaaactttagtctatgttacatcggatatttgatattaatttataatattaaatataagctaactataaaactaattacatagatagatgctaatttgcgagatgaatctattaagccaaattaatccatttttaacacatatttactgtagcacaacattatcaaatcatgtactaattaggcttaatagattcgtctcgcgaattagcctccatctatgtaatttattttataattagtatatgtttaatactttaaattaatgttaaacatcctttatccaaactacgctttagtagtttgggaaatctgataagaaatgggttgggtaatcttttcttctctttttgaagaaaagaaattgtggatgatttgaacagctattcttcgccattcttgacaatctccaagggttctcttacaacgctcgggacgagccaggtgacaccgatgaagattgcagagaagcttgcctgaacaaatgctactgcattgcatactcaagtgaatctggatgtgcaagctctgtattacgacctgtacaatctgagctcagctaataaacctccatacagcaagatctatgttgggttccaagctcaggagcaagaggggattgaccacaagatgtgtcctcttggtggttggatcaatagctgtagcttctgcaatgtttgcagtgttgcttctatgcaggtacaggagagacttgtttggttcgagtaaattcgtcgtagaatgatctttggttgcctactcatatgcacagatcaagatcaagaaggcaacggagtggcgacggcgtgggcggtgcccggtggtgcggcgacgggcgaggccgactccgcgtggaggcgtgcgcggagcccgtgcgacggcggcagcttcggctggcgcagcattggcggggcagctcggccagcgacggcgaaacccggcacggcacagtggcggcagtgcgtggcgtggtggcggcggtgcatggcaggcggaggccggcacggtggcactggtggcggcggggtgacggctggtggcagtggtttggtcgtgggagcgaaggaggcgacggcggcgcctggtggtggtcgtggcggcgcggtgctcggtgacgacggcggcggtgtcctccagatccgtgcgactcggctggatctggagggtggctggcggtggtggctgcggcagctagcggcggcggcggaggacaaggcggcggcgtagggccggtttgctggctgctttggtggcgaaaggcaacgatgtagcggctgctttggcgatggcggcggtttgcggagacgacggctggtgatagcggcagcggcgacggcggccggcttgcggcggtcgtgactgtgaggcggtggtgatgtcgccggatgcggcaacggcatcgccggcgacagcaagtggaggcggggaaggagtcgggtgcaaggtgtggatggcgacgggcgttcggcagcagcggtggtgaccgtgactgcggtcaccgaaggcatgacgacttcggtcggctagccaagggcgtggcagacggctacttctgactggtgtggcatcgtttggaggaggggtcggagaccagcttggcgcagagaggcgcagctgatggtagcggaggccggctcggcgtgagaggcgcggctggcggagatggaggccggcttggcgcgagaggcgcggccggcgatggaggaggcgaccttggtgtgagaaggagctactggtggttgtggcgcggtcttcggcgcacgaaggctggccggcgggggggcgccaatgcaggggtcccacatgttggcagagcttgagtggtggtggagcatcggggcaccacccatggatttgcaggtggtgagcagcgggtgaaaacccagcccggccttggccggactggcaacgatgattccccctcctgagggcgttgttgtgctgtctcatccctcaagggtggttgccgggcaaaaagcccagtcttgctcctttgagccctgacggatggcggcggcggttcttccgtcgcttctcttcttgaagacgtcgttttgacatcccctagggggcgatctcgtctgtgtttctttgttggtctagcagcgatcggtcacgcttagcagcggccggtccggtgcttgccttttcccaggcttgtgtgttggcgttgtcggtgtgtgggtggtagtatattttttcctttttgctggttacgacccttcagggttgtaatcttgtaattttttcctgctctatcaatagaacttcgcaccgtctcgtgcgagtcgttcaaaagaagaaggcaacggagaatttctgtgataatctcggagaaggcggattcagaagcatttttcagaggtacttgcccgagaagaagaagaagatggtaatgaaggagacgagtgtttccgagaacgtgggagcacacacgacggcaacattgggcgacttgaagtcaccctccatctcctcccacggcggcacgttcttccggtctgtgaacagtgacagaggtgagaatgcgtcgctcccgtcctcctcgatgccaccgccggcggcggcttgtcggtgcaggtcgcttagttgcatcatcatcggcttgtctcccccttccccgccgccgccgccaccaccagccccatcgatctagtgctgccggaggcgggatgcgagcaacgccgactcatcaaacacctgctccgccaccagattgcccttctcattgtgcatgcgccgaagtcgccgtagaagaagccgtgcggacttgtagccggaggaagaacgcctgagagagaggagagagaagaggagggaatgagaatgacacgtggggcccatgtaggccccaccattttaaaaaacatttttattgtaactaacatgtgggcccacgattattattattattttccatatcaagttgccacataagcgcgacgtcaatatcatgtgggagaaagactaagtcaaactaatcacgtaggcgccacgtcagttaaaaccggcgtgcaaaccgccatgggacctatattgcaccggttttgtaattgagggacccgttgtatctggttttaccgttgaaggacgaaaatcggattggttgacaagttaagggaactcaagtgaacttattccttcttcttttccaccgaagcagcaggcccaggccaatcggcctgtttgtcttcctctctaccagctagcccaaaccagctattcttcccggaccatctttgtttcctcttcttcggcccatctgtcccaactcgaccagcctcgccagccagccaaccaaccaggacgcgaatttttttcgtttttagattttttttttaatatttacagaaataatctatcgaccaaaaaaattacagaaatagcacctgccgcccaaatggtgggcggcaagctgacgtggcagacgatgggtcgaccgcgccgtctgccgccgtcggccaaaattgcgattaggcccttgtcgcccatacagagggcggcaaggggctaattacaattttggccgcccattcagagcttgtggccgtactttttcatctgggggcggcaagggacccagatgaaaaaagtacggccaaaagatttttctatgttatgttaataataaataaagaagtatttattggtaaaacttgttaatattgttataaaaatgtattgaagttggttgttgcgcaatttcatatgttaagtgaggtattattttgtaccttatttgacgtattagtactcggataatttatataggcctatcgcagtctaggtcgtagaaacattatatggacttaaacaaggagaattatgtaacatgaagaaatagtagtacaatttgaacatgatacaactatttgcattgcggttacatagatgatattagattcgaactaggagggaggtagtgcaatagttgaacacaacgacgatgtagtaatgggacaaggaagcatgacagtagaaatttcaatatgccaagttgtccgataatagctaacccctacgtgaggatccctctcctctctcaaaccgcgctttagtaaccctgtattgctctggtagttcaagctgcacaacacagctaggtggagttagaacccttctggtgtctatccattctctgtattgacatctccttggtggttcctgggaggaaagaatagatgtaaagcaagcaaagttagtaaatgttgtgagaaaataaggaatcatgtaattaaaatattcttaccatgaaatcgtcgtcaagaatatttggacaaacaaagaaccttcgacccaatgttgtaggatttatggaacgaagaacctgacaacgatcaccacacctacatcttggacgggctttccatggagggagtgccgtagttagcacccgccagtcgctctgttgttcacgacattgtcgttcataagccgcttttctctgtaagtattgctcagtactttcggatgcgaaataccagcgaccttcttgtaaacaagtggttaggtcgagaacgggattttctgtatcgacccactcgatgtatgcgcaagccgtagtgcgggtctgctgaatagagtagtgttacgaagaataaagcgattgcccatacggaatgaataagcatatgcagataataaaatacctcacggtcatagttagggcacctaaaaaagcgccttcctcgaatatcaggattcctcgaagccattagttggcatcgatcaccgcataggcagagaggacgctggcaccaaggtggtagtaggtatacacaaggatcgctacgccagtttggatcctcaacaccccggcgtctagccattgacgaaagccggtcggatttgtaatgaagcaagtggggaagagagtactgaatgtgactgagttctgaaagattgtgaggcctcactcgttaaggcgacttatataggcgcaaaaaatcgagtgatacccctgacatgtgaacgtggtggggtatggtgggtacgcctgattggtgccgaaagatacatgcatgatcggcaccgaaagttacattggtcgtatgcgccaaatggcgggcaaatactcgtatcacacgcgaataaaggaggctgcatcggtgcggcagaaagtagtcgtgcatgcgccgaaaggtatcgtgcatgcgccgaaaggtatcgtgcacatataacaacaacgtagtcattacacaagcatacagtactggaaagtgaagcaagtaaacaaaaagaagactgctctgctggccctgccccgcgccgcgaccacgcttggtcctccgggcctgtgctcgcacgtggtcctaggagtaggtgaaacgatccggtggcacagcacgggtagcacgagtgtcccgcggaggagtggcctgcgcctggacctgcgtctgcaccggcggtgcgcctcccagctgtgaggggccgatgacgtcctctgtcgagtctgaagcgaagtcgaagtcagtgatgtcgaagagcacggtggaagacaggaaggggtccgacgaggtcccagcatggtccagtggtggaccctgactcgacgtgccggctgcctgtgacgctgaccctgcagcctgggagaagtgggcggcctgcgtcatagcgaactgggcgaaacctacacatcgacaacgggacccttgtaagctaagacataaaatgtatgtaaattgattgtggaagtaatgttgtttttttaagtacctgtggggggcacaacagaaggcctagccgaggaaggcagggtgctgaacggtgcacgaaaccctgaagcaatcggcaagtgaaacggctcacttatatgtgcgaggcatgtacagaagtagtaataaaaatacttacctccgtgcggaggaggagtcggcctaggaacttgcgcagctggacggggaccagtcggtacgggtggccgctgtacagctgcgtctgcccgagcaacgtcgtctgcacgacaggtgagcactcggagaatcgagcgcatcgagctcctcatacagtgactcctcgtacgcgtgctggtccacctcagggcggccgatcgcaatcctctcagctgcccagatagaaagaaagagagggcacccaccaaaggtcgcgctgggatccgtcttcgtgcaagactcacaaagtgcacggtacagagccgccaacaacgcggaaccccaactccactgaggcacctcgcctcccgcggcgtcggcgatgctcctggcgtagtgcacgagtcccttgtcgaccgcgtgcccatgaccgccacagaacatcacccagccaaaaagccagagcaagtacgcctccaaacatcggctgtacgagtactcgtcggcctccgcctgtagctgctcaacctgcaagcagtcgataaaatgttaggcaccttaactgcggactaaatatgtaatacgattgtcatttcggtacaaaaacactcacggtgaactgaagcagccacctcttcgtaggtccggtgttgcggtggtgtgccaacggctcgagcgggaggtgcggtgcgcgctgtactagtgcgaaacgtgccgtcagatcgtcctgccagtccacagccgtggtcactggcccaacagcgtctcccgcgagcggtagccccaacaagtacgatacgtcctgtagggtaggggctacctcaccgcacggcaagtgaaaagtgtgcgtctctggcctccatcgatcgaccaaagctgctacgagggacctgtccacagtccatcgtctggccgggtccgcgtcgccggccgcagcctccaccagccgacacatcggtaggaggccggcctcacgtagcctgcaataacaaattaatatgtcattataaaaaatattacagtgcaactaacttatagtaaaacactgttcgtacctctcgacaaaggagtcgtgaaccgtgagtagctcaccgcacgtccgtgcccggaacgtcccatcaatgcagagaatgtcaagaatgtcccatcaatgcagagaacaggacgacagttcacgaatgccatcttgcatgcatgtagagctaagaacgccctttgcagcacactcttgccaggatgttcaattgaggggaatttcttcacttcgtaagagctcccagggtttctttcctcgataacaccaagcaggcatggcaaattgtcatacaaggcttcgtaagttccaaatctcatctctattattttctatttggccctccaggccttggcatagctaatagtatacttgtatgtctcctcgatgtgtcggattattgaccttggttcatatgtgagattatcgatgacatgcgcatacatctcagatgcaacaaatgcacatgtaatgttcctgtggtatttctgaacaccaggtagaaaacatgtatgcttggtaacaactgacactgtccaataatccttccatttccccttatacgcgtgcactctccagggacaaccatctttttccttaacacaccgaacttcatattgcgaccggttcgacttggcaaccctaaactctttatgaagtgacactgcaaaatgttttaccgcctccttcatatcttctgctctgctataaatcgctccctgaataacctcattttctttgtactcccatctcacactatcctattcagagacgatcagtccagaaaaatcctcactagcccattctgctggattaatatccgtctcatcatctgacgaatcaccttcctttacacgctcgttgtcagaatcctccctctccatttcatccacaatggcaccgacagtctccccctcgtcggccactccacctggttgaatgcccactggagcaactacgcccccgtcctctcgtgcgttgacctcctccacagaagtctcgtttacttcagcacttggtccctcgccatcatccatgttcatctgcacacctggatccttcgggtgaacaaacggaaccaaagctagaggccacccgcgttgcaatgcattttccaaataccatctccacactcgggagttttgaactggcattagttcccaataaaaaccctcagttgcccgacttactataacattgattgttatgtcacttgtctgtggatcaactctcaagcccctcattaaccatccttttatagaaggtacactcctctcagccggtctatcaattcccctttctgatacaataaaatctgacagatctaccccagttggcccgtaacagacgtttcgtggtccatggtaaacttggaatatttgtttgttcgacatatctgtcaacgaaataactagatcatattactctttcatgcaataaacatctacaacgtaatatcttcttgtgtaagccaatgcaacggtaatgtattgattccaaactagcagatctacgtagttaccgatatctataatacgcacttctagattagtacaactaaaaccctaaaaatataatgcatttattcaaacaaatttttaaaaaatacacactatttttaaaaaatataatcccccgtttgccacgtcagcttgccgcctcagaggtgggcggcagggtctatttttataatttttttggccgatagattatttctgtaaatattaaaaaaaaatctaaaaccgaaaaaaattcccaggacgcacctggacctggtgcgtcggccggcctcgccgcacctcgcgctcgcgcgcgcaaccctaacccgccctccctccctgccgcaccgagctcgccagtgcgccgtcccgcgacaagccgtggacaacgcgcccccctttccgctgccccttgaaatctcagccgtgctgtagtgccaagcagacctcacaacgacgacttcgtcgcttccccgtaccaaccaccgcacgtacagcgccagctgtacgtagatcgcgtcacccgagcagcgtttcgcttgtacccgcccggcgcaccggccccgcgaccgcgatgacgccgagtcgcgccaaccatccactccctgtcgcgcgccacgtcgcctgctgccgcccgtttacttttcctcatctcccgcgcgcgccttccgctgctgcacccagtccaccgcgccgccatgccgcgccaccggagctcgacgcagaaagtggtgcgccgcgtccatcctccccaccaccaccacagtcctcctcctgtaacatcctgtgcccctttttcatcgtcatcggcctcctcctttcccccaccaaacccatctccagttctccaccatcacacgatcgagcatctcggggccgcgacttcttgcttttccgccctcgccaccacatcgacacgccgagatccgccgttgcatcgcctccaatcgagcccgctcacctcctgcatcaccagcaccactctccgcctccctggccgccgtcgcgccgggtcgagtgccgctcgcgtgcgcgcctccttccccaccgccgattggattcttgtgcagaaatccatcaattcctcaatcctcactagacacatcaacgctccaactccaggctagagaagagcagaaggcttgcggagaagaatggcttctgccgagcgcagcaagaagctgagggtcctgctcatgcccttcttcgccacaagccacatcggcccctgcaccgacctcgccgtccgcctcgccgcggccagaccggatgtcgtcgagcccactctcgccgtcaccccggccaacgtctcggtcgtccgatcagccctcaggctgcatggctctgcggcgagcaccgtggtcagcatcgccacgtatccgttcccggaagcggccggcctcccaccgggcgtcgagaacctctccaccgccggcgacgaaaggtggcgcgttgacgccgctgccttcgacgaggcgatgacatggccagcacaggaggcgctcatcaaggaccaatctcccgacgtcctcatcacagacttccacttctcgtggaacgtcggcatcgccgaggaactcgccatgccctgcgttcaactcaacgtcatcggtttattctccacgctcgccgtataccttgccgctgccgtcgtgaatgactccgattcggaggagctcaccgtcgcagggtttccggggccggagctacggatcccgaggtcagagttgccggatttcttgaccgctcatcggaatctcgacttagtggacaatatgcgcaagttggtacaagtgaacacgaggtgccatggcttcgccgtcaactcgttcttgttcctggacaagccatactgtgagaagttcatgtgcaacggcttcgcgaagcgcggctactacgtcggtcccctctgccttccgcagccaccggccgtagctagcgtcggtgagcccacttgcatcagctggttggactcgaagccgaaccgatcggtggtgtacatatgcttcggcacatttgctcccgtctcggaggagcagctccatgagctggctctcgggctggaagcctccggtaagccgttcctttgggcggttagggcggccgacgggtgggcgccgccggcggggtgggaggagcgtgtcggtgacaggggattgcttgtcagagattgggtcccgcagacggcgatacttgcccactcggcgacggcggcgttcttgacgcactgtggctggaactcagtgttagagggtgtgacggctggtgtcccgttgctgacatggccgctggtgttcgagcagttcatcacggaaaggctggtcatggacgtcctgcggattggggagagggtgtgggacggagcacgaagtgtacggtacaaggaggcggcgctggtgccggcggcggcggtggcgcgggccgtggcgaggttcttggagcctggaggggcaggggacgcggcgaggatcagagcgcaggatttcgcggcggaggctcatgcggccgtggcggaaggtggctcttcgtatggagatctgcgcaggctcatcgacgatcttgttgaagcaagggcggacgccggcgagtccgcgctgcaacctctgtaacctgtcgtttctctatacgataccgagacattcgttccagactccatccagttcatctcgttctgttgcgttcaatcaaaataaattacgatgtgatgtattgatacatgggatcacctatatatttgttgatataattttttaaaaaatttgacagatgtaattatagtataattgtgatataattacactgtaacttatatgtaacttctatgaaactttcaaaaatatcttgtaatataatattggtgaaacggaggttgtggggacgagtcctctcacatgtgtgcgctgtgactttcttattcctcacttttataagtcttgaaacaaatataacggttcaaaattacgtgaaaattaagttatatataagttacactgtagttatatgcatgcatgttacagtgtaacactactggataaagggtttttaatcctagtttgtaaccccttagtcccggtttgaaataatcaggattaaaaatcattaagatggagccaaggtaggttcgttcttttctttttttcattatttttaactttgaatattgatttcactatatcccaaatcatcccgtgaaatccccaaatcgatcatcacataacaaaaaggatcatctccatatccccaaatcaatcatctccaaatacatcacaaatacatcatatattcaaatcacacacagatcaaatacatcacaaattctcaaaaacaatttcatcacaaatcctaaaaaaaaaacaaatctcctgccgccgccgaccccgcccctgcctggttgcttgccctcccggctccggcgtgcgcaagccaccgcggccctccgctggcctcgctcgctcactcctcctagctcgctcctcgatctgccgacaggaaggagaggataagatcggctttaaagaaaaggataagagagagaggaggaataggaatatgaggagtttaggaggataagtaataggaattatatacagtatatggatttttaagtaccggtgttaccaaccggggttaaagatcaatttttagtctcgtttggtcacaccaaccgggactaaaaatccctggccccctgacagcctctaatagtaaatgaaccgggactaaagatgatctatagtcctagttggtgggccaatagagttttaaactgggacaaaaaaaatcatctttagtcccggtttctattcaaaccgaggctattgtggattttggccgaccaggcaaagatggtttctccatcagtataattatactagattgtactgtaattgtatctgtcaaaattttaggcgaaaatttattgataaatatatagcaaaattgttgatacataacttttttttttctgctgctgctggaaaaatcacgttatggagagtacaaattaaccgaagaacatttctgacctcacttcatcgagaaaaagactatttttctgagtacatgtaatttttgctagcttggatataacgtgaagcttttagtttccggcttgctaaaattatgacgctatatttttttaagggatttcagtcactttttttctccatgtgattgctcggtctcttatatgtatatgtatgttttcatctctcctattttctatttcaagtagataataaattacttgaatcctaattctctcgtacattgtgcattagaaaaattacaatcataatgtcgacgtttgatgtcgcgatttcggtatttgcatattatggggatcgttggaactaggatatacgcgagactgagataaaagatatggggacagagatttttatacaagttcgggccccttaattgtcaggtaataaccctacattctgttggccgaagccggtattactcttattcaccataatcacaccagtacaatatttggagtagcctatttaactgttgtcgacatggcggtctgaaggtctgactcgtagtcgataacagggtcctcctcgagttcgtgcccggcgagatcaaagatagcgctttcgtctctcctgacagtatccggagacaccataggggactagccgtgcctatcttcgaagtcgatatccagcgtcttgtcttggcgtatgttgatattgtgtcttgatttattgtttcgtgtcttctatggtggttgtgtgttgatcgtctgtgtcccctctcctcctaaggggccttgtatttatacccataggtgtccccttgtccaaatagaaccagagaaaccaatatggatacaatccgagtagtccttgtcgtttccatgtagaaatttggttatccttccttatgcggaactcctcctatatccgaaggttgtttccgtataagacatagtatgtggtgggtcctgccgagatttagtcaattattattaggtatgtggtatccataacactgacacataatattgaaacttaccatgtaattatagcgtgagttttgatactttcagttacaaatataagtatatgtaattcatagttgtaaatatagctagtttcgagggaggtcaagcagactacacgcagcaagtcaacactgaaaaggagagtggcgatgagtcatgggcaaggccaatgtttgtgactcaattgacaataagagtaggaaccgctgaagatagcaataactatggcaatgtctgcaatggttaagctcatggaaaaacacaaggtggtcctaccgaagaaaaaaaattacttcccaaccatgcccaacaggcaaagagcaatgaaaatattgtattatattccttgtggtagcaccttaagcttaagatcattttttgttgcactaaacttatcatgtgctcacacaatggctaaggtgttatactattgcagtatttaatgcttaaggttaactttttggatacattgtggttgcctgaggccgcaagcatcagccgcgccaccgcccgtcctcagacctcaggtgcggcgagcggcgagcctgtgacttgcaacaagttcccgtttttatttaagaagaaagcagttctcattttttttaagaagaagagagttggtctaaaccagccataaatcctcacagtcgcttggttaattaaagcaatcagaaaaacaaaggacagggtaaaagcctgcggcaaacaactactgagaccacagtgcaacacagggttgccaagctcttactcaacctaaaccaccagaacatgtccacacaaattctatctgagttttagccgacacacttggttgccaagctcttactcaacctaaaccaccagaacatgtccacacaaattctatctgatttcagccgacacacttttcaagctactaaaacagtatggtctgtaaaaaaaaattctatgtaaaagttggtctgcaatataaataaattaacttttcaattttacaataattaaaactcaattaatcataactttcccgtttcatgtgccctcacttaaaatcttcatgttaagcaatttcaaacataggcacatgttgggaaaaaatttctatggaagattttttaaggagtaaaacagcttcaaagacgctgttttttgtttgaaagacgctgtttaactgtgtatattgcttatcgatagaaaaaaaagggaatatttcattgtttagataggattagtggcctagtggatggccattacaactttaaacgttattcggggcattatatacgtcgttcaccgagtagttattctgcattcattcaaccaacacagcaacgttccaaactagagaagaacaaaaagctaagggcgtctttgaatcgtaagaatgaaaaaatgtaggattttgatagaaatgtaagtgtaaaacagaggattgcaaaacacaggaatgaccgtttgattggaccgcaggaaaaacacaggaattagaggagagataaagactcaaaggaaagtttccatgaggttctacctcatgttagaattcctccaaaatttacatggcattaggcattccatagaaatttcataggattccataaaattcattcctttgattcaaagcgctatatagaaaaaatttctataggaatgaaatcctctaaaattgttatgaatttcctttaaataaaaaggggcctaagcttgcggaaaagaatggcttctgctgagcgcagcaagaagcttcgaatccttttcatcccgttcttcgccacaagccacatcggccccttcaccgacctcgccgtccgcctcgccgcggccaggccggacatcgtcgagccgaccattgccgtgaccccggccaatgtctcggtcgtccgatcagccgtcaagcggcacggctccgtggcgagcagcatggtcagcatcgccaagtatccgttcccggatgtggctggcctctctccgggcgtcgagaacctctccaccgccggcgacgaagggtggcgcatcgacaacgccgccttcaacgaggcactgacacggccgccgcaggaggcggtcatcagggagcagtcccccgacgtcctcatcacggactcccacttctcctggatcgtctacatcgccgagggcctcggcatggcgtgcttccgattctgcgtcatcggtttcttctccatcctcgccatgcgcctcctcgccggcgccgctgccgacgcgaacggctccgattcggagtcgctcaccgccgcggggtttccggggccgaagctgcagatcccgaggtccgaggtgccggacttcttgacccgccaacagaatttcgacaagtttgacatgcgcaagttgcaacagtcgcaagacaggtgccatggcatcgtcgtcaactcgttcttgttcctggacaagccatactgtgagaagttcgtgtgcaacggcttcgcgaagcgcggctaccatgtcggcccactctgccttccgaagccaccggccgtaggcaacgtcggcgagccgtcgtgcatcagctggttggactcgaagccgagccggtcggtggtgtacatatgcttcggcacatttgctcccgtctcggaggagcagctccatgagctggctctcgggctggaagcctccggcaagccgttcctttgggcggtcagggcggctgacgggtgggcgccaccggcggggtgggaggagcgtgtcggtgacaggggattgctcgtcaagattgggtcccgcagacggcgatacttgcccactcggcgacgggggcggtcttgacgcactgcggctggaactcgatgttagagggtgcgacggctggtgtcccgttgctgacatggccgctggtgttcgagcagttcatcacggaaaggttcgtcacggacgtcctgcggattggcgagagggtgtgggacgggccccgtagcgtgcggtacgaagagaagacggtggtcccggctgcggcggtggcgcgaaccgtggcgaggttcttggagcctggagggacaggggacgcggcgaggatcagagcgcaggagctcgccgcggaggctcacgcggccgtggccgaaggcggctcgtcgtacgacgatctgcgcaggctcatcgacgatatggtagaagcaagggcggccgccggcggggttgcaccggcacggcaacctcagtagtctattaatttcgctccgttgccatgagcgatgcactactcctgcagggacttcagaagtgttgttcttgtcacttgtgactgtgagaagcgtttattcagagtgcatgcaaaccgcagtcttcagttgatcagctccaacgaagatctgcacctgcaatatatattggcttaatttggccttgttctaatttgaaattaaagcttttaagttgcatctgatatctgtcgttgccttcagaggtttctaatatttcccttctgaaaatttcatcttgtttacgtgatcatgccaagttagtggatattcacgttatcatccacaagtttctaaaagattgctcattcctcatcagattccccggaaatatcatttttgtcaatccacttgtactacctaatctctattatataaaagaacccagtgatggtaatgaaaatctcccatcacttagagttggtgggattttctaaggctagataaatatatctgcttgttttttttatgtttgcttgcaaattatatttgacaaatataatttcaagtcaagaatctcagatatatcttttgaaatcggttgcaagtcacgggtactttgctagttacttcctctgtttcgtaatgtaagtcattctagcattgtccacatttatatagatgttaatgaatctagacaatctagatatatatgtatgtctagatttattaacatctatatgaatatggacaatactaaaatgacttacattgtgaaacggagggagtaataaatatctaaagtcatggaaaaactaattaatctttctcataagcacattaggcctcgtaagctgaaaaacaaatgccatcaaatgcatgattggataaaatgatgaccgtccgatcagatacatactccctccataaaaaaacaaaccctaggtttccgtgtcaaatgtttgattgtccgtcttatataattttttttatattagtattttcattattgttagatgataaaacatgattaatactttatgcatgacttgtctttttaattttttcatattttttaaaataagatgaacagtcaaatctagggtttatcttttttaaaggacggagggagcatatgtattatccctccggagccttctagtgcctctcctcgcgcacttggcaggcatgaaagagaacaagcaacatatttgggaacttaattggcggcaatttcataagttgagtacttatgaatttgacacatggaccaaatgaaacaaatattgtctctagtttttaatatatgatgtcattgacttttaaatacatatttgactattcatctttttcaaaactttttttcaaataaataatatataaatcatgcttaaaatactttcaacgataaaacaactcacaacaaaaataaactacaaatatgtaaatttttttagtaagacaaatagtcaaccgtgtgtttacatgttaatgatgtcatctattaaaaaccgaaggtagtatgaattgtttatgtaaaaaacatagaaattctatggcggttatgtatgtgacctatgggcaacttcatagtaatatttaggtcaaagatcattttagctacaaaagaaaaaaacaatcttaatctttaacaaagatggtttctcatggtcgtgcaaacacgcgactttgagtagctagtatttgtgaaaggacgacgggtaccattatgttttatagaaaaaaaatatattgtcagcaggtaagcgacccagatcgtagctgatcagcgtgcttacttttttaattagtagtttcagttaccatcgcatcgtgactcacggagtgtacctgcttatattattttaagtcgatcataaatcaaattttgaaatgcaactatacgtcgagcgcccaattcgagggtggaaaaatcggacgcccacatcaagctgacgtcaaattactttaaactattttttctcttaaattatttatccaaatcataaccgaattgcaccattaaattcattacaattaaatctttaaaataagaccacatagggatatattccaatggaaaaaatttaacttattattcaattatttttaaatattgcacgatgttccaccaagtatatcgaaatttgtttcactaagtaaatcgaaaatgtttcaatcgtttaaatcaggcgttgtttcaccttatatgaaaacaatgtttcagttcactgcaacctttggtccatacatagtgaaacattataagtatactaggtgaagcatttttttttggaaaaaaatgaaacgtattcccttattaaagggttttcataatacgtgggtgatttgttgtaaaagaatgtttcagttcactgcaacattagatctatacaaataaaacattattagtacattattagtacactagatgaaacatttttgctagaaaaaaaataaaataaattctgttaatagagggtttcaaaatatgtgagtgatttgtcacaacaaaatatatatagtggagacacgtgacagataagatcaaggacatgtggtggagaacaggagcacgtgacaggtaagatcaaggacatgtggtggagaacaggagcacgtgcacatccgggggagcgtccgattttacctgccccgcctgtcgcccgagcgccacgattctcccagattttggcccctttccattaaaagaacatgagatattgttttccagacaaggacagaacaaaagcagactattatctgttcttgccacgacacagtacgaatcttcgatgacaagagggcaagacaaaaatacgtggcaagcatgcagcatcagaatactaccctttaattaatcgtaaaataatcaaatcaattcagcaaatattaatatatagtctgtgagtgatctagctgagattgagaagcggctattccacaatagttcgatcgtcatctgattgcagacatcgcccactttcgccaaccaagagcaggaaaatggcttcggatggcagcagcaagaagcttcgcgtcgtgctcatcccgttcttcgccaccagccacatcgggcccttcaccgacttcgccgtccgcctcgccgcggcatggccggacgccgtcgaggccaccctcgcggtcacgccggcgaacgtgcccgtcgttcgatcgctgctcgagcggcacggcccagccggcgcggggtcggtggcgatagccacctacccgttcccggcggtggacggcctcccggcgggggtcgagaacctctccaaggcggcgcccggggacgcctggcgcatcaacgcggtggccgacgacgaggcgctgatgcggccggcgcaggagtccctcgtcagggagctccgccctgacgtcatcgtcaccgacgcgcacttcttctggaacgccggcctcgccgacgagctcggcgtgccgtgcgttcagttctacgccatcggcgccttctccaccatcgccatggcccacctcgtcggcgccgtcaaggaaggcgccaaggaggtgaccatacctcggctccccggccacgacttgacgatcccgacgaccgagctgctccaaacccaagaacgccaattcggggccatcagcctactttggcgtcgtcgtcaacacgttcttggacctcgaggccgagtactgtgagatgtacacgcgagacaaacacgccaagcgtgcctacttcgtcgggcccgtctcgccggcgccgccgccattgccggcatccggtgagtcaccatgcctcgactggctgagctccaagcctagcaggtcagtggtctacctctgcttcggtagcctgacccacgtgtcagacactcagctcgacgagctggccttggggctgtaggctgccgggaagccattcctgtgggtggtgaggactgacatgtgggccccacccgatggctggaaggagagggtcggggacagggggatggtcatcagaggttgggccccacaaaaggcgatactggcccacccgtcagtgggtgccttcgtgacgcaatgcgggtggaactcggtgctagaggcggtcagcgccggtgtcccggtcttaacatggccaatggtgttcgagcagctggatttttcacattttggtccttttgaaaaacttatttcacaaatagacccctagaaaaacttatcccaaaaatggttctttggggcgccagagtagctggcgccgtcgtccaacaggacggcgtggcgccgtccccctgccgacgtggcggggcgatgctgaggtggctagggagtgcgccagagtggctggcgcccccccaccgggaattttttttttgttttatttgtttgatatttttttcacgcttagggacacacaagaaccaaccatagaaaaattgaactcaaatggacgtaatatgtgacctgtagaatttttcctctcctctcctctctctccgaactagtgcaaaggagagatgtgcaacttttttatttttattttattttttaatttttttttcacacttaggaactcacaggaatcaaccatgtaaaaaataaactcaaacggacaaaatatgtggcatgtggaattttccaaagttctaccgaaaaacttttctcctcgaaaacacaatcttgcaagcggaatttggaggttttaatatctccgaacccggcaaagctggggagaatcggatgtaacattttctgtagatgtccgtgcatatattatttgcctgattccgagtccgtatgagaaagttacgcctattttaatagatgacatattctgtccgtttcggtagagttttggaaaattctagtttgagtttattttttatacggttggttcctatgttctcctaagtgtgaaaaaaatatcaaaaaaatgaaataaaaataaaaaaaattgcatctctatgtactgtttaacttatatatgtcatttcatgtggttatattttgaattagagtgcattatatttaacatgctgatcaaagggttttactaaaggaattatggtctaattttagtgaaggtgcaaagtagactaagtggtatgctagctattttcagacttagctaagtggtagtttgagtttaaattttttttgtggttggttgtatcgtgatcctaagtgtgaaaaaacatccgaaaaaataaaataaaaatgacaccgttgcaactccatacagagaaacaggaatggaggcggcggcgccagcatggc

SEQ ID NO: 60085 - DNA, 1786 bp, Oryza sativa
agaacgataggaatgggaggcatcggaaaatagtgagacaaatatatccacctccaattctagaagtgaaaactgatatctcatttttccaccatgttcccactcccactgctcttagattacctctttcttcctcttcctggctcatcccaaacacctaaggctccaaatatttcaggcttagaacatgaactgttgatgatgcctgtggtgttgaagtatatatatagacataggtgaagcacctaaactgtatactgtacaggaggcaatgagtatgcacacatcataatgaaccataacacacaacagtcagtgacagtgggccatagatcatctacttttaatgtagacctcatgcaatggagacaccagtacatcttctgcctactctcatataaaacagctgacacaatagtccttggttttgagccttgcaaggttagtcattaaatctgagccatgcatttacataaggaagaaaggaacctatgccatgaattcattctgattactttgagaatgatagttgggtggaggaagaaataatagtgctcgcagtggaggatcactggaaccaagcataattttctcacaattaaagatgatctgccccaacatataatgctagccatttttttagaccatagatcgaaccagctcttttagaaagccaagataacaaggtctttacaggaaagtaaaaacagaaaattaaaaagaagcaacagatttcaacgttggggatgaaccagtttacactttcagcataccatctacctctaaacaggaaacttagcccctacctacactccagggaacaaagactagaaacaaaatgcagcaaagcaaagaaaactagttcaaatcgccagaggtagaacatctgtgggtctcagttcctgcatcctgtccatcactttttcaatccatttccccgtcttctgtgtcttcttccttcagaaatatcttccatttctgcagcagaacaatcattctaaccgagatttcacaagaatgttttcatgcactgtcatttctcccactcaactgagcccaagaaatagctgccaacatcaccagatacaaattcaaattctttgcattcaacttctcaacattggccaaatgccataaattttcaaactcccagggcacctctgcaaaccccacaagtttctgatcatactccaagcaaagactgcattctaggggacagtcaaacaaaatatacaatgctagccatttggccaacgaatattacaattttcgcataagcagagacgcatcatgtaagtgtaagcttcattggctgatgggtctaaactctgaatacagagcatggaacaaaactaaaaaagatcatacatttggttttactgaaggagaaactgccatgaacttttggttgcaatcccttgaagaccggaaatctgcaacattagttttatgtaatatatccactgagaatctaacattttcaggacaggcttgattcctgtcgacctggaagactgagaaattttgagaaacagtgtggttatttagctcagtttctgcttaaccctgtataaaacagatgataaaagtattttgagtctaaggaaaaagtaatagaagcaactggttccattaccatctggatcatttgaggcgattatattttagagagctgtggataggtattgtcactattcttgtgctgcttttttgctacatttgcatttctcttcttttctgtccactctagtggccacgcatcagtgccaactgggctgcaggaatt

SEQ ID NO: 60086 - DNA, 5820 bp, Oryza sativa
actctagatggatgggaaatgaaaaacaataaacattacaaacatcataaaaatatttgaggggacaccaaaactattgctttattatttttatctaattcgagagagaaaccgtaatgaaatgatgaatttgtccctcgagctagcacatgtatgttactcggctttggtttgatcgaaccgaacaatgccatcttttccgcccgacccccttcaaaaatctagaatggcgaccacgactccacgagtacattttacaactttccaatttgtttactttttcaaatgtttagaaaaaatcaattgtttattcttttcttatttttccaaattttcaaactacacattatgcaatttgcaatctactatcgccccaagtatattgctgccatatatcaaatttcttctttgcatcaggttagaaacttgtggctcaaaagtcattcttgtatttttgaaaaaaaaactctctctccaattgaacctaaataaaataatagctacggtgcctgtactatccaataaattacatatttgaatgtgtcctttcttcatcgtacacttttattgtccaacatcaaattacttaaagtgttatgtagtaaaatttgccaatgaaaagtgtttataaaatttgcccgttgttttagaagaacacttctatatatatatgacatatcatatataattggaattttggtggtaaggtttcacaaaactacccacatctgaatccctcttaatcacaaaagctttctgattcccaatcattcaaataccatttaagaaaatcctatattatagtttattctttttccatagacggttcacgaaacttctctaattggtgaccttctaatagtagcgtgatgtaaacaaatgagtcttgtttcaaccataagtagcatatattttatcagataattcaaaaccatctaggtaaaccccgttaaggcattactatataggaaccatcggtgatgaccttctcagtaataggctaaatctgttaggatacacgtaggctacgatagtataaattaaaattttctatcgcgtaaaccaggaaccatacaagtattagatcatagatcgttaccactcgacgcgctgcgcagcgaaagaaggcgctaagaagtcgaaggaattctcgcgaagtagcgggtcgatgtagaggaagtagtcgatcgcaccagctcgatcttcttctcctcgtgcgttctcctcgccgtattcacatgctgatcagtaccgcaaaccagcggcgcctctaccggtatccacacgtatagggacggaacgccacgcgtaaatgtgctagcactcgcgcgcggctagggttttgcttagggaggatagtgacggctagggtttctcacatgatgcaatacctccgccggtcacacctctcacgaatatataggatccatcacttgggcctccaaggcccgtaggactcctattcggatccttatccgaatcaagctcatattggatctccatccaatccccttattctagcccattaagcgtgcgactctgtaggttcatgtacactcggctgtaacccaaaaactccttttcggttcacgcgtcaacagcggcccctagcagagtgtattgacccacggggcatacataaagatcatatcggctgaacctttagtgtatacttgtatgaacccctttgcctcacgatatcgattaagctcaaggctagatatgtgccatcctctaacagctcaaccgttcactcgaacctgttaatagattatataacttgtgattgactcctcaatcacctttggcatggctatgcacttccataatctacaacatcgaggggcccagagatatatctccataggaggggcaaatcccatcttgattattcatatcccactacatgtttcatagcatacccgaaaactacttttataactactcaactacggagtagcgtttagcagtccctaagtaagctactacacatgttaggaaccatgataatctcaggtctaaggattcaacaccaatactaaatgagatcactgatgacacaacacatatggctcttgcagtgtctcattatgttgggtctatccaataacatgttcactaacatgtgtccacattattaatttggtatctctataccatgatccatgagacatgatcatcaattaatacatgtgctgatcatctaaatatatttgttctacatatgatatttgatcagggatcctttagaaatagcaacacacaacataaagagtctcatgaaagaatcacatattcattaattatctatttcaaggaacaaagtcggataaatatgtaaacatagtatgtgatacaatcatctctatgattgcctctagggtatatcactaacaaaatcttaatttgaaaattaatctatatgtttgtaattgttttttttccaacataactttggattttaaaccgttaaattgtagatgagtaaagtattgtcctaaaattattttctgttacttcaaacacttataaaccgcagaaaaaaaaatgtcagccaatcagattctaaaaatagcattgtggtactgttatattgttaccagtagcatctttgtttggtggagtttctatcagctaagtttttgtcgaatgctctaactttcataaacaattcagattctcaactaaattatgagaatttaaataaaaaactaaaatataagaattcgtgtagttatagaataaaaaattaattagaagatataggtcagatatagttcatgaagaccagcttttccagtttctctatttttcggaatctcgagcccccaaacaaagcttagatatacctcaatgtttctcattagtttgggcctaaaatgcccaaaaacttctgtaccgttctttcctcatctggaaatgctatgcagtttaaaaaacaaggtcgacaactggtaaaagaaaactaaagataatagaatgagataaatgagaaaagaacaaaaagaagggaagagagcgagatgggggctagctagctgtgcaggttgcgtacaggttgtgtgatgtgagatatagattcaattcttctagagaaagtgtctggtcctatgatcttcatgtacacatattcatgtatgatgttggagcttaatgtatagccacatcttttcaaaactgatgttctaagtgcactcctttaattacgctttgcaacataatacttcgttgcggagaaatagcatttgtggatttgtcataaaaggcattggtgtaagctgagtaacagatgaacaaaaataaacataactatatatgttgcacatcttattcatactaaatgacaacaaataaaaagagaaattgcttaataaaatgatgcacggatctcctgcgtgttcccaaataaaagtaaaaaaagaaaaaaatgatgtaacattaataatccatggtacaagcttcgcaggctctcttgtttcaatcatgcagctcgaaccacacattagtgggagttaggaactctccgccaaacatgcaaaacagaacgatccattagggtatgattaattaagtattagcatttttttttgaaaaatagatcgatatgattttttttaaatcaactttcatatagaattttatgtgaaaaaacacacaatctagtagtttaagaagtgtgcgtgcaaaaattgagggagataagttgggaaagctaacaaaacaattcagcctaactcgctagtgcgccgacgagatatttcaatgtttttttttgttggcacccatgactccgcgcaaagactcctctaccgttctttcctcaactgaaaaacattacgcaattcacatatagaataaggttgacaactacaaggaaagaaaagagaaaggttgagaggagagaaaagaacaaaaaggaaaacaaaagaaaagaaaagaaaagaaagagagaggggaggttgctgcaggtggtgcgtgtgatgtgagattagattctgctcctgcaaaattttattttctctgctcttctcctcttctcttctctgtgggttgctgcaacgcagtttcagcacgcgtcggcgtcactgatgtcaccccctcccgtttcttcttcttttttctcctccttttcgttgttgctgtttgttccttccgatcccattctatgccttttgtgctgcgtctgcgttggtttgtcatgaaaccgtgcacttggctgcctctccaacggcaaaacgattgccggccttttgttcttgtgtggcgcacgcgtgtgccaaatgtttattctcttgttcttgatctttgtttctcttaatctgctcagctgatcaatttctcgaatgtaaaataccggcccaggtaacaggattgcttaaaaaatatattagtatatgattcaaagttttggagaacaccatggtttaatagactgtaacataggctaaattcgatgctgttgattggctgattagcacatggttaattaagtattaactattataaacttgaaatatatatatttttatttttgcaaaacagttttttgaaaaaaaatcgtttagtagcttgaaaagcatgatcacgataaacagtggcggacgcaggattaaaataaagatgaggcgaagatgctcgtctcaataagaacaactaaacgcaaaaaataccatatttatgttgtaatcatattaacatatagtataatcaataaattaaggcaaacaaaaaacaaaaatgatattaaaataaagtaataatttttgcgccgtacataattcgtcatacataaaaagataccagtaaacatatcaatttacaaatatgagtccattcataaagcatggttgatagatatcttttaaaaaataaatatataagaagatatcgcataccagaataaaatgattattattttgcttagaagggagagaaagaaaaacagtaggcacttactatagtaagggacgggggtgaacgatgttgaggaattgaccgaggaaaccatcacatacgcaggattaaaattggacacttgggctgcttatttatgggccaattgtgaattggatgtggtggtagacggtccaagaaggatatggagggtcggggcggcacgggccgtagctgggccggccgcctaaccccgcctaatgggtggtaccgcccctgacgataaacgagagaataactctttccaatcgcacagacaaacacagcgttacttacaggatgtaagataagtaagacaacgagcggtgtgtgtgtatatatatatagtgtgtgtctatatatatatatatatatatatatatatatatatatatatatatatatatatatatatatatggggtatgagaaatatatatcacggtactagatatatgtgtaaaaggtggtttaatttctgatatgcatagctttgttttaagctgaaggtaggcttggttagatccagtgatcattcaagtaacaacattccacactcatgattacttatgaaatttggttactcaagtcattggactccaaacttctcatttacgccctattaaattcattcatgccttgtgagacctatgatgagcgattgttgtcactagaaaaaaaaatgattttctacaattttattttagacttcgtcaagagagaatggtgcaacaacatgtcacttggtgagccttgacaacaatctcgcagcaggtagctaggctggatttttcacattttggtccttttgaaaaacttatttcgcaaatagacccctgaaaaaacttatcccagaaatggtcctttttggggcgccagagtggttggc

SEQ ID NO: 60087 - DNA, 2806 bp, Oryza sativa
aacgtttggtatagatagccgagaaggattttgcccaggggaaactgcctcttggtttcaagggctttggctaagaattgccagttggtggtaggaccgtagcttgatctgcaaaataggaacttctcaagccacatcaaaaggaaggcagtatgctctcgaggggtgacagatcccttgcccatatatgcggccacatagccagaccaaccacctatgctcttggtcctaaaatcaaactagttcttggtgttcaagctcatagggttagccgatgaagttacatctaatccagtaatcatagtgatgtcaataaggatagagaagaagaaaaaaaagatgacaacaagaagagatcaatctatagggtaaaaaagagtatctagccgatgggtacttacctctgcatactcggccgatggcgtggcagacgggctggcggaactcgacatcgccgcgggcggaaatttggccggagaggaaatctccgtgggatcgcctagtgcgccgaggggatcgccgtggagagagaagacaaagttggcttaagcggtgaaaaaggaggtaacagtgtgaaatttctcggggacgatggttagtatttaaagcgaggcggtaacggtcggaaaaacggcaatgagcgatattcttggaggaacggatatggcaattccaaaacattaccaaatattccggacttggggggcatgtgttaacaaccaaatttggtaatttcagtatcggagatggagataaaactgacgcagaatccaagatggaaatcatttcggaaacagagaaaggatcggctaaagtccgaatcggctgtgaccaggatcggcggaatccgaggtggacaaggtttgccgattgagccgagtccgacaatgtgatgcggtacacgttgtcgggttgagttaatgcacttgatgaggattgccatgcatagattgagtcctgagaaggcaattgtatctattaattaggatatttcatgtaattttcttagagatatgtttgggcaaaagtctgccgcaaagacttatagtatcttagagtttgttagagataagagtcgtgtccgacacggacatattttgtaatctcgggtataaatagaccccaagcctcatgtaatacaacaacacacgttcaaaaacaatctcggcacatcgccacccttttactttcgctttgtttcgacgagttcttgctttcgggttgagctgcatcgatttcgatcttcaactagagctaaaacttgttatggcggcttccgttctcgggattagtgctttcatcttcatgatactctaatcttgcttatgtaattcgtcgagttatcatatatcttatataatctttgacaatattgctatttaaccttcaatcggctaacgtctatcattggaaggcagccgattaggttaaatatcaacgttggtttagattatataaggtatctaccactttatgaaacttcaaatggcttgattgtctagattttgttcttcttttcatacttatagctgcatcagttgagtttgaccttataagtcgtgattagaaccatgatctccagcctgctttttagttgccgattagggtagagtcggggtttcagccgatcttacctgatttagctttatattttatgtgcttgattgatatactagatctgccctttacattaagatcttgttgcatttaagtatattaagctttttgtttgatatattttccctgctttaatatcttagtataaattggtatcggagtattagccgatacatgctagatctatttaatcggctaggctatgaacatatataatttcattgttaatatatatttcgatctaagtgatttatactgtctcggcatggcgaccgatctatcccaatcacttgatttaagtatatatcgacataagaattatatattgttagtatctacagccgatcgaacagatttagttctttcttacttattgaaaactgtcaatcgatccaaatatgacatcggctcagagataaatgatatgtcatcggcaactagccgattggctatcatttatggatttaaccgcgatttctttatctttatttcttattgattgtaggatcaaatcaactggtacactcatagatccaaaagcaagatttcttggacctgcactggagttaagcagatctcccaggcctcgtgtttttctcatcaacaatattagaagtataggaatagattttctttctattttctttccacttagcttagataatatatcatgagaatgagtagttaatgcttgtgtgtcactctacccttggattatcttaacccctacttagaatatgattatcacaactaatatataaattattagtcaagttctctctacataatctttccacgggataaaataaatacaatacccttggaatactctcaggtgaaatgctacaatggtatatccgtgcgcttgtggataaactctgtaaccataatttatcaggagtatttctgcgccattgctaggaattatatttctagtaatgtcattaagaaataccaacacaccattggcaaaggtgggcgtgatggagtatggatggacctatatttttgtctatgctacttccggatttacctaggcccatcggggattgctcatcgcctgtatagggatggggatgaaaccgggggtgggtgtgttggttaggggtggttatatggagggttttgtcgcgatttcccccttcgcagtatcgtgggggtacttcagggtatggtaacatgtgtggaa

SEQ ID NO: 60088 - DNA, 9932 bp, Oryza sativa
ggtttgggttgggcctatcgcaacgtggtttagggttggacaatgatgatgttaatattgcttaattacctactgttttactgctttcaacttatgatttaacaatgatgatgttaatattgctttcaacttaattaccttccccttgttatgacttgttgagtacggtagttgtactcagttttgctttatttttcccaatcccgagaaacagagaatctatcgaatggtgagttctatgaggcttgtgctagacgttgaggttttgcctgtggattatggagaaagcttcgctttgctgtgaagattatgttttgatggtctttagtttttccgctggttttctgagtttattttatatttttgtaagacgtggaactgtatcaaattgtcatctatgtactctagttgatgcttggatagacgttaaatgcacagatagccggtgattcgggttgtcgaatctcggggtgcgacagtcaggttcattgacggtgttcgttcaactcttggactcggatttggagagctccgacagttctcccgagggtatctctcctccttcccttgacatcttcgtcgtgctaatgatggaggaggctaaagctaaggcacgcgaatgtgaggctgaggggcgctgactgaagaagcagcaggacgacctcgataggcaccaagaactgcgtcgtcatgatcgggccgccagtgatgccatactccaaaccaagatgggggcgcacgatgttttcatgacgccccaacacaacatagttgtgcccaaagctctagtcaacaccatcgacttacccgagaaccccgtcctcaactcgtcatggcctaggtgaaggctatggtcgaggctactgccatccaacatcaagagatggcgcctaccgtcgtctctaacatggccagcgagtcatccaagcggctgttggtatttcttaacaacgttgttggtatttcttaacaacgttactaagcaacttaacccctagcaatgatgctagaaatatgggcggtaattatttacatttacaaaaatgaatctgcaagcgcacggatttaccaatgtagcatttcatcccggagtataccccaaggtattgtatttttaattcatgcctatgacagatcaaaactgttggtatttcttacgatcatagatagaatccacaaacgcacggatataccgatgtagcacttcccctatggagtattctaagggtatcaaatccaagggaacgtgtgtgattaattcatcctccggttaatccaaggacaccaagcgaatgtaggtagatgatagagaggatttcctagtgtgaaacattgtctagggaaatattaattttaattctaatggaatacttcaggcactagcaacccgctgtttccagatgtcgctctactccgtacccggacagggaggacttaagggctcttgagggctgtcaccacctctacacccacctcaaacgtactgtgggatacgcaacaattactggataataattacctaaacaccacgtctaagcaattaatatctactttagtgtttataactcaccaaagcaatcactatattttagttggttgtagtgaacaataatcccgtatgctaattaggaactaagagataattctcacaagataaatccaaattactcaggaagataattctattaatagcagagtaataaacagaatagacgaaccaggagaagattaccgacagctccggaattcctccgacttgttctactctactctcttactaattctagtatacaaatagtacaatagagtctcttgtaattcagctcaagcttgaaagtgtgtgtgtgagtgaatgagtaaagctccttaaataggacagttaatgacggttggcgaatgggaaatgtccgaagtgccctccaaccgtcatcaggggtgcatctgggacgtccatgccaaaccctagcctaaacggctgagatgctggttcggccgaaccttgcctggctaggcccatccggcctggcttttggcctatctcccccactaatcctgctctatccaattctcggagttttggaccgattctctagtgttttgataaagttcaaaacccatccttgtatggatatgtttccttctccactccagtctgattttcctcccaacttctgggttcatcacctgcattgaataaataccaacacttgtggaatatgttagaaataatccctaacactatgttggatgtttcattatctggactttatgcagatgttgccggtataaatttggcactaaacaaccgccaacaaaaacctatgcaggggttaatgatatccagtcaaaaagggcaggttgacacatgaaacaccaagaagggctactctcatactaaatgaataagcttagtatagtagaaagaaactagcaaagaatcctatctatacttcagtataaagttgtctagtatacatttactatgcactaatcatacagccaataccccctaactacgccctcctggtatattgagagaccacccctgattgccgagttccttacgacaacccgtcatggccatccgaccggtaatgaatacggaggagtacccacaccaggaaaatgtcttacgattatatacgaacgtggaggaatacccgtactgagctatcaccattagcggcccacctctattgacccgtgacatataaccccaattaatggtatctaataatctaagcaccgcgcttacattacaaaatactactctacatccatgcatccgacatagagcaaccaagtactcggacattaaaccaataccaatgcgtatctctagtaagctacccatacgattgacacatatcaaatttataccaaagcaagtaattaaactatataaatatagcataatactacaactatataaagaagagtatttcattatataatcaagtcttacaaaggaagagtaaactactaaagacatacccgattccttcggaaagacatggagaactttggaactctactatttctactccattataactaaagacgaaatataagctaagagagagcttcttggacttgatgcatcaaggtgtgagttaatggagtgaggtgaggtccttatatagcctcccaatgatgattacaatagctggaaaggtcgaaaataccccgcaaccgtcattggggaggcatctggattgtccacgccaaaggagagagccaacggttgagatcagggtttggtcgaaccctagactggcccatttggcccacaaatcggcaggtgcactcctcattgattcctcagcccagcagtgtagtggttggacccaattgatattattttaatgggtttacaggcccatccacccataagtctgcctctttacggatttcgattaattgttcggttatgttccgtcgattatgctccatttatgaatgcttctcatgcatatatgttagtagcatagcatatagtggaagtagatattttatttggaaattatgcattgcaagcatagctaatctattaattgggtaatattgacggtcaaaattggtggataacgattgtcaacagtgggcatcccgttagccggacagccagcctccccatcaacaacactctcacactgctagctcgttgtcaattgttgtcacgaccggaattaacccaacaggcatttcatacatgcgtgtattattccttgtcccaggaggcaaggtacaccaaaagttgatagaattcagagtttaacaagcggaagcgtaaatagttaatttattacatgggcgacgaaggcccagcacactcgaagataaacgagaaaacaacggaagactagggcgacgaccacaggcgcttgacggcaggcatgagctagacaccaaagccttcatcctccaggaactcctcttctgggttgggggaaaatttagcaagattgagtacaaccaccgtactcagcaagacacacccacaaatgtagaataaatgcaaaggattacaggggattataatataggggttaggatttgcagtaaatagcatttagaagacatttagttgcttagggccattttgtaaagacgatcctagagctacacagtgttattaatcaaggccgtgaacccacacgaacttgccttaacccaaggcatatgatgattcagaccgaactagcaaccagacccaggtcccagctcatcccaagccaacccaggccaaacatttcacattttagttgttaagcaagttttaagaaatataccactaacttgggtacattgctagacttacccataaccgagggcgcggctattcgaatagattatactctcataagaggtgtacatccacaagacacgtcttcctcacgtataaccacatgccacataccaccacgtcatacggacagaaggcgtgacatagttcccgacccatcctagccataaacaagagtaccgacccaaccctggctacggccagaatcccgggacaggtaaccaaggttgagccccttgcagcaggacaccggccctgtaccatgacatctcgactaccggggcacagctcgtgtagccttcatttgtcctagagatgtccatcgagccccgacttcgtccatccctatccgcgtacttttgcccatgactagactgagccacaaactacgccatacccactagacatgtgaaagtacggtagtgctttccaacagaggcccgaagaccgatccttatagtggccccatgtggaagtacgatagtgctttgcaacaaaggcccgaagaccgatccttatagtggccgatgtgctactatcaaaaccatgcacctcgagcccagcctaaaaccattttgggggttttgaatagaggggaaggtttgtgtccaattccacataagccaaccattccataatgtccaaatgatatgaggactcccaaagtctagagttataaaaccacctaaagtttgtttaatttaaatggcgaagcatctacctaaacttggtactagtgagaccgtaaaacagtacccaccagcagggttttggttactctaggcaataaaaacaataacaataatgtgaggacgtcccaaagcctaggtggtgcaacgctccaaggcatgtcagcgcgaaatatctggatggatggggtctcaaataaaacccaaataaatacggtaaccatccaacctcatcgcagaccccgacatgtcttgaagagtgcactacataggctctaagccatcggatatgaaatagaagacacaaccattggaatagccacagcagtcatctatgtcatacgcccgtcaaccactcgatggtggcgaccaaaagcgtaccctagagactcgatctcaacaaaggcatattccccagttatctcaaccatttcaaacccatcctcatgtgggactagttgcccaggaatgcaacatagtctcacataaatcatctcaagcatgatatccaaataatgagtggttctaagcaataagcataaataatcttaataaggttctaagtagtacttggcgacaagccataaatattggttcatgcggtaagcgtgctacccaaaagcccataggcaaaccgactagggtaaatccctagttagaaccatcctggaaatctacaacatcacaagctgcatcaaactcctcatccaaacagtcattatctgcagcagggtctgagcataaacaagtaaaagaaagcaagaaatcagtacattaatcaaattaatgtactggcaagttggaaacaatcctagcatactacatgttggccatattcaaggataagctgtgtataggttaatttgcataaatgccaactttagttcacaacatgtttcgcaatggaattttataacaatagtatagagtaagtaaaacttgtaatgtgaatgaataaataacacacatctacccctcgaggtagatcatcaccactctccatcatctcatcaccattcacggaactttacccaagttcaaaaacaaaacattccaaccattttccaggttcacaagagtttatcaaaatcacaaattatactcatgacacttcaccatgccgctcatgaccgtgagcacggctaatcgattagttttagactctgcagagtttgtacaacttttaagcccacatgatatggatcactctagtttttccgatacccgtcggtatcaccacactctacacattgagtgtgatctagaggtcataacggaaccattacaatgtttattgtctagccttgcaccagcacgatgtgtattttacccatgctactagcaaggtagcgccactaggtagcgggcccacgctttaacctagcgccgtaaggaacctagcctggaatccctcacgaggcacgacaccgttgtattggagagactacccgctaaaatcatcacataccacatatcattaatcaatttcatcatatcacaaaccataggaagttccgataagttaccaaaacccggtaacccatacccttcggcctaccaagatgcaaggctaaactctaaacaacttaataggttgaggccagcccatacttagcacatgtggtttgtactgttttcattagttggtgacatagagtggggtccttaatcgacccgggcgaacgctccccctatcggtgtacaactaccaccatacgtacaccactcgccacccaagtctaaaaacaagttatctccattttcagttcacaatactcactcatttaaatttctgtccagcaacatcaaaataaccattttcacatataacatttatcaaaacgagtaatttgcaaggcggtaaccgaatataagcatatagcggcaatataagcatagtataatcccaaagaacacaataattgtattcaaaagcactctatggttacaaccagcaaggattcaatatttcaaggtggattatgcagcaattaggtcatatctaccattcccacatttatatatttttttaccaaaagtaatactagctaacgtatgcatgtttgcaatagaatcatttagcccaataaaacataggatcaatgtgatcaaaggaggtgcaaacttgccttcgtttgcaaactcctgaacctgctcgtcaacaaactcaccctcttcttcttcgatgtattcttcctctatagaaaatacgcgtatacgataaatacaaaaatgcataaaaaccaaaatgcatgaaaatgcatgaaacttatgcagtgagtgtgtgctggtcttaggtggtctctggtgaaggaattttaattttgtcactttttattaacagagatatgccatttacaattaaaaaggtttaaaaagggctaatttttattaagcaacatttttgtacagaagtgaaaaaattacttttacaagtacaacgcctttattttagaaaagtttaaccaaaatcggtttcccattttttatacctatattcaattggttatggattaaacaagtcttaggcaacattatggcaaaccaaaaataaaggaaaagtttgtacagaaagtacccagttttatatttttgtaaaatagctcacagctctatggatctaataaaactggtttcacaatatttgaagttaaaatgaagtttctacaaattttagaatttctgctcattctctgttttaaaccaaaatagaaatcaattttcgaaattgaatccagccgggtccacagtcagtgaaaagagatttgcacagaggccctcggaagttgggggaatcaacccgtacttcttctgccacctggacaataaactttattaagagtccttattcttttgtttatttccatcaaggttctgctatagtaatatgagtcatggcagttttcagattggatcatagtgtcgatcaaattcaagaaatgaagtccccagctagctcacatcgggagcagccatggctgagctcggtctacggctcaccggcggcgatcggtggatcgaatcgttcgaacacaaaagagaaaatgtagaggacgttcttgcgcatccgtgagtggtggtggtgagggaaatggtagtctgtagcccatggaacatgagctacattggcggtgtgtctcggtatgcccatgcatgtgcatgcagaggcttggttagtgcaaagggttagtgcatgtgctctcatatggtaccagggtgctcaccaagcagagaaacggaggcagcgaggtccagggagcggcggaggtggtggttgttggccaacggcggcaaaactccagcgtcgacgtcgccgggtcgactcaaggcacgaactgcaacttcgagagtacggtggtgttagagatgagccacagagggtgcatgcacgaggaatccgacggaaactcaccggagcttggtgttgcttcggtggtgaggaacggcggccggagcggcgtcggcggttcgggtggccggcggcgaggacggtgacacccaccacgtgctcgacagattggtcctagggaaaaaggggtacgggtgtgctcggcgtgatgcgtaggtcacgttccataggagggaagagagagggactcaccggggatgcacggcgacgacggccaagtcgccggagccgggtaagacggccgagctctgggcattctgtgcgtggggtgtgttttcttggacttggaacacgatgtggggagtgtgctgttgcttctggtgctttggcttacgatataaggaagagtggagtgggggagtgagagagaggtggctggtgctttcattgtgttccttgggcatccattgggcatggggcacagtggatgctgtgaggggagagtgggaggctgtcatgtgggtcccagagggtgtggggcccactgcagtgaaagaaattcaaatatagccttggaggctaagtcaaagagggttgctgccaaggatctttggagggatcaaggtggattttgtgcagcaagaaatctgggctagatatcctcttggtcaggggtgatgtgcagagtaaatgtgctgaagtggattgggttagaagtctctggtttaggtttgatggagtgatgaatatgtattgacagtgttggttagcagcagttgacagtgcagttagcagctgattggatttttggagggagagaagaaagggttagagagtgatccagggtgtgccactcctcagggtgttagaagaaagttagtaggagactttggctgaaaccaaacttcaaaaagaggttttgaaataaattttacagagagagcaagtttgaatctgctaagcagttcttttcaggattctagacagattaaaggagatcaacaagttagcaaaccttactgaaaaactctgaaaaattgtgggttgatttctgacatatcaaggtttttttttttgagaacttttgtggaagttttggatgcatataattaccagattaattgtttttgtgactctaggcctatcaagatgcatatgatgagatgattaagatccaaaaacaattaaaatcactccacaaccacatgatgcatttaaattaaatttagttctcaggtttacaggcttgggtatgttacaaataataataaggtcataacaatggtaaataggcatggctaaataaaacagtgataacgcgggaatttaaataaagcgataatgcattaatttaaaacaaaataattttaaagcatgggacacaatatgttcaaaggagatgtgacttgccttgctcgctttcccaaacgtcggcttcaatctccacgtagagcagatcttccgaagctgcagcgtctacacgaccaacagaaagaaaaaggcttttactctaataaactccatataaccagcagaaacaaagcacaaaaacgggttcttgacttcttaaggaaaaattagagacttg

SEQ ID NO: 60089 - DNA, 1027 bp, Oryza sativa
attcatgtttgaactctgtaatctgaagttctgtaagtttacaatcgactgcagtttttccctttttggccaaaattgaatagtaatgaactgcgttgatcggtcttgtgtgaaatgagatgcattcattttcgcatcaaaccaggcagacagaaaaacatttacagaacctcatttgtactaggggaacacatccttgcacacaaatttcccctgtacactccgtgcagatcaactagcaagtatgtttccttgtactagatgcaaaatctgaaacgttaaattaccacatctcatgccaacagaataagtggtttgatagtgtcgatctagcttaagcgacacagaacctgtcatgctcatattcacattccactaacaagctggaaatcccatgaaaaatacaaagctggaaacccctaaataaataagctggaaagataatctaaataaacattactgtagcacatcgacacaaatgtatttgctgtgcccttgccaaacacacttaagaaactgatgaagtcaagctcatgtttcatttctgggggtgccagcctcttccgttgtggtgaatttggcccttcgatcgctgctctgaccgcttctgattgttcaagaccgtttattatataatttgctggtccaaacataagtagcacagtttagtttgcattgaaggtgaaggttttagtgcaaaataagatgcatatcatactaatgtatatggagtgctgacataacacaggacaaaagcaaataggatgttgcacgggctactaaagcttgcaatattaaggtgatgaacttaatgtctatagtttaaaatggtaaaggactgagtgcagatgattgagaccttgaatgagacaaacacaagcataagagataagctatgaaatcgtgacgctgatgacaagtccacagaaatgctcaaaactaagctaaataaattgaggtcccaattcatctcgctattttatcatctgctcccagttgttaccacagttcctagttttttgttgaa

SEQ ID NO: 60090 - DNA, 988 bp, Oryza sativa
  unsure (1)..(988): unsure at all n locations
cggtgaatccgggcttgattggattgggtcggattcgatttttggatcacccccggagggcgggaggtaaaacccctcctcctcatttatggctttcctttcctttctccggtcgatccggccgaaatcggcgattgctcgccgcggaatcccgattgggtgtggggggatggcctgatctccttccgagaaccgggagctcggatgcgtcgagttggttttgtgctccttttgctttccctttttctggattcgggtttccatattggaaggtttcttgatctcgatttcgtggcgagagctggttgctgaatcttatatagctttccttcttcttcttctagcggttgctacagatgcgttgagctttggttaatctatccggcgagagataatgggcgagcttgctgatctcgttgtcgtgccgtcgcagccgccgctcgccggcggccggcgggacaggctggcggcgctgctggagctcgcggcggcggatgatgttgatgggctcaggggggcgctcgcggagggaggcgaggaggcggcggagttggctgatggggtcgggctgtggtatggtcggagcaaggcgtccgaggcgcgcacgccgctgatggtggcggcgacgtacggcatcgccggagtggtctcgctgctggtgggcctcggcggttgcgtcgacgtcaaccgtcgccctggagccgacngcgccccgcgctccactgcgccgcctccggtggctcgcgcaacgccgtcgctgttgtcaagctgcttttggccgctggcgccgatccggccacccccgattccgccggccgcttccgcgccggcgtcatcctagctcctccggcttcgccagatgcccttggcgatctcgaggtgctcctcgggcgccgccgagcactcgccgtggcgacctcggtggcttcaggttcgtcatcccctccgctctctccttaccagatgagggcaacaggtcgccctcgtc

SEQ ID NO: 60091 - DNA, 630 bp, Oryza sativa
atcccttcctacaacaccatgattccttgattcatgcactgcttccactctccttagttcctccacaagttggttagataacagctggcccgagtgagattgcagaacctgcacatttcacaccgtttcagcgcatttcaattatgcaacagcacatcacccaatgatagctgaaaaataatagaaagatattgcaacctttataattagagggcaagattctcggcaaatatccaaaatcatcacttgaggttgttggacagcaccttctgcagcctcataagttgtgttgctcataatttccttcaagaatttcacacattcctggaagtactagctgttagcatgcatattaaaagtacagactacagagccaagctggaatgaagaccatatagaaaagtacaatctgcctgaatttgtggtgacatgtggaagaactcatatattacctcaagaaaagtctctccttgagcagtcagcttttcaaccaaccatttctcaagattgctatgactttgcctaaaagcaactgtagcaagcttgatgctaaatgcaaacggggtggaatcaaggactgcggataggatctcttacaaataaaattgtgagaataataaaacaagcact

SEQ ID NO: 60092 - DNA, 8857 bp, Oryza sativa
cttgtgaagatgagattatgccagatgaagccaaaactatttccttacctttactagagttgattttgtctagtaattctttaatataatcactattctgtgaaattttattttgccttatcttataatcttctaataattctaatgtagtatttagcttattattaagaaaagaatattgttctacaaattgcttttgttctttatatatatcttctaacttttgctctaaatcttcttgtctcttactccaatttatatagaaattatatattaaatctacaattaaatttagttggctattattagagtgccaactatgttcttcagtatggcttagtctacaccttatgttgatattatctttggtatttattaactttccaatattagcttctaaatttagcttctctatgattaccaggctctgataccactttataattaattcacaactaaaaccacgaagacaccattcagagcaaagcttccaagcgcgctctcaccctccattccatctttcttagtagtagttcctctagcctaccttgcataatatatattgaagcaaggagttgtaatataaaggtttgtaaggtgagaaaaacttgtttgtatctaccttcggggttcccgaaagggaaaaccgtatgtaagcctatttgcttaatatgaagtaattttctttaagtttccctgtttgtttgctctagataagcgtttatgctagggaccctataggagaaacctctcggatgttctcgtttttagcctgcatcttgcataggcgtctggagaaccagtatccgtagagaagtgttcccctcgggtggaactgcctggggagatggtaaacgcttagctagttcaaatatgactagggatacctgaagttggttgcttaaataggcagataagtgaggcatacggctagtaccgagtaggactttaaaatttctaaatcaagcgccggttgtttttggattcgccaccctgcaaagatcctaaaaatttaaagaaagttttcgagtgaacagtaacctgtgaacagtagtgaacagtaattctgtactcataataagtgaattcagcactaagaatagttgtgaatagttgtgaattaattatatatatatatatatatatgtgtgtgtgtgtgtgtgtgtggagcgagttatgagagtacttgagggaaccaaacaagaggtggtggcactggaaggccttttacgttagttaccaaacgatcccatcatggcatgtgcgcagtcacggcgcggcgctcggtcgcacgaacgcaccacgggcacgcaggcaggcaaggcaggcaagccgatggggacgtagtaattggcctgtggcctatataaagaaagattcctcctctccagggccagccagcccccgcccactcgtcagtgccaaaacctactcgaccacaacggcgacgacgttatgtttaacgtacgtacgctgctaactgttgcaggctagctttcagttgcgacgacgcgcgccatcctgttaatgttcaatcgttgggcttgtttatatttttaccattccaattcatgttattatttggtaaaattaataattatagggctatatttagtttgttaccaaattttgataatgtctatgaaattttaacaacattatattgagcacatcctactaaaacttgaaaatattgccaatttgctaattttggcattaccaaattaatgaaatgattcattttagcgtacggacccgtcatgttattgtcttatatatctcggccgcaacaaaaattttaatttttaaacttcattttaattttatctgaatgtttttgtatcgtagtttactttgatgttgcattagcttttaaatcgttaagagcatggataaaaaaagttttattatgtttatttgatgttacttcgttcatctcatattatcattggatgcatcaattgcaacctcagccaactccaattttacctctcatcatatcaacggtgacacatgaatgggaaatatttttagggtcactcttaatatctacttgttgacttatcagccccaatcaaaatttgatcttagagtaacttctaatgaatcaacatcaagagtggtgttaattttatgagaatatagctggagtaaaaccgggcggttaaccattctggatggcagactttctgctgccgagggaattgaagcagtatgagtatgtacgggagagctagcgagctgatgagtgggagagtgcaagctgcgacctgtagctagctagcattgatttcgatcgggggccaggatgcttcggcatccgttttccatggacactcccgcaggctacagctcatggagtcacgtgctcgtgtgcatgcattgcggttaaagtaacggggcagattcttttaatttactagtagcccccctctttgttttttgttggaccaaaacaaaactagtccatcgatggtttaattaagtagtaaattttttagatgcccccaactgatcttatgcttggtgaaaagaaaaaaaagattaagcagagtgctctgctggagtaatggatgagagagagagtgtgtgagtgaggtgcaagtggtggagcatcaatccatctgaatgtgggtgggcagaggatggatgcagtgcatggggcacgttgggggcctgcttctgtgctgggttgcagcttcctctcttctctctcgctaatcctataccctctcacgctaattaatcgcttcaccacccttaatgcacacagcttttgtcaaacattgtttttgtgcacacacatgtagtagtactgggctcgtaccactccactgctactgttagtgcttgctatgctacaccctacacacacatacaaacacactctctctcctcctcccccactctatattaattacttcacaacaacccttcctgttactggtgagcgacttggagctcttcaaagccccagcactatttctcctcccccttcctcctcctcctcctcatgagctcctcctctcatcagtcatcactacactcacttagctagtggcaaaaagatagatagctctagctcgtactgcatcaaacgggcggtagttgcactgcccgtttcaagggaactccagtgacaaccagcttcttgccaattcagaacgtgaccgtgtggtacgtacggccaaggcagtggctagctcgcgatggcgtcggagtgggaaatggccatgggcgtcgacctcggcatggggatgagcacgtaccacaacgcctccggtggcatcgccgccgcgccgatgatgggccaccacggcggaggaggcggcggcggcgggtactccgccgcgcaccaccaccaccaccattactacgggatgcctcatcaggcggcgatgggcgacgccatgcgcgtcgacgacctcctcgacctctccaacactcccggcgcccacgacttcttcccggcctccgctgccgccgccgccgcaggtgaccacgggcaccaccaccaccaccacatcggcggcatgggcgagccgtcgggcgccacgccgtcggccacgtcgtcagatcaccagacgtcgatgctctccttcgccgacgacttctacatacccgtaagcaccctggataattcgagatcgcacgcaaagctagccacttgcatatgcacgcatgcacatacccttgtgaattttgcatatgaagttagctagagtgcttaattttgaggcttgatgagatcaaacgggtttgagctgaacaatggcgatggatgtgtgtgttgatggggttcagaccgaggacgctgccgagctggagtggctatccaagttcgtcgacgactcctactccgacatgccgaattaccagtcgtccgcgcacgccgcaatggcggcggcggctgcttccgcggccaacaacggcggcggcagcttggccggccaaaacaactgcctcacggcggcgcctggccgcggcgcccgtagcaagaggtcgcgcgcgacggccgcggccgccgccgggtggcactcccttgttccggggccgccgttccagtcgtcgccgtcgtcgtcgtgctcgtcgtccgacttcccgtcctcgaacaagccatcgggcaccgcgaggccgaacggctcaggaggcggcagccgcggcaagaagagccccggccccgcgggggcggaggtgggcatggaggccggcgtgcggcggtgcacgcactgcgcgtcggagaagacccgcagtggcggacggggccctgggccccaagaccctgtgcaacgcgtgcggcgtgaggttcaagtccgggcggctgatgccggagtacaggccggcggcgagccccacgttcgtgctgacgcagcactccaactcccaccgcaaggtcatggagctgcgccgccagaaggagctcctcatcatccgcggcagccaccgcgactccgccgcggccgcagcagcagccgccgccgccgccgccgcgggatccgccgcggcgaccgggaggccggagctcatgttccgcgactacggcgtgtgctgatcaagcggcgcacgcggcgtccagagcgagccatgcaggcgcagctacgcatcacatcgcatgcatggatggatgcatgcacagcacagacgcgcgggcttagatccttttgcgaaattctcccgtctccctttctcttgtttatttcctctccctttttttctcttttttgccttattccagatatttttcaatgcttttttgttaattaatttgttggtacctacctcccttgcaagttcttcctcctctatgagagagatcaatcaattctgttggtataactatgattgtgattagccgtccaaggcaggggcgattagttgtctcacgtacgttcgacgtactaacgtacctcccgttcgttcgttaattctccatctgatcctttgctttttcgttattttctggtgaattttctctcgtggtactaccagtacttgcccattgcgtttgcgccttagtttcttcatggccattaataacttcgactcgactcgatcgacttcggttgctagtatatgtgtttttatttcttatatgaaaaaaaaaactttgggatggtaggtcaagcattttaatgggtgaaaaagaaagacgcgaggtaagcggggaatggtggtggaggtgggtgggtcagcacgtgacttgccctatcatggcctttttggcaggggaaagagtgggcaatggtccggtcacgtgacggtgctcccctctccctccctcctcacttattcgcgacgtttctaattttttccctttcattcctcctttctttctccttggtggggctagcagcaagctgccactgctttgagaggaaaaaaaactctccataagaacctaggccgagtttacttttaagctttttcttcaaatttctaactttttcatcatattaaaacttttttacacgcataagctttcaacttttccgtcatatcgttctaattttaaccaaatttttaattttagcgtaaactaaacatatccggatgtgatattttctagtactatgaatctggacaggtggatagaacatcttcgagtactatgagaaaatgtataatccgattttaggttgctatattttgggattgagagtagtaaagcggagtgagctcggtgtggtgttggccatggagctagcgagcgtgctgcctgccgacttccatgtggagctgtttgcttgagccgtatattgtgggctgattattgtatgccactagtactactaccacccccgttactgttactgctgcctgctgctactactagtagcactgaataatgtactattgtaatcatgcatgcatgttctcttctcttctccggtgtgctcgatgcaaagtcagacgtctctggtttttgcagatgtgacctgcggatatatacatcggttgaggttttatctgcaggtcgaagacgagaaagaataagcaaagcaacttgcagagggagaggggggtaaataagccaacgtgcttgctaccggcagcaagtgagggggggtggtggtgaccggtgacagaggaggcatgcatggcgtgcaaagcgactgtacaggagggtttcttggctttacacaaagaggggagatggcgagtggagacgacgagtagttatcggctgtcacgttcgcgcgcaggccgcgatttgacacttgccccccatgcgaagcggcggcggccgcagaggcctcgtcgtcgtccatcgcgcgggcgcgcaccgacgcgcgcgtcgtcgtccagcgtccaacgagagattgacttcgccggcgcggtggcagtggcatatgggtggtagttaacgggtactcctaccatttcaggttataagtcgttttcactttagtaaaagttaaactattttaaatttaactaaacttatagataaatgtgtaatatttatagaactatattagtttcatcaaatcaataattgaatatgttttcataataaatttatcttaggttaaaaatattactattttttttctacaaattttattaaacttgaaccagtttgatcttaaccaaagtcaaaaacgaagagagtaacaaggtaagctgcgtggcccgcggtgagctgtgtggtgacgcccacaccgtaaggaggcctgggccactactgctactagtagtagcaggggagagggggggcaggtcaaggcacgcatcggcatcatcatccatcatgtgtgtgttcttctccctgggaatcctgcagcaacccaccccagctgggagcaatcagacacacaacaagacgggggccagttgggcctaaacgacgatggtaaatgcgactacccactgacaaaaagcaattgcaaagaccaccttgccccacgcccaaagggccacaaggcccacaacccaccaccaacagtccaccaccacacggtgaattttcgaaacgaaccgataactttttttaatttatagtatgtgttttcttttttaaaaaaatttacagaaatatatttgtttccaaaaatatattataaataaataaatgcacgaaccgacaggtaacaattgtactgacatgtgtttgtttagctgcctcggacgctcattcagtccgtgcccattcctataacaaaaaagttcagtgcctattcgatttgttttccgtgaaaaatctttagtactagtagtacgttgttgaaaaaccatcactgaagtaaccaaatcaggcctcataagtggactttgaaaagaaatccagatgatacagaacatcctaaaatggttaggggcaggcacactccatgcatatcgaacaaaaaatcatttgacatatgctctcggttgattgagattccaaggacaaatatacagtcacacgggtacagggccattcatcggtacacgacattgcaatatagcataggcacattatgccggtcgagttgtcctcaagtacgtagacaatgttatggctatagcttatttcaaattactagtactgtgtctgtaaatgttattctacctcgcgtcctgagtgtacaataaaaagaatctgatgccataaaagacttaacagctagcagccctaaatgatggtgtggtagctggtgagagaagttttttctttcggaaggttgttgatgacagaagtggttaattctgcccaaaggatttcgtttaggtgatagtagtgaccagtgatcagagatagcgggacgagcagagacaattaaaggccccaccaacttttttgtacttaggagtatctaattaattaggtaattaagtataataatgctacctccacccaaaaaatacaagacgtatttattttgaattaaaacaagaaaaaaaaataacttatccaacatataacaaaaatggacgaggcttcttgacttaccgccatctttgcctgttgctgcaaagattgctcaacactgccattgcaagaatcagaaatactcctaccatctttgcctgttgatatttcagttaggagatcattttcttctgaatcttgcctgtcacgattacccgggctacttaaaatctcctcctccagaggtgtctgataagaatctgcacatttatcttcactaactctagtagtttgcatcttcatagtatatatttgttcaatattggcaatcatacgttgtcttccaaaattgttgctgcgtgcattctcgtttggacatctgagctcattcaaattaatattttattctaagttattttctggttctacaagagaattgcagtcgttctcttccttgacatgcctcttattgtgaaccatttcagtcacactcttcaattcatttaaagtttgggcaacaacaatactccagcttctacttcatccttgatgaagatcctgataaaatgttcagcagattctgaacccagtttatccaccaagtctttaaatgctactcccttcgtttcaaaatgtttgacatcgttaactttttagtacgtgtttgaccattcgtcttattcaaaaaatttaagtaattatttattcttttcatatcatttgattcattgttaaatatactttcatgtacacatatagctttacatatttcacaaattttttgaataagacgaacggtcaaacatgtgctaaaaagtcaacggtgtcaaacattttgaaatggagggagtataatatatatgtcacgcagcagttcaactggtaatgatcaactcatcattttcttctgttagcttctgcatccagaacagccaaatttctcactaagtctctgaatatttctgaatgtaacacatgttgcagttaacatctgatctctgaacc

SEQ ID NO: 60093 - DNA, 978 bp, Oryza sativa
gccagcatggctggcgccgccgcctctattcctgtttctctgtgtggagttgcaacggtgtcatttttattttatttttttgatgtttttacacactcaggatcacgatacaaccaaccataaaaaaaatttaaactcgaactaccacttagctaagtctgaaaatatctagtataccacttagtctactttgcaccttcactaaaattagaccataactcctttagtaaaactctttgatcagcatgttaaacataatgcactctaccactatatgaaattacttaatctaattcaaaatataaccacatgaaatgacatatataagttaaacagtacatagagatgcaatttttttatttttatttcatttttttgatatttttttcacacttaggagaacataggaaccaaccgtataaaaaataaactcaaacggacaaaatatgtgacatgtagaattttccaaaactctaccgaaatggacaaaatatgtcatctattaaaataggcgtaactttctcatacggactcggaattaggcaaataatatatgcatggacatctacagaaaaagttacatccgattctccccagctttgctgggttcggcgatattaaaacctccaaattccgcttgcaagaatggggttttcgaggagagaagtttttcggtggagctttggaaaattccatatgccacatatttcgtccgtttgagtttattttttacatggtgggttcctatgagttcctaagtgtgaaaaagtatcaaaaaaataaaataaaaataaaaaagttgcacatctctctcctctgcactagttcggagagaggagaggagaggaaaaattctacatgtcacatgttacgtctatttgagttcaatttttctatggttggttcttgtgtgtccctaagcgtgaaaaaaatatcaaacaaataaaacaaaaataaaaaattttggggggggggggg

SEQ ID NO: 60094 - DNA, 8675 bp, Oryza sativa
ttgctagccctagaaattcctcccagaaacatataattaattataacaaatcgctcactaattcgtttcagtgatagacaggcttgagtatttcgccaaatgatatgattgccctatcaatcacaaccccacaagtagtcgtaaagttcaacagaaagttgtttttgatttcttgatttcgacgccttagggtgacaacatagaaaacacaatatatatatttttgtttccataataaaaaaaagtcttacagttacatgtacagcatagtttatatagacagggtcacataacataacataataggcaataatctaccaatacaatttacatcatgaacgtagcaaagacggaattaattagtatttaagcacaaatgattccgagcaagatgcaacgagttaagctaggctattggtacaccatacacaggtagaaaaaagtgtacaacgatcaacaacataaaaaaaaaagaaagaaattatatcgcccaatgatgaagtacgagagggacatttcaaccaaaagtatgatgttgcatgtaacaaccaatagaaatggacctaggtttttcggtattgcacaaggcaggcaggcagcagggggcgtgtgcccacaccaaaggtaccaacctgaacttgcagacaagcgaaagattccaatacgcataaaaaagttgctttcaaacaaatctgtaaaatcattcaccccttgaaacttttgcaatgcagaaagcaaagaattattgatggggagttcacattattcaatctccatctttacatttttcctttgacaccatcgtacaaaagtcgggcatacttggttgttctgagacgacatgatagctgctaactatttttagcatgttgttgagatgtatcactatgcctttgaatctaaaacagaaggaagttggctgacatctagaacatatatactgtacataccatatggaattggcaacatagaactgtatcaagaaatgattaatctatctgtattgctgtctattattagggttccattttattacgatgtggtactgattaggagggaaaagactttatttagatttagggacacaagaatgagagcacaagctacactgagcttgccaaataacaaaaggttatttgagacactgacaatgaaacaagctgcaaaccacagaacagaacacaaggcaaacatggaaatctcagtttataagcatatgccactggcaaaattgacttgttgctccaactccatatcgtactataattcgctcgcaccttgttttcctcttctggaaaggagagcatctgtagcccctggttagaaaaactcaacaaagcgttcatagggcatactccctccgtttcacaatgtaagtcattctagcatttcccacattcatattgatgttaatgaatctagatagatatatatgtctagattcattacatcaatatgaatgtgggaaatgctagaatgacttatattgtgaaacggaggaagtatgcactaaatgctctaggatacgtgagtcgtgctgggaaattctgctgctcgctcaaccttacgagcaagactaagtgcgagcgatttgctatactatgcttactctgggctcactgtcaaagacacagttacattgttcgcccttttaacaagaactttaaatggcactccaaccttgtcccccatgatatcaatgatctggaataaatattttatttataaatatggtttaacatgctcttggctcttggattgaagacaggacaatataattactaggttcctaaaggaatactgtaagtgatacactagttagcttagttacctctttgatgcttcaaccagtttaccatcaaattcaacgaccacatccccaggacgaaatcctgcatgttcagctggtgatcctggtgtaacctggttgacactcatatggtgtcagcagtgccaactactattatgatcataataaaaatagacgcatgctaaacatgtgacaccagatttgcagttgagttaaacagtcatagactccagccaatatccaaaggccattgcactgtgatgattaaaactgaacagtaaaattcaattcaaacaaggtgattagatccactctacccagctgcaagaagattcatcagacatgatgaattaagcatcacttaccattggaacaagcacaccattttttacatctggaaaagaacttgatctttctttaagttgtgcaatgatcattgggttaaggtcaagcatctttaaaccaagccatggtcttacaactctcctgcattgcatgttggagaagtataagtagcagctaagcatattacaagctaaaccagaacaactaagctaagtgttcattacaaaagcaaagccatgtctgatttcaagtaattgttcactattgaatgaggtttcattacttctcttcgcacaagagaaaccaacaggaactagaagatttaatcatgataaaataaatgtgacgataatacatatattacagaactttactgttgtaagcatgttgaaactattttgaaagaacacacccattttaccccatttgactcttatgagcccccaaactacaaaagcataggcctcaccagtgttttcctctctctctctctgtttctcttatatgcaactgccagcagctgagcgccgctcccttcccaataccctcactgtcaaagttactacacgagcaaccttgtcactgtcttattttcaaatatgcatcttctcgtaattttatctccccaactatcctcaataatcctgctgggtctaagcagtgctctcattcctcacatcttaagccatggaggcaaggtggagcagtggccaagatcaaacgaattgataagatgcaaagttggctggttggaaaagtcttgctgtcttgaagaatggtacaaaagttcacatactcatcaagagtgaattcatatcattttaaacacagcgaaggaaaacaggtgaaatggaaaaccacatgtatgctaccaaaaaattgaaatgggtgagaatcgccttcctattcacagtcacctactcctagtcctcatctacccactgatacggattgtttggggaattcgaactaaatataccagcccatcccggaaaattggtcatgatttaacccgtgctaaacaagacttgagtgggatcaatgactgctatggtgaggaactcaataacatggtagctaattcaacagctttatggctgtgtaaggcaccgaaataaggtcagtgaccacaactgcttgaagcggcggtgatcagcatgaaactattagtgagggcttccatgtgtgcattagtatgccaactgtgaccatgtgcacactaatatgcacatgaaaaggacaagtagggtttgtttttgccaagatatagttactacattaggacgtgacgactcgaaatttcgaatgccatgtcaatcaaaaccacactagtcttgagagtaaagggtttactgattttgataatcaagagggtgaaacttagacggtcatgtagttgaagggttgaagttggattcttctggtaattgagggtgtatactagatatatacctatttcaaaattgacagaaatattacaagctgatttgaaagtatgatactatgatgctagatgtcctcataattcattcttgtacaagagtgcaatgcatgtggaatttatgtcacaaaaaaaagaaaactattcataaaagtcaatgcataaagacagactaaccaccaaacggtttcttgtattttatttctcccacagaacaagttggaaacaatgagggcattccatttaattctcacatttatagaagtacctaagtgggtaaactacaggctttaatcactaaaaaaacctcaacctgaactgaacaaatatatttcaaaagaaaagacgaaatacacaggaatggtatctaggaataaatagtacaatgcaactggcatcatacaacttagaaggaaggcatacccatttttcttgaagttctccactattttcacaatagagtcaatcggtactgcaaagctcaaaccatcagctgcccaaactttcatcacattaactccgacaatttcaccgtcaagattcacaagtggaccaccagagtttccctgtgtccaataaatgcgtgaactatttgacatagagaaattgagaaactagaacaggaactagggaaaaaaatatatcctagaagtcggtacatgtgagcccaatcatccataggacagagtacagaaccaacaaaaaataactccaacagacacaaaggagtttatgttcctccaaacaagtataacaagaaagcaagaaaattaaaaggaaaatgggatggttgacagcacaatgtactatatttttagttgggtaagccctgataagaaggggaaaagtaattcacaattttccgattacccccttctgcaattactagaattgcgatcctgaatcaaattgtatatgcttcagtagaattgaactctaggatcaaagcgtagaatcttagacctattccaaagtggcatgagagtccgtttgatcaccgtggcacctaatttgattcatttatcgtttatcttagcaccataatactgtattcctcttaataacataataccgtggaatacatgcattattgactgattttttttcagcaatgtgcagtacattccatgggttaatggtaagcatgtttattagatcatttacacataatttggttggtaaatatactccctccgtcccaaaataagttcatctttgcctccacttgtttgtcccagaataggttcatttttaagcaatcattacattgtagtttgtgaaagtagggggacaaatgcgttggaagtaagtgggggacaattccatcgggatttagttggagggtattctagtcctcttgcttttgtattggtatgtatgtgatgggtgaaaaatgaactaattttgggacggaggtagtattatttagcaactaggtcacattctgatatcatttgaacaattctacgcctagaatagcaattttaatgatcttgacattttatgtgacaaactaaactaaatatatgtaatccatttttactttttcatccttcaggattccaaatttaaagagaaaatctaattcatcaaataataacttcaaagtaatcaacgtagaagttctaattctttccaaacctgagaaagaccacacaagccaactcccagaatggtacaatcttatacgatcctacacgactagtgatcctatgactgggattacaagcattcgtggatgagctgtagctcagtggtagatcacccagtagaggtctcggtgggcttcgtacccacttccctgcacaaggtttcgggggccccttctttaaagccaactcaagggggacatacttgccccttcattgagtttttttaggattgcgagacttccagatatgattcttgatatgattttagttgtttggttgggtggaatcgtagaaatcaccctataactagaatcgtgattttaacaaccaattgttaccacccagtgagatgatataccaatggtaaccactcactgaacaaacagagtacataaaggagataacacctatgagtaccactcactgaacaacagaacagagtagctgagaactgtgtggtgttacgttaattgttttatcagtgggtttgaaccacaaaactactttgacatatgcttattagatatattaaaatttttctgcatttattgtgatggtttggtgacagggagtagtacaatggcataaacattagtataaaacaatctagtgtactcataaaagcaatgacttaggggtataatgtaaagggtcttgccttattgatagcacaatctgtttgcaaatactcccttcttattcctccaagacctaggtcactgcttttccggtcaacacaactacaagagaatggggtggaagtgaaacattgaagccataaaaacaagtagaaagcttgcaatcagaaggtagctaataatcttagtgatggacaacaaatgagagtacaacaaactaaagagattaggtctgcacttagggaggtgttaaccttacaataccagctgtaactgtgttttgaagagaaagtgggcagcccaaagcaacaacccaatcacctggtcgaagtttagatgatgatccaagatttgcagatggtaaaggggtcttcgatttaatcttcacaacagcaatgtcagagtgacgatcagcattgagaacagtgccttcaaactcacgaccatcttgcaaagtcacactaacctattacaatttcaacctttgtaagaaaagaatcaggatttatacaaacacattgcaaaaataacctatatcaaccaaaatcatgcaagaattatcaaatagtactaagtaagaaacagtataaaagtatttatcataattcataagcacaactattgtataataatttttaagaaaacaagtacttagatgatccggaccattaggcactgaattatccattctaacatggacaataatttggccccacacttcatagctatcataagcacagctataataatttgaccatactaaaatttaggattttaccactagtacagagaaaaaaattattctacgtcattctctttcttcaaaagaacattaaaggcctataacactcagtttgtccaagcgcaaagtggtatttgaaatacaaaaccaaacagtaaattccaatacaagccaattgtaatttgttgcatctgtactaatataaggaaataagttagtacataaaagcctgaattctaaagcttggagtatatcagataagtgtatttctgatgtccaagattattttcccatattagggaaaaaaacactaaccccggaaaagaagaagaagaagaaaagaacaatatgatataaggggttatccatatcatggcattgagtttcatcaaatgcctatgtgtgccactaatgtctcaccaacgtaagacaactgcatgttaccctcacattttctttggcatatttcagatattgatgaaaactattggcacagcatggatttatcctataaaatactggtatacttcccccgtgagtaaattatattcaggactgagcaaaaatcacagatttatatgaataagtgcaggaaacataatgaagaagtgtacagcttgagatgaacagaaaactacgaaagttagtgacatgttaacaacctttcccctcaagattggttttgtgctttgaaaatctagaacaacatgggcacatgtcaatattgtcccatctgggtctattatggttccagatccaatgctcttctctagaacccatccatgagtttctacaaaaagacaaacaaaagtttattatgtatagctaatgtgctgactgtaagttttcacaccctcctttagacagtttttaccttgtgtagaagaaatgttgacaacagcaggaccaactgcagctgcagccttggcgattgtatttcggttaatacatcctgggcaacattttgaatcatctgagtttccatcagagctctggttgctcaaattagtgggtggaactgacgcagatgcgaaggaattttgggtgggaaaccctgcactccaatttgatgcagatgtgaagaaatttaggaaggaaaaccctgcacgtaaactgtacacattaagatcttcaaggaaaaaaatacgagagattaatcaagaagatatggtggctactattgttttcagcaaaaataaataaataaataaattctcttgagtgcttctcttatatagtgaatatgttgttaagttacacatcgtgaatattctcataacattttattgacaatcacagaagctgttcagctcaaatactcataaaaggcatttatacagtgtagaggcaatttcataccttctacagaacaagcgaaagtcaaagctaactgttaacagctgaaatctagcacatacttacatggtcagatatacgcagattctgcaatgtaatgggataacatactatgttctcatctccacacacaacatgccatcagattggtcctcaaccagtccttttggtacacagcacaatagagtacatataatataacatagtgggggcacacgctcaatttaacttttttattttaggaatgactgaatttaaattaactacccatcaagaaagcaactgcacagataaacaaagaaaaactcccacgcacaggatctctcacccacctactaaaaattcagaagcattgttcatttccacatcgaaccaccatttccggaaatcacaatggtggttaaactagaataactccagcacattgatgcacaacaccgtagctacacaccacacgctagaatgtatgcatatgacaaggcggccacaaatttatagctcaatatcacactatgttcatacatagttggcaaaatacattgaactcgcccaggaaagcagatcacgcatctacgtcgagcaatcacagtaggaaaaaaaaacaatgaatcaatccaccgttgcgagaaccgtacacgtcaccccgacgaacgacgacgccgaaaaatggcaggagctagtctgaaagaga

SEQ ID NO: 60095 - DNA, 10725 bp, Oryza sativa
tcatgatgcacttagaagttagaatgcagttcagacgatgacaaacggaccattgcaaacaaaaaaataagtagaattaatctcgtaaaatagtttagagatgatgctgatgaactgtgatggagacctgtatgttgacatgttgtgtctctccttaattatgtagagcatgacaatttagtgtgataaaataatagtaacatttcatgctagctagaatgactcaacactgtcgtttggattgatccaatgggcatctgattcgacaaccacagccacttgcattaacaagttaacatcagctgcaagcagacatggatactttggcatgcagctctgatgaacatcagtagactcactgtactccagtccactagacttgtctgctctgcatatgccatggaattctctgaactttgttgcattttgcatcatgctgcctgcagaagcctgaattttacaaggcagagaacgaccagtccacatgtcacaatgactttgcacggtgctgtactgtagtactatgtacttttctctatgtccaaacactttctctgaatagtggtgatcttggacagttcagaagctcagtacgtatacttttctgtggtccaggagaaagagttttttcatttctttcttgttctgttctgcaaataactgaacattaatttgatcgatttgtatgaggtggtggctccatctgttgccttgtctggctgcagtgttctcgaagacagggactgaattttactttcggtagtttactcctcaaaccaaaaaatgtttctagaagcaaaggtttggatgtggacatattttgtagctaaactgatgtggattgatgggggttaaagaaatgcatggaagtggaagctgcaggaaggttttcttttctgaaaccatgttcagcatcggtattgtataatactaatagtttcattgtcttgtatgtttctttctcatttaaaaactttttagaggcgcatactttcgtggtatttgttaatgcagataatgcaaataacccgctacttgccactgcttttgtaaaacaaaattctggcataatgttaacataagcaccttctgtgtaaaaaaataatttctagctataaatctaagcaccgtctatacccagatttaaagttagaagttgattttttttcctgtaacaggggagcagcggggaagtgtgtatacctatctgtaatgaactgacatttctaaatagctatccttaatggtggatctaaacaaaataacgggaaagcatagtgcttccttcgtttcaaaatataaggattttcatgttgtttagccaatcccaaggttaggtcaaaagattcatttttagtcacttaagttgttaattttgatattctaaattacttagatcctctttctaggcatgtgatcgacttaaaatcactaaaataacgagaatcatatgaatcaatatagaaatcactatatagtggtataaagttcgagttccagaaattcattgtagaatgaagggaggaccaaagaacacgtgatgagtagaaaaatgttgtgaaaacacctgcacagcacctctactgtactccgtcaaaccggcaaacccatggcggctgcctagcggtcgtcggttcctttggtcggccactgcttctgctggatctgcatctgtggagacaacaaatcgtgtcttgaggaaatcattcaagctcatactcgtattaatcaacatcaaaattctctctctagatctctctcccaattcatcatcatgtctaagactaagatcgagaaggtggaataagggcaatcccaaccccctacctcagttagtgtccatagtattaaatacactgtcacatatgtaaaattttgaagcgctaaacaggggcgaagctagcatcaaaacaaggggaatgcactaccattgagaatctagaaaatttcagtacaacactgtacattctagtgtttttaagtgagaaattaggaatttgggggttcatgtgcacctccaatataacatagcttcgccactagcgctaaaagagttaacaagaagataggtaaaaagatgaatacactattttttatgtaagaaatcatctctatacaaggagatatgtggctaaaagagaagagaagagaggtgattggatgataatttaatttgaagataccaatggtataatgtttatatggcagagcaagtacgtggttgggattgtcctattgcatcgatcaatctctcattcaatcgtatcatgaacccaggatgggccagattcatcacttaccggcatggcagggagatccaaattaaatacagacacttgcctcgttgctttacatgtcatcgattgcctctacatatcaccttgattttctttttcttcttttgtcctttggattgttctgggggcagcctaatctagttttgtgtgattggttcacggtggtataactttagttctggtttgtgcctttgaggattatttgttgattaattaactttagtttgcgtttgtacctttcaggttatattgattttgggtctgttcactttgatgtcatttttaaccatactaatttttctgttaaagttgtcaaaaaaatatctacgtttagtttattgccaaatttggtcaatacataagaaatcctgtcaaaattttagcaatattgccatcttgctaaaattctaaaaattttgatattactaaaacttgttaaggtttattttgactacaatctgaacagaacaggctctttaggcaagctgttagaaaagcaaaagcttctagaaggaaactatacatcggtgtgcatggattctttttaccagcctggatgttgatgggtgagtcaacactcgagacaccacaagcgtgagtgcgtgacatgtactgcatattccaaatggagggatttttacacacaaggacaatagagtttagtacttttggggaagaaatgaccggacatttggagttaacatatgcattttttactattgttaccacaaggacaattttcatgaagtcattatctttgactgagtacacccttttctgggtgtagaggttttaatctattgttttttaagaaaataaagtatttatcttattagtacaagttatgattttattgtaccgtttcatgcaaatagatgatggtgaaattttgtcaaataaatatgacattgtgctatattgtagtactatagtatttatagaaaatttcataatcatcagggcgcgcacgtttttcctgaagcttggatattgtataatatctaattaggctgagttctaaatagatattcagaacgtctattttctttcgtgaaaccagctttctcaaaccacgtgtttcttgtaaaagttatatatacacatgtttttctttaaaaatatttttaaatttatagtagttaacactaatttatctcgtttgcatgccaaaaaatcctaaacagttatagagttgtgtatatagatcaagaaaacaaaaccggccttattgtcaagtaccagtaattaagcactgaaaatgatacttcctccatccattaaagttagacatattttatatttaagtttttcaaataagttgttcctacttataggctctacacatttaaatagagaggaaaattaaatgattgatcagaatccgagaaaccatttttatactaaatggttgtacgcgtgcatatatctttgttttgttatataccagatgagttaattttttttggtcttggtgataaaaataatgtgtaatatttggaaaggatatgaagtaccacatattttatcgacgagagtggtactcccaagatccacagcaaaattaattttggatcgagtctcttcatcgcttttgtcattcggctccagctcttctcagggcactcccaaccctccacctcagctagtgtctatagaatttattaggctgccacataagcaaaaatatgatgtggcaaagaatttaatgaagggagagaagaaaaaaagagagaaaccgtgtctcatgcacgaaacggggtcgggcgcaggcaccaagactacgaaacaagagaaactagcgttgggggcaactcatcgtttcttccgcccggattttcctcgagctctcgatctgctgcgcccgcctccatcccgccgccatgcctaccaccgtcccgcgccaaatcctcacgatttttcggcgcgcccctaatcctcttcgcgccaacaccagctcgtgcttctctctatccatctcgttgcctccttttttccctaatcacttgtcttctccaatctctctcgtgacagctagaatcagccaaaaccatccccaatcgctcatccctgagaaagtagttctccctagccatgcgcaagcatgaatctgacggaatcgaagatgcgtcgatccaaatccaatcaggctgccggtgaatcgactgcccttgatccagatgccgctagtgttgtgggagccgacggtgctccagattctactgttgttgcttgtggtgctctacgagctagtgctctaggcgctggctttcctaccgtaggtgctcatgccgccagtgcatggtggcaggaatcatctcccggtagctcggaatggtaaggtgcaaatttttgtatgcaaagatttaggttaatcaatgttattagtaaattaatgggttatattaggctgacaactttttgcttcagagaattgctaatctagtgttgtatagctggcacttttttactttaaagaattttttgctagcctcggtggcaagatgtatagctggtactgctaattacttgtattcacctgattaatttaagtcaaactcatatatgctagtttatggggactgatttttttctgaaatatattgtgcttgtatttcaccacttctgttcttgacacagatattaattttttttgttgttttctttttcaagatgtatccaccaggtggtttcctaaattatttacagagtaataagatctctccatttacccagacacatccatttgtgaactatcataatgcaagtcagctgccagaaaatttccactttgttggtgcaccaatgagttattctacaatgtcacctacaactccatgttctaaagcgataccgtcaccaactgggaggtgtgctgcagcacaaataggttcacaagataaagaaacaattgatattgaggacgatgacaccatcgagcctgctagatccgatgctaggtccgagaagcgattgaattggtcaaatgaagaagacattagattggtaagttaattttctttgtttctttttgaagatttcagtctgtatgcatttaaaattatttgcacttcattaaaggtacggtttattcttctcctaattgtaggctagtgcttggctgcacaattcaattgacccgatcaatggaaatgataagaagtcatatcaatattggttagatgttactgctacatacaacagtaccactaagagtaaccgtatgagaaatcgtaaccagttgaagcaacgttgggagcgcattaagaaaccagtctccgaattcaatggttgctatgcaagaatcactaaaatacatcaaagtggtatgagtgaagaccaaaagatggaccaagcattccagctatatgcctctgaacataatgacaagcctttcacaatggtgcatgtatggaggatattacggcatgagaaaaagtggtctacatatttgaagaaaattaacaaggaaaagtacaagagtataacttctaacccaactcatgttgtgaatgtcgaagatgctccaaaactgcgtcctattaggcataagaaggccaaagatgaacgcagcggaaaacgtctggcatcagaggctatttctgttattgaccagaaactagataaattcattgaagcaagcagcaaggctgagaagataggagaggtacaacaaagtttggcaaataagaagctagaagtagccaaccttaatcataaagcagctcaggaacaaacaaagagtaaaatgattgacctttacaaagacttactgctagctcccacaagtgatcttagagaaagttcaatactatagcccactactagctccaattcatctatagccaatctaatagctaatttatacaatgttgcttcctataatattaatatatggtcccacctgccatacacatattgcatcttggagcctgtgctacagctggctacaaatctgtagtctgctgctcttctctcttattatttatctcattaaaatatatttatagctggctaatagcctgctattgtacctgctcttagtgaagaagctttggctgagagatccaaaacattggagtgtatgagattggctttgtttgctaaagataattgaggtatgtttttaatatattgttggcaaacaaattgtgttgtgatagtaccattcaaatctgaacaagtgttaattttgtcaattgtgtgaactcattttatttttctagtgcttgtttgaacacaattaattatgttaactcattttttatactgcatgttgaacacaattaattttgtgaacctattttctttttatactacaactgaatactatcaattgtgtgaatgcatcctctttttgtactgcatttgaccactatctattgtgtggacccattttatttttctagttcttgtttgaacacaactaattatgtgaactcatttttttatactgcatgttgaacacaattaattttgtgaacccattttccttttatactacaactgaatactatcaattgtgtgaatgcatcttctttttatactgcatctgaccactatctattgtgtgaacccattttttctactgcaactgaacaccattaattgtgtgaacccatttgactaccctgacatatttatgtgtgtgtatatatatcctctagctcacacattctccccctcctctgccttccacattctttcttccctctttactcttccatcttctctcatccttaacaccatgtcgaaccaatctgatggtgattcccctacacatgatgattctcttgatgaggtgagcagcatagatccaatggatctgtacccattggatgagatcagcaacatattgggtgatcttgctgatcatgtggtagccgaattgaagtccgaagttgaagctctacaagatatgagacctactaggcagagtggtccgaggaggtatgttgataggccttatgaagaatctaaacatgggctattgaaagattactttgtacagaatccagtctataatgatacaaccttccggagaagattcaggatgaaaaagcacctcttcttacgcattgttgaagccctaggccagtgggataaatatttcacactgagaatggatgctcttaaccgcccagggttatctccacttaagaaatgcacatcggctatttgccaattgggaaatggtagccctgcagatcagcttgatgagtatctaaatattggagatagtactacagtggagtgcttgaagatgtttgtgaagggtgtgattgaggtattcggtgcagagtatttgcgacgccccatggtgcaagatgttgaacgcttagtgcagattggtgagcgtcgtggtttcccgggcatgttagggagcattgactgcatgcactggcattgggagaaatgccctgttgcatggaaggaaatgtatacccgtggtaatcaaggtgttcctacggtcattctagaagcagtagcttcacatgatcgttggatatggcatgccttttttggtgttgctggatccaacaatgatattaacgtccttaatcaatcaccattgttcgtccagcaactaagaggggaaggtcctcaggtgcagtaccatgtcaatggaaggcaatacaacacaggttattaccttgcagatggcatatacccagaatgggctgtctttgttaagtcaatacgtcatccacaatctgaaaagcacaagttgtttgcaaaacatcaagaagggaaatggaaggatgttgaatgtgcttttggtattttacaatctcgctttagtattttgaaacgacctgcacgtctatatgatcaaggggatcttgagaatatcatgctagcttgtattatccttcacaacatggtaatcgaagatgagaaagacatcgagcagcttcctcttgatttgaatgagacaccaagcacattaactgtataagaagctacaatctcacaaggacctaacccagagatggaagaagtgatacaaagaaatgctattattcgtgatcgtattactcataagcaacttcaatcagacttgattgagcatatctagcaaaactttaggaattcaaactaattaggtgattgttaatcatttaaagtctaatttacaatttgcgtgttgctaataactagtatgtttcattttaagttgcaatctctgttacattttagcctagcagtaccagtttagctaattatgttctcacttatttttcttgatgtaaagcttctgcattattttgatattgacttgccaactattttctttttatagatcaagtcctgctattttggtgctgttgtgctgctggtggaaatgctatggatcaagttcggtatgctgtcgaagcgtgtggcagacttatggttacatatgtttttttggtttggtgttgcagtgcatctagaagaactgctcatgtcataagagactaatttgagtccaactattttggctgccagtttgggtcctaccatttggctacctatatgttttttttcctttttattgtactgagatggatgaacttgaaaattcgctactactttatgctcatatatgcactgatatctgctagtttctactcatataatgtgatttgcactaatatatgttcatgttttgatatttggcactacagtactatgtagattggcgttcatatttggacgtatgcattgatgtgtgtcacagttgatccttctccatttacaggacatgcaaatagctattaaattttcttctcttagaaactgctatagacactgtgcattggggaggtagtgtctacaaatgcatttattattgtttctctcttctagacactacctatagacaccatggattgggagtgcactcagaccgtacgtcaagagcaataaatatagaaaagccgtgctataaaaccgtttcgtactttctcattgcttcggtcaaggagccgtttctcacggcatttaacgcataaaatccgtattagtgaagatgtgcacatttcgatcgtgcagctagctagctagcacgcaaattttgtggcacgaccgtgtgccacgccacgacggctactcgcgtcgaccattattcgtaaaatctcagttggttcgttttccacgcgaggattgtaattaactttggatgacgcccatggatatatcgagcgatagacccacacaacacgcgtcgatgatgagcaaccaagcggtggccgatggatcgatatatccaccgccggaattgaccgaaattccgtgggcgcgccggcaattttccagccagcgagaccacggatcacgtggccggcaagtttaagcttgatcatcccctaagattatttttaggatcttctaaaaaataattattctccctaactagtcgtgtctctctgtttatttgtatgaagaataaatagacataatttaatacgctgcatgtaaccacggccaagattaatttatattagtgtaacctcgtgcaatatttaaagcttgatgcaattcacggggcacgagcgacgtagcatcttaaccgatgaggattaatttcagaattataaaggttttattgtctttggcctttacattctttgcttaggtgatgatcaaatcaggataaagggagtagtaggctatgttcggatgtatggttcctaactttaattccttgttttccacgcgcacatttttatactcggtgcatttttataagaaaaaaatataggaaagttaattttaaaaaaatcatatgaatccatctttcaagttatctttagctctgcgccatgaacacaatagatccaacctagtgctcgctgcatttggcctcggaggcaatggtagctcaagcgtcggatctggcttcctctacttcctcggctagttggatcctattgaagctcaatggtggtggcaacagatgctttgcgtcgtgatcacaacctccctaacgcggtttcgacctttgctcatgtgcatcattgtccttcgtcctaacaatccgtgacaagattcgtgtattctcgtgagggcttgcgcaccctagcaagggcataacccacgcttatgtggacgggaatcttcgagctgacgaggtgaggccaaccactatctcaccacactgtaaatggcctaagtatagattttaacaatgtgtagccatggaattagaaaatgaactacactatataaagctgacaaaagcaattctttcagagtctcatatgttagctactccctccatctcaaaatataagcatttttagtttagtgacaagtcaaacattatcaactttgactattaatagaaaaaaataaaaaagattaatcatataaaattgatgttactagatttatcattaaacaaactatcataatatgtaatttttttattttaaacatcttactt

SEQ ID NO: 60096 - DNA, 1379 bp, Oryza sativa
aaacaaggaagctttgctcagatcaaaggaggcgagccctagacacatcacacaaaaagaaagaaaatggaacgaagcttgaagaacaaccagaagaaagaaggggaccaagtaaaggacattgattgatttcccaatccatgatttcacaaatatttcttcctctctgatttggccccaaactgatctgttggctaaaaatagcgaaaaaaaatgtcagatggcaaattgcaaggccaacaaattccgcaacataatcaggaatttcgctatgggtgttcacatatataggtagctagaccagtgtgtgctttggagtattcagaaatcacgaaaagtttgtgttgtactgctcaaaaccttcccagtactaataatttgaaaagatttactcattacaaagactagtacatgtggttcagtgtggctttttcttccctctatcaatcatttggagtctccccataggcgagaacccatacctgaacaaacatacttagagcaagtataataatacttagagcaagtataatagtagactataaaccggctaaatgctgagttggaggagagaagagagtagagagaggagaagcggcctgtaaacttacagtcggcttgtggcttggacacaagaaccaaggcttgtggcttggacacaagaaccaagaaacactgtgagtgagacaagtgggccttgtattaattgtaaatagctgactattatatgggtagagtgagagaatgctaaaaaaaccttatagccaacaggtcggatgtattattagccttgctcttaggtaactgtttctccagaaattgaggtactcaatcactattttgaaaacagagatcatagagagggtacttaatcacttcaacttaattcatgccataagccactaaataccaaattattttcagattctttagaataaaagcgaggtagccgcagctggttccatcttcttcggtttccatagctgccttagatacatgcctttttctcattttgcccctgcataagcacaaaaaagtcatagaagaagaaataaatccatagaggttaagcgaaaacaacattcagtattgcgctttttaatgaaagccgggcgtttaattacgcctttcctccaaaaaacaacattcagtaaaatttcagatcatatacacacatgtgaaattattttctaaaaaaaaagctaacagaactagcatttaatgcacactattcatagcttcaaaaaaaaaagttgctgatgagtttttgtgcatttgaaatataacagaccacaattagtatttatgtaatataaaatacttgctgaaatttactaagaaaactaaccttatagttgctgaaatttgctaagaaaact

SEQ ID NO: 60097 - DNA, 759 bp, Oryza sativa
tgaattaatggggggtagctttgaatttccgattacgacggttcttgcatctagaactggtcttatccagcaatcagggactcatgacagtaatgttgcaataataattagtatcctacttagttaatttatttggaagaccaattaagcagaaatggacggaagaaattcaaaccttcaactcggcgacggcgagcaatttaggaataccaggaaagttttcatcagtttaattattttatatgcagatggatgaacttactctgaaacctgattttctgaaagggaaacagacaaaacagaagattaagaacgtacatatgtccagaaagcacacacattaaactactttgtgcatttgtcggtgtcgcttcgcaccgattagaccggagttcatcaatccgcaattatccgtgctcttactcctcctgcttatctagaaccaaaatccagaagcagcatttgtccgaaattcaaacccactcattacagtgtgtgaacctttagcatttggggtcatagttctattaaaccgtaccgtgtctcccgggtatatcgcagagatagaacattctattggtaatttggtatgcaaccagtcacagtaaaaaacaacggaagaaatgataataatcaaaggttacacgctgaattttcatgctaatcaacgtccaaaaggttgtgctttttctcagggaaaaaagttaccagtatacttttactcttcgactcgcggcccatggcctaaactgcttcgcg

SEQ ID NO: 60098 - DNA, 1234 bp, Oryza sativa
gcccctcccaatttccaataataacccctccatccgatatggcatttatttagcctagtgtttttcaaaaaaggtaaaagggttaagatattgagcactggacctttcaaacgactaatggtgagattaattagagccaatgactatatcctactcaaacagttatcatcgaagaaatatcgatagtataaacagagatttaaaaccttggtctaacccctctaataaccagcatcaaaaagtcacaaaaaagtcatacgaagaggagcggcaaagcataatccctctatttttaatagatgacgcattgacatttagatacatatttgaccatttgttttatttaaaattttatgcaaatgtatgacataaaaagtgcttaaatacttttagtgataaaataactcatagcaaaataaataataattacatatttttttcaaataaaacgaatagtcaaacatacctaaaagttaacgatatcatcaaatgaaaaacggaggtactgtatacgtacacacctcggtttcacgaaccatggtcaccgtgctgctcctgagcttggtcggcctaagcgcctcgaagcagacggcgatctgctccgacctcgtggccacgtcgacgtcgtacatgacccctctcccaaacatgggcaccgtcatcctgtacgtgccgccctggtggacctccgactccggccgcgagtagaagccgccctgcacctccggcccgacgaggaaggtcgccttcaccaccccgaggaagctcaccgtgaagacgctccccagcttcacgtacagctcgtcggccacagccatggggcccctggtgatcaccggaattatcagggaaacgccgctcaccaccggcgggagtggcagctccgcctccgccgccgccgccgccgctgcagccgcaccgccgtttctcttccccgtcatcttcgccaccacggcgatggtgctggccgccagaaggacggcggctatggcggagaaccagacggcagcggctgcggccatgtccataccaacacgtacgtatgtacaggcagagcctgtaataacaaggcgcggaggacgtaccggaaggaacgccaaaaattgtaagatttaaatcgtatatatatatatatcttttaaaaaacgaggcgacggacatgtacacggtacaatacaccacacgccaaggctcatcacgcatttcattacgtacgtgaccgttctaccacgga

SEQ ID NO: 60099 - DNA, 658 bp, Oryza sativa
ccctaagccggaatttcttcgtcttgccggcatcggatgcagattaggtcaggtagcatcggacaagcctctgttgcagttgaagctaacccggcttgactcccaccttttgcctggtagcactgaactaccatttcttttgtagttgttgccatgttggcatattcatgccatattatcctatttgtgatttctgacaacatcttgtggattcgggtcaattatatttgattatatttaatatattgcgttgctattttccagttgatagtctgatattgtgcacttgtatacccttctggaacttctggttttcggattcactggtcacattttaaggaccaatatgaactgtatattgtagacagtacaagtacaagccaatatatgaagtaaatacgcaccacattgtgtaaaatgttgattttattaggttttaataaaggtggtagttgaaatgggtctacagcttatcgaaaaaaaattgggtcaaataaatatcatcgtgaactcatgatacattgaagaaagcttgtattgctgctgctatctagttagatgttagccagaacatatatcggcagtgagacagtttttgtgtaggttgtacttgtctttgattctcagtaagtttgtaattcagagctttgaattctga

SEQ ID NO: 60100 - DNA, 724 bp, Oryza sativa
cggccgggttgccaggaagtttcgggccaatggccgtgcagaagacatgaccggaagttccgggcataatgccaggaggttccagccagatggtctttactatgattcatatgtaatttccaaaaattcagagggcaaagtggttgcttattttaatgtgaatacaatgatgagtaccgcacttgtgtgtgggtgccaaaggctttggtaactaacatcaagggacccaaacttagacaggtttgggttcctaaatcccaagcttgatttcttttgtaggcatactcctccggtggttcaagttgggttgtggacagtggttgcaccaatcatatgactggagagaggagtatgtttacaagtcttgataaggagaacggaactcgtgagaatattgtgtttggagatgatggtaaaggaaaggtaattggtctaggtaaaattgccatctccaataatcaatctctctctaatattcttcttgtcaattcattaagctacaatttattatctgtttctcaattatgtaagttgggttacaattgcttgtttaccgatgaggatgtgaccgtctttaaaagggatgactcctccgtaccattcaaaggcaagttaaagggtgatctctatcttgtcgattccaatgtgaatagagtgaatccggaaacttgtttgatggctaaatcctccatgggtggcctatggcatcgaaaactaccccatg

SEQ ID NO: 60101 - DNA, 3940 bp, Oryza sativa
tttaaacatagtgctatgctgcatggccggtgccacattggtcaacaaagatggagctcatagaaagagggttgggagaggagaggtgattgatttgtgctttctcacttacttagggggtgtttaaatgtaggggtgtaaagttttggcgtatcgcataggatattatatagggtatcgcatggggtgttcgggcactaacaaaaaatctaattgcaaaatacgttagtaaaccacaagacaaatttattaagcctaattaatctatcatcagcaaatgtttaatgtagcaccacaataacaaatcatggagcaactaggattaaaagatttgtctcgcaagttagtcgcaatctgtataattagttattttttagcctatatttaatagtgttcaaatgcttgatgtgatagggtgtaaagttttaagatgggatttaaacagggccatgtccatcaacattggcttcttttttaaatttgcatagatactagtcatttcaaaatgttactaagtacaaccttgggatgagatttgatccatctaactagattcgttgttagaataagttaaattctattctactactagattacaatattttagacagatgcagtaacttcccactcacaatacggatttcgtcaccagacatcagtaaaggagaaattcattccagtcatgacgtgtcagctcgtagaaattatagtatactctctccgtcccataatataaaagattttgggtggatataatacattctattacaatgaatctggtcacatccatctaaaatcctttatattatcatactaatccataaagcgaacttggcaaccttgtgttaattaagctgaaaattttattgacagaaacaacgcaaagacaatgttcgagccgcttagactgttctggccgtggaacccaacatgctgctcttttggcccattccaagcccacaggagaaaaaaaatgtccacttggacacgtgaaggaataaaccgtcaaccagtaaccacctgtctaatacctgtcacaaatcacaacccgtggacccaccatgagcaccggagtcatggacccaccatgagcaccggagtcggtctagctcgcttgtctacgtgcaccgagtccacgagcaccccacccacacccaccgacccaccccaccaacgcatcggcgcaacgccgtcgccgtcgccgtcgcggtctagaaaaagccgccgcgatctccgaccgtgtcgtgcgctcctgtccccctcctctccgacgagccgcctcgcccatggcgtcgcctccgtccgctccctcctcctccgccgccgcggccgcgcgtgccgctccccatcgcccgcgcttgcggtcgcggcgatctctccggccgccgccgcagccgcagccgcgggtgcttccctcttccgtcgcctgccgatcctccgctctccgggtgagttcccagatctcgcgggcgccttcgttccttctcctcctgctagggttccgcatcgggggaatagccgcctcgctgatgttcatcgaggctttagcacgtgtactattggcacgaaatgagtgttctcttctagtttttccccgtctgattatccatgtgttggcgagttgggatgctgcttgtgtgattcgtttcgatgctatttgatctcgtcgagacggttaggatgttgcctgttggagaaatcatccacagtatcaccttggatttctgagtggtgactttatgatggatgtttgtatataactaattgagtttgcgcgagaatgattcgtttgacaaaccaatgcgtgtgaaatggttaagctaaggcaatcgcattgtcatttaattatcctttcaggacttccaattcagaaatatctccacgagacccacaagcaggcgcgatgtccttccagttgcctctgcatttgatgaggtactgttttatttttctttagataacattgattcttatggagtttcttgatacattgattcttatggagtagcttaatttactattagcgttggtttttatgtaggatctgggtgatttctcgctggtgcacgctgatggggatgaccctttagaggttgttgtatattcaagtgagagcgactggagcgatgaggaggtcgtgttaaatccaacgagtgatgttgagttacctctaaagagcaagagccgctttgagggtgtagagggtgcgatgacagttgctgcccataggtttgccacgattgagaaagggcatagggacagcaggcaagataataatatcttctgataatacttaaaaactagagattcagcgtgtagatttgtagcatgcattatgatcttccaggattatctgtttatgttattcctggtaaatggcacttaaaagttatcaaactagtagtaagaaacacacgctttttacaagtgtttttgctaggttctgactgaagctctttacatcaattcccagaactcaacaagggctgatgaataatgttggactgattgctttcttagcaatattacttttgtttgtcgactggtgttcttggcggattgttagactacctctggactctttttacttgacacgtccttttttaatatcatcagttctatcagcattagctggatttgtttttgcaccagttgctgataacatgaagattcatcatttccggaggagagggaagcttatgtctccattctatagaaagccaacaccagcaatgggaggattgttctttgtacctattggcatttttgttgcaagaagacaggttggttcctcaactggagtgaatggagcagctattataaccctcatatttgcaatggttggatttcttgatgatatttcaaatcttgtcatggactgcaatcgtaaaataccgcattggatgagattatttgttcaggtgaatggtgctttttcaagagagatgataggatgctcttcccttatttttttgacgggagatgctcttcccttattatgttgaaagcaacttacagttcttttgcagattgttgctgggatttacttatctatctggttaagttctacaaatatttcaacaccatataacacgtaagcattacttcaacttatatatactgaaaaactaactgcagtttgaattaatgctttatcggttaggcaatgtggtaaattgcctttttttttttgatgaggagtaacctttcttaatggcctatatcaaagtattatcatgatgcagtacaatgtacaattcagttaataaggtgcacaacattatttctgcctccctgtactcacaggaacactgcacagatacttcgtgccttacattacttccaaatgtactgatttaacatctattttcaactcatgctagtagctagtcactagtgatcgtgttcacatgttaatttagaggcaagggtgctttgctaaccacttctgattttcatttcctatttagtgcaccaagctagtcatgtggccttaaattccataaccagcattgatgtggccttaaattccataaccaacattgatgtggtcttaaactccataaccagcattctgtaacaaaaagatacatgtcactaccgttgtcatagttctatagctttgccattttgactaatactttaggatgtttttgacttttttcacttgtcagctttactaattcgaatttgttcatgaaggaaattccttgttcctcttcctcctcctcttggccttgcattcataggaaaaatctatctcgttttggctgcaatatgttctctttccatgggcactggagttacattggttgatcatcttgatggcttggctggtggcgtcgctgctttagcacttgctggattgtctgttgcttccctcccaatttgttcaggtaatttgccattctggcttgttgagctaatctcaaatatactt

SEQ ID NO: 60102 - DNA, 16794 bp, Oryza sativa
gaaaaatccaggttcgagcagttcgtcaccgagaggctcgtgacgaaggtgctcgagatcggagagcgcttatggccggagggcgccggagtacgaaataccaaggatgaggagaaggaggtcgtccccgcgaaggcggtggcggaggccgtgacgaagttcatggagccaggaggggcagggagggcgcgagatgcgccatcaaggagctcgccgtgaaggctaatgccgccgtagcagaagccggctcatcgcaccgtgatctgctccgccttatcgatgatctcatgcaagccaagtaatggtaatgcttgtaagataaaccagctctgttttaaaatatttgttgctctaaatttgttgtaagttaattggccatcaatttctatgaactcatacagtttactatcataagattaatatttttaaattcaccataagaaatgctttcataatatataatttacatttacatgccgttgaactatataattttttcaaaattaatggttaaaaatagacatgtttgactttagacagatctaaaatagcaagtaatttgaaatggaaagagtaacctttttgttctatttgatgcattgagctcctgagtttatcagatttatgtttaaaagacgagctgttttacttttacctcaagttacagctcactgcaacatctactgatcaattcgctcagatgcagcctgaaccacttcccaaactgtagcagttcactgaaacataggctatgtttagttcgtactaaaattgaaagtttggttaaaattaaaacgatttgatggaaaaagtgaaagttaatgtgtagaaaagttttgatgtgatggaaaagttggaagtttgaaaaaaaaaatttgtaactaaacacggccatgctgatgaattcactgcaacactgacctctaagaaagatcattgcttctcctctcttccagtcgcattggaacgcccaggagaaatctaaccaacttggctgtgttcgttataggaggttgggaaacgaaacggttcattagcacgtgattaattaagtattacctatttttttaaaagaatggattaatctgatttttttaaagcaactttcgtatagagtttttttttttaaaaaaaaaacgcatcgtttagcaatttaaaaagggtgcgcgtgaaaaatgagggagaagggttgggaacaatctcatacgaacgcagccttaggtcaccggtgaattggtcgccatgagattgtacagcactaaatacctggatatgagaactttcactgtacaatatacttgtggtatatactgttagtataaacgatctatacttgtgatatatactgttagtataaacgatctaacggtgtatattgatttaattttccacctaaaatatatgctagtataaaatttacaagggtttccctagaaaaagtaaaacttacaagggtcaggaattaatttagataaaaaagtttcggtacccgcatcgagttgtatgaatgtgtttacctagctaggaatgttcagaacgtgtaaggcatttcacgcacatctgttatgttacaccttacattacgtgatcggtaattggtcacttgtaatcaaagtatgtaaaattttaatgatgattaaggaattgtgccaccgcaacacgcaccatcatctctcacaggcgtacaaatgaaatccagcagcgatgccggcagcctgacatgtgaacgagtcccaattagaccggaataactcttaaccacagaattcaattttctataaaacttctaatttacccatctatatactagcactacaatgtaaaagttctccagtaaaatatgcacaaacatatcatggaaattacaataatcgtttttttgaaaaaaaaagttaaaaaggatcaatgaagttctccgtctgcttggcgccttttttccgcatactttacggcaacatctctgttcctctgttctcattcaagataataaaagttagtgcagaacttccccaacagaaaaatgcatgtgcagctaaaatcagaaaacaaaaaatgaaatgaccaagtgcattttttgccaaaaaaaacacaatttgtgataaagactacttgttaatacacaattctccaggtagtttttttattttggaaagaacactaattactgtgcaaataattaccgagataactagatactacaaattacaaagagtaatgactgaggaagaaggtattagttgcttcatgaatggcaaatgcagcagctaatcacttactggaaatcgaatgactacttgaaaattgaatgagcaattgggacagttctaaagtagagagttagggaattacctgctttatagcgttgagagacacatctggatcattactaatgaacctcccatgagcattccgctgagcaatgtacaggttccagtcgaactcgcgacggagatccatgcgcctgaagtgttcatccgtccagcccgcgtatctcgtacgaccaaaagggaggccctttgcgtcttcggtctcatcgagctgctccgcagcttcgttcaaaatactgagataaacacgccagttaattttgccatctttgaacaggtacccgcatcctcctcagcatcaccagctgctggcactgctgctacagtacacatgaacaacattaggtcacaagaaacaggaatcccatccgaggcgactccaaattcatcatacctgaatccgaatcctctgtgttcttgtcgagatgcagaactgcgaccaaccctgccaacgcaccactgtagaatactcgcctccccgtcgccgccgccgccgcctgaatagagagccccagccagggctccgcctgcgcctgcgcgcgtggcgagagcctccgggtgaggagcgaaccgagggtccggagggccatggccgccggccggagtgcgcgccttcttcctccgacgactcgaattcctcttcgccctctcctccgccgccgccgcgcgcctcgattcgatttcttagtggttcatgggcttgattgatgggtttcgcttccgatttccgattgacacggctttggagaggcgttggggggccaaaatataggataggagtccggtttgcctccctcaagtgtagctgcagtctgattcgaataactaaaccctcaactgtagtcacagtctgattcgtatccttaactgtaataaaaactgtaatctcttcttttataaaaattaaaggtgtttccgtgttccatcatccgtgtttgagtcgattataaaaattgaagatgtttatgtggtttgttatccgtgtttgagtcggttttaattttatgttttggttttaatctatatctcttctttactattatagaaattaaagatatttttgccagtattttggtacgtcatccgcgtatgagtcagttttaagttcgtttgcttttggaaatacatatccgtatttgagacggtttttaagatcgttcacttttggtaatacataaggaatcatataagaaatctgtttaaaaaaggataatcgaactcctaactgcagcttatgattttctaaaaatatatatatccaagcgaactcccacagtgaatttcatcttaactaaaccatataataataataagattaaaataaacttcacctgttgcaatgcacgggcattttttctagtaaaataatataataaagcttcctttaactattaaaaccgagttaatttaaccttccgtaagggtttcccatcattctgagcctgcacattttgccacccatttatagggaaaattggagccatgccattataattttgcaaaatttaagatatgccatcctgacccacatgtcattgactcatgtgggtcctacatgtcattgagataccgatgacatatctcaaactttacaaaattataatggcatggttctaatttaccttttttatatcacatgaatgcatgaactcaaaatcattgcagttcactgcaacatctacggacgaattcactgcaacactgacatagagaaagatcagttttaggctcaggtattacaaattttggccttcagatcaaagccaaacaactacgtgtcagtgtacataattttggcctgtggacaaagctcgtgaattgtcaatttttgtgtttaaaccacgaactgttttacgaattaaatttgaaaatacattgttcattcatttttttcttaggaatattcgggatgcaaaatcttttgcagaaatataccgtctatctcgcataaccgttgcgcgaaaatgacgtgggaataacgttgcggacggtatcactaagtgaaaacgcgagaccgcgcggcctcacggaatggaagagcgatcaagcaatcaacgataccggtgccatgcggtctcgctcaagcaatcaacgataatccgtaatccagataattaatcactaattattattattagttaattgttaatgaagtaattaataactaatcaaatggagtcgttggacaatggactgtcgctgattgcttgagccggtctcgctcttccatttcgcgaggccgcgcatggtctcgcgctttcaccgcgtgataccgtccgcgatgtcattcccacgtcattttcgcgtaatagttgtgcgagacagacggtatagttctgaaaaaaaatttgtatcccgaatattcctgataaaaaattgaatgaacaatatattttcaaatttaattcacatggaagcatatgaactcatcaaactcgttatggttcactgcaaacttctactggcgaattcgctcatatgcagtctgaacgaattctcgaaatcgtaaaattacatgaaaacatctgctactgtcgaattcattcagaaaagaaaaaaaaatctagtactgatgaattcactgcaacaatggcctcgagaaagatcattgcttcttctccttccttcctccggtgacattggacacgagcccccggaggaatcttgccgacttggtcaccggcgagtttgcggccatgacgttgtacagcatggtctccacctcgccgatcgtcggccgccgcttcagccgcgacaccaccttgaactgctccgacgccggcgcggcggcgtcgtcctccaccatgagcacccagctctcgccgccgaacctgccgccgtcgacgcaccggagcagcacacccttcttcttgctcagaaggcccctcacctccagccccgtgaaggagtacaccacgctgaaggagcccacgaatcccctcgcgccgccggcgaacccctcctcctcctcgtcgaagctccacgccgggttgaacatgaccaccggcttggtgtccagcgcgtcggcggcggccttcatcttctccacctgcgaccgcccgggcgccaggaacacggcggcgtcgcagctgctcagcgcgtcgggcgccaccgcgtcgagctgcgcgtgcgccgtggattccccccaatcatggggctcccgtagagccacacccatctcctcggaggacggccacacgagcagcagcctcgccggcgcgccgccgccgccgcccttcctcgacaagccgaggcccgacgagaacacgtcggaggcgaggcgcgcgagggagcccggcgagtcgtcgacgactggtatctcggcgcggaaccgcggctgccgctgctgcttcctctgcttgccgagcggcttgcgcagcgcggcggcgaggcaggacctcgcctgggacacggcctcctccctcgacgacggcggcgagggggccgcgcccgcctgcgtggacgacgaggagcggacgggtcgcggcggctgctgctcgcggaggagcagcgagagatggagaagagatcgctgccgctgcggtggcgcgaactgccgagatggtggcgggaacgacggtttgggcgcgagtttggagggaggagtgttcaggaagctcaaggccattggcgccagaagcttcgctgccgggaggagaagataaggtggctgcttgcttttgacatatcaactgctctagtatcagtatgtctcattggccataatttcttcagagattcagtgctcaagctagcctttttttttttttcacttagatgtgattacaaagatggttatgactaactgacagcatgctatgcttaacctttgtattgaggcagactttcaacatcacaaaatgggcaacgaattccatcattagtcactgaacttcagccaacaatgaacagtcagtgtgaagaatacacatattgaagtgcttcatcaaatgagcacaccgaggattatatatgtcgagaatgcttgtacccacacaaactacaataattacaaacaaataatttcatattctcagtgtcattggactgtcgagcatgagttagcgtaagcaaagcattaagctgaaccaggaatgctgaatttgcaggttttgaaccatgataaaaagttattcggttcccagactctcaactcaggctgtgtttagatccaaagtttggatccaaacttcagtccttttccatcacatcaacctgtcatacacacacaacttttcagtcacatcatctccaatttcaacaaaaatccaaactttgcgctgaactaaacacagcctcagatgaatatttcaggaacagaacttgtcaaggattccagggttgggtcatgagaagcagcgtttccttgcataggcagaaagtggtatgtacaaaatcatgcgaaacattataggaactattcaagtcaaattacaggtcatgcctcaaacaatgaggtagatattcatgttcttaatattcaaattcaagcattgttcactagaggttcagattccaatttgttcagattccaatttggtaatcgatttacggttgccatgcaacctgtggccctacagtagatgttcattcagtgaggtatcttcagaaaacattcatgccatcagccatgtcaacaactcaacataagaaacatgaggctgttcagaatcccactcctaggggagtaaccacaagagtaaaacaagttacagttaagaattgtgatggccagtttcataattcaacaaggcaacttcactcaacaaatcatctaagcaggtaatagctcacctcgttttgtgtatcttctcaatcttctcaatccccttctcctcaaactcaccctaagtgaccaaacccgacagcatggacaaatgaaccctcagaaagccagaatcaggtgcactaattgatccattggttggggattagaacatcatcttattgctagtcagatattcggatgacaaagaaacaacttagtatttttaacatgtgctacaatttagttcccaggggcggaaattcagaaaggttgcaggaagagacaccagcacgacatataacagaatatatgtgatcaacgactcaacgaggaaattggtggttaaatgcagggctatgtgatcaacgaggaaattcgtggttaaatcgagggctatgtgatcaacgtttgatttctttccttctgaatgaataaattgtataacattcacttcctacataaattgagttttctgaaattaggccaacattacccacgaattccagtgttgtggacctgctagtaaactgcaagcttctataatcctagcgagcacacaaattcgaaagctttcgttggtgtcaagtgaactcatctacagcagaatacaaaatcaaacatgatagctcaaatcttatcaagatactcatcaacaactcaagttttatttcaagataacgcctgggtagctgatacaggtatgcagacgaaagatcacacctatattactcataatatataaaacctggtacagctcaagatgcccaggtgccggagcatgtgggatgctcagaagacgatgcggaactgcggcgcgccctcgccggcggccgggacgagctcccagcggcagggctcgaggtcgtcggacacggggcagtaccccgcgagcgtcacggcggcgccggactccgccgccgacccgaactcgaagacagtcgcgtccgccttccgctgccgccgcagcacctccaccgccccctgagtgcccccggccgccgagacttccgccacacccgcgccacccgttcccttcgccggctcgggcaagccgccgccgccccgccgccaccacgagaagagccccatctggattagggaaatattagggtttttggactttttggtgggcgaaaaaaaaatctgaaagaagaagagatcgtggagatatcactacccagtgggccccacatgtcagcctctccacaagtttttaactaaagctatatgggcttgtgagttgtgatgcgatgggcttctgggcagcccagtaggaagaagcggcccacggagattagtcgtcgtcgtcgtcgtctccctcgcatggcaaatgcagtggaaatctccagaaaaaggaaaaaaaggcgggaatcacatcgtctactacctccaaacggaatcacacctctcatcctctgctttccgcaaaagccatcaccaccaccaccaccgcctcttcttcctcctcctccgcgtacaagaacctctccccgcgtgcgcccagcacacacacctgcgcctcatctagacaggcagtcgatcgatcagtcagtcgccatcaatgccgccgcggcgggggatcgaggtccggcaggcggtcggcgacggagcagcgccgaggtggcgcatgtcgctgctggagaacacgttcagctcgttcctgcagtcgatcggcggcggcgtggcggcggacggggcggcggcgagggccgtgttcggggaggggtcgctgttcagccccttcctgttcggcaagttcttcgacccggccgacgccttcccgctgtgggagttcgagccggaggtgctgctcgccgcgctccgccgcggggccaggaccaccgtcgactgggccgagacggactccgagtactacctcagagctgacataccaggtaaattcaccatctcgagtactggctttgattaatttctctcctgtttttctccatttctgcgtagttaaggtccatatctgctttctgtttgtgcatattgtgattagttctcatcactaatcttgttagtaaaaattaatgagtatagcatgttttagtttgtgtatgctcttccttagttcatagattatcttctttagcatgttttagcacgttctgaagggaaaaaaaactgagttaaccttacacatttgtcagagattatcttgcttgtgcgcaatccaatcttcaggttaactggcaggaacagctgagcctgataaatgtttgtactttgtactagtgttgctggatcaattttctgaaacagaagttcttgcaaagagtgcaccaaattaattcacatgccgtattgctatcagcaagaacttcagaatcagattcagatgccacggagacagggagttttttcaacttcctgtaggaaaccaaacagttgacatttgctagaagtagccgggttataccagaggataaaacttgcaacatgaaagtaactagggtcatgtggtttccccctttttcttcctgcgcttttctctgctttttcactacagtaacattgcgatctcgctgtctctgaatttacatattctttgcgtctggttgcggtgcaccatccaccatggtccaaaaaaaagcagacatttttttaatcagatgaggaagagaaaaaagcagtcatggcgtgtgccggacgattacgaaaccctaaaaagaacctaatcgctttcacattattgtagtgaaactagtgatcgagttaatcaagaagcaactgctgagagactagccaactgatttttgttcaggtgggaggaaatgcgacgtggaggtgagcggcgacgacgccatgagggtggtcgacgtcagcgggctgtggcgggcggcgccgccgccgcctccgccggacggccgggactggcgcgccgggcggtggtgggagcacggcttcgtccggcgcgtcgagctgccggaggacgcggactggaggaaagtggaggccttcttcgacgacggcgaggggttgctcgagatcaaggtgcccaagtccggcgacgcccaccaagcggcggccgccaccgcctgagaatcctaacctcgccggcgtcgccgcgcgattggagagagcaaattattcttcttctgagttctgacagtgacggtgaagatggcacaaaacttgataagaatttctcaaagatatggagggaccaaaaagtgagcaaagatcatctcacacatgttgcatatgcattaacgtccaatccatgtgcctgcagatgatttgtactagtactaatgtgttagcttaccgttaaaaatggatcattaattagcatcgtgcatatgcatcagcatcacagtcacagcatcgctgtcgaattggtcgacgataaattgggtcatcgagatcataaattcgattccggaatacatgaacatatatacatatctaggtcgctgctttgagaaagttggattcttccattttctttcggccatgatgtctcgctatcaccccgttcttttttctctcccagtgcggcaagatgagaatcggaattgacgaaagcaagactgctttttcttcagatcttcaggtaattgtaccgcgtcgaaactttgattggcctgatggctgatggcactcatcattttggtcactggattgctttagatttttggtcactggattgatttagattttcagcaaataaataaaaaaaataaaaaagcattttttttcactctcagtgcgcacctggcagttgttcggtttttttgtatcactgtagcctgatgccctattaactgaattctcatgccactcgattagatgaacatgtcgacaagtgtcactaggaactccctgttctttccgattctttatcagcagcttttactggtgcatcatgtatggtatcctggagtaatctgtactggcaaatgacaagaaagtgcaacctgtgaagtatcagtacaggtggctcctataaaccggagctgaattccatgtccttttgctctgtttctccaacctaacgttcgtcaaaatcaatgagaaaaagacagagatacgacaaagcagggaaacaaacataccccaaattgtgtttcagtcacgctcagagatgctgaatcctgtggattttacccatctagaattggcctacatgctcgttgtgttcttggagagaccgcccctgggatagaaaattggggtgcagtcgtgcagagaatgacaggttcaggttatgtttattggggaatttcagcctgtatctgaactgacaaacaagagtctggccggctatggttgcttccgcagtcaccttctcacgggctaataatgcagataatattttggttcttgagaaaacaacgaggaatgccatattttttatgtaaaatttagtatcttactttaactaatcatctgagttatggaggtattgagagactaagaggccaaattctacactgaaaaatgtgatacataatacctcttcgaatacaataaagtcacgcaataatgtaactactagtctactacaaataatcatcgtgaaagtgaaacatatcagatacagttactaagctgactgatacaaacatgaacaagaactgtctgaattgagcttctcctttgagctttttggtcaaatgatttggggactccctttgtagtttgatcaggccagtatcaagaagccacgtattttactccctctgttttcctagatagtacttcctccgtatcatattataagactttttagcattgctcacattcatatatatgttaatgaatctagacaaacatctatatgaatgtgggcaatgctagaaagtcttataacctgaaatagaggtagtagataatttgttaccattgatcatcactttttcaattttgaccagtacaataattattgttatatggttagtctatgatgaatgaaagtttaatacctatacactttgataatttggtatcttttaaagtacttattcttttttttggaaaaaaaagaagaaaaattgtcaaagttgaaatgtgaatagtaccttgtactctctcctcgagacttcataatatcccaaacgtatctaccataatattagcacaccaaatctcatactagtatataatcaaagcacaatcagacaaggatgttgtggatgacatcacaattgtcttttaccccatggaaagagtccaaagggatatcctatttttctacaaggaaatgaaaagaggatctttcacagtggtcctataagtagggaccatgtcattccaacaagcaaaccaaaacagccttgcaagcttctcaatccacttcactaatcactaaccttgcaaattttcacaactccaaagagcaaaactaaattgtacgaggtagcaaagcaacccaatccttcagcaaaaaatgatcctaacttgcccaatggacacttgacaagtgtcgcggatcgcagccatcggatgcaatttgattggctcttgatcagcctccggatcgtgtagcgcagtggtggctagcacgtaggtagcaacaaagccatggacatggagcatgagctcaggggcggcggcgtcggggcggcggcgcatgggcatggctccatctgcttctccggcgggccggtgctcgtcgacgggcgacgcatccagcagctgctcctccactgcgccgccgcgctcgagtccaacgacgtgacgctggcgcagcaggccatgtgggtgctcaacaacatcgcctcctcgcagggggaccccagccagcggctcacgtcgtggctgctccgcgcgctcgtcgcccgcgcgtgccgtctctgcgcggcggcgccggcgggcgccgccgtggagtttctggagagaggccgggcaccgccgtgggggagggccatgtcggtgacggagctcgccgactacgtcgacctcaccccgtggcaccggttcggcttcacggcgtccaacgccgccatcctccgcgccgtggccggcgcatccgccgtgcacgtcgtcgacctcagcgtcacgcactgcatgcagtggccgacgctcatcgacgtgctgtccaagcggcccggtggcgcgccggcgatccggatcaccgtgccgtccgtgcgccccgccgtcccgccgcttctcgccgtgtcgagctcggagctcggagcccggctcgccatcttcgccaagtccaaaggcgtgcagctggagttcaacgtcgtcgagagcgcgacgacgacgtctccgaagaagacgtcgacgacgctgtgccaagaactcgcgtccgtgctgtccgacccgccgtcgctggggctaagggacggcgaggcggtcgtcgtgaactgccagagctggctccggcacgtcgcgccggacacgagggacctcttcctcgacacggtccgggcgctgaacccctgcctgctcaccgtcaccgacgaggacgccgacctgggctccccgagcctcgcgtcgcgcatggcgggctgcttcgacttccactggatcctgctcgacgcgctcgacatgtcggcgcccaaggacagcccgcggcggctggagcaggaggcggccgtcgggcggaagatcgagagcgtcatcggcgaggaagacggcgccgagcgctcggagcccggcgcgaggctcgccgagaggatgagccggaaagggttcgccggcgtcgtgttcgacgaggaggcggcggcggaggtgcgacgattgctgagcgagcacgccacggggtggggcgtgaagcgggaagacgacatgctggtgctgacgtggaaggggcacgccgccgtgttcaccggcgcttggacgcccaactagttgagcctagcttagcaatctacagtatacatcaagtgattaaagcttaagctggtgttagactgtctattagctcagaagtgacaacggagaatcaactgaggaggaatttctggttggatttagtggatcgttttaaacttctacttccatgacaagatatttcagttgaattcttgatgttttactctcaatctagattgttttagatcaattataaacatgcacctcccccaaattaatatccgtgaattactgttggaatcgaaatattttctggtgagaatgatgattcagagggaaaaaaacggacgtgagtttggatgcttaattgggtttaggcccattatattgaagcctacactaaaattcacaacccaatccaattataattggcccaaaagttatacatcatgtaagattcataaggcccaataattattgggccgtgatgagcacgatccaattgctacccacaaggccacaaatccaatcccatggtcgccccaaccaccaccgctgcatcgccgccggcgatggaccggcgagtccagcggctggtcagcggcgtcgccgccgccgcggccaccgtctcgctcctgtacctcatctcccacgcctccacctcctgcttccccggcgccacgacgcttcccctcgcccgcttcccgcgaacctcctgcgacgccgcctcccgccgcgtcgtgccgccgggccgccgcctcgcgaagctccgcgcctccgcgcgctggcgccgccgctccgtggcactggcatcctcctccgcattcgcctcgctccgtggcctccgccttctagctggctcctcccgtgccctctgcctggccgccggcgccggccacgccgtcgacgcgctccgcgccgagggggtcggtgacgtcaccgggatcgacttcgtcgacttcccgccgctcgttcgccgcgctgacccccaccacctccccttctctgacggcgccttcgacctcatcttctccgacgaccccgcggggttctccggcgccctcttcccgtccaggttcgccgcggaagccgagcgcgccgtccgttctggaggcaccatcgcgctcgccgtcgatcggcacctcgatccgtcggccgtcgcggtgctcttcaagaggtcccgcattgtagaccagagggatctcaccatggatggatcacaggttaggatgctcatcttccagagtaatggcactaccttgaactcgcattaattcgtttatcattgattgatgccatgttatgctaattactgtttatgttcatgttgtaatgttagatgcgtgtataaaactaagctccgattatgtgtaaattaagcaaggaaaaatgtgacattatctaatgccagttgatgtgcatgaatactaccatggacccatgattttccttcagccatcacttttattttgctgctacaaaatactaaatcagcagctaccaaagctaccatttcatcataaaaaacatgtgctgaagcctgaaattgctacttaacagacgatactggaatgccctctaaataataacacaacccaaaagtttcatttttttccgatgtacttgttatgcgctgcaattaggataaacatcaataaacttaaccctgagtatgaagcttcttggagtttggccagtccattttcttcgctgcgactggtcacttgttgctacaagctgcttactacgatagttgattgagagacgttagtagttaattaagctatttgcatctggcgccactgccacactttggaaggagaaaagcatagtatctactataatactacttgaacacagtgaagaaaatggctcacatatgatatcttaagatcttgtgcaatcctttaatggcgtcactattaaacaggacaatttctgataggaaactaatcataaatcagtagatttccttgtatggagtaagcatttagttatctattcttctttcactaacttttggagagtggtaccctgctaagtgtttagattagcatcgaaatataggcataagcaatattgtcctcatttcagaaaacaatgcaggtcaatgttcaccaaggtgccaagccctaatcagaatgtgggattacataacagtgtctagctcctaatttgcgataggactaggatcattcacctagctgggatgcagatcagaatgtaggattacataacagtgtctcttgcttttcatctttccatgcattcttcattttgcatatttggaagaaattattttattagagtaaaggccagaaggccatgctttttctgaaagcgagtagttttgcagagttatgctggggttaccagctttacattcaacccagagcacacaaggcaaaaagaggagggcaaccaaaatgccagaaagcagggtagaaaaacagcttatatctaatcgaagcagaaaaaaccacaaccaactccagaacagtactccttaagcagtgaacagtctcttgcaacgctgctatcagggactccaaggaactgaagggaacaatctcacactgtctcagcgacaccttacactgcaacaaaagatgataagaaaaggaattgttaggggggttagaaccagcttgtgtctgaaaataatgccatttcacacaatccagagttgccaatacgctgcaagacgaagcataatcttaactctagaaagttgagatccagttctcccaatgtcaaggttaaaagaatcctgaaagctaatatagggatcatatcccaccccaaggcaacccgacaaacacaccaaatgaatgtgtctatagggcaagtaaatgaaatgtgatttgcatcctctaactggtcacagagttgacaaaatttagatctcacccaatttcttctctt

SEQ ID NO: 60103 - DNA, 11435 bp, Oryza sativa
catcacaaaaatgattttacatggttttcatttttattttttttagaaacacagtacaaacatcgtctcactatcaacaggtacgtcgcttaccactaaaataatagttagccgtaaatacgagcacacgtgtcaagtctaggacttgagctcgggtgggttggtttcaccacaaggaatctaaccagttaagttacactcaatttactttttgttttatttttataaacattgaattaggaaatataagaactgaaatgcatattgaaaactacgtagattggtatataaatgtgaacaaacattgagtattgcccactactttctccttgcgtcttaggtcctactaatatttaggaagctgtaaattaattctgataagtagtaagtgagaatttaaaatgttagattaatttttttgagtttattttttaactaaatctgtacccaacgttcttaaatatgagtgaaagtgatctaaattatttaggggttgttcagattgatgttgtttcaaatcatatcttttttaaagtaaagttatcaaatatgtgcatacatttttttccaaacttgcctaaacacatataaggaatcctgttaaaattcaataatattgtcaacttaacaaaattttgataatgccaaaattcggtaaatttcattttgattacaatctgatcagctccttagatagctaaaaattatggaagctctctaaacatgagctataatcatattcctacatgtttggaacacgggagacatgaggaatatctctatggaataagtgaaagctaacatgagaattgagattaatttgcatgagatgagtgcctgacacatccacacgtgcataagcttcatcagttccctggtcatcaggaatctgcacagtacgtatatatcctacttaattatgtgctccaccatgttatgagatctaaagattctctgagaaccgagcgttgctcggttggctagcttcgctggtgagcgagcagcccgcgcgggttcgatccctgggatcgtcacccgcgtgtctcaccgggatttattcccaaataaatttccagctctcccgtgccagcgccacaatagtagagtgacgtcctcgtcacacacaaggttcttaggtggctttgtgtatctcattagtacgtgtgtgtatagttgataggtctagcatgcgtgtaggggtgtgggtgtgtgtgcgtggtggagtgcgtttgcacgtatgttcagatactacagcttgtactcaaagtggagagctctcaaaaaaaaaaaatctaaagattctcttagagagagtataatagcagactaatagctagctataaatatattttagtaagataaaagatgagagagaagaacagcgggctacaaattcgtagtcagctatagcacggactacaagacgtaatgtgcatataataggtgggatcatatattaatagtatagtaagcaactattatataaattaactattagattggttataaatgaattagagttagtagtgggctatactattaaacttgctcttggagataactatgaaaattagcagatggattgccatggcagaggggatcgatcagtacgatcgatttgaaataataatgctcttgtcttcgctttacatgtcatatcggagcctcttcatcactttatagtactccgtacatattttttttgtaaggtgctagtatatgtgtaagcgattggtgcgtggtggggccatcgtgtttgtgcgattgtgggatcgatcgatctcacgatggatgggtacgggtgctcatgcaggctgtgatcggtcgcaatgattgaaatgatttgattgaaatgatttgctacgcttcggtgcagaaattattaagtaatttttatttattttttttgacaatcggctataagtaaaaggaaaaaataataaaatgtgagggtttattagtatttatcatcagacaagcaaatcattactcgcgatttaatgtggaacagattgataatatattgataagtgcatgttaaatactataaaaaatgatatatagatttgttaaaatattgtaaaaatgatgtgagggatgatgattagatatacttgcagattgatttgtagaattaaataagttatagatgatgttgtatgtttgtatgatattaaatatgcaattattgagtgtgtgatgatgtgccatggttgcaagttgagttttagaggttagtggacattaactttattaactttatagtaatataggattaaagcaaaactctcgtcgtccacagatcgcttttttttttcatcaaatccaaattacaatttgctcgttattcggtagcacatcttttaaactgttaaatagtatgcttttaaaaatcctatttacatagaagtttctttaaaaatttagattaactcacttttaaagtttgtaataattaaccactccatcctaaattataagacctatattttttatacgatccttgatgccatattttagttattaatttatttcatattatacttccaacgaatatgaaaaatacttgatataacacgtgtaatgcttagcatagatatggttagtatgattatcagttaaaaaataccgagtttaatttcctttaaaaagaggtgccatataatttgaaacgaagggagtaatacttgattatccatgtgcgaatgacttatcttactttatgtgccgttgaaaagctaaagtaagctaaattcaaatagccatatcaaaaaattaattctaaagttgattttttttttgaagtagtctatttttaaccttcttttaaattgatataatatacatatgtcaaagtttatactgtaaatcagctttagttgcttcgtttatttttttaacactttagtcgtcatagctctcaacataatcctatttatttttaaagtttatattcaattaagtgttgctaatattatttctctattatctattaagctacattagcttaattgttcctaacacttgataattaatctatggtccaaattaccctatcattttttctcttatgaagtcatatcatcttagctttgtatttagatgattaatttatattatctttcttcttttctttctcttattgagccaatcattttagttctaattttggacgatcaatctatatataatttaaattattataaactacattatcttaattatttataggccatgttcttttctctaacaaaagttggattaaattttggatactcgtggcatgcttttcaaactgctaaatggtgcgttccgtgcgaaaactttctatataaaagttattctaaaatatcagattaatctattttttaaatttgaaataattagaactcaattaatcacatgttattacaacctcgttttacgtgaaacacttaatcttcatattaatctttattttcatgacattcaaacaccaccatagtttttttaatagtcgatcaaagatgaaaattacataaagttatgttgtctagctctcttaaatattatttgtactattatatacaatttttttagcaacatgcgaggtttcatctgattaacctggaattagagcgataacgtattgtacctatctaggttaaagccatagtactgcagctggaacatcttctagaagcagagatcgatggagctagctagctgagcaacaagaggatctggatatgaatgtacgatgcaaccttgtcaccagctcagatgttgacccttgcatgggaaaggcgccaagaaaaaggacattgtagagtagtgattcagatgttgggagtgaataattaagtgcagcttaattagatcagataggacagtgatgagtggttgtgtgtcctcaaattaggcacttttgattagttagtatcactcaaatgtacatatgtaaagtctatgttagcttttagggcaccatgtgcaaatgcttggtcgtccttggccgatagatgtgaataataagtggtgaaaattacgtatatttttcgtttagtagggtatcaataagagattgttaaaccagtgcgatgttttaatattaacttactcatactattagattagactccgtcttatatatagatttactggaaaaatatccgtacgttgcaacgggtgaagaatattttaatcttattattgttatatggtttagttgagatgaaattcactgtgttaaactcacttggataaatagtttgttagaaaatcatgagctgtaattaggagtccaattgtctcaagttaatatgcgaggtttttgaaaagatttcttatacgattccttctatatttttaaaagcgaaagaacttaaaacccgtctcaaatatagattttgtatttctaaaagcgaacggatttaaaacccgactcatatacagataacgtagcaaaaacatcttcaatttttataatagtagagattattagcggctttgacatgtcactctgccttatcaacatgacttggtgactaactagctaggtggagtactatggtactatgccttgatacttcaattgtgtaataaagtttgctcgtctcacacatccatcagtccaaccagttaattcttatcgtcttgctatctctatcagttggtctttttttcctcacattcattttccattttctttgtacaagatgaaaaggaaactcgttgaaagaccccccacaagtagaatgtacaggaagatattaccttttccgtcttagaaaaaataacttttacctacgaatctaagttaaaagtgattttttttacagatacgcaaagaggccgagctatcctaataaccaggatttatcttttcgtttttgaagtaaatcgctcttcaccggttcacccaaaaccgataaacaccaacgactcacggtcaacaccttacgaaaatcggctaatatccaacggttcaataaagcattgtccaggtcaagtgatgccgtcctacgtggaaggattggaacgggtgagctggaaaagtgactaccaggtgggccccaccgatcctaaatccgtttctcatttttttactgcaagtaataactatccctcttttctttgtcccgtactggacggttgaaagtacatgaatgagaggcggtggtggggcccgcggctggtaaggtgggcccaccgacgacttgtccacccagcgggagagccgggcccaccggccggccgccgaacacccgcctgcctgcctgccccatgtgggctcgggcccaccaggtttttttcccttttctttttaagttttccccgtagtaatctatacaagctgttgtcattttcttccttaaaaatgtgatcctaatccaacgaatactcctaaaattatggagaaacttattggtttattatagcactatagttgaattcacttctccagtgttctaggtcaactgctaatctccaccgcggttcacaccctgcccaagttcacaattaccatggcaataataatataatatttttcaccatgagaaaatcaaagaataatgttttccccattttcaacctggtgtaattgattacgtacatggaaattttaggacaaaataagggcggtgcaacataagtagatacgcaaacgaacattaataatttaattagtcggcggtttttgttttccacttgtttagtgataaaggatgcgctgaaccgggagcgctaacgggaatcgagcgcccacctttttctccctttttcttctcttcatcatccaaaagccaagttgccaagttgcatatatccatgtcatttatagttttcaattctagctttggtgatagattagggtcaagtggtcgatttagttatcaaggaggaaagctagtgcccaatatccagagtaatggtaattaataataaattgtaagcacatgaattacatatataacataaatcttaggactcttcaacatgacaaaagaatcggtgaagtgaacacctccaccgatttttctccaaatctgggcaagtcgcatgatgcatgcagacatgagcatcagtggacaaatcattttgtattttatatcgtttttctaaatacttttccgagttggattcctttccatgatggcagcgggcggcttctactatagttgtcggtttgtcatggcaagacaaatattgccgcactaggttaaagttgggatatagctatacaaactatgttattaaatagcgtcggtttgtacgtcatgcaggttgccttgtctatttatttagaaatataattttaagttgcatagattattttaaaaatatatatgtaattactgttaaactcagtattgaaattgggttcaatgtcgtcatacacacggcgactgatggttaaacccattaatcataacaattgagattaattatgcatgttagctagtgtatcattgtctctctccatgaaactctacaatctagtactatagtatatcttgcagtatatcccatgtcctccaattaggccgctgtttatatctactgtatgccctaaccgctggattcgatatgattgaggagtactggattgaaactatcatcgaacgagaacataattaattaattaattaattaacatgttgtaaaggacactacctttttccccggcccatctccatctcaagaggatgacagcatgaatatgtttttcttcagacaagatgcaacacaacacactgaaaatatctacatatatctgtgtgctataattaaaccacccaatgcaaggccccctgttctagaagctggatcttacggttgccctcttgcaaagaaatagttttctcgagggtatcatctttagtggagtatgtggagatagcattaattaagctggtaatctcaattaactaattagatgatcaaagccttgggactatggtactgtttcaataaagaaaataaaaaaacatggaagatgtttagccccattggttgtcctaataagtcaaaaccaaagaaaaaaatttaaattttcaaacttaattttaaagttgattttaaactatttgcaacgtaatttttttcagcattaacttaagtcgctaaaaacacatatataaaagttttatctacaaattaatttttattttttaatagtaagttgttttggtttattagggaatatgagcaaccaataaagcgggttaaaatcacacggaccttttacttcacctctgtcctatgtccattgtccatattcatctttaagattggatttatttttggacagagaaagtacgtgcgtatatcaaatttgacaaactattcatatccgcaagcaaatgcagccaaaatggtgagatttgagagctagagatcgcacgagacacagttgccgacttggcgttctcttctctccaacaatatcgccacaactatttatttccaacgaagaaaacgtaccttttctatcacacaggaaccgggagaatctttccacatgactgacgactactaatattctcttggaacataatctaattaatctagttttttagctcgatttttcaactcgaaaaaggaaaattggaaaaggaaatcagagtggcagatctctgccacttttctcgaggcaatcttgcatatcacacctctacaaaactaatatcccagttgtcagtggtataacccatattattcagttaaaagcattctagagtagctaaatgtttacgtggtttccacacaacttttgtggtttttcaccataatttactccacttcccccgagacaatcttaaaaaatcacatcctccacaaaattaatactccttccgtcacataatatagcaatctaataccggatgggacatctcataatacaataaatctgaatatccggttatatattatgggacggaggaagtactagcttcgatttgtttgtccctataacccaaatgattccgttggaaaagcataccctaccaacatatccagtttttttttaaaaaaaaaaccaacatatccagaattacaaaagaaacaaacctctgcagagcatgcacgcttgcttctggagacactcatgacatgcagtctcctttgatctgatcttcactccatcactgaacctgaaaacgaagtggcaacagctcaaaaggtagacggacaactcacactcctatctcctacttgagcttctagaagcttgtgcttttgctttgcttgataaccagcttagcttggctgatcatttcatgcccttggtgtgatccactgatcactgctgagtgatgactcaacaccaagcggccctcctcctctctagctaagctccttttagatctgcattgtggggcccactgtgacttttaggtggcccacatgtgccaaaaggtacaaataaaaagaattgtggtttgatttgcttcgtactagtccatactaaacctcggaatattgtggtattgatttaattagtagaaaaatatttcgtattacatgaaacaattatcacacaaagctatatgcgttatgcaaggaataagtttaagaaaaaggagaagtggtggtaatacaatttatagctaatccggttggcaatggatgaattaaataaatggctgataaggagttaaaaaaaatagaacttatagctatgaacctaaacatggttttgttttgtgagcttaaaattcggagaagctactggtttatagttaacatctgtaaatctaaaaagaagttaggtttttccacattctggcttgtaattcattttttatctacactatttatgagagttagagaatatggggcttttaactatttgccacacctatctcaatgacatgtgggtccacatgtatctatgacatgtgggtccacatgtatctatgacatgtgggtctagtggcaaatagttaattgccacatctaaaagtggcatatatagttcaatatctcagagaatatgggaaaagctataactgctaaaagtcccctctgataggttctaggagtctatcaagggagtttctgacggttgcagcttatctaagaatctccagctgccagaagctcccctaaacagtccaggatttcactcagaattttagaatgtgtagccgtagaatttagatactattagttagaaactaggtttttcagcccagattattaagagctgactaccaattaattactcttaaaatcataagtttccaacagggcccaagtttgtggtagaaattggtgtccccatcatttggcttatttcgtaataagccaaaacggtttattaggaaataaaaatgaatttgtagataaaacttttgtaaatgtattcttggtgacttaaaagtcaatgttgaaaaagaaactacgttgaaaatatctcaaaatcaatctcaaaattaagcttgaaaatttaaaatttagttttttctttgaccgattaggccatcagataggaccctggatttttcgaccaagggtaagcagcgtaggccctgaccctcttaacagctgaacaaacctgaacactgaagcaagtgatggagaccattctccttccacctcacatgagctgtccttgttgcccagcctcctctcctctcctctcctctccaccctcatccttatcctaatccaaatccacctccatctccatgttcatctcaagcttctcagtccccacacaccccagaagcctcatcacattcactgattgcaaaaaaaaaaaaaaacaaatcactcaaggataattttaagatcactgtcactgattgatcctttgcatcaggaggttcttttattgtttccatggaccaagtttggatggcatcttttgggggtggaaaatttgggtccataatatgttttttccattgtctggattttattctgggggtgttcaagaagagcaccaagttggacaaagaataagtctacaatgccatctagtcaaatttgggataagaatttagaaacagtgtgctttgctggtctatatggtgacagcatgtgattaatttatttagttttctttgtgggggagattcggatgctgttctggactctcgttttaagcgcgctggagatttatattagtgggacatcaaaatggaatttttcaggtaagagaatgcaagctaaataattgaaatagaattattgttatttttattattactcatgccaagatggaccggctagtatctccttaactactactgtggataaattctaagcgctataattaacaccactacggtgaataattatttttaaacttaacgataagtgagctgctaattaattaaatcaaataatattaagaggaaaatgttgtcataaaaagtcaggcaaaatgaaatggagtaaaaaaaacactctcattataggcactgcaataattcaacaaaagaatacaaaggccttgtcaggttgtcatggactgttctactattatagaagtagcaaggaaaaatgaagcctttcttttggccataaaaataattagacagcaactaatttttcaggcaaaaaggcacttactagtcattatcaccttttccatagttccatcatcaaaaaccacaagatcaagttttccagctcgctctttcttttcttttcatttccctgtgtacttgttctgatctacttctactcaattacacctcatccttgcatacaaacaaacaaaaaaagtaaaaaaatgaatttccactaatgatcattacctgtaattcaagcccctctttaagcaacaaaataaacttttttttttatgaagagttgcatgttgaaccggcagaaaaacaggctttccaaacaggttgctttcatttttaaaatttaattttcattaaatttcgttagcggtggagatccaccaatcagaaggcgccacgtagccttgagtgagctctatttaaaccactcctctccccccagagagaggcgacccacagatccagaagcagcaaaaaaaagagaaaaaaatcagagaaaaaaaaatgaggagcccgaggagccgtgcgctagagcgcgacgccggcggcgtcgccgtcgagcacgtcgagctcatcccggggatgcccgacgacgtcgccgtcgactgcctggcgcgcgtcccgcacggggctcaccgggcgatgcggcgcgtgtgccgcgggtggaggagcgcggcggcgacgcccgcgttcgccatggcgcgcgccgaggcgggcgccaacgaggatttggtttacctgctccagttcgcgaaccccgcggcggccgcggcggccgcggaggaggcgaaggaggacggcgacgcgccggcgaactccccggcgtacggggtggcggtgtacaacgtgacgacgggggagtggaggcgggagaaggcggcgccgccggtgcccagggctgcaggaatt

SEQ ID NO: 60104 - DNA, 1259 bp, Oryza sativa
gccccacgaacaccgtttgcgaggtctccaggttcatgtcgcggcagggcacccgtatcggctcggccttgccgccgttggaagcactccggtcgagccaccgccggaggtgggagatgatgacacgctgctggatgacggcataagtggagagcgcgcgcggcgtgaagttgggcgcgatccggcggcgcaggtccttgtgctcctcgccgaccaggtagacgaggttgtgttcgccgaagagcttcttgccgaacgggtggctgacgacgtggaaggcgtcggcgcggacgttggcgaacacgcggtgggacagctccgagtcacggatgaagaccgtgaaccggccgaagagaaagtccgcggcgagcccagcgccggacttgcgagcgagcgccgcttgcacgtcccagaatccgaccgggtcgcggatcaaatgcgcggcgctaccgaggaacggcacgacgagcggcgcccctggcatggaccccttcttgcggtggtatgacagctgctctatgagcatgtataacgccacagctgcagccagcaatggcgccgccgtgcggaggtgtacgaggccgtgaaacgactcgattgagccggacgggtcagtgctggttctcatagtgcgtggggtgctgaaggctctcgagctcctgctcagacagttgcacttatgttctactggacatgcgcgtatacgtatttataggaaaactatttcaatccggcgggcaacgtacgtcccatcagtttattcaaacaccatccaaatattcgtgttatacaatacatctattgaacacattgactatagggttaactatagataacatggctatcaattgaagcgccaacaacaggctctcttattaaccttgcttttatacaagctctctctcttaatagctatatataaatgacctggataaatattgaagccagtagcctactaaactattgaccttgctcttagagcaagtttaatacttagtagagctactatctataagcctatattaaagctaacatgcctataatagatagactataagattgcctttaatctttttctttttctttttctccaactatctatcaactattatatactaaaaatccattaaaccacgtacaaaagctcttaaaccatcatatgacactcctatgaacgcttcttaaaccatcatatgacacttctataaacgcttctagctagattagcgatgtcacgtgtcgctctaataaataagaga

SEQ ID NO: 60105 - DNA, 870 bp, Oryza sativa
tgcttcttcgccatggatgccggtaagccctccacctcggactcgctggtccttgccactgcagctagcaagcagtcccctccatctctcgttgctcctccgccggcagcagccatgacccgtccattcctcatcgtccccaccggcggacgcgacaccctcgccgttgtcgttaagggaatcaacggccggggcgcttctccgccatggaggccggcgagcccaggaggacaacggctaaggggaacgagcgaccggggagccgagggtgaagctcagcgggacgagcggcacgggggaaggaggtcggtggtggcagcgacaagggttgaggacggtgacgcggcggtggctgggtggcaaccggcacaggggcggtggccggggaccttgccgggggagcagacgatgacactgtaggcgcagcctggcctgccggctccgagacgaggggctcgacgacgacgacgcaagcgcagtctggcctgccggctctgagacgaggcactcgacgacgacgacgacggcgcagcccagctcgccggcttcgagacgaggggctcaacgatgatgacgacgcagtgcagctcgacccgccggctctgagacgaggcgctcgacgatgacgacgacacagcgcagccccactggctggctcagagacgaggcgctcaacgacgacgacgcaagcacaacccggcccgacctccatctctaagatgacaacggcgacgacacctgccgcgtcaatggtggtggcgagagaggaaggggaaatagaagagaggggagggaggtgggcccacgtgcaatagggggtaacggggatttttgacggaaaatatggagtggcacgtattcaatttctcc

SEQ ID NO: 60106 - DNA, 34676 bp, Oryza sativa
gccgccgatgcggtcggcgaggtctttcttcgcgtgcgcggaggccggcgggaggatctacgtggcgggcgggcacgacaagcacaagaacgcgctcaagacggcggaggcgtacgacgccgtggcggacgcgtgggacccgctcccggacatgtcggaggagcgggacgagtgcgacgggatggcgaccgtcgccggcgacaggttcctcgccgtgagcgggtaccgcacggcgaggcagggcgggttcgagcgcgacgccgagtggttcgacccggcggcgcgcgcgtggcgccgcctcgaccgcgtccgcgcccctccctccgccgcccacgtcgtggtccgcggccgcgtctggtgcatcgagggcgccgccgtgatggagtggctcggctcgcgcggcgggtggcgcgaggtcggcccctcccccccgggcctcaaggccggcaccgcccgcgccgtctgcgtcggcggcggcgagcgcgtcgtcgtcaccggcgccatcgaggactccgacggcgggtccggccgccacgccctctgggtgttcgacgtaaagaccaagaactggaccgtggttcgcccacctccagagttcgccggattcgccttctccgtcgccgccgtccgcatctgatccgatccgatccgccattgacgacgaaccccgccaagatccaagatctcgatctggatccagctgctccgcctcaaggagatctctactacacacaaccaaatactactctactctactagaacagtagtatgtgcacaagaaaagaatcacaaggagaagagaaggagaggaagctagtggtgagtttgtgaagctcctctcctctctctatctctccccaatctgttgttgttgtgaggatgatgatgatgatgagtgtggtgtttttgtccaagaaaaccatggaggaatcaaggggatgatcttggatctcctcctcatcctccatcgttcaaccatggttatggttatgagtagcaataatccaatccattgtacatattatgaccagccgtttgaggtgcagattgcagagtccatcttttgtctcaaaatgaaaccatctcgtcttatgatttcttgagaaatttgaatcagttcttgctgcaagagaaacacaagctgtggccggatttgcgccgggatcttggccggtgtagagtggttgacattggcgtttggatctggaggttgtagttaattggtcgattattggtaattaattagctgtggagcgttgcgtgaggcgatggaagcacgtcgccatcggcgaggaaggaaggaagggagataaggtcggcaccgagtaaacctcacatttgctttgcttgattgcttctcttttcgcccttcttttccttttcgtttttgtttttggttctcacatgggagatgacgagatcctctcgtttatggacttctccctctgtttttagctcccctatgtttcatcgtattgtatgacccgttttgattctttataccatgttgaaacttttaaagtttaaccaagtttcttgaaaattttagtagcattagtttcattaaatctaacacatatgttttgataatacatttgttttgggttagaaatggtattatattttttataaacttaataaaactggtctaggaaaaaaaattcaaaataactataatatgaaacggatatagtatctaagttaaggtttgtgatctcgttttgcaccgtgtttagatcccaattttttcttcaaacttctaactttttccatctcattaaactttcctactcacataaactttcaactttttcgtcacatcgtttcaatttcaaccaaatttctaattttgacgtgaactaaacagccttggggtcgaaaatgctaagctagtcaatgaatttttacatagagggggcctgttttatagggcttctaactttagcccatctacccctctcccgctcactcatattaggagtccttttagtttaggtgataaaatctggataaaattacattcagttgcggtggaaatcaaaatgttttcattgacggacagttttacaactttgacacaatctcatgttttctgcatttccttgtgaaggagtacttaaaaatactacctctgtccaaaaataagtgcagtcatggatatccgtgcccaacgtttgatcgtccgtcttatttgaaaaatttgtgaaaaatttaaaaatatttagtcacacataaagtactattcatgatttatcatctaatagcaataaaaatactaatcataaaatttttctaaataagacgaacggtcaaacgttgaacgtgaatggtataaaactgcatttattttgggatggagggagtaataacatacagtttttgacctaagttacttttttttctatccttgaagcccgtagaacagattttcccttctgatccaaccagatgtccacagatagtgctaatgtgatggagctatgcatttactaacatgaagtaatccatacttctgacggttagggggtcgagaggcagccaacggcccaaccccctctctctctcgttgcttggaaacgcaaggaattgatgaatccaagccattgaaacttgtaaatagccaagtgtcacactccattgccacatcagtgatttccttcattgacaagttcatagagtatcgacgatgatatcgtctgcaccgcgcgatctctttgaactattcaggactatcgcgttcgtagttgacttcctttccaaaggttttgttaagattttcggtggcatgaaaatagttacagtattgtactagtcgggctgtgtttagatccaaattttggatccaaacttcagtcatttttcatcacatcaacatgtcatacacacacaacttttcagtcacatcatctccaatttcaatcaaaatccaaactttgcgctgaactaaacacagcctcggttttgtgagaatttatatcatgagctatgccgccgtggagttcaaattcagtgttttggaatgttctatttcaagaatttagttagtcccaaaacgctcgtctcggatcgagactaaactcaggttgaaacgaaagactaaaactggagtatttgtcaccatcaccccccgttggcttttctttgtataaccatgatccaagcaattttaatttccccttccatgcttggtcccaaagaaaaacaaacctccctaaaatcaaagaaaaaaactaaaaaaaaaggtaaaccttcttgccaagaaaattgggggagaaaaaaaaagaaaaacaaaggataagatcgagagaggcagccatgacggcgtccatactccgctggcggttgatgctgacaagctgaggcacgcagttttgatttgtagcgtccggagaagaagagaagagaagcgacgacttggttgtgaggaatcatgctgagtttgctgacggctgtacgttccagcttaggaagaggagatcgacttgatttgttgaaagctccagcaaacgaacttgtctggatcactttgatcaagaggtgacatggtggatgaacaagctgtgttcgattaatacaaaggttcggaaaatcggaacctttctacagcgcacgaaaaacatgttaacttattattgcaaaactaactaattattagcttaaaaaaatttaaaaacaaattaatattatttctaaagcaactttttatttttttaaaaaaacgtacttgctccgttccaaaatataagagattttaaatagatatgacacatcctagtacaatgaatttgaatagatggtccgcctatttagattcattgtgctaggatgtattatatccatgcaaaacccgagggagtattctttagtaattggggaagtgtgcttgtggaaagcgagagaacaaaagttggaaaaatgcaggtgagaacacaccaagccttgcaaggtagcttagctacttctagttattttatacattttttaaaatgctaaacaatttggttttttcaaaagctttctatatacaagttttaaataaatcaatctatttttaaaattataatagttaatacttaattaactatgtgctaatgatcttactcgttttgcatgcatctgcagtttagccttggcaatatgctcaaacgatcgcagcttaagtttcaccccttgtgtttgtcagctagttagcgttctaaaaaatttggattgctaggttcatgcgtgtggggaggcccaacggcatgttggtttgccacaccgaaaaaaacacgagaaaccagagtcttacttttgaagttaccgaattctggggaagctaaaagttggttaaaacttaaatttcagttggagttgggaaagaagaacatttccatccatcactccatgagaacagcactgaaactgaaaggagttcgtgcccatcaatccgtgcattctcatggtttaatttccattttctgttttctcctcgacagataggcatgggagatgcaaccaacatttaatgaaaactggaaacagcaagcaatcctcatgtatatatatatatatatatatattttaaaaaattctcctttgaataactaaacaatgttatcgatactaactaacggtagctatcaaattatttcagttatttcagcattttcgcagcaggtagcattaatcagattctctgtatgcatttgtgtattatctcggaagtactacatgttgttgcgaaacctaatagaggaagctaggcagatgtgtgtatcaatcattccaattagcttaaaataaaatttattgtacaacctttcaggttcgaaaattgagcttatctcatccgaacttttattatactgcaagttttgtgtacttgtaccattcaaagcagaattattgtgcctgatagacctggacctataggttccaattaaactaaacaagcaatgaaccctcgctcagccccagggcgacatgggcagcaactcgaggctgccccgccgccggcctcctctccctcgcctcctccgcctcactgctacctgagcagccgccggcagagccgggtggcggcaaggacggcggcggcggggcctttctaccccctccaacacccggcgactggggttaatggaatttggtggttcctgtacagcagtacaactagcatgcagtggtgacatatatacaccctgtttagattccaacatttttctacaaactttcaacttttctgtcacatcgaacttacctacacacacaaacttctaacttttccgtcacatcgtttcaattccttcaaacttccaattttaacgtggaactaaacacagccatagtccacatttcctaacaagagtgttgttccaagggcctttgcagaaagctccacataacaaacttcaattgggtaacttggtggatgataggaaaggatgaacatcgatcaccccataaaaatgccacctgatgcatttgtcatattgcttcatgcatttggaaaggctcaacaactttgtcaagtgaaagccttggctgcttggcacctgtttggctcagccatacgaagcacgtgaagccttaacctgaattctagcattactttaaactgggggtggttaatcaaaattcggctaaaagctagagacgtcaagaagcagaagattcctaaatttgtagcatcattaaaaatttagttcccgttaatttgtagcatcattaaaaatttagttcccgttggtctgttgctgccaatatacgtgcagtcaacacacccggcagcgtagatagctcccgggtaggtcaggcgaccgcccggcctccacaagtccacagttgtctatcggcgtataaaagaatcggtagatcatatagaaatatcattagccgctcaggctcgatagcgtcactggctccgcctaggccctagccagtggaggttcccatcggttgcccatttggcccaaaatggcttatttggtttattagaaaattaaaattaatttataagtaaaacttttgtagatttgtttgtagcgacttaaaagccaacattaacaaaaactacgttaaaagcattcaaaatcaacttcaaaatcaagttcaaaaattcaaattttggcttattatttggctgtttaggccaaacgatagggcaaggagtctagtggagttctattgaactccagtggtagaaatcagatacccaaatgcaactctacggtggtgtttgaatcttttgaaaatggatatgaagatgaagataaagattaagtatttcacgcaaaataagatggtaataacatgatattaattgaggtttaattattacaaacttgaaggtccttgttaacatggataacatgatattaacatggtaataacgccccttgttaccctagttgatagaaccggcccatcttgaaggtccaaaccgatgataagtaattgaaatcaacttctggccttgttactgtattacaattaagggagagatttcatttcttacactccacaaattgggcttacatcctggacaaaataatcaatgtggcaacgaaaaagtgtcaaattgttgagcttttgagtacaagctttgtgtatttgtaccattaaaatcagaaatattgtgcctaacatggttaataagatatgatagacgtggattaattacctataggttccaaattaagttaaacaagcagccaaccacccaatctagacttgaattccatgtctataccaggtaaataatcagttggcagctgcccagtgtaatcggttgttaggcaggtaggcttgctacaaagttacaattaagctcattaatttcatatagtagttaatggaatttggtggttcctgcatactagcatgtatagtgacatagtgaacatttcctagcaagagagttgttccaggacctttccagaaagctccacataacaaactttaagtgcataactcgatggatgacaggaaaggatggacaacatcaccccataaaaatgtcacctgatgcatttgtcatatagtaataaaaacaatttggattgcttcatgcatttggaaaggctcaacaacttttgccaagtgaaagcattgatgctatatgtttggctcattagccatacgaagcatatgaagcctaaccttaattctagcattaccaaaattggaatggttaaaagttgggtactaccaaagttcagctaaaagttaagagagtacagaagcaggagattcccaaaattttagcaccattaaaatttttagttccccttggtttgttgatgcattgtgcatgctgtgaacgcttcatgctgccactggggttctagtgaacgattcttccttgtagcagaaatcagatgctggatgcaactctagatgtgcatgggctgggccaagctgttgttggtctctggatgggcccccttgtctcctagttgatagaaccggcccatctcgaaggtccaaaccaacgataagtagttgaaatagacttttggcattgttggttaattaccttactatacccccttcagcttgtaatgtttgacgttgatgatttttggacatatgtttgatcattcatgccttctgttccaaccgatgttatatacgtgcctattttcacttgtcttccattccgaccggttgattcctcaacacgtatgttgcctctccatcactgaaaataattaaggaaatatagttaggtaaccttgctaaacatttaaattacgcactagtttaccattctagtgcgggatgcgaaacagcagccctttgtgttggatggacatcttaaaagaaaatgtaaagtatcgccaagctatttcttgaatggaactgccaggaatttgcgaagcatactagtatccatctgtttcaccattcaagaatgacttagactgaacttggacagcatcggtgtgtaatcactttaatcgtgccatgcagtgtagcgtcgcgcgaactactttatagtacatgtaaacatcaatggaaggttgaatatagaatcaaaattaggaaatgcagaggaagtgaaaacgaagcaagaaaactgccaaaaacccttgtttgctcaaatttaacagaacacgaaaatagttgtcgaagcaacaagacatcacatgagaagtaaggacgctaagctagcaagattaaaacaatcacaatcgagctgctgcataaatatccatgacttcaacttgcattagcattatcagcaatcagatcatttgtagttctaccattgactgatgtcgagatttgagaaaaatagatgttgccatgactaaaaaatcaacagacaacttcagaggatgaagtgttgcattagctataaagccagagagacaactgacctccgatatctgtctgtcttaagatgttgagttagactttgtgcaggcgatttgccagcatgaacagcggcataggcatccgtgagaccaggaagagcatcctcgtggcgatcaatgtacctcgctacgaaatgttcattgccaaaacaaacacaactgtagtaatcaacatcattttttatcaaccccttctccacaagggcttgtagaacataatgccgcggcgccaaccgcttgtccaggctgagcgtgagcatcacaggcctctgcaagatgtattcagtctccaattggaccttagtgagcaagaactctattttgccgcgaagcgtcttctccgagaatcctagaatgctcggcttcctgctgatcgcagagcgtagcttgtccatggagcaaccaagagtgccgcgcaagaactccatcctcgcggcgatggtgccctcgttgttacgggcgacggtgcacacggcgtccttgaacgcccacgatgaagtgggcacgccgagctcctcggcgcgccgcacgacaatcttcagtcgctctgggttgaacgtgagcagccacgcggcggtctgggtcatctggacaatatcacaaacacctagcccgcactccccgagcagcgcgacgttgggcctgaccaccctgtcgacgtcggtggcgaggatcgcgttgcacctcctgaggatcttgaggagcatgtcgaaggagccgaggaaggggacccagaacgcgagcttcggggagacgtcggacgaggcgaggtgcgccgcgccgccggacatgaggaagctgcggatctggggcgcagacaggttggcgcggccgcggagggaggcgatgcggcgggcgatggtgccgggcctcgcgcggagcagccgcggctcggcggcgacgacggcggcgaggtccgcgcgggagagggagagggagtcgaggccggcggcggaggaggagaggagggcgagcacggcgtcggggttggaggaggagttgagacgggagagcttcggggacgccctgcgcgcctgagcggcggtgaggccgcaggtggcgatgaggtagtgctcgacggagaagggggatcttgcggcggtggagagaaggcggtgggtgaggtgcagaggggaggaggaggcggtggaggtggcggcgtggagcagcgggaggaggtggttgcggaggtggagcatgtcgccgcgccggcgacgccgccgccgccgtcgccgcgtgacagcgtcggctaggcacaaggcttttggtggctgtggggtcctgatcctcgacggattgagatcttctacattgcaccgtgtcactgacatgtagatccgatgatttccggtctcatatgtttagtgataaaggcgtggtgcagtcgaccgtagaggatcttaaagtatcgatgccttaacactaccaaggtttaatgaaaatattgaaaaccgcaaaatttcaaggttttgaagcgggacaaaagtagattacaagtgaaatttcgaaaggatttggtgaactaaaatttagagtagtaaaaatcaatcaaaataactcaatttttttgaaaattcggcaaaaattatggtacaatcgaaatccgatactcaatggaaaaagtgaaccaagcacactagtactctgaatcactacaatactattaaattaataattttactagcaaaaatacctgtgcgttgcaacgggaagcatacagaccagaaaattgagaaaaagttaagaaaaaaattacattatgtaattaattaaaatataaatttgctaaaatatttggtatttttaagtaggtaggtgtataattaaatcaatttaaaagtaaagcaagtgtgagaaataaaatgacatggttaaatttttattaaattctccttgattagttacgctctttgaaattttattgaaattatcagagcttaattgctaatttttaataatacaaacatcatttaacaattatttaattggaaaatgaatcaaaatcctcgtttttagtttgggccgaatatagaaaagtttatataacctcccttttttctattcaatctgtctggcctatttcctttctccgttgaagtccattttgtgtcctccattcggtgactcaataggccggtggcccgacgtggcagcaactagagctgtccgatcgaatggacggtccagattaatcctaacctaaataaatacacccaaaccgtaaccctaaccctaggattcattctccccctccccctgcccccaatctcccccgagcgacggcggcggtgacgccaccccctccccccttcccccaagcggctacggcggcgcggagcagcgaccggcgagcggcgccctcccttccggcgggaggggaggcggtgaacaggtgcgccggcgcccttcccttcgccggatccagcgggatggaaggcggcagcggcgccccccctctcccggatccagcgggaggggagctggcggcagcctggcgtccatgcgacggcagcggcggcagcggttcgacgacgacctccgattttatttgtgtgattgaattctgattgggaatttttgttggtaggggtgattgaattccgattgggaatttttttttgggtgggggtgattgaattctgattgggattttatgggggagacgacggacgaaaaattggcgtacggacgaggtgacgaacggaaaaatacaaatgtttatattaatttattgtatcgatggtttaaggtacgtctgaaaagtcatgaaaattttatttatgattaaacttttattatatctaagtaattggatgttgaaaagaaatgctaaagagtaaactatgataaaagcacccaacataatcttgattctacaataaaaaaagaacaaaaaaacagaagtagaatttaactattcatacgtaaaaaaagaaccaaactttaacaattccatcgcaatgcttcagcaaaaagatgacaaatatccaacgtatgtaaaaaaagaacttgttcagtaaattcataatggcatgatccaattaatccattttctaatggaaaattattaaagacatagagacactatctcctcaggattattcctgataacaacatagcttttttttaacaactcgcacgagacggtgcgaagttctattgatatggctggaaaaaaattacaagattacaacctaggaaggtcgtaaccaggaaaaaggaaaaaatataccaccacacccacacaccgacagtgtcaacacacaggttggggagaaggctagcaccagaccagccgccgctaagcatgaccgatcgccgctaggccaacaacggaacacatacaagatcgcccaaaaaacgctcttacaaccaatacaaagcccaactctatccacgtctttcggatttagggagagggtgagagagaagatggaacacctctgccccctaggtcctccgaggtggccaacttgtagaaactacgacgccgccacaagaggatgagaatctagagcgtgattgcaccaattgctcgagtggtttcggcaaggggatgcctaaacgacgtctccaagaagagaagcgacggaaaaccgccaccgctgtccgtcaaggtctcaaaagagcccagactgggctttcgcccggcaaccacccttgaggggtgagacggcatgacaaagccctcaggagggggaatgacactcgggtgccatcgttgtcggtccggccaaggccgggctaggttttcacctgccactcaccacctgcgagtccacgactaacgcaccgatgctccaccaccatctaacctctgctgacatgtgggaccactgcaccggcaccccccgtcagtcagccttcatgcgccgtagaccgtgccacacccaccgacagctcctcctcgcaccatggtcgcctcctccaccgccgaccgtgcctctcgcgccaagccagccttcaccgctgctggccgcgcttcctcgcgccgtgctggcctccgctgccatcagctacgcctctctgcgccgagctggcctccgccccctcctccaaccactgccgtgccagccagatgcgaccgtctaccatgcccccggctagccgtccgagaccatcgtgcttcctcccagcgcaaccacggccacggtcgccacagcaaccatagccacagccgtcaccgccccagtcctccacccccagcgccactagcccaccaccaacagcgccacggccggatctggcgctgggggggggggggggggggaggggaggggggcagatccgggagccccgccatcagatccgtggtcatcgccaccaccaaccctgccgacattgccaccattgccaccccgccgccatgaagaaggccatagcgagcatagcgtcctccaccttcgtagcttcctctggatctggcagccaccgccgcccgccgcctacatccacgcgccagctcgctcgcacgggcgacccacctcgatgccatcttcccaccgccctgccacagcccgctgtcgaccatagcagccgcgcctccatgcctgccgcaaccgccgacgccgcgcccgcaccgccacagcccagatccagcggcggggacatcggatccagctacgggggtgccagatctggcgatggcggcgccggatcagccgccatgcgccggcgtcgcgtggccttcccggctctccgcgccaccccttcacgccgggacggccacgcgcaccggggtttgtagcctcgctgctgccatcccggcaggtcgcacggtttccggcgacacgctctagcggcggcgaggcgggggagaggaagggagggtggctgcggccgggggctagggttcaaccccggtcggccactaacaacattacttggagccgaaaagaacttgtgaatagcacccttttacgattcaataaattgaacttctcgttattgttttcctttttttttcttagcacctaacaaatgcttcttatagtatgcaacattaattctaaaatctaacatttgaagctatgaaagataaggaatatacaaacaaaactaaaagaatcctaatctgctaactaaagaagtaatggagtaatgtaccacgagatcttaaatcagaatcaacggaagaggagtgagtcaacccgcccctgcttgcctgtgcagtgacggtgggagcgtggagagatgctgcaaggtggccacgagtccgctacaccgtcggtggcagtaccatagtgttacgagtaagacctctgttcgccgctagtctgaagataaggagtagtcttcgccgctagacggagaagagtgctacggcgaacagcaacagtagatacaacttattattacctatgttataaaatataacgatataacgactacgaatcttatcctaatcgctcaatactaccacaacactctctgtataacactctgctatgatgacgagaataatggcgatagtaaaggactaccatgcctcttctctccttattgaactaagatcgtctattttcgaagtcacctaacttcaaacctagagtatcctgatccccacttaaatatgacgcttgttgtattatgtttttacggacgtcagatcaacttttgtcaatgtttaaattatttcctttattttttgttttggattaatgttgcagcaccttataataatataataaatgttccagactgatttggttgttgcagtatgtgtttctagctgttgttgtactgttcttatcaagaaatattgcttcctcgctttcttcttttcttttgagttaattggacttataactacgagtttatccttgaacaagatccatattcctattttcttacggtaaaaatttctttaaaacaaatttgatcatcgaaaatgatatgcagacgtactattgaactctaatgataagctggattgttgtacaaaatgcgttacacaacacacatgataaattgataattgataattgtttaattatcatcagatatatgttggcaacgtcaatgtgataactgtatgtgttcacttttctgaagccaagtggagtaatgcatgcaccttcaacagttcaaccaaatataagcccgggacattaaaaaaatgtgtagtaagaagatgtaagacctttgctaaggatttaaatcacacaacttcacatttctaatgcagtttgttgtttgcgaaataccagctctctactgttggacggacatctgaaaaaaaaagaaaagatagtcaagtacatcagcgttacagtatcacccagctatttctgcaatggaattgccaagcatagagtgatctcatggtggactgatgctaacactaacacatgggaatttcataatttggatcgtacttcattattgtggagacagtgcagatttgaaattgaaatgtactgcctctattttttaaatagatgataccgttgactttaaatatgacgtttgactatttatcttattttaaaataaataaataaatttaatttattttgttgtgatatgctttattatcaaagaaatttaattcaagtatgagttatactttagcatatttacactaaatttttaaataagataaatgatcaaatattgattaaaaatcaatggtgtcatctatttaaaaaatggagatagtatgtaccctgaaatagaaaatgtcggcaaattccaacccaacggaaggagtgaagatactaaacaggcccttagaaataaaattttgtaaggtctattaataaactattgatttaaaaaggtctaaaaaattaaaaaagtgatgcatatttgtttggtttgtgctttattcgatcagacaatagtatagtgtaaatagtttatgtatgttctaatttgtatcgtttcagcaccacaactagacaatatacctgccagtacatcctaatattatgataaaggaatatgtttacctacacttcacatgctttctatgtgaccgcgtcatcgcgtatcacaaagttaggctatctcattgcaagaaaaatcaagagcgccaaatgaacttaccacgcgatggttgtccgggctgtagtgcagtttgtgaaacagcaccctgcagccccatgatgatagatgcctggacagagatctgaacaaatgccaattatccccgagttatttcaagaatggaattgccaaagtattgccagcaaatagtgatctctgagaactgacatgcacagtaccggaacccatgggaatttgccaaattccaattagtactggcaaggataacacatgggaatttggatcgtacgtcatggcttcactcttcatttattgttgtggagagaatgcagatttgaattcgaactcatgcaccctgcctgaattaggaagtgtcagaaaattcaaaaccaatggaaggggttatttatctcactatctgtagatccgaaacttttcattcaggattaagtttataaaaatagtgatatcttctaccccctccattccaaaaagaatccaatcctagcaacgaacctggacacgcaggttcgctgctaggattggattctttctagaacggagtagtaaatccttatgcatgaacattccctgcattttggttgggttacgccaccttttaataagagctgttccatcaaatacaactatacaagtgggtagtggggtgcttatagtcgtagatatgaatagacaattagcagtgcattgcctgaactcagaagaaaggaagagtccctttttgagtttaacatgagcgcctcgtaccaggagttctccgttccccgcgacccagttctccaacatcgccgcttcatcttctcctgaagacgttgttgctgccacgacaccatccctcacctggcagaggagagagggtgtggcgagccctcggtgagtgggcgatggcgcactggtgccctgacattcacaaacattcataggattagagaacttaaaactctatttaattatttgactgaaccatttatgagaatatgagctttgcatcccctggggaaaaaaatgattttgttccccaatgaaatttcatccagaggaaaaagatgattcatatgctgccaactgcaacggtagcagcagtctgccgtcctggagacatggacgaacaagagatgtgattctgtttacgggttttaaacagcgggtcagcggcagttcagttgtgatgagttgttaattactcagtgattcttgtcgtgcctgtaaaaagtaaaggagtcattcctagcgtttgcttattcattgaaaatacacagttacttgatttgtgccttatacggacagtagtaatttgcatcacagcacctcaactacacaatgtactggttagtgcatccttatattatggtaaaagaacctactccctccatcccaaaatataagcatttttagcatagtgacaagtcaaacattttcaattttgaccattaatagcaaaaaaatacaaaaaagatcaatcatgtataattgatgttactagatttattattaaaacaatcataatatgcaactctttttatttaaagcatcttacttttatagatattgttggtcaaagtagcatatcggagaccgtgtcaggataaaaaatgcttatattttgggacgggagtatatttcatatgctttgtatgtaaccgcacacaacaaaattaggctttcatctactcaaataggcccagaaaatctaatggctcatttgttcagtaacaggaacaagagtccgtaacaccataatgatgcacctctagtgttagcatgccaagttgtactccctccgttttttaatatataacgccgttgatattttaagatatatttgactattcgtctttttcaaaaaaattatataactattatttattttgttgtgactcgatttatcatcaaatgttctttaagcatgacttaaaactttttatatttacacaaaaattttaaataagacaaatgatcaaaacatttgtcaaaaagtggacggcgtcatacattgaaaaacagaggtaataatatttatggagtactaaattagcaaccgaacaactcatcgtgcccttgcaggagcatttcgatcattagacacccccaagaaaaataaagagtgtcaaatgacaaacttaccagaccacaggttgtccaggctgtagcttcttagggtaggcagctattccaactttatcatacctgtgtctgacaggaccagaacaataaaatcttaatggaataagtagagattttcaaaacaaaattaattgtactagtagttgttagacctggatcattaatattgtaacacatgcataattataaatcaatgtttattatttcaggaatttatatttttaaacttaataagtccattaaacattcgttagagtctctatgtaagcattaatgcagaaattagcaattaatgatttctttgtcataattgaacccatccaaaaaaacgatgaatcttcggtgaatatgttcagcgataccctcaaagttttttatccaacacacacacatactagtaaggcctaactttttgtatgactgatccaaaatataactattgcagatgtaaatctatcgtaacttacatgaaccacgctatactttcatcaggtttggaaacttcgataagcttccaacggatgcactcaatcttttgccagttttctccattaggtgcctggcagcttcttttcaagcactcgcagtcttgtatttcaatttgctggatagaattagggaaatctggtagagatgataagttggggatcctgacaaatttgatcctctccagactggacaggttcttcaaactgcttggcaggtacatgactttagaatccctgaactctagaaacttgatagatgtgaaatttgcagagctttgaaatgtaatggatggctcgtcgtattgttcaaaacagagtttctctgggagcatgaaatcctttatagagagcatgagactgagcatagcagagctactaatagcgagtgatttccatgcatgatgccgggaaaaagactctgcggtaagatttggaacatttatcagatgtatgtcctggagatgtggacatgataagccttcaagaaagcacaagtctggcatgttattcagtgagagtgattccagggaacgcagatgaccaatagcaaatgatgaagagcttcggcagcatgtgatggaaatgctacgcagacgtgggaagtcagtactgaggaaattggcccctagtatgcagccaaatagagagagctttccaatagaggatggcataacagctattccattttcatccaccaactctaatgagatgcatgaatctatcttaacttctgaaagggaggttgcctctcgtaagccacccaatgatctgaggcaccagcaagaacggatatataatcttttaagcatcgtcaagcgctgcagcacctgcggtgatgggaacgaagttaagttcataattcgctctatagacaaccatttcagcgaggtgagtccttgaaggcaaacagctaaagctccatctgtgaggttgcatgaagaaagagagagattctcaatcgatgatgggagaagcaacagattctcagtgggtcttgaatagataagtttcgtcctcttctcttggcagtacaaccatgcttttatgatattttcttccaacaatacttcctctctttcactttctatagcactttttatggtttggagttgtgcggatatatcatcatccatcaatgccatcaactgcttcagagatgaatgttcgaacaccaacgtgtccctgacctttttactaatctttgatcctctctttgcctccaggatccttgcaagggtggatgacaaattgcccactttcatcaaatctgtatgttgtacatcctgtccaagttcttccctagaaataaatctaagcaacgggcaacccatcatatttaaggatacaaggcctcctggaaagcatggtaatgtcttcagattcaggatgttgcggagggctatatgacggaaatgcttgatgagctgtacactggatggtaaacattccagggaagtgcaattactaagcacaagggtctttaaattaacaaaataagaatcttcgagcaaccagcttggatatactggagatctgtagcctgtaactataaggtcattaagttcacgaggtggcttgagaccctctagaacctccaaatgcaaattgtcatttatatgcaagtcatctatgtaactccaggaaagttccaaacgatcaagccgacttttattatgcagcatcgcctccaaagcctcatccttcgttctgacattttcgagatagttaatttgtaaaatgtttctaagctctctcatgtcccttaactgctgtagttcataacctatctgttttgccacagagaattccaaaacatgttggagtttcgtcaacttacctatataaggaatttgaggcacaggtagttgtgcaattggtccaaatgaaagactaggagagcatctttcaagatgccgcaatttacttaagttgcagatcttcgcaggcagattgttaacatcacgatgtacccgaaggaactgtaaatggtaaagagtacacaatgatccaggtaattcagaaattgaagttttgaggatgttcaaatacctcaggtgcttgaactcatcaatagactgaggcaacttcctgctattgtaaaagcacaaaagcaatactcgcaatttcttcatgttacagaatacctcatgaaatagtttatttgcatcatccattactggttccatgaagataacagtacgcaaatgaatcaacttgcagatgctttgtttatgctgtcccattctatcaacgtaaacagacaaatgttgaacagtgtgcggaatttctgtcaccatacagtcttctaatctgaaacagtctcctctggaaagtgtttccgcaaagtcatgaataatatcatgcatactatatgatgtatcaaagcttttaggaactggctgaaagaaacatgcagataccatctcacggaagtacgccctggcaatatcttctactgtcctactctgatcggatgaattgacatcagatgaatcaacaacaaacccctctgctacccagaggtgaaccaactcattaattacaaacacatgaccttttggaaataagctgcaatacataaagcacctctgtatgttaggatctagattctgataactccacagtagagatcccctggtctcacctaagttatcactcttcagagcatctttccatgcagtgatagtcatgttcctgctcaactgagaaccaacaacttttgctgccagaggagattgtccaagcttttgagctattctccctgcaatatctaatagctcctcgcttctgtgctgctctctcattcctgctccagaaaatgcatggtatttgaagagtgccaggaactcagtgtccttcatgttctgcaaaggaaaaacttgtttacaacaaaggggagctgggagtctccctgatctagaagtaaccaaaacttggcttccccgttgctgagaaactagaggagctagcagttttgcccattcctcctcgtcctggaaaccataaaaccaaacatcatccaacacaagtaggaacctctgtgactcttgtaagacgcctctcagcgcgcactggagattgttaaggttagtaaaatgcacaactcgattattgtttgtggcagactccatgatctcggctgtatggcgatgcacgtcgagtttacgagaaatacagatccacatccttacatcaaaatgattcaccacacgctcatcattgtagatatactgtgccagcgtggttttccctgcacctccatgtccaacgatggccgaagtacagtagtttctctcaccactagtgttagtgtcatctgggttgcagagaaaacttataatatggtcacgatctgcgtcacgaccaaatacttttgaagtgggaagcgatgtggtgatggtactgctgctgctgttgacatgaggccctgtgatggctgctgcagtagtccctgctgaaaggaactcccgatggaagttcttggcttccaccaggatgttcttcagttctgtcaacttacggagtagtcttctgttggcagggagcaaattggacgcggtagacaccaaagcaaggcgagagttggaggttgagggcatagaaatgtttccagttgctttgcgctggaggagtttgtactcatgcatgtcgagcaggtcctcggcatcatagaaggctgctttgagcttccaaagccagcgctctaactccatccggcgggggctcctctctgccgctttgatcacgaacctgaactgtggtatgacggtggtctcaagatcgtccagctcctgtgccatgtccttgccaaggtatgttttagcatcgttgatgatcttccgcatgattggcgacacgacccaccctgagcccgccaacaccaccacttctgccattgtactgcaagtctgcaacttcacaactcagtcaactctcccttgccctgtgtctgccagcttgtgacccatctgtgtttcagtgatttgttttgtcacaggtttaactagacaaatatgatggcatgagaagttgagtactgattgagtggttcgttccaacttccaaatccggtgtgctgatactggtttcaaaaaaaatctagtggcagcacccagcaattgagcgaaactgcaaaacctagcgatcaagttagattccaaagccaaatttctgatgtgtgcacataaagataagttatcattgcagtcagactagcctgatgtattgttttctaaagaattggtacatgtctgcaaattaatactccctccgtccaaatgtaagtgcagttgtgggtttctgtgtccaacgtttgaccgtccgtcttatttgaaattttttaatgattagtatttatattgttattagatgataaaacatgaatagtactttatgcataactttttttttatttttttcataaatttttcaaataagacggatggtcaaagtaacgttggacacagaaacccacaactgcacttaaatggggcagagggagtagagtatatcattggagaccgatgaccaaatgtacatggttatagtacagttgcagcctaccgtgaatgcaacttcaattaaaacacatcaacatgagggtataaaagtgttatcagcagttttagtaaaatgcagcctcaattaaaaaatatcaatatgggagtacaaaaaagtgcttcatatgctaactgttgctttcctgtaaatgcaattatacagcagttttagtacacttacagcttacctgtaaatgcaacctcaattaaaaacatcagcatggtgatataaaactgccagatgtgactataagtgatatcaggagcccggttgatacccttttaacaaaataaaagaaacacacagataatatttttgctatttatctattgcctagtttattttccttgtttatcagtcacctaaacttgcacaatcgatggacctacaagcaactcttcttcaacttgtattttaatatgtggagatttatatctacacaagggcatataggtgtgttcttttaaacttctctacactaaagaaattgtttgtattgtatatgtggggatttactgaggtacaattcctttattgtgagaacagtgtttattcatcccaagaaaaagaaacatacgagttgtgggatgttgatataatagttggtaaaagagctggtagataaaaaaaacagaaagtcagttgatgaaatataaatgcaattccaagagaaataaagtgagcctccctgcgggcatgacgcacccgggtagctgagcggcaaggagaagcattgtccaatggaggatgcaccaaataaatacttgtacacttcaagtacaatacgaaatttcttcaaatggctggaaaagaaaatatctgtatcaacacaaagcaagaatatgccaatttcaaattctcaaatgggtgacgaagttgtaaacttcgccttttaactctctctggtaaaattcaatgtacggagagtcaagagagacacagataaatcatactcaatcaataatattgtaagaacacattgtagaagctatatagaagctgagcttctgcaactacataagaacagacatggaaagcgaactacggcatttcgtcgaacacgtcacacgcagaacccaatccatcagcaaagacgctgagcaagacgtacctgtaccaatgaatcccaagggagatcctccccgttgagtgcggaaccgacatcccgagtcgccgtggggattcagcgacgtgatgtgacctcatcccgataagagaccctctgccccagcgccggcgaccgaccatggcggcctcggtcggcggggctcgtggtggtgtgcgacccgcgccaagaaggagggcacttcggcaatcgtcaccaccgccgccgccgcctgcactcccatcccggaagcgatggtcgtcggcggcggcggcggcacttgccgtcgagtttgctccgcccagccttggaggcttcgacacgttgacatggagaatgggccgggcccttgttggatagggcctggcccatcttgaaggcccacaggaaggcgatttttcatcaaatttaaatgttgttcgtgctgtccaagctcaagctgttgagctcttcgctggaaacaaacgtaagcaatgggaaaccctctatttcatcaaattcacaatcaccagttcaatcacgctaactgtaagacataattcttatcagaataataacttgtgaattagtggtcttaatactccctccgtccatattataagggattttgggtggatataacacagagtctgtccagattcgtgctactagaatgtgccacatccactcaaaatcccttataatataggacagagagattactttaagagcaaatatagaagaataaaatacgatgggaaaatcacgaaatgaatttttgaaatttaaattttggctgcgcctttacaagttgaagggtaaactgtggtagtatgagattgttaacgtctcggtgtacagctacaggtaacatgtacagcttcaggtaatacactcattcataggaactgtaaatggatccaacagcaccaggtaattcagaaaatttgaagctttgaggatgctcaaataccgtatgcacttcaactcagtaatagttttgacgcaactcagtacagttgtaatagcacaaaaatcaaaactcgcagtttcttcagattaccgagtagcacctcatgaattgaaacatatgacggtgcgcaaaagaatcagcttgcagatgcagagatgctttgttatagaacagcataaacaaacactgaacagtaagttcggtaaaaaaaaaaaaactaaacagtaagatgaagccctaaaggacaaaaccaaatctttaggtatgattttttttagttttcaacgcttagctcgttttcaccttgtttaagaaactaggaagaaagcccgcgcagttgcgcgggcaatttatttattgtttaaaaaaacctaaaaaaacattatatcaccatattcactataagaaataaaccataaattttgacatactaaattataataatgtccatcatatccaaacaaaaatctttttgccctcatctatcatcactacttattatcgttgtcttgaaatatagatattttttaatagttagaactgcatctctatccacaaataaacccaatacataattaataccatataaaattcatatgtacttcatatgcaagtactcataccttacaggtatccgaatctatatgtaaatatttaaaaataccacatctactaattaattaatatgataaaaacattaacttatatatgaatgtccctttaataaccggtgaagccgactatagccgctaagccttttttctccaatgccttgattcatgtgtgccttattgatatagttgtgctcctcacgacaaccttggagcacaattttataaaggattgcatcggtaactaggctagttgagctctattatcaatggtgacctcttactcggaccacttctgctcaataatgcgtacttttgccgtagttactacaatgtagccagttgaggtccatgcttggcgccctttagggtatgagtaagagaaaatgcaggtgatgaaaatattttttaaatgttttgaatcgatttattttatagagtatacataatttatttatggtgttaatcgatactactaaattttagtggtacatatataattttctcttttaaagattagcagagttgatcattggactctactttgaaaaatccaataggttcagtggtgaggaccactaaaaaaatatttggtcaaattgtgatcttttgctaacatacaagttaatataggttttgattttttttcttctattatacatctaatttacctatgcatattcatgggactaacatttgatgaaatttgttaaaattatttgtgctaattgttaacactatttggtagagaacgacataaaaagagatataatgtagttacatctatgtttttttttctagtgaacagtagtctctcgtgtggatgtttattttttcttttttttttctttttggatgattatttgtcaatcataagaataggatgtacatttttctattcatagtgtgcatctgcatggatttatatgagcttatgtgatcgccttttaaattgttagtaaataatactttaaaaaatttgacaggaagagggtggagcaacgggtggcatgaggtggtgtcatggtgtggcttattttaccaccttgctaggagtggtcactacatctatgctcaatttagaaaataaaccttatagtcagaacaaatgagaaaactaccatataggacagtcatatacgcactcttcttttttttattatttttatatatctagcgtatgtatgtacataggagttgtgtatgtacgtaaggagagattagacggtttttagatagagagattattgtcatagatctaatttaatggttgaaaataatggaatcgctaattttgaggtgtaaatcgatgaatagttgtttttcttttattttatagtttttcctagatactctctaattagagcgtcacataacatcttagaagcgtttgtaggagtatagaaatgctattacccatagtcacaatctacttgtagtcaactattgtttgtggtggattatgcaacctctacttgcctatcatttgttgatcgttgcacacttagtattgtcctttatcttcggtgcttgacgacatacatgctcattagatatcagttaaccgttagccgttaggtgcattgtgtatgaatatcttgtaagtgatatgacttagcgattagtaaagagtgacctgtatataaaacttacatatatggggatcagtgatgacatgcaattgatattttaggctaggatattgaccaattatattgcgtactacatattaagtttttaatacctaagtaataaatttaaggcagtgttgtaaagtgcttataggattaactactccctatttatagcgagtacgtttgtcaaactactatacggtgtattacacagtacgtgttttacaaactttttatataaaagttttttaataaatcgaatagattcatttgtattttttaatatttaatacccaattaatcctatgctaatgacatgtatcatcttgcacgtcctggataagcacagctaatgagctaaatcgatttaaacctaagtaggagataaaagacatcgacacgatttgaaaagaatatatttgatccttaatttctaatgatatataaataaagataactcacaatacgtgaaaatacattcatgataattttagtaatattattttgatatatcaattatttttatagtagggagtgagtaattttgggaaagagtaattttgggaaatgttactcacaactgaagttgttttatttttaaaaatgtaagtctaatttcactatacaacatacaattatataatgcatattattcatttatttagatttttatggatgttttgatgatgtgcgtattgtagaatttaactcaaaatagcatatattttgacaactattagttgaaattattaatttggtttttatctcatgagagagaaaaagaaaaaaaaataagggaagggggtggccacgtatgaggtatgtacgtacgtgcacgtacaggttcgggagggattgttatggacgtgcagctttttaaagataaatctatttggtattttagatttaacggttaaaaatatggacctaccagattaaatgaaaatcaatggctagatgttttttcaaaactttctaatttattaaagtgccacttggcggcttaagagcgtttgtagagatgccatgtggcggtttaggagtgtttgtaggaagtttaatagacttttagtatataaagatagatagatagataataaataatagatagatagatagatagaagatagatagatagatagatagatatctcagaccataccatccacatctatctgcagcttatcaaaactggacagcctgcattctactgtagcttatgaaccactcacacatcctcaacttctcttacaaaattgctcgtgtacagagtgaactgttatatatatgcttcttcgtggattcggttcacatataccagacatcagctgcaagattaggcctcaatttccgatcactgtttgtacatgataaccccaacagcagtaacttcatggcatcgcctggtgtccagctctcaggggggcatccttggatcaacgattttcagctttcttctatactgcacttggttatctttactccggtgagccctcttatgtgaacccaagtgccattttagtttatttataatgaaaaattagcaagtgctaaaagagtgtgtattttgactaacatgaagatgagaaaacgattgaatctgcttgctttaaataggcttataaatactgactgaattgctaacaaattgataaccgaaagatctaacaaatcctatcttcctatatagttggtacccactaaaaagcatttactcctataaagcaagacatgcaagaagccacatcatcgataattttaagcctttggatcgcattagtatgagaggtatcagccatgcattggatcaagaagctggctactcatccattcacttccctttagctcataatcactcgtgacattgttatccattatgtacatccaaatcctcaaagataatactaatctttttttcaatacaacttccattattacataagatgtgagctttcttttgttataaacaattggataacatacaataattaggtatcatgaatccaaaccaatttttgaaacatacttgagatgaagcagagaagtgctacactacctaattgtgacagtatccagattgtacatgaaaataactttcatatatcataacaatacataatgacgtttcaaaaaataaaacataaattgtatcgtaataacagaagctatatatgaagccgcattatcatctattttatatatacaaagaagtgcatctaatcatttaaaacatttattttattctgtgattaaactagcaaatcccgcgggcaggcgcggggtgccaactagtcctatctaaatcgcaagccggtaagtactgtagctgtccgacacgccgtcttacgctccctcccgcacaactcctgccattgtaaccgcgtcctaagcactcggcgtgctgtgtctggacctgtgcgcccctgcgacgatacgtaattccgatcatgacattgttggtatgcagtacctaggatcaaccttgttgacggcgggctgagaccaaactcaaggatagttggagtctagcacgatcaacaatgtcgagtgataaggttggaatgcgagtgtacccggtggacggacatggttcggagagaacattgtaatttggcggcatgtcaaaacgcaaggaggaaatgaaggaaagatagccccatgtattagtaacgtgctgatgcattttgccgtctcgcctgtgtcgagtaccacctctataacatgttggccctgtttacacccaaatttagcacctaggattagaataggaaagattgccaaaatttggaaatctaccggtttcctccgagtgggccggtctgaccgccatgtgttgggaggtcagaccgccggttgtaggccggtcagaccggtggtgtgtggccggtctgaccggcgggtccgagtccaaccctgtttcgtcgggtctcgaagtttccttgctcgggaatgcatgtttcgggtttcctttggattctaccccgagttggatgtggaggagggcctgtataaggcaagaccaacccctatataagggacaggccggttcattgtaagaaaaaaaatctactatcaatcaatcgaatcgttcttttcatattgcttttagttttctcttagtttgtccatctttgtcggtttgcgctgtaaaccgtccgccgccgctgcgagagtgcgacacctctttgtaggtttgtcctgaaaaccttccgtttgcccacgagacgggtagttatctagaaatcagctccgctagccggtttagttatcaaaacccatctagatttagctttttgctagatcgaggtggttggcgactctaggatcaccgcaaggcttaaggtgctacgatcgtgcttgtcaacttgtcaaaaaagttgccaacacaatttttggcgactccgctggggaagagatccgttcatcgtcaactcgacttcgacttcgccatgacgaagccatcatccaagacggaggtggagccatctcatgtgataccggtcacattggatgactttgaaggagaggatcgcaaagccatggaggagtacatcaacgagctcacacgggaggcgttgatgagagcaactactaggactcgtcaaggcgtgatcatcaagcccgggccacgtcccaagctcgctcccgacgtggtaagtaatgacgaggtatcgcaatctatcaaccaacaaattgcatctacaatagattcatctatggctaattttaaagatagattagatgtgatgtttaaggaaaaagttgatgggtttttaaggagtaggctaggttcttttatggatgattacactttaaaagataaagcctataccactgctgatcaacctcctatagatctgatggggtctaaaaccgacggagcggcgttcgtgaccagtccgaccgggcctaacggccggtcagaccgtgacacagccgtcggtcagaccggccagatggccggtcagaccgggtattatcccgtcggaccgactggccagatggccggtcagaccgggtattaatccaccggtcagattggctctcaggccggtccgaccgcgcagcttgacgccggtcagaccgggccctgggccggtcagaccggtgcaattgtgccgatacagggaatcgatccaatgactaatgctagttatttgtatcactttagaacatttgattcccctgtatctactgccaccactagtcctcaaattcccccacatattcctaatatttacaatgatgtctctaggggatatcctcccgatactaggccaggccaatataatcatattgcgccacaaaaccaacctattaggccaccaaacccaccaccaaatccgcaagggcctaataacatggagaacatgattagtgatattatgaggactaaattcgggatcgagactaggaatcgtgctagagcttataaaaaaccatatccggattattatgataatgtgccgtttcctagaaattatagagttcccgaatttaccaagtttagtggtgaggatggtaagaccacatgggagcatgtaggtcaatttttagcgcaatgtggtgaggctaatagtgatacttttaaattgcgcttattttctttatctttatccggtaatgcttttacatggtttacttctttaccggcaaattctattcatacttgggctcaattagaagaacaatttcatgattatttctatactggagagactgaacttaggttatgtgatttaacatcggttaagcaaaagtataatgaatctgttgttgattatattaagaggttcagagatgttagaaaccgatgttatactttggatataactgatagagatttggccgggcttgcttttaatggtttagttgctcctcttagagagaaactagatggccaacaatttcttgatgttagtcaacttatgcaaagggctctggctcaggaaagccgggttaaggataataaaaaaattgctagaccattcgataaaaagcctaatgttaatgtagttgattactctgatgctagtgatagtgaagaggagggtgatcatgatatttatgttgccgaatggtcatggactaacaagaataaaccttttgtttgttctaatttaatgccgactcatcgtaaagatcggcaaagtgaggttaagtatagttttgatgtggccaagtgtgataagatttttgattatcttttacaagagaaataaattagattacctaaaggccatgtcataccatcacaagaggagttaaaacatcgagcatattgtaagtggcatgattctcattctcactctaccaatgattgcaatgtgtttcgacgacaggttcaatcggccatagatgaaggacgattgaaattcaccgatggctccaagatgaagcttgatcatgatccttttccggtgaatacaattaatttcaatgataagaaggtgttgattcggccggagcaagccgaatctactaagggaaaggaagtggtcattggtgagccaaggcttaagatgatggtgccaaagaagccggaggttggtgtttggaaggagaacaagggtgaagcttcaacttctaaggctcataggaagaccaaagtaaccttcgatatgctcttggagaagtatgagaagcaaggtggtgagagggatcacaacaaagggaaaagaccaagatcaccccctagggagcggtttggtcactcaccaagacgatcgcgttcacctccatattttcatccacaagacatgtcatggggttcttatccaatgccgccaccgagttatccttatccttacttcatgccatggggggcaatgccgccaatgtacaatcatatgcctccaatgcaattcaacaaagggtggggaggaccacggaggccaattcatgagcgcttatcttcaccaaacaaaagccgattttatggtaaaaatcgggttaatgaagaaaagagggaatgaacgcgcaccaaggtggaggaaaggacttcggaagtgattaccatcaagatagggtcccatgatgtgcctataccttctggagatggagttggaaagttcccaagcgagaaatccgaagccggtaccagctcctcgcagtcggccggtctgaccaggccttccggccagtctgaccgcggtcatgtagccggtctgactgggccatcaggccggtctgaccgccgatctgacgacggtctgaccgacgcctcaggccggtctgaccgcacgccacacgtcggtctgaccggcgcgtctggccggtctgaccggtggtctacagccggtctgactgggctccagcgtcggtttgatgagagggctgcaaagggcgatgtgagggcttcatcgtctccaaacaaggttaatagagggcattatttgcctcctggaacagagccgaatcctaggtggatgcctaaggatttgacggctacgcaaaagagaaggttgcaacgtcttcgggcccaagaattaagagagaaaaaggccgaagaacagagggataagaggttcaatgagttgcgaccaccaccggtatggaggcctaagtccatagagaaggcaaaaccgattgatgtagaggagaaggaaggacaatcggttgatgaaggtaaatcgtctccaaaggaggacatggatatcaacatggtgtgtatgttgcctatggagttttgtgctatggatgaagccgaggttgcccaattctcattaggtcctaaagacgcggtttttgaggaacccgatgaatcaaaccgtcacatgaagcctctctatctcaaaggccatgttgatgggaagccggtctctaggatgctagtggatggaggtgccgccgtgaacttgatgctgtattcgctattcaagaagttggagcgtgaggatgatgagttgaagaagaccaacatgattctcaatggcttcaacagtgaaccaacggaggcgaggggtatctttttggcggagctcaccgtgggaaacatgacgctaccaaccgctttcttcatcgtcgatgtgcaaggtaactacaatgttattttgggtcgttgttagattcatgcaaattgttgtgtgccttctaccttgcatcaatgtttaatctaatgggacggcgatgatgttgaaattgttgaagcggatatatcagccgaggttgcaatggccgatgctacttttgagtggcgtcatgggaatatccaatgcttatcggggagggatctttctagctatgattttattagtatctccgatggcaaatttgtacctatttctgtaaagccggctagtgtagcacggctaagccatgtaaatttatataatgagtaaagaggctagtttagagtggttacaaaagagggtgcaagaatatcggtctacaaagaacgatattggtgaaaccgttgaagattttgatgaagtggagaagcttggacaagggtttacatcggctgatccattggaggaagtagacataggtgatggaactaaaccaaggccgacttttataaacaaaaacatgaaagccgattataaggttaagataatcgagctacttaaggagtatgttgattgctttgcatgggagtaccatgagatgccgggtcttagccgtgagcttgttgagcatcggcttccaattaaaccgggttttaggccttataagcaaccaccttgtcgttttaatcctttattatatgaccgagtcaaagaggagattgatcggtctattgaaggcggggtttattaggccatgtcgttatgcggagtgggtttctagcatagtcccggtggag

SEQ ID NO: 60107 - DNA, 6320 bp, Oryza sativa
ctatagactgacttttggtagtacaattcctgtttttctctgaaagccacaggttagcttatcaggatttgcttgcaaagctacattttgcagcaatccttctagctcttcccaagaagttaactcagcggtcccaaaagacctcgtgaacgttaaaatccatatttggatggaattatgacgaaggtgtctctcttttttgccaatgattgtccacctatccctttatttgcaacatctataatggcataagacatatatagtacaatgttttgttctcttctattgctgttctgttggctttgtgttctcttctacctcatcatgcctgcctgcctgctgaattttcttcgttggagtcttcgtctttcctggatgcatgcatatccacggctggaaaatgtgtggaatggtagaatgattggtctttttctaggtaaaatcaattcaaagtcttttcagtaactgttcaccattgacaaactgcggtaaatgtttgttcttgccgggcctttgttgatgggcgacacctcgaggcccagcgactttccttcggtctatagcctacaattgtacatatatgcacaagtcaagatgccgctacaagaaaaaaagggggcccatatcacacttaaaagcttggcctgccaataattttgatgaatgttttgttcattacctccaatttgaccaaaaaaatcagcaagaaacccatgtcatgtggtagtgtgaccaaagagctttaggtggccctgtagcagaatttggtaatcacgaatccaaatatatgaagcccaaattctcggtactgtaccagacaattggacacagaaccaagcataccatttggcttttgcaacttggggatttttttttctttctgttttgtgcagaactggctgttattgcagaaattcctgcattccaaacaggccaaggtttatactagctgtgtggaggttctgaatatcttcgtttgttgtgaaaaatcctgcactccaaataggactaggcttaaactagctgagctcaaccgtagggtgtgtttagttccacgttaaaattagaagtttgaaggaaaaaattagaagtttatgtgtgtaagaaagttttgatgtgatgaaaaaattgaaagtttgaagaaaaaattgaaaactaaacaaggactacaactaatgaattcttctaccccggaggacgctggagctcccgtggggggtttgaggggaccctttgagtcgaacttgataattgtttacatgcactacactacacaacacaggcagtactactacttaatatctactaggcaggggcggagctagtgtatactagggggtgtccaggaacccgatcaagaaaattttttagctataccttatctattttcatcatgtatacacctcctcaatgcaaacttagacacctatattagtttaaactcaatctaaagtagagtaaattaagtaagtgacaccaccctttattttgctgtagctccgcccttgttactaggcatgctgcaagcatgcatatgctctatataatcctagagcaagctgacaatgcaaccacagtacagcagtcatagcctccgattgattgtgcgcatgtcggtcgatcggcttcacgaactgcgtcgcgacgatgacgacgacgacgacccggccgatctgccaatcacatcatatcggcgcgtgctgcaggccaggctccatcgatcacacgtacactgcacccctcgcacgcacatactgtacatctcgctgttaggtcgcgacgccactgtcgcccgacggcgaccgcactggcgaccgcgatcgctggcgagatcggaatgttcccccgtcctgccggctcgatcgatcgtcccctcctcgtcgccaccgtcgccgtcgcacttgaccggccggccggccggccaatcgtcggagcaaccaccacacaccctgtacgtacgtgtcaccttcctcttgttgcctatcgcctaatcgaccaactgtactgcaagtgtgcgtgtgtgtgtgtgtgcagcatcatcgttcgccagctagctgggtcacgcactgtgtgtcacaagccacgaattatgccgggtagtgagactatgtgtcgactactgccaatcagtagggattgtctgcagtagatgtcgctgatatatgggatcccgggtccacgtgtcagccactgcgccacgggaaatgccaagcaacaccgcaactgtaggagtagatgaaacacgggtgcatgggcctgggggctagcttgtcgtctcgtcgccgatcgatgcaaacgagagatgtggcttaattcctgggcactgcagagcgtggccgttctccagtcccagatatgatgatgatgaggaaggaggaggaggaggccggcgacaaacagccagggacaagctaaggcaatggcaccagctgacacagccatctccctaccatccgtgcaccagctctcacggaatggggctcctgccctacatgtccccttcggttccttcctcctgcacgtgtgcatgcatgcacgccagccacttgggctcactgtgctgatctttttcacatgagatatatatcctattgattaagaaattgaataaaaaactttgtttatactcttttggagcccattagtaacattaaagaatcgtatgtgtttcaatctggatcactattctcgtcacgtacatcattcacacgttgcaatctgatttgtctaggatcaggtatatatatatcgatcccagctcccagctgtacttgtgtgtgcttgtgtgttcaactaccttacccaaccacccaagttgtcacttgcctcttgatgaagatactaatactagtatactactgaatattaatcattggactattgtgtgcacgtagaacaagtgagtgtgcatatacactattcttttcatctcgtattatagcaatctattacgaatctggatatgaacatatgcagattcataataatttaaaatgtttctcgttaagtattagttaagtattagggagcggagaaagtagccagtattccacgtatttggatggataattcatggttatggacggtcaagatgtagacacgttgtgacatggggtgtgccaccctgcaggtggtggtgtggtcaacaggctggttgccgtcgagctaggcgcacgtacgatggaacgacaagcgagcgtgagacgcgcagggcacgttgctatcatgcctcgcctgccccatgcagcgaccggtcgtcccgggagacgattaaattcgatctatcgatctcccaacgctctgggccggctgccgcccagctcgctgtgtgtggcatgtagtgggtggatggatttctcccacgtgtggaaatttagggttcacgattccgatgccggattgaaatccactcacgagcgatatcatcagatttcggtggaatacgttaagaaaaccgataaaaaccaataaaatctgaatattttttattaaaatttaaaattcagtggtatatggtggccaccacacgcatgccaagagaatagtagatatggaataagggagaagccacactggcttaggaggaggtagcaactagcaaatactactctctctgagttgataatagttgtcgttttggacaatgatacggtctctaaaaaacaactttgaccattattttttattaatatgtataaaagtgttaacaaatatatgatcttattaaagtactttttaagactaatatatacatgtagtcactatatttgaaagacaaatatttttaaaatgattcataatcaaagattctaaagtttgacctcacttttatttaaaacgacaagtattatcagcccggagggagtcctagctagtccgcacgcatcgtgacaatgcacatatgagtaaccaaccgcacattgctagtactatccgaaggcaaaattgccacagaatataaaataaaaagtctgctctttaatttgttggtgggcatcgtgagaatgaggctttacccaacaacacctaaaaacaaaataatttgttacatcacaccgcgaacattaaaaatacaatattcacttggttgagatgagagaggaaccacataaagtatttattttacccttgtcttagacttccttcccaattggttgtgcatggtgacggcggagctgtcttgggccttcgtctcatgacagagtggctcttgcacggtgatggcgaagtgatcttcacggtgtttgtggtagcagaaccacccccaagcagcgatggtgttagccctgaggaccaggggattgggcgattggcctcaacaatagcgaaccggcttcgagataatgccaacgaagcgactccatccgtgtggtatagcgtgcgttgcttgccatggcatacttggcacgaatgcactattgagcccactatcatcacttgttgcgtcgttgttgtcgtcgaagccgtatttggagtcatggggatgaggagctgcccatttgattgggtcaaagatcgaaccactgggctaggaaaaaagtttggtcctaggggcaaagtatccatttcacaaaaaaatgtctctcgaaaacaacaagaaatcataaaagatgtgtgcgtgtgatattcacaagtaaataaccacgtctttacagtgttcatggacaaagctacattatcacattgcctccaacaaagatcatattttttttccatggcaaattctttgaatgttggtgattgatagaacaactctgaatagttctaataatgtttatttttctatataaattttaaatctagaagtgattaattatattttggaacggatggagtaaggaataacaaaatgaattatacgtttgaaaacaaacgacctgggaaacaaagctgtagtacttttccagaggagaaatcaacaacaaagatacggttggctaaaacgacagcaaacggaacaatcatgtcgaatccgagaaaaggggcggccctttcttcctcctcctacccctctgctgctatagctgctgcatcgatttgcatatgaatgcatgcattgatcgatcctacagacagatcgatgctttcatttctcctttggattcaggcatcgagtatttggataagcttctcctgcctttttctcttgtcacagtcactgacatcgatcgagctagctctagctatgccagggttaatctgagccaaaagaatcaacacaactacagaagcagtgttgaaaaaatggggcagtgccttttgtagtttttcatcagctgcaatggagtgcaatactgcactggaccaggcagggtcatggtcttctcttgaacaaggactcatcagatcatatcaccagatgcagtcagcatctgcttcgagctgttgctgttcctgtcaggaatctgctcctttttttcactgcagtgtactactagccatgcaagagctagggggacatggagtcatggagcttttgcattctggccgtttggtgcttgtgcttcatcacattcacatgcagtttcatgatcaaatagctcagctagctgctgctgatgctgtcaccagccaatcttcagagaaagcttgcaccaaccaagcacggacttgccgatcttggagctttcctttgcaataagtttcgatgaactttttgccggtgtgacgtttttccacaaaagagaggacacgaaaaaacagcgagaaagaagatgaaaaggtgacttcaattttttgtctctgtattctgtcatgcttcatagtttatacacaaatgggagaggcacgcaagaacagcaagaaagaatatgaaaagtgtaacttaaaaaagaatgacaaagagacagtctatcagggaaaaaggatggattaattggtgcagaaacgtgaaacgaatagattgatccggtcaaaaaaaaggcctccttattgtgttgattttagccacatatatatgttcatgattcatcgtgactcatgtgtacaatcctatatgcttaatgtatcaccatattaacaatgtaaaaatggttataacgtgaaaaaaaaactattgagaaaaatggttagatgcgtggtgaagtaattaaaaagacaattctcagccaacaccatggcaaggaaacatttttcttcaacttatcaacttatggataatgtgtaccagttctcgaactaaaatttctaacagaaaaaaaaaattctatggacgttagtgttgctttgatacattaaactaagctatttgttagattaatatatagtaaaataatatttagttcatcccaatataagcaattgttcatgatatgcccgac

SEQ ID NO: 60108 - DNA, 632 bp, Oryza sativa
tactcctactccgtagtccgtactccccttatttcccctcattgctcgagttattatggcctaaaatacggctccagcgctgctgcgagctccgtgcaaggctacaatcagaatgtacattaatcttcctataggagtagtagtagaattcaaatcaaaaagaaaaaaaaagaactcttacaatgcgtcgtacgctgtacgtagttgctgtgatgcattgcattgtgcgatttatttgtgattttaatttgttttttttttagtttacgcattctttataaataatgtctacgggtatagcccgtcgacagtgacgaacatgtaaaaacactatcatgacagagtgtatgcttcggactcgaaaacaccaagcgaagcagggtgaggacataattacttttagtattttactagcaaaatgacaatatgatgtaacggatgaaatcaattttaattttacatacatacatcaaacatgcacgttggtagattagtcgaaagcaatgacacattaactaccacatggtgagtgcataaggagcagaaatttaccatctctcactaaatcgattagtccataattagccataagtgttacagtaatctatatgtgttaacaacggattaattag

SEQ ID NO: 60109 - DNA, 647 bp, Oryza sativa
tgttaaattatatgcctacgtaaaaatatatttaacaatgaatcaaatgataggaaaagaattaataattacttaaattttttgaataagacgaacggtcaaacatgtactaaaaagtcaacggcgtcaaacatttcgaaacagagggagtactaaattttaacgtcccgcctctcctaggccgggcctgctcagaacctctgaaccagcgacagtaatcgctactgaacacacccaagatactaaattgtaacgtcccgactctcccaggcctaaccagcgacagtaatcgcaaaccaacacaagtcttttctgcacactttgtcctcacttgtgcgcactcgggaacaatgtcaccggtcgggaaattgttcccaaattgtaacgtcccgactctcccaagcctgaccagcgacagtaatcgcaaaccaacacaagtcttttctgcacactttgtcctcactcgtgcgcactcgggaaattgttcccgagtgccaggccttccgaaaattgtaacgtcccgactctcccagacccgaccagcgacagtaatcgcaaaccaacacaagtcttttctgcacactttgtcctcacttgtgcgaccagcgacagtaatcgcaaaccaacacaagtcttttctgcacact

SEQ ID NO: 60110 - DNA, 7936 bp, Oryza sativa
tgcaagtagctcatcagctttgcacttcaaagttgtgttttgctcaagttttgcttagtagcaacgtagcatgccttttatttactccatcgcttggcaatttggcatgcctactgatgattatttggctttgatattttattggtcttgcattactgttactttggctggatgctgtagagtgcagacacaagaaacgacctgctgctgcactcaactaaaaatgtttggttgcactggttttatataacattgaatgacgattgaattgtggttgcgctgcaccaatttgttacacagctgttgattgcatcagttcaactgctcccaaactgacaaggagtatcacctgatttattggtggactgtctcaacctgtctcagttggaacctcgtgtaaagaatgcgacaatcgataggtataatctcaccaattgtcaaagttcagttgtaaaaccattaaacaagcttggtatgtcaaaacccaggatcaatatattctgttcatatcttagctagagcaaatgataaatgattcaatgcacaaatgtttgttcatttaccaaccaaaaatgttagaccagtgcttgttcatctatcaaccaaaaaatgagtacatgaattgtacaccagcgtgatccatcatggctcgccggcctccgggatgctttgcagcgtgggctgccagtgccgttgttggtggtgatcaaccacctcgccggcgttgatgatacccgcaatcaccttctcgtcgccggcggcggtcatggacgccatctccagcaactcctgcagctgcctcttgctgatcctgatcctcacctcgacgcccgtcatctcctccctctccggcgacccaagctcgccgtcgtctgacggcgcggcggcgcaattgcccatcttcttcttgcagtcttctgaatatcgaagaggccgttcgtgcgagagacgacgtatttgtagcttctgaagaaggcagagaagcgggtcagaaagggtggctgatgcaacgtgcaagctgcggaatttatccactgcgatacagtgcaaactctgaattccaatgccaggatagacctgctattttctgtctctctctttcctgacccacagaaactgggtttaatgcaactgttcatgcacaaatgagaaatgcgcactcaattccaaatttgtgcttttaatacttggttgttgttcaaaagtgtacattttttggtcaaaaatacctgtttcagtctgaataaaagggttgcagttctttgacggagtaaatacaaaactgggagttgcaaacccgcagccatcatcgtgtgaactttatgggggaaaaactatggcagatgcgatcaggcagtctgattttcttaatgtttacagtttagtgttgaattttattgatgttttcttggaagcatacagacatttcacagcatataaacaatgttttactaagtggtagaaacacgagcatttaacaaatcaaacaaggaagcactcgtagtttctttctgaagcatttcaccttaaacaaaagaacaccacacgtgcatctttgaaatacagcgtactttcctctgataagttgtcacaagatggtcacaagatgaaattcttggacaaggaggcaaatttgaccatgctgacaaattgtcctcttagatcatggttacaggatgaaactcttggacaaggaggctaaattgtttacaatgataaatgaatgctcagcgtcaaaaaaaaaaaaatgaatgctcagtttcaacttttactgagttgcactccgttcgtgtacaaaagttgatttattttagaacagaatgaatactatattgtattcgtcggtacccaccttaaacaataggatttgttcctgtgtgaaaggaactgttcatcatcagaaatatttgtatgcagttctagtaatctcaaagcttccaggaaagcaattatatagttggctaagcccataactgcaggtgatgtgactgtaccacctaacagcaatctttgtcagatccaatttttattcggttcaggaaaagcccatcaattcgataaccactaatcttgaatcttttgcaactgcacagtggttgaaggaagtcaaaatggttcgaatttattgtctgaaaaaaatggtgctaggatcgtatagaaggaccttgcttcgtcagatacttaaacttggaagtcttataactgggactttaatttctagtaacaaattgatctagcaatagagctagtaaaaacaatggtctaagattattgtttgcagtgatccttgatctgatgacctctaccagtatcaactcaattgaaattccaaacttgaaatagtagtatatattagaatgagcgtacactgcagtaccaaaagtgaatagtatccaatgctggatacatctgacacctgataagattaacaatccgaaaatgcaggttctttacaaatatgatgagcaccctgaaataaacaactattacagcagccacaagattgaataaactcatgtgcacaacaaactatagatctttgacattctaagaaccaagagaatcttaaatatcagcagaagcatctatgtaagaatccaacaatgcaactgattactgatcaattaaccacacttactagatacagccagtgtgtgtgtagagtctagaactgcctatacagcgaagttaagagctagccatgttcatatgcccaccattttgtttgtgccaaactacaagataagctccaatcaatggagctgaaaatgagatacagttgcagaatcataatttatgcttcgacccaactgcctctgatcaacgaatttaattgcaccttttgatccacataattgatagataggagagtaccaccgtactaggcttggtgatcagatgctagtattgccaacgcagatattatctatctttatggactactgatggaacagtagttgaagatctctgaacattaactgtttgtagaggatctctgaacattaacttgtgaaccaaataagtcaggagtttacggctcgacattaacgacgaccagtaagtagaatacagcctgcatggaaattttcagaataaacactcgtacaggtacagcaagtgacttgaatccttcattaatttcctgaactgctctgcttagtgttttctgaatttacagttaacctagtactctactatatgatcatctcacgaaaatcaaggtcaaaactacacatgagcattcagacatccaagcttcctttccctcctcccaatgacatatatagccaccgtgattaaacattattcccaacttaattaattcatccattgattaatcaagctattggaattctaaagcactactggatcgatccaaaacatccgcgatttttccctcatcccaatggtccaagcatcgatgctctgaagtctgaacttggcccaaaaaacccccacattttcagatccctacgcagcatcaatcacaagatccaagaaagagaaacaagagaaatagtgatacaactccactactccagaaacaatgaaacatgcagtgttcagatgctcgagctcagatcactatgcttcgagcttgcagcttccatgcaaaccaagagcaagctctgctcagctggcaagactgaactttctgaaacttcaccactcattctgaagctctagttaatcctacacactataatttatttggcagcaaggatcatgctcggattttgtatattagagaactatatcaatcatcccaaatggtctctgtgggggccaaccagccactgtgctgcacacatggtggcgtgatgctctccttgaccatgccaatgggagctgcacattgggtaccatttaattagggtggtctggctaattaagggagtgtgctgacatgattgcaatggcttctctttacgattattcatctccccaacttggagcttgcggctccactcaaccaatatgctgctgatactagtagatgtctagaagaaagcagcagcatcctgtatgcaaaagctttgcatctgcttgccttctctggtttttcatttgaggcaagttgatagccccctcgtgcactcacattattaaccccagtttgcaccaaaggagaaacatggctgattagattagttttgtagggttctctaaagatgtactgataggttgctacctgctagtaactttttatgagataggagatattggtgtccccagccaagtataaaaataatcctcctactatcagatgtaagacattttagagatgagcatatgagtcaagaagaaaattgaatccattttactccctcaaacttatactatcggagcacttaacattctaaacaatttttcggctcagttttataccttaaactattcacctcactcctggtatttctctctttcgctataagtcgtattttacactaaaattatgataatgcattataacactaagaccaatttaaacatcgaggttttaccaagcatataatcataaaaaaaatactcactctatcctaaattgtagggcgtatatcatcaacgactacaaagttagcatcacatgaaagtcagtagataaacaaaacttgcgcaaatcaattaagtcacttcttcggcttcttgaaaactcctatcaatgaaattgatacgttccaaacagaagtatacataacatgcactattgtctaagctcaactatacgaagaacttttgctcatggtgactttgttaatcttacgatataccggtccggtctctgggggtgcacgtataaacgtgtgttcatagaaacgagtgtgtacacgaaaaagaaaatccaaaatatgtaagtattttttaattagaagtagatgagaatgattgtagaattgattgataagagaaagtagataaaagagaatagttgtgattgattgagacgagaagataggtgaagaaataattttatttgaaataaggtagtactaaaaatagctataattaagaacagtggtagtacgtgattttcaatacatatttttccgggaaattataggtggacagtgggctggctccaccgggagaccggcggcatagtgataactgataaggcacacgcacaagcagccaagcacggcatcgggcatccccaaccccaacccccaccccacaccacggcgcaacgcaagcaattcgtccgcccgcccccgcccccgcccccgccccgcggaaccggacgccgcggcgccatgttccccgccctgtgcgcgtggccccgccgcccgcacgccgcgttgcgccttcgactcggcgtcgtcttcaccctcctcccaccaaggggtagaatcgagccacgattttggtcggtcttttggaccagtggcgtacgagctaccaccacgatgcacgcgtcggcatttatgcagaggcgcttagccagcctaccacacacgtcggcagccgacggcgtcctgatgaccactttcatgtgacgggccagctctctactcttccccccgtactaaagggacacgccacgaactccgtgatccaccaccaacgatgtcgttagttggagcttaacccatcttgatatttggtctcgattaattaattactcgtgatgatctcaatcaacacgtttgctgcatgattttgctacaggagaacgaaaggaatgaacgaacgaacggcaatgcatatatatgctacagtacaggcacagtttttctgtcccgtggcacgtgcgatttcaccgtgacatatagtattggctgccatttgggtactactagtactaaccggttgaagtgtgtcatatggaacttggcagttttgacaggacacgggcgcatgtgctgcgacgcgaacgtgggcagcacgtcctcctgcgcccgcccaacacccggtttgttcgccgagctggcacgctcaggcgttcccagctgtgacgtgccgtgacaagcttagatccttatattctggttaggtgggggtaaaactttccaggccctatcacatcggatgttggatattaattataaatattaaacgtagattattaataaaatgcatctataatcttggattaattcgtgagactaatctattgagtctaattaattcacaattagcctagtaaacattctctaattatatattaattagacttaaaaaatttgtcaagcgaattagcttttatttatgtaattagttttataaatagtctatatttaatactctaaattagtatctaaatacatggactaaagttaagtccgtgaataccaacaccaccttaatcatgcgatgtaattaaggatgaaaaaaagaaattcatgtgtggtttatcgacgcaggatgagaattatgacgagatgaggtgatcgatcgcttcatgcaccgcagatctatcaatactgccttaccagcgtttttgcccagtgaagtgaatccatgtatgccaatggaagggaaaattagaaacctaaaataaggcggaggaagacaggtttcgaagtgatattttgccgatacatttctttggtcaaggggcagttaaggcctacacataacagcatattagtttattggagtgacatgtaaggggtactaccattttagaaatgattttaggttggtttcttactttactctatcaaagaaaggaaaattgaacaagtgcaatgcccagccaaaaaagtcatagggttgctagcatatcttaggacaaaaattgaaggttgcaataaaagctcatccattacaaccagcagatatggcatcattccctcttaaactccgctttcatcctagaaaaaaatatatcggtacttttttaatggatagtagtaattttttaagtatacttagcgtcgttttacctcaactaaaactaatgttgtttcgtagtactccagacctttaaatatagaaaaccactcgaagcttgctaaaataatattgattatattttaaaatataatctaccaagaacaatatatacctttaaaacaagatttcatactaatacattttatagttattttgatgaaagaaatatatatatgtttgaactgataatgttttttttgtgtgtgagagagcaaaatgttttagtactaactatttcgccttttaaaatttttgaacgtataactttttgaagtattcagaacttaatgttccctacatggggcacaatgtttcaattagtgttccactcagatactagatcagctactgacggatttacgccattcccaaattctatcttgtattctccttcgaagccagaatgagaaatggatagtgtcggatatctcatcatttatctcttatcctattcatatttttttaatcagacagaagaacaaaaatctatttgcatatctaatccataccatagaaattaaatctaaggagacaattaaaacataaaaaactgcatcaagaaaaatatgttatattactcgttagctattttaccatgtttataagtggactcataatatattttagtatatatttgataataggggacacagtcgctattcttataccctaagcccatatttttcggtagatatagagttggattttggatagtatcgtgtatcttttttctcttccatatccttcacgtgagcttcaagtctggtgggcaaaatattcatctcattttatccacatctatttatctatagtgttattttgctgcatactatttttatcatatattttctttccaatgttatagtaagtgatctttcactgatggttaactgaaacattttaagcgcttgatttttatacttatatcgacatctatgctcaaacaaggctaattcaactcaaaccatttctctcacatatcctaaaaatcataataacaatagtactaacccataaggagtacatcaaaatactt

SEQ ID NO: 60111 - DNA, 688 bp, Oryza sativa
tactttttcttttcaaaaattcgaacagccagcgtactttgtgcatcgtgtggaggaagaataaagcgatgcaaaaatcttctatgcgcgcatatatatggtgccaaaagtgcctaaaaatgcaatcaacattttaatttgaaccgcgatcatacagccattaagtgcttacaatattacttccttggtctagggcgtgtagcaattaagggatagaaaaagtctacaagtctaatagtagttactaatgaccacattgccctaacaaacgattgcgaaacttttgaagacgatgttgtttttccagcaatatgcatgtcgaaagcaggatgatcacagggaaaaccgagagatgtgtagctcgttatctggtgagaactcccaaggctggagctgccaccgatcagaaagggtttttcagatgggcggagaggattttcacatgcggttggctggcccgacgaggaaatgagttcaccactaatcagaaaactaataaacatcacagcaaacataaatttcataagcctgctagtgttaaaacaagtaccttgaacaatttattatttataacaagaatggacttgctttgcttgtgaggaaatatgtgcaaagcttattgcatcataaaggcctcttggaggagaaattagaactttatgctgattgaaacaaatgggctgcagga

SEQ ID NO: 60112 - DNA, 867 bp, Oryza sativa
tgatcggagctaatcgacttttgatgaagtgccgagtgatctgttctccctgcaagaatcttgagggtcgggaatcccccggaagaatcttgaggttggaagagaaaatccgccatagaagaaatgagcaaataccacgatttcgtgtgtgtcgagggtcgggaatgcttcgctgaacgccggtcgccacccgataatctccttcgctgggagaacaccgtgcgcctccatctccttcagattatcttctatcacatcggagggcgcccactaactctcgaagctttctctttcttccgccatgaatgtgaacaggatggtttaatttggtccgagatatggctggagaggaatggggaatcggagcggtggacgcggggagaaattttgtgaagtttttgagggtgggttggagcagattgatgaaccctagcttcgtcggcgcggttctgtactgtagcacggagtggggaatggcgagagtctcggcggggaagacgaaatgacgtttggacttcggtgtttttagggtatcgggagtactaatgggcctgggcctgtatagtacttcagcccaattatgttttcagcgtggcccgttgtgatccctagggacttaggcgctttttgctttggcaatatgtgctcacaaagatgcggctcgatgctgttaaaatcctttttaacgcgattcaataattctttggaattattatgatgcacatgaaaaggtgcccgacagaaaggtgttataccatttttgtaagcttttttaggctacaaaagctgttaggttaatttgagatgactggtttattagtagtcattctcctagtgcttattttgattatggtaagggttataggg

SEQ ID NO: 60113 - DNA, 3645 bp, Oryza sativa
aatcacatagtcgggggctacacctaattaggtgcatctactcgatgcaccatgttttattttcgcccttcacagtcttttagcactcggcaagcctgagcaagttgaattgaagcactcggattattttttttttgtttcgagaagactatttttgtcaactgcgaaggtctcgggggctactgtggagattatggttgccccatatctgcatgacagttatactttagtcagatatacggtaccaaatatacatagaatatctttatgaggactcgagttagtttttaacttgtatgtcaaggaaatacccggggtcctagtcggttacgattgtattttatctataatcccatattccgttaggatatggactgtattttgtaaagcggattccttcccctatataaggagggtccgtgtgcctcttggggtgcgtttttcttttttccagtatatacaatcaataacacactcggcggaatcatccccggacaggagtagggtattacttcttgaataagaaggcctaaacctgtataaaattccttgtctccaaacccatccactttcctagcttgatagccacccccttttattattgccgaaatcttgtttcgacacaatccttcatctcgacataacttggtgagttcttccgtttcaacaatctacatactacctagattccattttagcaatccctttgcactatcatgccaccctctgagctgccgacgtgagcacggccgccgcctatggagacgctcgtcggcaactattctcagcaccttgccaaaggtcggcaagctgccggaatccctctagacacctcgtaaatgctctagaacccctcccctagccatgtctaactcatattacttcgatcaccaacacggcctaaccgtgccaccgctgccctagccgccaacccatccacatatcaaattaatccctccgccgccgctcgccgtcgccggagatccctagctccctccccttctcggccgcaaccaatttctccctctagcaccgccgtaatcccaaaccctagtgccgccggcccgatttggggaatggccgaaggtagaagaagagaagagagagagactgacaggtgggacccgcacacagtaacatttcacttttattttattttcaaactttagaagcccatatcttttaaaatatagatccaaatccagtgaaacttggaccaatattcttctaaaatcattctctatcttttgagcccctttttgctctttttgcattttattttattttctctatttttcatatttttggattttatttaaattccttttaaatttgaattttatatatgtctaaccctaggtcttgaggattcttctgactccatagataatatcaatcaatctcaggacatcgagcaaggcaagttaccatatacctattgatcatttaagcctatattttacaaattatttatttatagccttctattcaatactctattttatatgcacaattcaaccatagaaacccacataatttagtattgcttactttgcttacaatctggttaaaataccttatacttagattgggacagtacgtaagatttggttgatttccgggtggctagtactgtctcgatcgatataagttttaccaggtacttatgtcgaacaaacgggtacgaccgcagattctagaatggggacagacctagttattatgttaattagcaatatggcacctctatatagtggttcttatttttaagtcctcgcgcaggaggcaactatagccgcgaagggcaactttagccattaccatgtataggtaaatggtttgtgatactcgagtataaactatatggtatatttctaaaccctgatcgagatgacgtggtgtcatacgatcagttccccttaaatatctcgggaacgccagaactcctcttgctgctgttaacaatacgttcagagcataagaggatataagttcatggaacaggtgccataattgttaatgacttaatactaggccatgactaaagctgatgattatcagcaagtcgtggactgcgggtaaagcgtacatctgctgcagtagaatatctttgaaattattcgaatagccgtactcatggagttgagtaccgggactcatatggtaccctggttagaaatctaaagtctatacattttacaaattcttgctataactcttctagattgtttattactgctttttgcaaagaaccctactatatgtcaatgcataacatatttccatgataacttgctgagtgttgtaaatactcacccttgctcttataacccctttttcagatctaggtcaagaggaggacccttatgactattactacgatgaccccgataacttagagaatccctaaaggttatacctcactagtcagaatgtatagaaacttccgctgtgtattaaatagttaggtgagtacctattattgtaaaacccttagtattgtaaaactttaacgtatgcaatgaagaaccagttatattgtatgtatcaatatctactgatccagggattgatacattaattctagtcggatccaagttgttagttttgggacccgacaatagcccatgtcaaaggctaactctcggaccttatacaaccgaagcatctcaaaagggagtgggattttggctatatgtacatggtagaccataatcagagaatttcttggtgcctttttaagcatgtgcgcttgaatcaaatgctattcagttatcatgcttcgatgtgtaggaatgtattgtacaacatgagcactatgaagcaggcaaagagtatcagtaagtccagtgataatagaggtacaatcaataggccctactctactaaaaacaccttaccattgagctaacatgggcacaactggagaaacatgaattttatggaccatagcataaagcaacgtagctcatcatttcttataggcctaatattagatctaggaaacaagaacatgcctattcaatggtgcagaaaacacaaggtaggattatggatctcattcagtctagggtagccatagtcatcatggccagttatagcttcccaaaactcaactttaaccatgtgtagcttgttctaagttaagatagcatctcacatcaaaacaaagaactacactcacttgaccccaagtaagagtatactcttgcttaaacatccggaatgtaacttccttttgatatgtttacacagagcataaaaactctatggtaagaagtctacactcaaattcttgaacacggcaaaaacctagccaccccacaacattaaaaacagtatcgaacttagaatccatacctgccttggagaggagattcagatcatatacctctgtgtgctcgaagactcgctcttagatggatatgtacttattgtactccttgttgtggaacttgagttgcatctctggatccaccatacatgtggagttggctcacgtatgacgtagcatagtccatcatttgaaacctcatcatgagaggaggttcctccttgagagcaaccatgacaataacaggagtgccttgatgagctcttgattgtggcctctcgcaccttcttggatatcttgttgaatgggtt

SEQ ID NO: 60114 - DNA, 11565 bp, Oryza sativa
accaacgggacatcgctctgcaagattagtgccacaaaaaaatacgagatttctagtatttatgataaatgtaagcatccacaaccatccttctaaacatgctagaaatgaggactgaaaggtggttgtggtcctcgcacagagacgcgacactaatcgaacaggactctgggattccttaagcgagcatgaattcaggggaatttcgaaataaaaactttcatgctcatatgtgaaatgttttctctcgccctctagagtcgatgtctcaagcttgtccgaggcctgaaggttctccatctcaagagatgcatcgtgcaagaacatggttctttcttgatgataaacaagaacaacgttctgaagaccaggcggacaaggcttaggcttgatcgagggtgatgagggtcgttcggtttcatgaagatgggcaataggttcataaggaacgaacgaagatacaaacatcacctcctcgaacggctcatgcttgggatgagccttcgttttgctggaataattcagggtgtttccataatcttcataaagatcatccttgaattggaatggaatttctggaggatgaatttcctcttcctctggctccagcaaccggaatgaggattcggcagttgagttgggttccaactcctcgtgcagaggatcttcataaataatcttgacctccgggacggcttcgcttcggccgaaagaatcgttctctaagatcaaatctaagagctctcttccttcggcggttgtcttgtgtgcgaatgatccttcggcggagatatcgagatttgcggcagactccttgtctaacccgtatcgaaattgttgtaacaacacatggtcgggtaaagacaagtctgggccagactgagttaacaatgagaacctggcccaagctacaccgagatattccttctcattctgtcggaaagagatgatgtctaatcgaagattaattacacgggttaatggaaagaaagcaaggcagaatttgcacttaagctcctcccattcaccgtgaatttcatgacagacagcgtgtaccattgcttcgcttcatctttaagggaaaaaggaaacaacttccactttagagtttcatgtgtcaagcctacgatggataggcatgaacacactagctcaaagtcccgaagatggaggtatggattttcaccaataccaccagagaaggtttgctctcgaatcatggctataaagccaggaccaatttcgtagccatcggataggattgattttgaagaataggatggctcacaaagattagcccgaggagcataaaggttttgaattgtgggttgctccatcaaggaaaagaatgaaagaagaagaaataaaaataaaaatacgaggatgacctagactcggataaattagcaaccgttccccggcaacggcaccagaaatgcttgttggtatttcttacgaccacagataaatccgcaagcgcacagaataccgctgtagcacttcaccttcgggaaccccaaaaggatatcgaactcagggaacgtgtttaatctacctaaggctaagacgatccaaggacaacaattgatgataggtaggctaggctagagaggtctttctatgggttttaattagcttagataagttgaaggtaattccatatctgttgcttcgtgcaccaacccctgctggtctgccagcgtggttctgtctatagctctattatgtatctgaacgtggaggattacctggatgggattcagggctgtcaccacctgccgcctacctctgacaaatccgtgggatacacaacaaacaaaggtaatctctaacctagacaccacgtctaagatatttattactactctaatacttgcgcaggaacttccttctctatccaaattcctagtactagagcacttagtataaatactaaacaatgaacccgcaaagatggaaatctatcttacttaaacaaagtgattaaataacataagaaaggaacacgaatgcttactttatagaagaagtttctccgaatccggagcagagtataccgacagctccggtactcctccaaaattcctcctacgaagctacacttgtcgaggtagaagtcggttgagcgccaaacttccgggcactcctccagagcttcccctcactctctacattattctaatgtacaaaagatacaatagagcctcttgtaattcagctcaaagttgtgtgtgttggaatgagagtgaagacctccttatataggctccaaatgacggttaggggtatgagaaatgatcaaaacaccctgcaaccgccataggggaggaatccaagccgtccacgtgaagccagatggcgggaggcgccaggattggttcggccaaaccaaaaatccgtcctcccggcctctcctttggccgataggttgcttattgggccccccaacatcttgcacaatgttttggcccaattctaagtggttttggttgacatatgggccctccaatccgtgtaaacgcgtcctgaatgcgcggaggtgcattttttcgcatgacggatgtgttttctcctcaaaatacctgcatacacatatttcaccaacactagtggaaatgattagtaataaaccctaccactaagttggataccatattttatttcattatatgtaagtattgacggtcaaatattatgatttaaggaccgtcaacaatgggcctgcttgctcatattgtgtttgtgtcgaacttcaggtcactcatcgtgtacctacacttgaaacactcctatgcctagctacatatttgtaacatcctcaaattttaaactaaaatttgactgcatcatgctggcttttgattaaattagtgtgctttaaaaatctatttgactctttaattggttcaagtattactttcttagagccctactaatttaccctaattattccctttattccaaaccctagtgaatttgtgcaaattctcttaaatttgcaaccatagattatttccttagtttatcctaatattagtgaggatttgctatacttcaaaccctagtgaaactctttcaaatccatagattaaattcattcttttctagggaaatatttaaaaattcctgaaaacactgttcattgcactcaaggtgctcgacaaaatgcccagcccagctagagcagcccaatcaccacccaatcttgtgcaaagtctagaattgatcctaggggaccacatcccactcaaaaaccgtggtttagttggccttctcctcccccttgcgcgcgccgtcctggcggccgactttgccgcacgccgagccgccacgcgtcggtctccggatcgattgcgcgtgcccgaccgccttggcgtgccgctagccgttcgacgcccttagaccaccaccgccgcaccaatcacgacgacgacgaagtcaagatgaccaccgccgcaagaaatcaccgctcgacgccgtgcgcgcccgtccaaagccgccgccgagtacgatttcgcttctaccctaggtgaatcgcgccaattcttgccgcatggttggattaaagttagacgttggtttcccctctcacaattcaaaccattcacccccaaatcggttgttttcaccctcgccgccgccgtgcgtcgcgcccggattggcgccaacacgtcgcaatccgaattcgcacgcggtcaagtcaatccttcgccggtaagtattcaaacgtggcctcccgccactcaaattgatcttgcccgccctctcatagcctctaccgccctagccatatccaaagctcgagctcatccatggtgatgacggtgctcgagctcatccattcctcccagccctataaataggaccccaatcccttccctgtccatcatcgatcatcaacaaccataaccccacaaccctgaagctctgcttcaccaatccatcccatcaaccaccatcacccatcggtcgaacaccttgtgcgcgatcgactccacacctctctctccatcctccgccctaaatatcccttagaacactttatatcaaccatgttctagtataatagaccctaaccaaagtcctgcgtcgagttctacctcgccgtgccaagccgagcactgccgctcccgcgctgctctgttcttcgccgccgcgaagtttttccggccgcaatctgtggagattatggttaccccatatctgcatgacagttatactttagtcggatatacggtaccaaatatagatagaatatctttatgaggactcgggttagtttttaacttgtatgtcaaggaaatacccggggtcctagtcggttacgattgtattttatctataatcccatattccgttaggatatggactgtattttgtaaagcggattccttcccctatataaggagggtccgtgtgcctcttggggcacgtttttcttttttccagtatatacaatcaataacacactcggcagaaacatccccgaacaggagtagggtattactttttgaataagaaggcctgaacctgtataaaattccttgtctccaaacccatccactttcctagcttgatagccaccccgttttattattgccgaaatcttgtttcgacagttggcgcgccaggtaggggcagcgtcaagttctcgctgactaagtgcgatgggtttcgtttctggcatcgatgacttcgccttccctcccgggcaggcgttccggttcggcagcctcaacttcatcaccgacgacttcggcaagatctctctccttgactcggattcaaaccagtcggggagagaccaggtccccgtgccattcggtattccgaactcggccgaggcctactccaagatcatctctcccgagtcggcttcaaaccactcggacgagatccaatctactctttcgcgactagatcaagacgacgggtcctatccctcaatcctgatgaaacttccttatgatttggccgctatcttcactgccaagacatctcccactcgaagatctaggcgagctccggcttcggccccgatccaatctagatccagagaggttggcgttatactccaacctcttgggacagtatcgacggaagagttggatggttaccttagctcccccggcgtcagttctcgaccaaccgagatcctcgactacgacgatttcggctaccactacgaccatggcgacctcgacaacttcgacgacagttatgaggataactacacgcccctcttcttcggcgtattcatggctgacaacgaaacggaggaacagcgccaagcccgagaagcggaccaagatcgcgcacggcaagaagctgaacgtcgccgactggaggaagagcgacagcgacaggagcgagaacgattacagcgtgagcaacaagatcgcgaacggattgcaaaggaggctgaagatcgacggcaacgcgccttggaatctgggcgccgagcgagagagctcattgggctacaagacgtcgatggaacagcggtctttcgcacccccagcagaacgcggttgcagcaattactctcctcgacaccctcctctaagaaaacgcactcaaccaagctgatcatgttgtcaacatcttgaaccagacgaagaccatgatcgctgcctcggttccagccaactccgcaagcacccgcaccccgactggtagccgagttcctcacctccgatctcatgattatcatcagccaagcctcagcatcatcggcacaggatctagtcgcaggagcaggggtcacgacgaacgatctgttcacttgcctcccgaacgtcacagggagcgccgagtcgaacggcctcgctctccacctcaccagcgtcccgtcgaccttcgcgacacgatcaaccagcgccgtgcagcacgaggtcaccgccattcaccaaatcgctacgacgacgacgtggatggagtagctgccttcactaatgacctgcgtggagtggattggccagccagctttaagccgactggaatcgagaagtatgacggcaccactaatccagagtcttggctcaccatctacggactcgcaatccgcgcagcaggaggagacaacaaggccatggcaaactatctacctgtggccctagcggactctgcccgatcctggctccacggactaccccgtggcacgatcggatcatgggcggaacttcgtgatcacttcatcgccaacttccagggcacctttgaacgccccagcacacagtttgatctctacaacgtcgttcagaagtctggagaatcccttcgagattacatccgacgcttctccgaataacgcaacaagatctccgacatcaccgacgacgtcatcatcgccgccttcactaaaggcattcgccacgaggacctagtcggcaagttcggacgtaaacctcccaggacggttaagcaaatgttcgaaaaagccaacgagtatgccaaagccgaagatgctattaccgcgtccaaacagtcgggcactacttggaagccaaagaaggacacgccgaccgcaggagggagtggaagcaacaaccacaaggatcgcaagcgtaagcccgaagaacttgtggcgaccacctctccatcttcccgacaacgttcccgcgtcaacaccttcgacaagataatgaactcccaatgtccgcatcatcccaactccaaccacgtggccaaagattgcttcgtctacaaacagttagcggagcaatacgtcaaaaacgcacgtaaaccttcagacggagatcaaggcacatcaaagaagaaagatgatgaagacgatgccccgactggttttcaagatcatcgcaaagaacttaatcacatcctcggcggacccctggcttatgagtctaagagaaaacagaagctaacagaacgggagatcaatgcggttcagcctaacacgccccaatatcttcggtggtcagagatagcaattaagttcgaccgctcggatcatcccgaccgagtggtccacccggggcggtaccccctggtactagacccagtggttcgcaatgtcaagctccgacggactctcatcgatggtggcagcgcactcaacatccttttcgttaagaccctggacgatatgcagattcctcgcacggaattaaagccgagtaatgcacccttccacggtgttatcccaggattgtcagctacaccactcggccagatcactcttccagttacctttggcactcgggagaattttcgcacagaaaatgtttgtttcgaagttgctgatttcgagacagcatatcatgctatacttggaggaccggctttagctaaatttatggccgtcccacactacacctacatgatgattaagatgcctggtcctcgaggagtcatatcactacggagtgacatcaagcaggccgtcacatgcgacaaagaaagttgcgagatggcccaaacccacgagactactctcgcccgcgaagagatccgactggctgcgaccatgggaagcgaggaagaagtgcctgcaaccaagctgacgaagaccgaagaaagtgatgccaagatgaaaaagattcccttagatccctccgatcctgataagactgctgtaataggcgttgagttagattgtaaataggaaagcacgctcatcacctttcttcagaataataaagatatttttgcatggaaaccatccgatatgactggtatccccagagaggtgattgagcactctttacatattaaggaagacgccaaacctatcaagcaacgactccgccgttttgcacaggacaggaaggatgcgatcaaggaggaattaaccaagctgttagcagcaggcttcattaaggaagtccttcatcccgactggctggctaacccagtcctggttcggaaaaagacgaggcaatggcgcatgtgtgtcgattacaccgacctcaataagtcttgtcctaaagacccttttgggtaacctcgcattgaccaggtggttgactcaacagccggctgcgagttactcagtttcttggactgctactcgggatatcatcagatccgactaaaagaatccgactgcttgaatacctagtttattacgccctttggggcctactgctacatcaccatgccctttggattgaagaatgccggggcaacctatcagcgtatgattcaaagatgtttttcaactcagatcggtcgcaatgtcgaagcttatgttgatgatgtagtcgtcaagaccaagcagaacgatgacctgattgcagatttggaagaaacttttgcaagcattcgagcttccaggatgaaactaaaccctgaaaagtgcatcttcggagtaccgtcagggaagttgctcggatttatggtatctcagagaggcatacaggccaacccggagaaaatcaacgccatcctcaacatgaaaccgccaagctcccaaaaagacgtccaaaagctgactggttgcatggcggtgctcagccaattcgtctcacaactcggcgagcgggggatgcccttcttcaagttgctgaagaagactgacaatttccagtggggacccgaagcacaaaaagccttcgaagacttcaagaaacttctcaccactccaccagttttggcctcgccacatccacaagagcctctactgttatatgtgtcggcgacctcccagtttgtgagcacggtcctggttgtcgagcgtgaagaggaaggccatattcaaaaagtccaacgaccaatttacttcgttagcgaggttttagccgactccaagacaagatatcctcaggttcaaaagttattatatggtgtcttaattaccgtcaggaaattatctcactactttcaaagtcactcggtcacggtggtcacatcgtttccactcggggatatacttcataaccgcgaagtgaacggacggattgcgaagtgggccttagaattgatgtctttggacatatcgttcaagccacgaacttcgatcaagtcacaagctttagctgatttccttgccgagtggaccgagtgccaagaagacatgccagaggaaaagatgaaatattggactatgcattttgatgggtcgaagaggcttacaggcactggagctggggtcgtcttaatttccccgactggagaaagattgagctacgtattgtggatacgtttttctacgtcccataacatggcggaatatgaggcgctactccatggattaaggattgcaatctctctaggcattcgctgactaattgtccgtggagactctcagttggttgttaatcaggtcatgaaagagtggtcctgtctagatgataatatgactgcttatcgacaagaggtacgcaagttagaagacaaattcgatggactcgagctcacccatgtcctccgacataacaatgaggcagccgacagactgccaattttggttcaaaacgggaagcagctccttcagatgtgttcgtcgaacatctttacgaaccgatcgtgcccagaaaagagacaattgaagctacggatactcaaggcgtaagcatgatcgaagctgactggagagaaccgtttataaaatttttgagcaaacaagaactccctcaagacaaaaatgaagccgagcggatttccaggcgcagcagactttacattattcatgagggtgagttgtacaagaaaagtccatcaggaatactgcagcgctgtgtgtctttggaagaagggagacagttgttgaaggatatacattctggtatttgtggtaatcatgctgctgcacggaccattgtcggcaaagcttaccggcaaggttttttctggcctacagctgtgtccgatgcggacaagattgtgcggacatgcgaaggttgtcaattctttgccggacaaactcatttgccagctcaagagttgcaaaccatcccgttgtcctggccgtttgcggtctggggacttgacatggtcggcccgtttaaaagggcagtcggcggttacacgcatctctttgtggctattgacaaattctccaagtggattgaggctaaaccggtcatcacgatcacagtagataaagctagagattttttcatcaacattgtgcatcggtttggggtacctaatcggatcatcactgataatggcactcaattcactggcagagcatttaaagacttttgtgaagacttcggcattaaaatttgttacgcctccgtggcacaccctatgagtaacggacaagtcgagcgcgctaacggcatgatacttcaagggatcaaagcacgagtttgcgaccgactacgtccctatgctggcaagtgggtagatcagctgccgtccgtactttggtctttacgcactactcctagtcgggctaccggccagtcaccgttctttttggtttacggtgcagaagcaatgttgccaagtgaagtggaatttgaatcactacaatttcggaacttcaacgaggagggctatgaagagggccgagtagacgacatcaatcgactagaagaagcccgagaagcagctttaattcagtcgactcgatatttgcaagggttgcgccattatcataatcggaatgttcgatcgcgagcctttttagtcggtgacctggctctgaggaaaattcaaacaacacaggaccagcataaattatctcccttatgggaaggaccgttcataattgctgaagtcactcggccgggttcttatcgactcaagcgcgaagacggtactctcatcaacaattcttggaatattgaacaccttcgtcgattttacgcttaggcatttcatttgtatctttcctctttgactgctaacttcaagtttttccttgaagttttcagtcagggggctactataataataatggagtgtgatttttatcaattcaatttgcttacttgatgtatcattgccctgtttgatttcttggcttagtcaatgaggactgaaagttttttaacaacttttgtgggttttaggctcaacaaggtttgacaaaaacttttaagaaatcaggaactaagttaagatatcaagcacaacataaattcatcagtattgtacaaattgtgtctccatcatcattaatcatcaaaatcattggtacattaatcagtattagtcttttcatcatcagaattatcaggaccagtcggtcgaagatcggtgtcctgaaatctctcaactacatcaactgctatcttatcagcagatttttgtgcatcgctgatgaggtcaagagcagctccttcgctcgtcccgtctgcaaagtcatcaacggcatcaacgtcaaccctcggataaagagttttggtcaccgcgaacaccagacttgctcccatacttccagcttctttgatgctcttgaaatatgtatccggagcaactctcagcttgtcgaaaatttcagaagcatcaagtgcactcgggccgttgttattgaagaacatcgcttgaacaattggggcagcagcgttagcaaccttatcccgagctccttcaacttttttgatcttgccaaccaggacgtcgaattgagcttgagatttcatcttg

SEQ ID NO: 60115 - DNA, 8034 bp, Oryza sativa
atgatctcatgaactttattaaagtgatggatgcatataatgaagcaccaaacagctgaacatgcatcaaagttaacagtcataaaacatctcagattctcaggaataaaaattttggtgcatttgccctggtaaggcatttctgtactttcatgctgttattgatgagaaacagtcgagagaggaaggcatgatgcatgagaaacctattgaggccagtgtgctgatatttacattctgctgcagtgctaactatacctggtattaatttaataccaaccaatactattgtaacagttttatatccccttggatgcttggcccatgggtgtcataggacagaaggtaagatctagtgctgcaaaaggggcagcaatcgatggtggaacattaataatgttggttctgcatccttaactatggttacaatgaggttcagacatagtagctgtctcattggggaacagtcttatgaatttcacaattattcaccaaacagtcttatgaactaaatcactttatcaagaacttcctgcttgtgtttacctatttagtacttcctaaagtactatacataaaagcaacagagggcaaagatgaaagaacaaagctaattcttactagataaggaaatgacctaatgttgaaaaaagttgacatggatcttgcttcaattgttgcagaggatatgattagacgcaagtcgggccgacgtcgttgaatctggtatatatgattatattcatgtaaatatacaagcatcgtgacagataaaatattattcacacgtgaagatatggaaagatcagactagcacattccaaagatgaaaacctttttcagaagacccagcaacatgtcagttgaaatggatcgttcatgggcttcatcaaccataattacactgacaaaaaaaaagaggattagtgtgtgaatcaaagaaactaaaccatgcaagacaataaataatacagcttagtcatgcattttcttaaactagaaaaagggtttaataccactgaaaatatgtcactcaaagtatttcactcaaaacttgtgcaattggatcaaacatggttcaataatcaatacaaatggacagttgactacttgaatggccatcttatgatcatgtcgacgttgagggtgatataaactgatacctatacttggtcagaagaggatcttccatcatttctctgatcaataccccatctgtcagaaatttaatcatggtcataccctgccaaaccaggtatgtaaggaataagcagactaacaggagagagagagagagagaaaaaacaattttattctaatttgtattgacaaacggtgaaggaatactgtagatatacaacaatgcttcatactgcagaatccatataaaaaaaacaggcataaaaaggaaatgggtcatactggatttgtttgatcctcaaatcggattgtgtaaccaacttcttctccgagtctcacacctacttcttccgctactcttgatgcaactgactgttcaaattactaacattatgagttggaaggcaattatcagataaaaaaaagaagcatttgcaggtgcaatctaagaaaagtaaaggtctatcagaactggagcatgaaaataagaatgtcatctacgaatgaaactgtaaaaaatttcattcagttgacatcctttaagtcagtaaacatgaaattctatccactaaatgatctagaatggaaagtgaaactgtaatgggcatgttaagggttggcccataggcctagtcaaggtgttcctggacccaagtggcatgtctgcatcatggaggcattgacaccgcaagggcaatgaaaagagatggaacatcagccttatatagaaggggtgacttgacccttcatacactcatcttttaaattaagaaaatgcaaacaacaactcaatataatcttacctctaaagatcaaatccaaatagggattgtgatcattaaccacatggacaactgttgcaaacagtctaatacatatgttcgataagttattgtggaaatgtgagacatactgcaaaaataccatctctaatgcttaagaagaatcttctagctcagatgccatgtttatttgaactattggactacacatgcaggtatttccaatgaggatgagtcaacagagcacaacagtggcatggtatgagatcaaagtgaaatagttctctgtagccaagaaaaaataatgtcacatgtcatcatcagatggtcaatcagaaagacatgattttgtgtagaatctagagacagctgcaaaactaaataaaggttgcaaacactggatacctgcacggccaatcgtcttggttgagtgcagcctataagtcgaccaccctcggcccatccagcctctttaaggtactgataaaagaatacaatgaagccagaaatgaaaatcatttgccagtaagatggtgggaaattatgtagtgctgattcaatatacaatgaagatggaaagggaacatcatccgccagaagacaatggcagattatatgttgtttgcagttttcatgggcttttaaagtaagtaacatttaaacaaattcctctaggtgatttgaaggccattgttcatgtttactatgatatgtctttatattgatatatgtccctagaatatgacatacattaacagaaggtgaatataatcaaacaatagcaccaaagtgattcaattaaatgcagaaagcaggaaaatgaaactggagatccaagccatagcacatgctctcatccagtcaagcacccagagctcatagcataggccagtcttgcacacaaggtgtttttactctcagtctctcttactagggaacagacatgaggtattcggtggaatcaaaacgaattagtcagacatgacatgcaagtattcacaattttgaaatgtaaccttccaccatgctgcctaaggcacccagacaaaagtgcatgcaggtgcagcataaactgcggatgcaactacgtatgcaccggtcgcacgcaagcaaacccaggtgttcgaccaaatgcctcggacagatctctccgcacaccaagaaaatcgtcccagtggcaactgcaatgggaaaccgagagccattcatacgcctagaacacatacctgagggatctgcgtggactttccgctgccggtctcgccgacgacgatggtcgtggcgtgccgctccaccaggtagaggatggccttccggtacttgtacaccggcagccgctgccgctgccgctccaagctcgcgtacccaaacctaaaaccaaccgcggcgagagcagcggtgagcagccacaccttcagaaaccgcgagtagcgcgcgcgacaatgcgagagggaagagggggggtttagtttagggtttgggggagcacccggatgaggaggaggagctggtgcttgtgggcaggaagaggacgccgccctcctcgtcctcgacgatcgccgccgtcggcttctccgaccccggcctccagaacctcgacatggcacgcgccgccgcttctcgtcgtcgccggtggggaagaccgtgtgtccgtgttgtggtggatgggggagcgatagtgtgggaggcccgcccactgccggtgcttcaaatgggcttttgatttgggcccaccttggatgggctattaggctttggaatgaagaacaagtctattttgcttgataactctatgctcccgattaaatcgtctccttcaaccgcaatactggatataactccacgtttatctccgaaaacgaaataatttgctttggtttcaaagattgaggaggcgttatatccggtattgtggttgagagaggcaatccgatccggagtaaaggttgagtgtggtaaaatagacatatgaggattgttgcccggttcctgaggattgatgggctaaaatcaaacctcacacatgcgatggtgctgggcttctggaaagtcggttcgattcacagcccaaggcagccaactgaatgtgctacagtggtgtagcttagattgttcctaaattttcttatcacacagtagtcgcacatgcacaatatcacattttgacttgtgcaaatacgctccccaacacaaacttaaaaagacgaaatcccacgatatatcattgatctcactaaaatcatattaaaagcccaccttcataggtgtagtcatacacccacaactccatcaccatattactattacttctttagttcgcagtgacattgttttcctctcaccagtaatcgataaaaggtgaatgccaacggctaaaaggtaggagctgtactagaataaagcacctcgacaacatccatgataagccatgaattcgacgatccactctattctctttaatcatgcactctgtatataggttccttgctatcaaaagtacatctatttgttccaatcacaggatcgagttaatcgtccggaagggctggcctcgtaatcgtaggttgttcgtgtcgatcagatcatatcgatcgatggattgatcgagcggacgtatccaaaggcgacaccacccccaatttggtgatcgaggttccatgcatgcacgtctcatcatcgcttgctttccgtccatgcacgacaaaagctgaccaaattaatcatcaatacgtacatctctggggtcaatatatgcagatatgttccgagtgccgagccattctgtctcaactctcaacccataggatcaaattaggaacataggtctattctaaagatgttaattaagctgcgttcgttcatcacatctcccctcctctgttccatctttttccttatttttcctaaacttttaaagatatacgttaataagttgtttcgttttaggtatgcatcctaacccaaactgaatttctatcggaaaaaaaaacccaaactgaattttcttaatcatcacgtgtttttcacgcttacctctcatgctcggcgctttctctcccacgtgtctcttcctctcccccagccagatctggtcctgccgctgccaaagctgaccggcgtttgcgcggtagccaggacggtggcggaggggaagtgggaggcagaggtgcggcgatggcggccagaggcagccggtcctgcgcctggccgtgtgggttggggatggctggaggtggtcaggagggcagcgggaaccggcaaggagtcggcgatggagtccctccggacggcggtagggacagcgaagcacggcggaagatggtgacggcgctcggcggctacggcagccctaggggctgcggcgtcccaagacagtggcagtctgagcactgtgaatccgataaagtggaagctgatcccatcggttcgtgtatggttggctagtttcagctaaacgacgaatgacgacgcatgaaagtgggctaactggcggcatgtggcgtcagcttatctgaaatggataaagatggcaccaacggaggtttacattgacggcgcactaggggcggcggcgactagacgactttcactcgtcaaatcgggctgtttcaggagaacaaggtgggacgtagagaaacaaggatgtgtcgaggttgtatggttttcttttcgttttttggttgtgtgttttcctccttgttgaggtgtgagtctaaatactcacgtatcattttggttgtgtatattattcgtggatatagaggccagattaataaaaatttattataaaaaaaatcctaacccaaactgccgaaaacggctttagggtgtgtttgaggagaaggggattgaggagattgggaagataagcaaaacgaggtgagccattaactcatgattaattgagtattaactattttaaatttaaaaaatggattaatatgatttttttaaagcaactttcatatagaaaatttttgcaaaaaacacaccgtttagtagtttgggaagcgtgcgcgtggaaaacgatgtgcattctcactccctatcatccaaacgaacgcagccttagagcatctccaacaggatggctatttttggctctccatttgtctatttagccaactaaccataaagattcctctcccaatctgcgcaaagactctctaaatcctaatggctagtttcctctcaaaaaatccatatattgcatttagttcacacataccatatccatatattgcattggtccatacattgcattgcattcagttcactaaattaaaggtccatacattgcattgcattcagttcactaaattaaaggttcatacattgcattacaaaagttcactaatttaaaagtccatacactacactgcatacattgcattgcaatcagtccagtaatttaaaggtccatacattctattacaaaagtcaaataatttaaaggtccatgcattgcattgcaattagtccactgatttaaaggtccatcatattgcactgcatttagtccgtagcagtacacaaaagtttagaggtgattaattttgatgcaaataaagataccccacttggaatccttaaaccgcttaccaaggatttcagcttgcaatgagtcatagtacattttccttggtccagtcaagcaaaataatgcagttcatacaaaatcaatattgtgagcaccatgcttctccacgcacttgcaaacgcaaacactataacaacaaggtacatttgatgcacacatatttctttcgatcttcagagttgcacacattacagagcaaatacacattacagttgcacacatatttctttcgatctttcgatctacagagcaaatacagaggggattttcgatctacagagccaatacagaggggaaaggagtggtggatgggggttttacctgctttgctatgggcatcggcagggtggtctcagcagggacggcggcggcctcagcaggtcctatcggcagcagtcaatggcggcttcggcaacaaaagtgaaaagacgacggcggaggggcggccctggtagcagaagacgacgacggaggggtggcgcagaggggcggcgctggcggcaaaagacaacggcggtggtcgacggcgtcttggcaacaaaacacaacggcagaggggcgcccctggccgagaggacgccggcggaggggtggcgcacaggggcggcaccggcggagagatgcgcgcgctggatctgggggaagggaaaaacgcgatctgtggaagagaggataggtgggagtagtacacgtgcgtgggcccacgaatggctaggcctttttggctggccaaatttggccagtgcgagcagcactttgtccagccggatggcttggcttggccagtttgttggaggacaaattttaattaaaattgtcaaaatttaatttagagagtagactaaggaggctgttggagatgctcttagtagtagtatcgaacatcgggacataccaaacgagagggattttggtcaaggatttactaaagtagtagtagatcatacgcacacgtatataaacagatccatgaatccatatccatgcatgcatacatgcaccgtcatcaggatattccaactcttttggagacagggtacgtgacagggcccgaaagcgatgtgcctgcccttttttaggctccggccggaactactagcgtagccatgcaccctcgtaaccgagcgacgagatatatcgatcgcgatgtggatggtgccggccgtcgccgtcgccccggccagccgcctgcatatatgcagctgctgctgcgcgcggtggacgcggctcgtgcatgtggtgtcgcggcggtgtcgggccggtccccgcgcgcccccgcctccaccacggcaccaccactccggtttgcgctgcttgtttgctctccgctctcccctaatcatctccacatgcgacttgtacgcacgtagagtaggggaaatttactccatcaagcgctacgtgaagcaagatagtgaaaatacgatccgattcgatgttatctcgtttcctatatctcgtagaaatagttttaaaaaaaccgggaatgctcattggcgggcgtccggcgcg

SEQ ID NO: 60116 - DNA, 803 bp, Oryza sativa
  unsure (1)..(803): unsure at all n locations
ataagttgcacatgagctccgcgtatgtttgtattctcaagcgtgtcttcttgccagcttgccgctggtctgacgcnctggtatcaacgattctgctggtttggtaaataaatctctcggtttccctcaaaaaaaaaacgcctgcatatttcattcctcacttttcagagaagccacaaccacaaaccagcagcgtgaataatgtttattacggagtaatcactatttccatcagctgacaactttcgatactgaattactgatactcgttcagtctcctgcatacacattacagataagtactgtagtatttttgcatctatgtcatttctcaattactcctagtgccctccattgctgagcggtggaaccttttttttttttttagagaactctgagcggccaatctatccatcgttgtcctctgcgccagatttgggtgccactcgacttttgggtggtggatctatcacgaacagtagtaaccttctgatttgccttccttgaacctctgccagcttcaacttaattatttgtttctttccaaaccagcctccctatagatcagtagctgcaataaaattgtaaacattagccatgtgaaaagtatatcagaaaatttatcttcatatgtagcttcataatattgtataaatttacaatatccaccaacataaaattgtagaaattaatcaaaattactggtaccaggatggcatgtatgtgtaaacagtgtaattttcatttctattatttatacaagctctagttgaataatacaggtgatgaactactgtaccatc

SEQ ID NO: 60117 - DNA, 787 bp, Oryza sativa
caactgatcgatacagttttcaaccagctagaacctactccccccatcttataataaatttatttttgactcctcatttatcctaaaataaactcattttttaagtaaatgtatcagagtttgtgaaaataagaaataattatattaaaaataaataaagtgaagaatatctatattgagatttgataaagtaaaagtattcttatcttttaagttttgtgttgatgtgtgagataggtgaaaaaataatttattttggaatgaaggaagtattagagaagcttagtgatccgataacaaccgtagtcaactaagaaatcttaggttacatccttgcccaacccaaaagagaaaaacatcgagtgattcaaactgccacgttatcaaaagatcatactcatagagtacagatcctgagacagagcatccttgcctgataaagttccattttaagctgcaaacttaggcataaaccagagctttatataataattctctgaatggacttgaacattcataggtcaaacgtccagcaatcacgtacacctttcttctccagactgacatgaagtacaatggaaaggagtagagcataagcagctgaatattacaatgatgtatcattgccaatcacagatattggttccattacgaatgatgaacatgaaacacctgatcatagcttgatgtgtattgtttccttaaaactcatcatgatcatcaagcaactgcgcagttatgcatgcaaattctttattgcaagtatgatgagattgaacactttctg

SEQ ID NO: 60118 - DNA, 10905 bp, Oryza sativa
gcgcgccctcccccacgtgcgtacggcccacctacttctctatctcattttttcaacaaaagatgtttcaactagtgtatttacaatgtttcactatttatagatataatgttgcagtgaattaaaatactcttttacaataaaaactcacatattttgaaaattctctattaagggaatttggtttattttttgttctataaaaaatgtttcacctagtgtactcacaatgtttcactatatataaatctaatgttgcagtgaacgaaacattctattgcaacaaaaaaacccatatattttggaaaccccctattaagggaatttggtttattttttgttccaccaaaaaatgtttcacctagtgtactcacaatgtttcactgtgtatagatctaatgttgcagtgaactgaaacattctttcgctatttgctgaaacattgtttttatataaggtgaaacaacacccgatttaaacgagtgaaacattttcgatctgctcagtgaaacaattccgatatacctagtagaacatcgtgcaacatttaaaaataattcaataataagttaaattttttttcgtcggaatatatccatgtgtggtctgttttgaagatttaattgtaacgaatttaatggtgcaattggatcatgatttggataagtaatttaagagaaaaatcattttaaagtagttttgcacgtaaattgggcgctgacgtcagcgcccaattttaacaattttgcatcgggcgctcgagcgggaggcgttcactaaaaaaaaactgacaatatttaagtttaaattttatttttataagttttaaattttttttaactgcctgtatatgctagagtttaaattgttcttctttataaatggtggtagaagttaaatttaaacgtgcacatttgtgtagtagagtaatatatttattttaatttataatgctaattttttattattatttgaactatttagaaatgagaagtctgctgcaaaacgtatctaatcttctcgggtccggaaaagagacgcagaattacgttagcatgcacaaccgcatatctacaagcgactctgcaaggctctcagaatcaatcaggccgtaccatactatcgtccttgaaacctgctgctgtctattcctagatctgcacggtcatggccccctctgttcttaaaaaaaaaagtttactcgcttttctgtgacagtgacactggctgccccaggacattcattcatcttttcctgtgcggaattacttgcagtggttatcgtgacactggaactttcttttcctgttcctgtatgcaacgaattactttctctgtaaatttcttaatagaattcgttaaattcctgcgctgctgcttactacttactccgtacttcagctcagtggatatgtgaacagtgaactaaacaagaagaaagagtgaattcagtgatttatatattaccagcaaacaactgctcaactccaaaattgcagtatgaggaggaccaggaggttgtacatggtacttggtcataattcataacaaatcatttgcttgtagccaaaatttgaattttgaaacttaattttagagttgattttaaggattttttcatcatattttattttctatatgattggtttttaaatcaccaagaatttaaaataaaggtcttattcataacttatttctagttaattattcaatttttaaggtttatcagttgtgaagcagatgatgagaggccaaacctattttttaagagtaaatttcataaaacaccacctattatgatctaagttgcaaaaagacacaaggattttggcacgtgacacataactccgggtattatatttctaaagtttcatgaaaccacatcgttaaccatttgacatactcatgtattaaatattttaaaaaatatgtaccatttgacatcctcataattttgaggtgtgattgtagaactcaaaagtatgatagatcaaagtcaaaataattaatagtatggtctcgtgaaactttaggaccataatacatatggtaatgtgccacatgccaaaatcccaatagttttgtgcagcttggattataataaatggggttttatgaaatttacttattttttaatgatagtgtaagggtgaaatttcaccgagatatgaaagcacaaaataaatataatgcccataattaattatgcacataaagtgttgtatcttcaataagattttagagaagtcaagggtttattattgtccgtacacatttttttaagcgtgtatttaagaggacacaccagtatttgtacatgtacagtgttatgagagtgggcagatacgtccagtggtgttcccacgtatatacttcttgggtcacaggactcaatgtagattattatattctaactaaattataccatgttaattattaggatatcagttagtaatcatataattagtattagtatgtattattggatccttgcataatttttattttaagatcatcgctggattctcgtcgtatatatatgtatggtagtagtgcatcagtttgtatcaacgagtgtaagctcggcgcctccagcctgcaggtgggccagctggtggctaggttgcccaaactcgtttatacagcctccggtcccatgatcgatttaaatcagcctgcgtcaacagcgtgatgtacacttgcacacgtataggtacgatctgattgagaccgtgtatcatatatactctctctgttttaaaaaaccaaatttagtactagatgtacttcctccgtttcacaatataagtcattttagcatttttcacattcatgttgatgttatatgtagattcattaatatcaatatctatatgagaaatgctagaatgacttatattgtgaaacggagggataacatattatagtacaataaaattagatagagatatgtccagatttatagtgttagggatgtgttacatctagtactaagttggttttttataggatgaaggaattacgtacgcatacatgtatagcatatcatcatacgtatagttgggctgtacttgatctgaatcgtgaggctgggttaggtgtgcatctctactcatggcattttttcaatcataggtatgtagagaggggtaatgcagctatagctaggagagtacgtacgtggtgcgaaacgtacctctcgtgtatatggcgccagctgtggcatgcacgtgcatgcatgggatggattggtgtctcgtattctatcgatcgaacgatcgagagcgacacgcgcgggagatgattacggaacatgcggacggttccgcgcgcaattgcgatcggtcgatcatatgcagctgctggtaggtgggcgcgcggcgcgcccgtggcggcacgtgagacgccacgacggccgtccaattaattcccatgcaagacatctcgctaccactggttagtggagtactacgatcaaaactcaaaagtgtccagttacccccgaagtatatctcgatgtagaaagtgattcatttaattatttaattcttacggtaaaatggattttttagtgtatttgacagaagactaataacgaatgataaaaagagatgaaaagaaaaaaaaagataatataatgatcgatgtgccatgcattcatatatttaatttatactgtaagatggaattttcgtatgtatagtatatttgatagaagactaatgacgatgataaagggaaattaaagaatagaaaaaagataatatgaatatctcatccaacggtggagccaattagccaaattcccggagtggtcaggcggcggccacctagactccactactgttacctgactggcaatggcctacgaattttatttttttttacggcgcctacgaaaattaattgatctcactgaaaaacgttatttgtcgtttggctttgatgatgccgttagattcgacactggtcggtgcaacaaagcctatggtaactaggccttgatccctaagcatgtctcctaaatctctttccaacgtcatattaaaaatactcctatatacaatacggagtataaagatataaagcaagatgcatgcgttgttaaattccagggttcgctagtttcttggctttgcccctgctctcaaggagtagtacaacctgcatatttcctttgcacatgatgcaacacacactagctccatcccagagctcccaaccactgcgggcggcagccaataagggcgcagcaaatgcagaaacgagggcgaggcgaggatacaaggcaaaagctgaacacacaaccctgcagctagctagcatacatgcatggaagctcccaggggcccacatgctagttgctgcgtgccggtgagtccatcaatgcatgcacgccatcgaaacaaaaaaaagacgacacgtagtaggaaacaacgggagcacactagcacaggcaccagcaagccaatcgaaaatgtatatataaatatagtggtttcaaatagagaaaaggcctaaaaaaagggaaaaaaaggggtaaaatatagagctagcattgcatgcatgtggtgcatgtggtggatcatgcatgcatggctataacagcttgggagttgggaccaattacacattgtgccgtggagggaggattacaacattggtgtgtgctagctgccacaaagaatggcacatggagaggaaaaccacttaataaatagtactagccctactaatatacatctactatgcaatggccgcccgtctactacgtactcctatatatctgcagcgtcacctggttgtagaatcgaatcacaagaactaagtcaaccagaggggggtgaatggttggtatacccaaaaaccgaaaactcttagctgaaataaaagttaccctcaaaatcgacggatcgcggtctgaccgaagttgtcttgccggtctgacagcctggttgccgtcggtctaaccgagattatatctccggtccgaccgccgagatcagctgcttctcgctgtcgctgccgtcggtctgaccgccgcttgccgctggtctgaccgccggtagatcgccggttggaccgccggaacccggtaaacacaaatcgaagaactcttaaagtagatgacgactttattgattctctctgtatttacaaagtgcaccaacagcactctttacaaaaatttcgactaaactcgaaaccctaactcaaaactcaactcaattgctctcaaaagcgataccgggaagcctcacgctccccctctatttatacatgaggtaggcagcctaaagccacgaaccaaactcatactaagagttctaaacaccttaggaaaccctctagtacaagaaagaaactttacataaccaatcgtaccaaatttggactccttccaaattcgactccgcatctcatacgcacacaataactccatcgtatgccatatggaatctccatcaaccacgtgcatcaactctagcctaagtatcccgcatgatctctgaccaccacggacgtcgtcttatccccaaaccgactcccggtccatcaccgcaaatactctcccgaggcatcaagtcacctacattagaataaacaaagaaaccatattctgagaccaagctatctccaacttgactcattagtagcaaacaacagtattacatacatatagtatccatctagaagtcataatcaagaaataaactcggatatacaaacaaacaacccgaaaccaaaaccgacacagtgtcggccggtcagaccgcgggctgcgccggtcactcattagtagcaaacaacagtattacatacatatagtatccatctagaagtcataatcaagaaataaactcggatatacaaacaaacaacccgaaaccgaaaccgacacagtatcggccggtcagaccgcgggctgcgccggtctgaccgcgcattacacgccggtctgaccggctaccagagcccggtctaaccggttacatgaaatcacctgtgaatccaatcatctccaaaaccacttcgtgagtaaattccaaatatcaaaaccgataatctccaatgcccaattgttcataacagaataataataaaaaacacttttgattttacactggtctccatcatctctctgatcatgtggccagcattgccaggtaccgctttaattcgagacgggtagttatgcgaaatttctcacatggtgtgtcaaagatgattgatcactagtttaattgattcaagacgtttgtatgcatgcatgaacattgcatgccacatgcaaggtgtcaaataaattactaactggaaagcacgctgtttatattgcacagtttggaagtacaaaaccaccatgattaacctgtctgtgtctggtatactactatcgtttcccagaataaaagtgctgcagcttgaggtaattctggtcgaatgcttgcacgtacgtatgctctccgggcgccaagttgaagaactttaatactccaaccatatatccagcagctatatatagctagcagagtgatgaacagttgactagctagctggaaaatgctcaccagaacagtgtgagatccgaagaaccggctgggccggggctatctctcacatatgcaagttgagcctcgctaagctgacacactcggtggatcatgcaccatccatgcacgcagatgcagccatgctgcagccatgcgtgggtggctcaaattgctcaaatttatcgctcaaccgcgcgcagatcgatcggaaacaaaacaaataatggccaatcgatctgtttgtcgcccactgcatgatcgtacatgtgtagaaacgttttgtctaccctgcagtgccaaaaccgtttcttagatctaccccaatcaatagatctccatagtcacattttttgcttacgatatgaactgggcctggcggtccaaacaaatggcacagtgcaaatgcaggcgtaaactaaaaaaaaaacaaattaaaatcacaaataaatcgcacaatgcaatgcatcacagcaactacgtacagcgtacgacgcattgtaagagttctttttttttctttttgatttgaattctactactactcctataggaagattaatgtacattctgattgtagccttgcacggagctcgcagcagcgctggagccgtattttaggccataataactcgagcaatgaggggaaataaggggagtacggactacggagtaggagtacacctcactgagaagtaaacaacgacgacccaagctgaaaagaaaaaccgaagagatcgaacagtagctagcgaccgccccggcctttggtgggataaaaaaaaggggagaaaataaaatcgaacagaggaggcggccggagcgggcccaccggaaaaacctaggggtcacgtcagcacgtggcggatggtcccgctagttaatttaaccgccccgcgcagtaggcccagcccaccacgacttttgagcgcgcggccgtttaatccattaatccacacggcgggggggattcgcttaatcccattgacggcgccgcgcggcacggaccgcgttcatgacccgccctcgtgcaccgatcgaatcatccagccgtccatttttgcgcgtcaaagatcccgcccggcccggcccgggagccaatgctttactctacaattttcgccggtagataaaaccgtactccctttatccttaaagaaaatatgattgaacgtgacatatcttactcagattcaaatacgttttggttttttatgaaacggataaagtactatcgagagccacatgatacatgatacggagtatttcattattccgatttaatgcatgtatatttttaagaaaaaaaatagtactgaaatcataaattttggtggatgctacgagtatgataaacgaaaaacctgtggaaaacattatactccagagatgagttcatgtcaacactgataagtatatatcactccggccctttggttaaaattattcgccaattccgacagtaaaagaaactacgagcaagtcatttgtacgatggaaacgaagagtacttttgaccggaggaagcatttgtgacaaataatcatactgtatatagtcacctcattattctctgccaaacactagcaccataaattacacatatgcccgggtttattttgactaaccaactactcccgtcatcccaatttaatcatacttataaaagatatgaagaccaagaaaaaaaatcatttcttctaaaatttaatctcatagatcaaggtgatgtgttagacatgcatatgagcacacaaacaagcaattggatgcatgcgagacatgcaataatactctcacggttctattttaactacgttttgaacaacattaaataccaataagtacctaaaagcacccacaatggttatttataagctctctacaaaagatccatgtcagcatattttcctacttggaagatattaaatgaagagagagagcaaagctatctactaacttagagatagtctatagagaaaaacgaggcaatgcatgagagagctatagatacccatgtagacatactattgaggggtttactattaatatagtctattgctgagatgtacatgttttatagagagcaccttactttaccattgtgggtgctctaagtctatgtttagttcctctaaaatagtaaaagttttgcagttttggagtactttttgtcaaaatggatctaatcattagtagtaaaagttggcaaatttgacatttatcatttgggagtctagagtagcaaattttgctaaaatagtgcgttggaagccgtgctctttctctctctaaaatggcaaaatcttaccatgcatctaaacacaccaataaataaaacttcaataccaaatcttttgctaccaaaacttttgccaaaaatatttgctacagcaaattgatctaaacatgccctaattgggacacatattcccggctatacccatattaagggcctgtttagggagcttaagattctgagaagcagctggcagcttctgagaatttggaaaagctgggtttttcagcttctggcttctagtttattttctggattctacagtatctcagaatttggaccaaaagctggactatttgggggagcttctgattctgaaagaagctgcagcagttagaagctccccaaacaggccctagatacattcagggacatcacaacccaataattttatctagctcactttgttaaaaccactattttcaaagtattgagttctatgtttgagtcctgtggcactctatttttccaatgactttggtcaaaacgaagcaacagatgcatgcatctttattgtgtttgcatgcaagcagggatacttctgggaagctattagggcagtcccaaccctctacctaggatggtgtctatggcattaactacattgccatgtaggacttttagcttatgtggtactatattaactagctgggtggcccgcgcaattacacggctagcacccaaacaaaatcatatatttttcagtatgattttacttaaaatttattaaatagctatctcgtcgtcttaagactttaaaagactaaatcttatcatcccgtatttctaattatatagtttttaaaagtcacaccagctactaccccttacttctgtcatatacttctttatttgcttgcttgatctaccactatttctattcattctccttgaaatctttaaaaatcagatcttatagtttttataatttctagaagtctcgtcaaacgctgtcattatactcctctacgggccgtcaactgtcttttctctatattgtcattgggattttaattattttaattattccgagttttaattaatcacatattggatttctatatggacttctctttcaatattgcatatttttaattccgaatttcagctattttttattgtgtttatatgtggactcttctttttttttctccgattaacgtgggaatttctagcctccacagcgaacgtggttatgtatttttggcttgctaatttttggcttggttgtgtatttattggcatgacaataatgatataattcggaaacggcagagtttgattaggattattttctttcaatgtttctaaaagtggtgtcaacacgcgtattcccaaaatattgtccgtttccagtgtataatatgattaggtttttcttttcttttcttttgttttgtttttgaccgattgtacatttcgtttccagtagattaggttttcttttttttttaagacagattgtctgattccagtagtatgattagtttttttttttaccgattgtccgattcgtgtttcttaatatgcctttttttttcctttcttcagtttttaactaatcctaatctagttctatttttttcttttttcttattttttggagtaatgtgagaatttttaggccatgagaacgaacgtggaggctcctttttctattactttaaagatataatagatagatagattaagagagagagagagtgaagagaggaagaaactgggtttcatgcaagacacagcttcaacacaagaacctatgcactagacactatcaagttttgcgttaggagagaatagtgtctttataatagatgaagaatatatatgattggtagagaagaaagatgatatatttattaatggcccactttaagtaaccatgggttgtagagtgtagtttctattgtgatgtcttattgacatggcaccatagacactacttatggacaccatgggttgggaccgcccttagcctggaacttggaagctaagacgtcaattttctctatccaaaatctattactccctccgttttttaatagatgacgctgt

SEQ ID NO: 60119 - DNA, 781 bp, Oryza sativa
  unsure (1)..(781): unsure at all n locations
agatattctcaaatgtacaagaagtatgctgaggttacttctaaaggtggtaatagagcttcaagtatgctgttctggaatataacatggtgcatgcatagcaagataccttgggataggggtgccgtccacattggggtacattcccaatgatgtcgcataagcaaggatcatcccttcttcaggcctgaaagttccaagctcggctaatctcagggcatgaccacccactgcagcagcaagacttactgctttttctgaagaactcaagaaaattatcaattacatgatgtactgaaatacgatcaattttgagctttataaccagatgcctcatatccagtttgaaacaagaattgatggaacaaaaattacaaaaaagatatacatattttatttgctaacttaagaatagttgatgtgatcagcatagactgctactgttgattgcaagtgcagaaagagttgtccaaataactacacaaagaaatactagtatttttggggtggcttatgcaatgcactttgacatgactgttccatgaacagtagcagtctattcgagcatagttgacatttagtactagaatgataatgcaagtgtagtatattcagtaaacaaggtactctaccgttttcaaaatacagggcttatttaggacgagaatactaagaaatgtatgaaataaagagaaagaagataaaatgagcatactacccatacttaaattgattcgaaattcgtattcaagaagaaanaatgatgagctacttgcagacg

SEQ ID NO: 60120 - DNA, 35760 bp, Oryza sativa
aaattataattacgtaaattttttaaataagacgaatggtcaaacatatgagaaaaagtcaacggcgtcatctattaaaaaatagaggtagtatcctctaacatcagttaatagtagagaacaaaactactatttactcatgcacagataaattaacgaacatgtatacaataataccttttatttatgcgcgaataaacaaatacacacatattagacgatcaatttaatttaggaagaccttataaaacttaggagtagtaagctatgccctaccgacttatttttttcaaaaatttgtcgatatgtttgtagtaattttttttgtgcttcctttatttttcacaacgagaagtttaagcccctctagttcattttgtattgtacatcacagtactactactaatgtttagtttattgtgctaagctgtcaaaatgaacttcagtaagagggaggtccacggatcagcgctgtaggcataaaccatgcagggcagcagagaggagtgtcacctcttcttcttcttcttcacctgctataaccaccagctgttgctagctgtttctctccccttgtcatgtgacctccctactcccatctctattatttctctctcccctccctgtccctatcattcccattgcccgatttagcgctcgccgttgttttcgcagcagcggcggcggcggcggtggcggcggcggcgcgcggcaccaacaaacacgcgagctaaaacgagggccgcacaatctccggcacccgcgccgcgctacattaggatacgggcgctcggcgacggggaaggtttcgggcgtcgcgccatcgatcgcgggcgcgcatttgcgttgattccgggccaggctccctccccggccatggcgcagctgccgcccaagatcccaaccatggcgacagcttggccggagttcgggggcgggcaccatcaccatgctgcccacggccaccatcaccagcgcagcccctccatgggggcgttcctcgcggcgccattgccgcccttcccgctcccgccgccggcgccggcgaacggcggggcgcagcagcagcagcagcagcagcagcatcagccgtcctgggtcgacgagttcctcgacttctcggcgaccaagcgcggcgcgcaccgtcgctctgtgagcgactccgtggccttcctcgaccccgtttccgacgacaatgccggcgtcggggcgcacgacttcgaccgcctcgacgacgaccagctcatgtccatgttctccgacgacctgcagccgcctccaccgcagcaacagcctgccgcgcccgcggcgagcgcgtcgtcgccgtcggaccacaacagcatgaatgacgagaagcaagacaagggcgagacagatgaggcgcagagcgagtgcgacggcgccacgcccgggcagccggcctcccccgccaccgtcgatcccaagcgcgtcaagaggtactacaattccggcaatgcacagcttgcgaacgcagaattccccaattttccctcatcgttcttggcgatcccctcaaccgcaggatcttggcgaaccggcagtccgcgcagcggtcgcgcgtgcggaagctgcagtacatctcggagctggagcgcagcgtcacgtcgctccaggtgcgtgccgaattacgcatttcgtgcccgtaatttcgccgagcaccgcatgcgcgcgcgcgccgtgaatttgacctccaaccgtttgctctttttttctttctcccgagcagacggaggtgtcggcgttgtcaccgcgcgtcgcgttcctcgaccaccagcgctcgctgctgacgctgggcaacagccacctcaagcagcgcatcgccgccctcgcgcaggacaagatcttcaaagatggtgaccgccatttgccacctcaattatgctactatatatcgttctcacaatgtcgctgtccgaattcaattcggcgacagcacgcaaccaaaattccacagctaaactaacactcgttctgaattctctcttctctgctctgctcagctcatcaggaggcactgaagaaggagatagagaggctgcggcaaatctaccaccagcaaagcctcaagaacgcggaatcccaaccggcggacgcggccccggtccgcggccgcgacaatgccgacctgatcggcagcgagggggccgccgcggccgcgccatgcccgcactcgtgatcggccgagatccggacgctctctagacctctagcgaggtggcgccggcccgtcgcgacaaccacgagcgttgccgcgggggtgggccggcgccgtgttaggattggtgcattgttaatttgggttttgcattctttggggtgtaatgtaacatgatttgttcattcgggttgcttttgttcattcttgtgcatcctctgctgctgctgctgctgctgctgctgctcctgattcttctctacttccctgatttgtaattttattccggcattttgggcgaaggttgtagctaagaattgtaattcagattgggtgaggtcaagtgttttgtttggctggtttttttttctctttttcttttttgtatctgataaaatcaaatgtaatgttccttcatttttcctgtatgatccactgtatgtatttacagctatccatcagtctctctctctcttccctttaatccttctttcctctcgccaactttcgttattgccaactgttacgaagctcgcatgtaaagttcatctacacgttactgtagtatctaaccatttttttctctctctctcaattggactgtgggtgtgtgatgcatactttacaatcaagcagtacagggtaacaccggcgtcagtcacatgcatgcaattcgcaggtcgacaccaaacatgcaaccaaagcatcacattccttgctgtttcatcgcgagattttaaatggtgaacaaggagaggggtcaccgggagggaggtgccttgcttttgctgcaagggataggcatgttcgtctgcggcatgtgcatgtgcgtgctgcgcccgtatcggccggtacaagttaactctggcaaaaacgggttaggtttagcgtacgtgcctggtgttagtaccactacgactatacattatccttgggcttgggcattcgcatgagtaattataggttggttttggactctggcttcgctggttctcgtcgtcagcttgcccaagagggagaaacattttggagaaaccaccgggtcggattttttacagtttagtttttttttaaaaaaatattttacaaataaaactccaagaaaaacttgtttcagaaatagatctttttcttggcggtaatgatcatgacgtcgaggtccaacgtatttggcgccaacgacactagtgccgacatcctcgtccctctcagcggcggtggcaatgatactaacactgaggatctatttgtaagaaaaaaaattcaaaaaatccagaacctgggtggcgcagatgccccatcaatggatagtctgctcttgtttgtggtgtaaattttggccctagagaaaaaaaatgctgctacatggtagttacatcagtggcggagccagaaattatataatactagggaaattatataatactagggctaaggtagggctcgactaatggaggattagttttctgaaaaaattacatagtgaatcaacaaaatttaagcaagtttttggaggcaggcctagcttgagccctaggcctacctccgcccctgagttacatacgctggatctacctcccggcgaccccggacagctgcccggactcatcggcagataatccactaaaactccatgtaattaggaaaaagaatgaaatataatttctgtagtaaatactagctataatgtagtttgtctgggctctgtaatatttcctgataggctactgtatacaccttttgtactgaactactgaagggctctgaagtagcctggctgctctgtttcaaggctttccaggaaacaacaacccatggcgctgaagaaacactgctgcttgccgacctggaatgggagagcaggaatggtcttcgtcttattcatgttactctcggttgccggggggaggtgggcacatgcggctcgaactggaaacagcgcgcaacgaagtccgaagtcggcgatgcgtttggacatgtaggaatattcggctgtcgtacgcgactacccgttaatgcttactgtttcgataggaatcgagttgtttgatagtatgagatttctgtgaaagtctcacagattttttgcgtgtttcaaaattagttttgtttaagctaaaatgttatcaaaatgccctcaaacatgaatagggggaacattttggaacaccatggagtgcatgtttcgtccgaaaggtaagaaactggcccaagttatgacctaagtctattttacctccttcacgtctggcttctaattacattgcattctttaaccgcaaaactagatataacgcctatcccacgtttaaaaactagtgcaactgactcctctagtggtttggaaaatggtttctgctgatgtgacaggttgactatgggaggctgagaaagcagatgagataataaagaggctgacatgtggccccacttactaaagagtcaatcgcggataacgtgccatgttagcagacactgcttccaaaaccaccaaaagagccgattcacactcgttttttaagatggtggaaacatcatatccggttagacttattctaattccaacggagccatcgtttgagtttagcccccaaacaagctcgtgcacaagaatgcggcccaccttgtcaagcccataattgtctctatggctttgaagtctgacagatgtatgatatagacctttgcaagccaatagacttgttttaagagatcaaagcccatcgattagtggcattgtagcacactgcacagtgcacactatctgatgaagaaaaggaaaacgatttctatcttgcactgaccatctgaacgaactgacatccaagatccaacacatcaagcatcagatcagaacgcagaaaacgcagaaagatcggcgcgtactagcgtacgtactaacagtactagagtacaataggactcttgcacgggccgtacgtgcatgtgccaagacaaacctgaaattctgaatactgtacaattgtactccctgtttgcgtggaaggcaaagacaaaaaccaggacgtgggatcggctgatctggattactattgaaaaaaaatccaaaaaataccattgataaacgtcccaatcaaaaaataacatcaacgaacacaatttcttacaaatgtcgtcatacaaatgtcttatacaaatgtctttgttccagaaatactatctatgttaggtttccatttgcatccttccgttaagtggtataaaagatcattttacccctacgaattgttaaaagttgattaaaatttttgctcttttcgttcgcttacagtatatttgtagtttgctttttacactaaattattttaagttgactgaaagagtaaaagttttattcatcttttaactattcttaggggtaaaatgcctttttatatcatttaacggagggctactaacggaaacctaacgatgacatttctgaaacaaaggcacttgtacgatgacatttcctgaacaccaatgatattttttcaattggaatgcttgttgatgcaattcttagattttctcattactatttcgtgagcaatttctgtttactgctagctggaaaagttttttatccaaggtcacaaattaatacagacggtatacactccacagtactactacctccgtctctaaaacactatatttctaactatacacacggtaacttaattcggttgcccacacggcccgagagttataccctacgtgcaccgtcgatcttgtccttaatggcacatggccacatccatttgtcgtataactcaattctgtcacaaaaaaggccttttctagtatttaaattttatcttaaaaatacaatacaactactttttcatctactatctcatttcaaacgattacaatcatatctcatttaatttctgtacatagtactatgcatccctatttgacttcacttatctctttgatgtacatgacaaatttgagatgtgcttatattttaagacggagaagtaactttgtttttttaaaggaaacctaaccaccagaatagatgccaattatatttcactaaacaaaataaaaatccgaatgagttacataaaaaaaggacatcatctaaacaaaagccccaccaagcttctcaacaaacaaacaccactacgccactacggccggctgccactacactaggccctatttagtcgcgaaaagaaaatttttgggtgtcacatcgatgaccatatgtcggaaggggttttcggacgcgaatgaaaaaactaatttcataactcgcctggaaaccgcgagacgaatttattaagcctaattaattcgtcattagcacatatgggttactgtagcacttatggctaatcatggactaattaggctcaaaagattcgtctcgcgattttcatgcaaattgtgcaattagtttttatttttatatatatttaatgctctatgcatatgtccaaagattcgatgtgatgtttttgggaaaaactttttgggaactaaacaataaacaattggcctaaaggttcctcaaaatagcagccccacagggggacacgccatgaatcgaccatgcatagtcacattgctgctcaaatcctgccacttatctgcctaatctggtattgtggcctgccgtcaccgtcctagttggccgcttgggcttccggcgactagctcaagtggtagtaaagcggggaggagggagacatcagctgctagggtttggttgtctcctttgagtgacgcaagggaggggcaaggtctagtttgtaactttgttgtatcgtaggaaagaaaggaaagttgtttactttctttatacttgttggtaacccatacgtgggtgcacggcttgttactgatatttgaaaatactaaaggagattatcatgatttaataaatatgtacttggttaggaatgttagttgtagttttttcatgtttaataagtgaaatttggaattaataaaaactaacttatatttatatttagtttgaactctcaattctcacaaacatgcataggttttaatgtggtctacaatgttaaatgcgtaatcagggtaatgattaaatgatgcatagataggtgtgacttataaattgcagacaaattaccagcaaatgcactaaattaaagaggaggaacgagatcctctaccacaactccctattcagaaaaactagctggttagcccgcacaattgcgcggctagcacccaaacaaaatcatatattcttttaatatgattttacttaaaatttattaaatagctatctcattgccttcaaactttgaaagaccaaatcttatcatcctcgtgtttctaattatatagtttttaaaagtcacaccagttgctactccttatgtcatctccttttttatttgcttactcgatctattactatttctattcattcttcttggaaccttttaaaattggattttatagtttttagagtttattgtcacattgggtttcgtttttataatttctagatgtcccgtcgaacattgacattatactcctctacggcctgtcactgtctcttctatttattgtcattgagattttaaaaatcaaagataattatcatttgggttcatttttactttctaaaagtcctgccaaaccatcagcagctttgccattgtactcctctacggctcgcccactgcctcccttctttattgtcattgagattttaaaatcgaacatgattatcattgtttttttttactttttaaaacttctgaacctttaaaaataggacttgtagttttattttttataatttttagaagtcccatcaaacgatgccactatgcccctctacagcccgtctgctgcctactctttattgtcactgtgattctaaaaatcgaacataactatcgttggaattcattttttttttattttctagaagtcccatcaatcgtcggcggctctgcaactatactcttatacaccccgtccgctgcttctcctttttattgtcactgagattttaaaaatcgaatatgattatcaatgtgtttttttttactttctagaagtcccggcaaccgccttacttgtttgctttacggcatgtctgacgtccctccttttaattgtcatcaggattctatttggtttttttattaacaatttttatatatcgtatcaaccgccaccactttagtcctttataggcctgttacttaattttatctcatcatgtgttttagatggtattttctttcaatagtctttatttttatcacaaatttaattatttacaaattgtattcctaattgaaatcttatttttccttttctaatttcacaattttttttataaaaaaattagttaataccgtattgtgttcttttaatgtttttattttttttattttcaatttcaattgtttcaaaattgtatttctacttgaactctcttttaatttttctaattttggttattattttatttttatttgaaattttaattaatcttgtattgggttcttatatggattcttcttttaatattacttatttttaattctgaatttcagctaattttcaattgtattcctacttgaactcttcttttattttcttttttctaatttcggatttttttttatttttattctgaattttaattaatctcgtattgggttcttatatggattcttcttttaatatttcttatttttaattccgaatttcagctatttttaaattgtattcctacttagactctcctttcctttttctaattttagattttattttatttttatttcgaattttgattaaactcctattgggttgttatatggaaacttctttcaatgttacttatttttaatttcgaatttcagctatttttaaatcgtatttctacttgtactcttctttttctccgattaatgtgggaatttctagcccccacagcgaacgtggtgcctcctttcaaagctgttttagtaatataactagttagatggcccgcgcaattgcgcggctagcacatatacaaaattatctatttttaatgtgattatacttaaaatttatcaaatacctatccctttgtcttagggctttgaaagaccgaaccttatcatttgtgggtttctaattttataaaatttttaaaagtcacaccagtccactacctcatagtccttttgtcaccctttatttatttactcgatcttccatgacttctattcattcttcttgaaacctttaaaaattggatcgtatatttttagagagtttattctcattgaattttatttttttataattttagaagtgccgtcaaacattaccactgtactcctctacggcccgcccgctgcctcccctctttattgtcagtgggatattaaaagtctaacatatttatcattggggttttatttcttactttcaagaagtcctgtcaactgtttgcggctttgctatactacttctctatagcccgctcgctacttcgcttcttgtttttattgaaattttaaaaatcgtgcataattgttattggggtttattttttttactcttcagagtggcttctccgtatctctcttattagtcatcatttatattttatttggggttttgtttatagttttatatgctcggttgccaccagcctactcctttactggcatggtacttctctctttattgtcatttgtcatcattgtgttatagatggacttttttttttgaaaattccgtatttttcattccgatgttttgttatttataaattatattcctaagttaaactctcataattattgtttttattttctaaatttattttattttttattctgaaatttttgttatttataaattatattcctagttaaactctcataattattgtttttattttcgaaatttattttattttttattctgaattttagttatttataaattatattcctacttgaagtattaattttcttttttttttctaatatcacaatttttttttattttgaatattagttaatgtcgtatagacagtacagtaagttgcaaagctccaaatttgatttcttttttcagtccaaatccatgttagtatcatagtatggaagcctatgtccgattggttttttttaaatctagaatccttatcgtattcaactggagttctattgatttatcaaccatactatcaatacatattaactcgatcgttacagtttagatctagtatgatctaatggttaatattttttcttcattaacatggtaatttttaaccttcggagcaaatgtgttggattttttttaagatgccttaatgatataacagatactctctccgaaaaaaaactaatcctggttttaaacctggacatatgggtttttgctggacgaagggagtagatagagagatttttagtggatggattttgatctagttacgcagcttaggacagtcagattgagcgtcaacgacttatgcttggccgataggcacaatgagcacacttatatctggtaaactgagatccaattttttatggtggtacactgtattgaggacaggctacttggatccagctcattcacgtcttgtatttctcatcttttagtaaaggacgcatactgtatccggtgaattgatctctaattttttaagttccttcagcattgcagagcatctagatgtaacctttttcaagaatgcatgttcttttgctggagattctgtacttatgtgattgcttttgttattggttggtatttattgggacttgattgaaagccatagttggaatcggacaccaatttatacctggacatatttattttgcttagaaggtgacatgacatactttacctcaggtacacgtatttgttccaattctaaataaagaacgcaaaatcaaaacttatatgcatattccctataagtctacatatcccgttagatttaatatacaactctaaaattttatttctataagaaccattaagtatattttgatttatatacaattcttagtttctatttttataagatccagattttatatacaactcccaacttctatttttatagatataattgtatttcatatacaactgtataaatcaatatataccgttataatccggacccaccatgatcaaacggttaagattttttttctttttctctttttttctccgattaatgtgggaatttctagcctccacaacgaacgttgtgccttcttttaaggctgttttaataatataatagatagattggcggctcgtcgattcgttttttttttataaaaaattttcctctaccacagcaactgctaagtcggcagaggtaaacagcgacgggttacattgaattgctacaatgagacgccatgcaatttccttgccacagtaatgcctctacaatgagctatagactatacagtgcctgcgtgtaatgctgcagacgatcccagtagtcctctaatccatcttggctacgggcaattatattcacgacggctttcttatctaacactgactggcgaacgaacaatgtgcgcacaacgtttggatcggcatgatgaacagaatattcacgcgtcacgcatggatgcatgcaaacaatgaaacaatcctcaccaagggaccccgacccatctgctgcgcctgggcacatctcacgtgcggagctgcagtctcctcacgggtactgtcagtgatcggccatcacgcagaccccggatctcacgcacgttaagttcatgatgcaaattgcacaaattggtactaaaacttctagctaaaccacggcggtttaggtgttaattatgtgtgctgctaactaattatcaataagctgactgcataactggacggaaagcccagtgaacaaacaacaaagctctgaatcgccatatgtggcgccatgtcatgttgtggtcacatgatcggggacaaaatgtgtctagaattggcatctagtagctgctgcctgaaatgatgaatcactatccgagcaagtcgattatgactgcgcgcgtggtttgcatgggtaaaattagcagggccatatgatgtttcaccttttaattacggatttgctaaatattatccgatatgaagttgagataaatataggacatgcggctagtagggcggaaagaagcgggtttgctgtgaatatcagatgggtgagttgatattggactattgaatattgatccgatggataaaaaattgactgagatgggaatgtgttttcttgctattggtgcacatgcagtccctttttatttattcaacatacatattgattacttttaaactgttaataatacagatataaaaaaaattagcagcagcaatttgattggttgtttactttcttcattcattttactacagcttatcgactaccatggtcattgctttattttaatttttcagaaacgtttcgtgttcaaatgaaactagcaacgtataatagtatagtaccagttggcaagtactgtaccaagtagctatagtaactactattagcgagatgcacaattttctggcagctgacagctaaaccaaagcacaatggagttcaagggaaagctacctgcgtcagcgattgcgtttgtatgcatactcctacgtccaaacacgcaacataacctgcaaaaacaagcatgagagtcggtacacctcccacgttttagcatgttctgaatgcagcttaccctagtaggtttcaacatatatacttcctccgtttgatattataagtcgttttaatttttttaacttattttttaaaagtttaatcaagtttataaacatttccaatcaaaccaacatattattagaatatattcaatgttagatttaattaaactaacttgatattttggatgctgttaaattttcttataagtttaatcaaattaaaaaggtgatactatgaaaaaaaatcaaagtgacttattataatatgaaacgggggagtaaataaaaccggcactaggaacaaattaactaggcatgacagaaaatccaagcaaggaaggaatagttcggtagtagtagtacgctagtttgctcggtcgcgaaaataaattacgcgtagatcgttgaggaggaaaggaatggcgaatcgacgacaagggagaattgggcaagtcaacttctgcatggaatgtgccaatctggcttggctttgccgtgcaagatcccgctcgtgttagggggtgtttgggagagaggggctaaactctctctcaaacatcccctctctcaaaagcataagtcatagcctctctcttctaaacacccctttaattattttttcgggtgtctggaccaatcggcgaacaggcgcttctccgattgggcatttgccgcattggagagcgctcgaccttgagcagagcagagcagcactgtgcctcggtggctcggtacgttggtgcgtgtgatcggtaagccgcgcgtgcagagtgcagacaggcgtggccgcgtggcgtcgccgacggccggtgtttcttttcccagccgccccggcactgacgccaagccgaagccggggccggccggcgcgccccaggtttccgctgcgtcacttcatcagtagttcagaactgtattagttaaccaggtttatttatggccgggagttgctgcgagatggaatcccaaacagatccggatcagtgcaaggcaataatcaatctacctcaattgtcttttgcagtcgcattcatagattagaaaatgcggcgtattcgctgtagaactctgacatcacctgtggctgaggatataacacgacattacgcgcgaatataatcaatgatgatatctatagctagtaaatcattatgcctaaacaataactatcaccaaatctgcaattttattcttgcattatctgaaaagttaatccgacgttgcattatctagtattaggtctccaatctcgtggaaatcttgatccgtgtcttctcattttcgtaattattttgtattgtttttctttctttgaagcattcaacaatatgattgaaccatgtcatggggatctggaggattgaacacgcaatgatattctactcctggattttctttgtgattttagaattccactttagaaacaactggaaaagaagccctaacttgttgatctgtccaattccaccacagtcttctcaaaggctcgtgacaacaaggagtacttcgttatggtcaaatctttattagttttctgttcctttgttgttgcttgttagggacagtgaggcgctccattaatttggttatgcttccattcgtgcaaaggtgctttgagaagatttaagtggcacccacttagcagggtaatgaaaattcacatcgaagattaaacttaagagtttcgatataaatttcataatattccgacatagtaatagtcacttcaaaacctacccctatcccaaaacataagtttttttaatcgctactgaacacacccaagatactaattgtaacgtcccgcctctcccaagccgggcccgcttacatctgacagctttcataggccacagactaccctcacaaagcaacacaagtgtcgttgctgcttgcagccattccgaaccagcgacagtaatcgctactgaatacacccaagataagatactaatagtaacgtcccgcctctcccaggccgggcccgcttgcaaccattccgaacctccgaaccagcgatagtaatcgctactgaacacacccaagatactccctccgtttcgaaatgtttgacaccggtgaatttttagcacatgtttgaccattcgtcttattcaaaaacttttgtgaaatatgttaaattatatgcctacgtaaaaatatatttatcaatgaatcaaatgataggaaaagaattaataattacttaaattttttgaataagacgaacggtcaaacatgtactaaaaagtcaacggcgtcaaacatttcgaaacagagggagtactaaattttaacgtcccgcctctcctaggccgggcctgctcagaacctctgaaccagcgacagtaatcgctactgaacacacccaagatactaaattgtaacgtcccgactctcccaggcctaaccagcgacagtaatcgcaaaccaacacaagtcttttctgcacactttgtcctcacttgtgcgcactcgggaacaatgtcaccggtcgggaaattgttcccaaattgtaacgtcccgactctcccaagcctgaccagcgacagtaatcgcaaaccaacacaagtcttttctgcacactttgtcctcactcatgcgcactcgggaaattgttcccgagtgccaggccttccgaaaattgtaacgtcccgactctcccagacccgaccagcgacagtaatcgcaaaccaacacaagtcttttctgcacactttgtcctcactcgtgcgcactcgggaacaatgtcaccgatcgggaaattgttcccaaattgtaacgtcccgactctcccaggcctgaccagcgacagtaatcgcaaaccaacacaagtcttttctgcacactttgtcctcactcgtgcgcactcgggaaattgttcccgagtgccaggccttccgaaccagcgacagtaatcgctactgaacacacccaagtcttttctgcacactttgtcctcactcgtgtgcactcgggaaatccaggccttacgaaccaacgacagtaatcgctactgaacacacccaagtcttttctgcacactttgtcctcactcgtgcgcactcgggaaatccaggccttacgaaccagcgacagtaatcgctactgaacacatccaagtcttttctacacactttgtcctcacttgtgcgcactcgggaacaatttcccgatcggtcacctatcccgaaattactccacgccgcactcgggaacaatttcccgatcggtcacctatgcacgcttaacctcagagttctttctagatcagcttccggaaaaaaagttgcaacttattgatatgagtattctattaatactattaagccttagtccggcatgtcacattaatactctatacagtaatattatttgtgcccaatgaataaagattaaagagtgagcaccacgtgagccacgcgaaacggcccaaaccagcggctcacacacaccttatccatgcaccgttttccgatgtgatgtacctttaaccgagaaagcacgacctcatcagaaatcctaatcagttaaaaataaagctgaaatttaaattttcaaacttaattttaagattaattttaagataattttgatgtagtttctttttagtattagctttgaagtcataaaaatacatatataaaatttttacctataaattcatttttatatgagcaaacgatggcactctacactgtataccattgtttcatatcagcacttcacaaaacttcgtggtactctccccgtccaacagtatatgcccatttttagaaattaagaaattaacgaaaggacaagtcatgcaaaaaaaaaagaaaaacaaactactagtaagaaagttggtatgagaaaaataaactaataaacgttggtaggtgagacaaaataatactataaaagtcaataagtatggaataaagtactgtatcagaattttaaaatatcttatattttaagataaattaaaaagtaaaatcccttatattaagagagagtatatacatatttctttttctccttcaaggaaggaaaataacacatcattgaacgacagaatgagtaaccaaaaccatttttgaaggcactcctggtaaaacataggacaaaaaattgtaatactagtatagtacaaagagcatgaacggatatgaacaaaaaagtttcagaactggttgtccctttcttctgacctgactttgccacaatccggcgaagccgccatcagaagttagtagaacattcgacaagttacgactagtttcactttgatccgtataagaactcaaggggatttcaactccatccgttatggtcaatcaagaacatcttctagatcgaagtcaatagtccaacagaggcatctctgtcggaagaccccagatcaaagtttgccatctggccaactaatcctccagcgacggttaactgttatccctgctccaccatgtctgaccaaactttattctcccttcctctactctatatcgagattcatttagaatgtttctcattttagtataatgttgatttattttagaacggagagagtactctctctcgagattcatttagaatgtttctcattttagtataatgttggtttattttagaacggagagagtactctctccaaaagtgcaggagcagcacgtaacgtacccataccattctagtcgtgtattgatgattgattgcttgcttgctgtgagtatttttgtcacgaggatcaggtgaaacaattaaaaacacaacggccaaaaagacaatggccaccatgtgttatacacagtacacattcgcacttgcaaatcatggaacatgattagttacaggacgatccagtagttatagtactacggagtagtatcaacaatcaagcaagtagtttgtgaattgtgaccatcaaacagattcgtgtagtacaggttgaaatgaactgctcgccggcgtcgcagcggagtagtgcgggtcgtcgctactcacgagcgtgtgccacttccccgtcgttgtcgccacctacttctacctgcgcggattcccgtcccgaagtgacaatttccccgtgaaatccccccctatccacaagggtaaggcccgtgcagccgccgccaccgcctcctcgcacctcgtttcttccaccaccctcgcgcggcggcggccgtctgccgtctgccaatccgcccgcccagaaaagccgcctcgttccgttgtctcagcgcgtttgaccagcgatctactatccccccttccccctcctcctcccacgcctcacacactgacacacatatgggcataaatatgcctccgttgggagagatgccaacacgacacaccagctagtagtgtgcgggtttgggagaggtgcgtgtgcgccctgagctgctgctgccgcccggccgccacccgtgacccgcgccatggcggcggtggtggacttcctggacctgcgggcggcggcgccgttcgtggtggccgcgctggcgttctacttcctggtcgagcagctgtcctaccaccgcaagaagggcccgctgcctggcccgccgctcgtcgtgccgttcgtcggcagcgtcgcgcatatgatccgcgacccgaccgggttctgggacgcgcaggcggcgcgcgccaggaagtccggcgcggggctcgccgccgacttcctgatcggccggttcgtcgttttcatccgcgactccgagctgtcccaccgggtcttcgccaacgttcgccccgacgcgttccacctcatcggccacccgttcggcaagaagctcttcggcgaccacaacctcatctacatgttcggcgaggaccacaaggacctccgccgccggatcgcgcccaacttcacgccgcgcgcgctctccacctacgccgccatccagcagcgcgtcatcctctcccacctccggcggtggctcgaccggagcgccgccaacggcggcaaggccgagccgattcgggtgccctgccgcgacatgaatctcgagacctcgcagacggtgttcgcggggccgtacctcaccaaggaggcgagggagaagttcgagagggactacaatttcttcaatgtcggcctcatggccctccccgttgacctgccggggttcgcattccggagcgcgaggctgggcgtggcgcggctggtgcgcacgctcggcgagtgcgcgcgggcgagcaaggcgcggatgcgcgccggcggcgaaccagagtgcctcgtcgacttctggatgcaggagacggtgcgggagatcgacgaggccaaggcagcggggaagccgcctccggcgcacaccgacgacgaggagctcgggggcttcctgttcgacttcctcttcgcggcgcaggacgcgtccacctcctccctctgctgggccgtgtccgcgctggactcccacccggacgtgctcgcaggcgtgcgcgccgaggtggcctccctctggtccccggagtccggcgagcccatcaccgccgagaagatcgcggagatgaagtacactcaggccgtagctcgcgaggtggtccggcaccggccaccggcgacgctggtgccgcacatcgccggcgaggagttccagctgacggagtggtacacgatccccaagggcaccatcgtgttcccgtcggtgtacgagtcgtcgttccaggggttccccgagccggacacgttcgacccggagcgcttcttctcggaggcacggagggaggacgtggtgtacaagcgcaacttcctcgcgttcggcgccgggccgcaccagtgcgtcgggcagcggtacgcgctcaaccacctcgtcctattcatggcgctcttcgtctccgtcgtggacttccggcgagaccggacggagggctgcgacgagccggtgtacatgccgaccatcgtgccgagggacagctgcaccgtgtacctcaagcagcgatgcgccaagttcccatctttctgagctggtttcccttgtcctcttgctctgctcctcttcccgtgcatcgcataatttttcttcttctccatttttcttttcaatctggtggatcgtgtcgcagctgtgatgcattgttgatttgtaggttttgatgtttggtccattcaattatttttgttggtaattgggttcagttggggtttggactcagctttgggtcccagccggctaggggatgatacgaacactacatctggggttgttggccacatgtgtgggtcttctggtttggttggttggcatgtctcaggaaattggtggtatttggaatggatttgctcgattgttttggcaactaaaatgtgagcagttgcacgctacttctgttcatttatgaatgtaaggcgctcgatttggattgagtgagcgttggctcgtgccagcgcagctgccaatgcgtatattcaccttctttttgtttctacgaaaaccgtcggcgaggcctctttttttttttttccagttattacatagtttatgcctaaatttagtttttattggactaagtccaaattcaaatatagatgttggttttcatgagacgaagagagtagctactactacactttgcctactagtagctagttaacggaagaagaagaggagagatttttctcctttagaaaggaagcttttttcttttcatttgagtaaaattccttttattcttctatttctatccggttagtattcatcatttccgcacaactgtttcataacaggacaacagactcatgcatactgtctggctttgaaagcgatagcctatccaaaatacgatggaaggagtactattgatggtagtataattaaattctaaccatagattttcttgggtatttaaatactttatgtaaaactttgctagggtaattttatgttaatataacataaaaatctaaaaagattgtagcaatattgccttttatttcaattttagcccttcaaaacttatactacctatattggtaggtttaatataatagaatcactttcattggataaaaacagggattgggaaccaacaaatatagatggccaaatgggccgtccggcatggcacggcccgacctacggcccaatacgactcgggtccgcctgaaggcacgatagtccatcgtgcttctccacagaataagtctatttttcatccctcaactctgtgggttgtgtccatatggttggaaaataagtctattttgtgttcctcttctcattaggccttgccttatatggttatttaagtctattttgcatccctatactatttttcttcaatcgtgccatgccgggccggcccaccgtaccgagggtgcagccctgtcacgacctggccgtcgggctgaggcggcacgggcacgaccctagtcgggccgtgccgtgcttgcgccggccgggccgcggacctcgggtgccaacagagtttataacccccctcccccccccaaacaacgcctcccccctcgcaagtaaaataaggttgtgtttcggaggagggattgggaacccttcttcctggcacgtaaagcagagttgaattaacatatgattaattaagtattagttaaaaaaacttgttcaatatgatattttaaagcaattttattgtagattatttttagaaagacacacatgttagcaatttaggaaacgtgcgcgtgaaaaacgagaggatagaagttacgaacaaactaaggtgtgcttgatatggtgttaagcatctatttgtactagatgatgccccgcgctttgctgcgggatatatgttagataatagagaaatgatgaaatgatttagattgaaatgttatgaaatgatttaacaatgatgatttagcatgtgcatgtttagttttagaatgaaataaattgtggatataattactatatggttgcatgttgagctttgtgtgtttaatgggttgatgtggtatgtttgcatgtaggttttaggatgctaataaatattatgcttatatgttgacctttatgtgtttagtgcgcattaactttatagaaagaagatattactagatgatatgtctgtgcgtttccatgggatcgaaaaaaaaatctttattgtctattatatacctacaattgtcttattactaagctattttttgccattagttttgatgcctgctgagctagcaagaggcacatattatccgcatcattaaggccctgtttctttcagcttgtgattattataatccagattattgggagtaagctgaaagaaacagataacttattgaagtagcttattataatctggaggccagcttattataatctgataagctcatttaggtgagctttttccagattattggatgaaaaattacccaccatgccacccactccctttttagacttgcaaatctaggaaagaaagaactaaccacttattatactacatattataacaatctagcttatagtaatctgacttaaataatctagattataataatctcaagctgaaaaaaacatggcctaagctagcccacacaaccgatgttgattttccatctgattaaccatctccttttgtgttgtatttttatataatagaatagaaaaccatcccgcctttgctcaagcgagctacaaccaattattacaccaaatcactcagaatgagtgcaactcaaagaaacttaaaaatcaaaattcttccaaacatgaagcgaacacaaactcataaacgccaacacaagataaacaatatacaattaatgaataccatttgtgaatctccatccaaaattgacaaaaaaactgcataactgtcgtctcaagattatgatatgcagacttcacaagcttgtagttttcatcacacttttgtagttgtgcccaggaccggaaccaatatattgctgaaaagaacctgcatatagaaaatatatggtgatttatcaaaaacaatatcatttctatttaaccatagagccctatatatagcagatgctcctataaaaataagtttgctgattttttctatcaatccccacaagctaattttgaaagatatgagatataataagtggaaggtataaaccagaagaaaactgaatagctctctaaagaaattttgtaaagtggcacttcttaaaaagacgttgaatagtctcaatttttctatctcctccattctcaatcgccgtcagcaccagcagctgacctcctcaagcaccgccagcctcttgcccttcttcagtcttggtccagctctctcctctagcacgatatacccatgtccccttcctcgtcctagttggcaagcagaaaccatgcaacgtgaacctccgacgcacgaagcgacctcaccaccttggcacaagtggggtttggaggttggtgcaatgcggcggcagttcgtgcttggagaatgtcgctggtgaggggcttggcttcttgttggaccggaggaggcgaatagctggggcattgtcggccgtgggccgtgccagcccgtgtgatgactgaagaaggcgctggcgaggggattggctacgtattggtgtcacgtatccgaggaggatttggatcgtctgccttcaccctgtgaaggcacggtcgtgcagtcatcgcttattcaccgtccatacaattcaacggctcacgtgtcacgcgcacttaactgctgttgcaatcagtccatggcagcccgacaagacacactgatgagttaatccgatgaggcccctcgtcgctgctgccaccgccgccgccgtcgatgccaacgatggcagtgactagctagctcggagctcgtctgcttgtacgcacacgccgtcaccagccatcgtttgggcccaactttttttttgttcctcatttttcggggccaaagtaccaaatttgctaagtttatttctttgttcaactgttgatggtactgaagacatattttagctatggagattgtagtttctagtgcgttgcttttgttcttgttaatcctttttgatttacgatctctattctctatctcttttgatttacgatgtggcttactctctattgtagttagtaatgaatgatgttgtttgaaacttatgaattgtctgatggaatgcatactttacttgctaaatagttgaatcgaatgcatgctttgctctgctctgctcattgtaataatgttccaaaatccaaattccgggcagcaagcatgctgcatcactgccgattgatacatccagtcctagcaggaagatggaatggcaaagcttccatatgaagcccaagacggcggcggtggcagcgcgtggcgaaagacgagctccagctattcgccggcggcagcgatggcggcactacaagtctaccaaactgactctgaagtctggagaacgtgcctcttgttgagctgacataggtctctatgcccgggagccgttggattgcatggacggtggataagtgatgactgcacgcccgtgcctccacaggatgaagtcagacgatccaaatccattcgaggaagatggttttggcgtgcaaagagcgaaatcgctaaaaagcaatcagtcgcgcggctcccctcctgcgcggcgcggccacgtggcacgcgcggagagggggccgcggtggaacggcgcgggagcgccatgtgcgcacgtttctcttttttttctttttttttctttcggtttttctttttgttttttctggtttttttttctctgatttggcgtttctcttttttctttcggtttttctttttgattttggctggtttttttctggtttatttcagttttaaactcatacatatataaattttgtattcgtatgtatataaagtttatatacgtacaactttgtatacgtacaaatacaaagtttgtatacgtggcttttttttgtttttttcttggttttcagtttttaaaatatgtatgtatttacgtatataaagtttgtatacgcgtatacaaagtttgtatatgtggttttttttgtttgttcttcgttttcggtttttaaatatgtatgtatttatgtatacaaagtttttatacgcatatataaagtttgtatacaacagtgtagtagtagtactagtagtatagtagtagtaacagtgtagtagtactatcagtagtagtatatgagtagaagtagtaggtgtactaatacgagtatacatcggactgaccgtgcgggcggccgtccgttagtagtcccctgcaaagagggctaagagcatctccagtagagacctcaaatccaacctctaatcaaattttgagagttaagataaaaaaaaaactagatccagcaggaaccctactactagagccctaaagtgaggaggccctcaaatcctccccccaaggccccagtcctggggactccgagcacagcccccatcgtccttttttttggcgcggaacaattttgcttcgcgcgttttattgttactcccgcgcggctgcgacgagggatcttctccagcgaccaccgacgaactcccagcacctccgccaaaactgccccaaaaggtaagacttttccataactttgttgcctgtcgtccacaatgccgtcggcggctgtccatgcgcatgcccggtcgccgacctcccgccatccgccggccgtcgcgtgctctccgagaccacccgcgcgcacgtcgcccacctgcacggcgtctgcccccatgctggcctctgcccgctcgtatttccagttttcactggccggagcctgtacgccgccgctgccccattgatttttctggaaaaaaaacttgaagtaggtcatgtggtgcggtggttgagtagtacagtagcagtcaattttctgaataactcgttcttgactacaattggacatgcatgtggtgctagatggttctcgtctggtggagactgatttgtttttaatttttttttgagaattgcagtggactgtcagccaggagaatctaattttatcaactagtagatatcactgtacttatagtagcactgcattgtgtagcactgtacaattgttgcaatggatcgattagaaccatatacatatatgtaacgctccgcttttcgtgaggcgttaaaaaactaattcggtaaaatcctaatttcgaaaattttcgttctttgtgtgcgagtctaagtcgtgccaagatctcatttcaaatcccgttgatccctctcatcgaaatcaaaatcctccacctcaaatttctcttccgattcgagtctctgaaatcaagttctgaaattcaaatccttcctctaaatcctcgccaaatacttctacgaatccagaactattcagatcccgcctcgaatcctttccttgactccaccctatgttcccgaaaacaaatacccaagtattccttttgaatcctttccatgacttctccttgaatcccccttgatacatccctaaaccctcgagttcgaatatcaaatttgaatttgagtccaaaccctaaaatctctccaattctatccaaatcagttttctctgtaaaagtctactttacctccctgtatttttggatggaccgatttccctcccccggctcatctcccctcccagcccatcatcttaccccccctcgcacgtgcgttgcacgcatgcgagccgagagagagctctctcgctctctcgattctttctctctcccgtcttcgctctctctctgctctatcccctcccggcgccgattcccgccgtcgccgcccaaaacccgccaccgccttcgctctttcccgcgctcgcccgcgcgtggcagaccgcccggtcgccgccgcatcagccctggccgcctgcgccgcacagccgcccatgccgccctgccgctcgcccccaccctgtgcgcgcgtgcgtccaagacgtggaggcagcgcgtctctctgcctcacgcgctctcctctccctctcccacctcctttttcccaaaccggcatggtaaagccccccctttccaccgtcctcccttctctttttccctcccaagcaacgacgccatgcctccactccttggccgctagcgctcggaggcagagacgcagacgccagcgccggctcgccacccccaccttgaccgcgccagcccgcgctaatcctcccgctcccgcggttcgattttccgacgctcgatccaccgccttcgccgcccaacgcatccacaccgtcgccgccttcgcactgcccacgaaaccgccgctgccgcccgtgaacaccagcagagctccctgttcccccacctttttccttttgcccgacaccgccggcgtcatcacctgtcgccgccttggctgcacgcgtcgatgaccgccagctcgctctccttgaccgccaatgtcggttccccctcccaaaccgcctcttttccatctataaagcccgggccgagcctccctatcttattctctctcggcatctctcttccaccgccatcgtgcctttgttgccgccttgcagctgccgacctcgcctcccttcgctgtcgcgcgtgctggtgaagccggcgtgtgcgcgaggagccgaagaggactccggccacccttcttcttccccttccccggcccaaggccggagagctcgccccgcgccgtcgactgcccatcactgcccgcccggctcggtagtgcctcctcccgttccccttcctcgctctccctcgtccccgctagcttgcgtggtagctcggtagccctgccgaacgcgcgtagacgccgccccaaggaccgccgccacccggcgtggccccaccgccattgccgcccacccccggaggccgcctctcgtcgccggacctccacggcgccgctcagacccatccgaccccggaaatgagttccttgaacaccggagatgcttccgccgcctttaattgagtcctcgtcgcccctcagtgatttcccctttctctcgccgccggccgccactgtcgaattccaccgccgtcgaactccctccggcgaatccgagccgttggctcgctccttctcgacgccctcgtcactccggtgtgctccccgaagaccaaatccgtcgcgcttgctccggtgaacacggccgccgtccgccgtccatctcggcctccccttcttcctcctcccgccggcccgcgtggctgccacgtaggcgccacgtcggcgccacctcggctttgaccgggccaagccggtcagccgtcccctccctccgtcttccctcccgtgcgcgcagtccacggaaagccgtgcggctgcatgtgggcccgccgccatccgtccaaccggtgcaccgctcctaagccatgcgcacccgaaacccgtgcgccgcacctcgcgtgcgcccatcccaccgtgggccgtgccaccgacaagcgggccccacccgggaccccgcgcggtggaatcggtccaccgggccgtctctctctcccccgcgccccctctgttgggccgcctcctcgcgcccgcgcccggcccaatggctcggccgcgccgtgcttatcccttgggccatacccgagcctcccaaagaagtctaaattacatccctccacccttttctttttcagggatttaataaatccttttttttttccttcctttgtcccataaatcaattccttattcccaaaattccacaaaccatttcctttggtcccgcgtgacagtgactatcaataatatttttgagaatattatttctataaattccataaaccatttctcctattccagaaactccaattaaacttccaaaattcatatcacccaattcgcaactccgattgactccgttcaacttccaatattcccataaaattgagatctatttaatggcactactaattagtctaaataggatctttcttttggtcttttgtttaggttttcagttgtttgcgtatagttgcggttatcggattttcgtcgatcgcgtgttttctcgaagattcgtgaagcttcgtgaagaccttgagcaaggcaagtcaccctttgatcaattgcccctataattgaaaagtcattattattttgtttgcaacttgcattattagaatcacacacttaacttgcttggcctcggtttgcgtgccaaaccgacggacctacccagtagtcgcactaatttccgtaggttgtactaccctgtttccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaaatgaattgtgaaaactcgcgatgcgggggttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacaccggggcggggtcggttggagccaaaccgggttcctggtaatgcaagaacgagaagcttgctgaattaccgatcgaggtggttggagtttgatttgtgaacgcctaaaatggcctatgattatgtgaggatttgatccttctatgtggcatgaggtatccctgggtcggcttgggaaaggctttgtcgcgaacctctgacaccggccagtgtctggagtaagttcgtgtcttgtgggtaaagtgtacccctctacagaggttaactaactgttcgaacaaccgtgcccacggtcatgggcggatgtgaggtggttcccgttgcgtagatttgtttgcctgtgctttgtgaaaagttgttgtggtgtgggaatcgtaaccagaatcagcctatgtggcagatggatgacctgagtggtcagaaacgaatctgtgtgattcgggatgtctgtgggcatcatagactaggcttcccgagtggaagcggattgttgtgctgctgggcagctggactctgggagtccgagaaaatgaaaaaggctctgggagccgattaatcaagtggaatggctctgggagccgagaagtaatgatctgacccgggaggtcggtacattaccaattgagttgttgaaaagcatctcttaaagtcgaattgagatgcaagtctctcttcggcccaaacttagaaagaaataaatcacttagtgatttcaaaatgccttcaaataaaagatttgtaaaacaaccttgcctctcctccaagcttgcatcaaacacctaagttcccgtgacttgctgagtacgaaagtactcacccttgctctatataaatatatatatatagttcctccgccctgaagagaagataaagtgaagagaagattagggtttcgtcctggttcccagccgtcgcctgtggtgttgggtgttagttcgttggttccgctgctgctgctgttgttggtgtttcctcatccgtgtcgtcggttgcattctcgggttgttctgagctgcaacctaagttaaggtaaataagtcctctatttattttaaggattgctatgattcatatttgtcaccgtgggaactagcactatgtcctgggactggtaccgagatcgcggtttcgtaggaaacggttcacgccgttttccctacgacacgctcctgtcaggtgccgttgtacggcggtatcagattggggtgtgacaatatatatgcaggagtatgtggtattgtactagtacgatatcactgcttttcatagattgagtgttgcatagtgtatatgggtatactctgttggatacgtgtgcatatgctctaaattttcttattaattttatgatcctgtgatggcagtgttttttacatggacttctacgacgacgacgacgacgacaatctcattaccgaatggtgggatcaagaggagttatctgacgatgatgactactacattgtagctgctcttcttacggacatagagcataagaggaccaaaagaaagcgtcgtggttcagtcccagctcgtgagataattcatagggacaggtttgctggcaatttgcgcatagtggctgattattttgcagatcctcctgtatataatgcaaaattatttaggaggaggttcagaatgtcaagggagctcttcttgcgcatcgtggctagtgtggaggctcacgatgactacttcaggcagagaccgaatgcaatgggtcttctcggtgctactgcactacagaaggtgtatggtgcaattcgcatgcttgcatatgatattccagccgatagtcttgatgaagtcgtgaggatttcagagagcaccatgatagaagcttttaagcactttgtcaaggctgtggtagatgtgttttctgatcagtaattgagggcaccaactgctgaggacactgtgaagcatctaggcccccggtgttaattttggtaattaatgacaagcactaattgtggactaaccgttgtctttgagttatacatttttaagttaggtccacgtcatatgtgcgcatagatgattatcgatggattaaaattgacggtgcaaagcaaagggaaagaagacggtaaaactagcgctttaatttagaattgatcgaggtgtagggcgatcaaatttgctagtttaattttagtttcgccgtactattaagaggggtaatgacctagcaaagagatgattttaatttccacattaggtcattgcattttcatttgtgctctctttttcatttcacacacattcactaattcactgggttcggcctgaccagggacggtcagactggccacatagtggcggtctgaccggcgtgccctggccggttagaccagctacatagtggcggtctgaccggcggcactttcccggtcagaccggccccctggaggccgagatgatgctgctcgggatggccgatacggagccgacggagccgtagtcggtcagaccgagctgatggtggtctgaccgagccgaggccggtctgaccggccgccccatgccggtctgaccggctaggccgatggggccctctgacagggctacaacggctagttttctagccgttgcagagtagcacggtctgaccggccacatacctccggtcataccggtagagcacaaagttgggggatttcgcccccaacggctagttttggtgggtgggagtataaatactcccccaccagcagcaagggggctctcttggcacccaattcaattgcatacactccttgcacctctctcacactcacttgagctttgtgttcatccatctagtgtgttagagggttgtttagccaagagtcaagtgcatttgcttccattgtagatctagtgtggcacttgatcatctccacaccgggtcattgcttgttactcttggaggttgccgcctcctagacggcttgtggaggagttgcccggtgacctctccgagaagattgtggaggaggcccggcgccggtttgtgagtggtttggagttcaccaccttcggagtgaaggaagaactatcccgagtgatcgaggcttgggtagtcctctccgtgggccggctcccgccttgcccaccccttgacgaagggggcgtgcggtggcttcgtggttgagcggtggagttgggcttgcctcaacggggagtaggaaaccggcgagttctcgaacctcggtgaaaaatctcttgtctcattgtctcatttgattgtcgcatttacatttgtgcaatttacatttctagagacacacttgagatcatatcaccctaggattgcaaaacattgacataggagcgtgatttactttcctagatatataattgagccactatcaccctaggtttgcaaaacataatttagttgcttagttagagttcaccctcaccaagcctagcaacttaggttagatttgattaggtgttatttagttttaaatcgcctattcatcccccctctagtcgacatctcgatcctacacactgcaaggttgttggctataaacactccaagggggttcccagggatgctaggttctattgactgtatgcattggaggtggaagaattgcccaacaggctggaaaggacaatactcagggcatgtggatgggccaaccatgattcttgaagctgttgcatctaaagatttgtggatttggcattccttctttggactaccaggttttcttaatgatatcaatgtactacagagatcaccactctttcaaaggcttacatcagggacagctccagagttggagtttatggtgaatggaaagaaatacaccattggttactatcttgctgatggcatatacccttctcgggccacttttgtgaagaccatttccaatccacaaggtaataagagaatacattatgcaaaagttcaagaaggagtgagaaaggatgttgaaagaacatttggtgttctacaagcccgctttgcaatggtcagaggccctgctagattttgggatacagagaccctatggtacataatgacagcttgtgtaattatgcacaacatgatcattgaaaatgagcgagatgaagatgtagactttgactaagatcaggaggacagtgaggtgttgaggaaggaggaatagcaacgacgtaataaacatgtgttagagaagtttctaaagatacataaagaaattgaagaccggcaggtacatgagcaacttcgagatgatcttgtggaacatttgtgggcgcttcatggtgctcggtagttcaatttttgcattttctatcatgtattgggttatgttcaatatttgcttgtaggacatatcattttcatgtttgaaatttttgaactcaaatttgaattgtggtgtttgaaattgcaaatttgaatatggttgaattccacgcgctagaattatttatgtttcaattattgtgtgttaaactggatataaatataaattctatactaaaataaaagaaaaaaagaaataggggctaagatatggaggctactgctagacataaagacatatttaggatcctaaagcattgggggcagctcccatttaatctttggggactctaaagtaggggctactactggagatgctgtaaggcgcgcgactgttgcatgccatatatggaggtctcagccgacggcgacgacgaggggttggctgcatcaaccgcgaaaaatggagaagcaatggcgacgacggtgataagctgtggcattattgagaaagatggttgggaaaagagagtgttttctaaaatttgaagagcaacaagtgtttccctcacatagtggagtcggcatgaaggtgagagcaagtttaatagtatagctcactactagctctaaatcatctttagccaatgtaataaccaattcatacaatagttgcttactatactattaatatctggtcccacatgtcatacacgaattatgtcttggagtccgtgctgtagctggctacatatctgtagcccgctgcttttctctcttttcatttatctctttaaaatatatttgtagttggcttatagcctgctattgtacctgctctgatagagggggactcacgcccaccactgttagctccttttatggtcttgttgggaagacatacttgtcacattgtagctaaccagcaactgcaactagtcaacagtagctactcccaccgtcccaaaaaaaaaacccaatcctgggtttgaatctgaatatagtgtatgtctgggattgggttttttttttttttggacggagggagtacaacttatataggtgttgaagccagcaagtgtagggagcactagttcgtgtgcaaccgaacggattggctgtacagcacagccagaaagttgtaaaaattggagtaccgagtagagtagagatatgagattatagacatctcaagttttgtgtgttgtgggcttgtggcctgagttccgagtggggtggtagtgaatatggacctggcgggtcaatttcactggacatggtcttataggtgctttgcaaggaacacaccgacctggccttttcggcctagcccaaccagccttgcagcatactccgttcgtttccacttaaaaaagtggattaagttctggatattcatgtcacgcttttcaaactactaaacagtacgtttcgtgtgaaaactttctatatgaactaattcatttttcaagtttgcaataattaaaactcaattaatcacacgttattatcatcttatttttacgtgaaacacttaatctcgtcatcttcatcttcagagattcaaacaccaccattgcacccttattatatactgctactacgctacacaatgttttctatctcacatcaaaattcaagttagattataatttgtccggtatgtgtatctttatcttctaaagccagaggttccgctggaattcaattggtccacatggcatattaaatctgcgagcgagttgatgaatgcgagtttctacgttaaaaaaatcttcacatttttttctaattactatcattagcattaactagaggagttagttatgcgcgaaagtatgcgtcgctggtgcgcacacgccagctagctttccccgttcattcgtgctagcttcccctgttcattcgcccgcacagaaacaggcagaatgcataataagaaactaaaaatagcgtaaaacttaacagttgaaaaagagaaaaagaaagaaagaagtgggttttttttttaaaataaaaatccttagacaaatacttatagccccaccggttgcctaaacagaatatgtcaaagccaaaatttaaattttaaaacataattttgaatgattataagatactgtcaatgtagtttctttttcagcattggtttttaa

SEQ ID NO: 60121 - DNA, 736 bp, Oryza sativa
acagttggcttgcacggtatcatgctggatttttgtaagttcattttctgcatcgttccaattagtgatcctaatcgtttccagattacttctatttggctgcttctccatcaatttggggcagaatatgtgatatccgcatattcgatatgttatctacatagctgttgttaggacatagaacgcaatccatgtggtccccggatattagctgcatctaatgctattgggcaatgcaatccttcaaatggagagttttggacaagcaacatcattttgcatacgattttcattgttctgttttcagttttcaattgttgttggtgaactaaaagatataacaaattttgcagcctagcccaaagcaaccgcatacgcctgatcgttgtaattattataaagcgcttcttgaaggtaggacaggaagtaagcctcttggcaacgacatcattcaggaggtattatttgttcgtgaatcagtacaatttgtcaccttccatgctgtttggtttgattaatgaaatgcttgtgaaccattattaggtgggagcttactctccatcccctcgaattgaaatggaggtggcaacaaagtgggaccgtcggggcctcaacaatttgaggggtactgatggtgctttgtgtgaccgttatccggtatctgccgatgcagaaatctctgcgttaaaggcagagcttttgcaggcccacaaccggatccatgagcttgaagctg

SEQ ID NO: 60122 - DNA, 706 bp, Oryza sativa
aaaacaaaaacaaaaaaaaaaaaaaaaaaaaagaaataaaaaaaaaaaaaaaaaagaaaagaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaacaa

SEQ ID NO: 60123 - DNA, 546 bp, Oryza sativa
ttatgtttatatgtctccgtatggataacaaaatataaaaagcagtttattacataacaccaattcaattgagtaattcatatataagattacatccattcatctagccaccacattgcttagttaattatggaccaaataatgtaaaacctgttagccagggtggctagctatctggtttgtttgcgtctatcaactcttagactgtcaattggtcgacatctacgcttatcatttctccctctactattgctgacgccaccaacgcccatgtgaacaccgaagaaggagaaagcgatggcttagcatgtagggcgccgcactgccggagttggtgtcgtggttggggaaaagggataaatgaagggaggaggaggagaagagaagacgctagtatgtaggacatatgtctcttttttattttatttagtgatggggctaccacgtggacaccacgtcagcaaatactgccaatactgctctgagagtctttttaaccggtgtcaagaattggagttgttattatatccggttttgtggttgagg

SEQ ID NO: 60124 - DNA, 3628 bp, Oryza sativa
tcctcacatcctaccccccaccccacgcacccccccccctcccgccggtgcaccccagctctcccctcccatatttacggagtaaattgtttactatcaaatctatctgctgcctatattactcactccctgtcttgtagtagaaaccgtccacccactttctcctttctctccactttttacggatctggtgctcctcccctgccccaccgccgcctacggccaaggagtggcggtgtgcaggcgacgggcggccgacctaatcaccgcccactcccaccgggggtcgtcgtcgggtcgtggccgtatcggcgtgcggctccggcagcggcagttcagggatgaggaggagcggcggcgaggcgcatccagccacggctcggagacgaggaggttcgggcggtgaatccggtgatggcgaggcgtgtgggcggcgtgcggctattggctcgggcttcctccggtagccagcgatggcgacgctttgcggaagcggcgggcgcggccggcgacgacgacggcctgcgacggcgacggcttgcggcagcggcaggcgaccgtcctccacccggatccggcggtggcggcccggtggcggcgggaggagagcccagcggcgtagtcggcaatggcgtggccggcgacggcgacggcttgcgacggtggaggatgggggaggcgagggggaagaggcttcgtgctcctccaatcgggcgcattcgccgccattccgcccgcgctcgccgaggccatcggcgccgctgggtagggcgcgagcgtcttggaggtgatgggcggggcgcgcagactgctcgtgccggacccgaccgggacctgctcccaactcccgtggcatgcgagttgagtggtgccagatccgttggctacgactgggcaacggctgatccggggtaggcttcgtgctcactggtgctgccttctcccatgactccgacctccctctctagccgtcgccggcgtcccctgctggatgcagtcaatgtaggctcgggactcgcctgatctggggtggatcgacgaccattgggctgtcgaagcatagcagagacccaggcagagatgtactccctccgtaccaaaaaaagacaaaccctggtttccgtgcccaatgttttaccgtccgtcttatttgaaaaaattatgaaaaaaattaaaaagacaagtcacgcacaaagtattaatcatgttttatcatctaacaacaataaaaatacgaattataaaaaaattttatataagacggacagtcaaagttggatacgcaaacccaggatttgcctttttttgggacggagggagtaggttgctgcttgcaggtccgccactgcccgtggacagacagtgctcgtcgatcgcatttgctgtaggcgccagcgactagtcctgccaggcctgactggagaacggtgggatttggtgctgctgcaccctcagcggcgctggttagttcctttttttttttattggatcgatggaagttctgagctgagcttgttactattgtgcttttggctttttgtggtctcgatctagttgaacagagctgttctaagagcatcttaatattattcccttgcttagcagtaaccaagtattacaaatcaatagcgataagtgtatgaaataaaaaatttgcccctttatatctttgtagtttgtaataagcctgctaaattctcaatgttcatgtgttctgttcaaaatttatatgattcagaaattatccaaaccacttgtgctagcgttattcataaattaagatgtcatggctgatatgatctgtgtatgtttgaatttcgacagtaatctcaaatttatacaactcaaaacttgtataaaccaccggtgctatctgttagagcttgcattttcagaaatagctgtaattggacatattttcataaatgatcatgtattcttagtgaatttggttctatgtattgttgtgatgattgctgcttttgctggatcaagcatcatgagtgaatagccctgataccagaggttttttttttttgcaacgcatgaagaaccatgctctcatcttaattttcatttgttcagtcatgaattgtttgtgcaatatattcagaaaagtgttcccatgtgaatttcatttgtttagtgatatatttgtgcgtgcaatatttggataactgccaatagcatcatcatcaggttctctgatatgtttgataaatgaaaactctagaagctcaattaggtagcagttctatgaagttttgtggttcaacagagcatatcaattgattttctctgaactactctctgaaattttgtggttcaacagagcaaaggtgtttgaataaaataatctacaacctattaacgtgatgatggtaacgttttttatcagtgaaggattaaaactccttgattcccatttatttatgcgaaggaaaaaatgagccattttttatcccagttttgcatcgcggaggaaaaaaaaatctatttttcaaatgttatttactgatgtgtcatgattcatgatctgagaatttatcattgttttagacggatctatttggttttacttaaatgctcaccctctagttttaacccttctagaactgtgccatctgcccatctgtaatatagtgtagtggaatgattcattcggctcagttgaactagaaaatctagaaaatgaaccttgcagctgaatgatttattccgatcatcttgaccaaatagatttatttctggatttggtatttgctttctcattctgctgagttgcacaatgttcaattgtaggctgggagtaaggcgagcccaagaacattatagtccggatttaatttttgctttctcattttcaggtatagcagagtacattatgctcatgtgaatacaaccaagtacattttcagatccggttgctagctagtgccatggaggagcagcaacggccacctccatgacgcgactccgtcaatgtccagccagcgccagccatctccgccaccaaccaccggccggtgtctagatctatgttatattgtcatggagtaaaatgtttactcacaccatatgattgtttcatgccgtgtaggcttattgtaaaaaagttactattctcatatttctcattgtattcatatcgtgtaggtttattgtaaaacatttaccatgtgctaataagtgtccgtgaaaaatacttgagtctatttaactatatttaactagatagtaaaattattactcaacaataacgaattaatctaacattatgttcacgagtaattgatttacttagtgaggctctagtgtgaaaaaaaccaataacttattgacgaaaacaatattgggcgcggacgtaatctcctagtaattcttttacttatggttccacgttagaaggaaaacaacataaattaattgggtgtgcgggagtgttagtaactcgtttactcataggttgataggctcttttactactataagtaatttacttactaaaagatggtcgcgaaaaaaaaagaacgtggcatcaaaaaggtgcgggtgtggggcggttgggggtgggggaggagagagaaaggtggtttttctgggtgggagtgggggtggggtgggggtg

SEQ ID NO: 60125 - DNA, 6142 bp, Oryza sativa
aagggtcttgtcacactcgcatggtgacgtgtcaggtatagcacggtgaaaaatggtggattgtgtcttgtctcttatgggtacagttgtgcacctttggtaagagtaaaactattcgaatagtcatgctcgcgattataggcgatcgactagatgcaccgtgattagtttcacaccattaattaatttgacttaatgaactagtgtagttcatgtggtatggttagatctgttcaacatggtgtagcgttgttcagtggaggtttaatcttgccttaattaatcaacaattttattgttttcaactataaatgtttacacccgcctttatgcaaatagccacaaacttcacttgtttccccttgcacgattgtgtcattggtgtggcttgcgtcatacggtggttatacttagccttgctataattaccatttttcagaagtgtagtgctactgagttgaaaacgaagttaaagtaccaaggcttatactccagttgtgtttactaggatcacctcttttccgttgctgccttcttttggtgtgatgactaaatgcctattctgtaagtatttacactttatttacatttggatctatatattaatttgttattttgtgtaccctagcttgattcttggacaaggatttatacacagaatagtttgaaaatttggctaaatttctggtcgtgacagcagagttcttcacaaatgcactataggtagagatccaaaaaccgcgcactatacacattttgtgaaccttaagccttactcgttctcttggttgtggactctatgccagcgatttaggaaaatggcggcatggctaggatgtgccgatgatgccgtcgaaccagctcgacgagacaatgagggggtgggggtggggggggagaggggtggaggaaggaaagtcggaaggagggagagggagagggagaggaaaaggacgaggagcaagtggaagtcggaccctcccctcctccccacaattatcaagggggtccatctcgatcacagtataagagggctcagttcagggatcggaagaataccctggaccatcctagtgctcctatgggtaggaagaggtaagttagttggcatatctatgttcgaacttgtgcgaacctttattttggcttcttgtatgctgtaaagggtatggatggatgtggcaagggatgtggatgtagtgctgtgtatggattttggatggatggatgtgaattgatttcggatggatggatgtgtgctaagggtgtatttgcaggtggtgatgactggatatagagctggttgttagttcctgcttggggccatacttcatagctaatgaagatggcgctgaaatgtccaaacttagctccatatagcttatcgctaaggtatggcctctaagcagccaactgcaagcctagctcagagcaggtgcatcggcactgagcttgaaaaccttggcgccacgtgcattggcgctgagtttgaacacctcagcgctctacaggctcgcatgactatgttccaaaccgcaaaggtagatggtgctgaggccttttagtccgacgccgaggttggcggcttagcgcctcatggctgcacaacacaggagctgtgttggacgagatgacctcgcgcggcaatgtcccgaaggaggtctttccttctggccccatctacattggtgcttaagtctttcctttcagcggcaatatggttggtgaagagcccctgccatgtaagtgaggtgattggctcgggttccatgtgaacacgggagtcagcgccaacggacccggtgttgacgcgtacaacctccacaacaaggtggtggggctgaggtcgtggatcatttttggttgatttttttttgcatggtgtaatttcaaaataagtttttagaaaggatcaatttgtcaaaaaaaagatatattcattctccgattttgctaaacatcacacgggtgatttttcgttgatatttgacagatttttgcccctacaattatgcgccgagatcagtacacgattctgcgtcaatgttgtcgtgaggtggagaggagacctcgtgggtcccacgtttgccgctgatcacgattcacaagaaatttacatcctagctacgtgtaaatatcctatataactaaaataaaatataaaattacagtcctatttaactaaaattacatatgtaaattcagttgatattaattataatcctatttaactaaatctacatttgtaaattcagttgatttgacatgtaagtgcactgtaattttgataaaaataatgtgtaagtaaatatgtacttattattttctttaaaatataaaattacaatcctatataactaaaattacatttgtaaatttagttgatttgacatgtaagtgcactttaattttgataaaaataatgtgtaagtaaatatgtacttattattttctttaaaatataaaattacagtcttatataactaaaattacatatgtaaatttagttgatatgacatgtaagtgcactgtaattttgatgacatgtaagtgcactgtaattttgatgaaaatattgtgtaagtaaatttgcattagttattttatttcaaatataaaattacagtcctatataactaaaattacattgtaaatttagttgatatgacatgtaagtgcactgtaattttgataaaaatgttgtgtaagtaaatttgtattagttattttattttgtagtccgttggatgcaaatccaagggaggaaaaaatctgggtgattaatcacccgagtgatgcataagctgtcccttcattctctcaatccaaatttcatcggagttatagttgataatagctcgctgcggttaacggctttgggtggggaacaggggaaggcaaaacctctgcttgcaaactccaaaaccttctggaacgtttcgtcgttcgaatcgcccgcaccaaaatcccacccctcctcttcctccttcctctgcaagcaaagcaacccggtggaacaccacgcgccgcacccctcctccacctcgctcctccgctcccgctccccgccgccggccatggtgctcgagctccaggtccaccccaccccctcctctcccccatttcctccctcctctcgcttcccccattcggcgctcgctccgcggctacccgcgagttcgctacggtgattaatttctgaaggtttttattgttggctggaacccaatgcattcgcagaggagcatgcaggcaactatgatatgcgtcgacgactcggtgtggatgctgaaggaggactacccgccgacgcggctccaggcgcaggccgacgccgccaacctcgtgttcgccacgaaaatggcggttcgactgcaacctcgtgttcacacaatttttggggtttttttttttgactccgggagtttttgggggcgtcgtgttcgttgcagtcgaatcaggcgaacacggccgggtgccggccatggctggggacagagtgcgcgtgctcctcgcgctcaccagcgaccccgtcaagttcctcgcctgcatgcgcggtgcgtgactggcccccaatctccatatagggtgtgtttggttcccggtcaaggttggatgggatatggcggtccatattttcctggatatggcgatccagttttttgtttggtggagtgaatatggtgatccagttttttgtttggttgtagggatgaaagtggatatggtgatccatttttttgtttggttggaggagtgggatggatgagtgggtacaatcactcttccattagaagtggtgagtttacccctatttcaacctactaaaaaaataaatagaaataaaaaacagaacgaaataaaaggggaaggagaaaaaaagaaaaaagaaaaaaaaatcttcctctctcgaaatcgccggccgcccctcgcctcctctctcgtcctcgtcggccgcccttcgctcatctctcgccctcgccggccgccgccgcgcctcctccggccgccgccgctccagatccggccgcgtcagcgcctcctctctcaccggccaccgctgcgcctcctctctcaccggccaccgctgcgcctcttctctcacccaccgccaccccgtctcctctctccccgaccgccgccgtgcgtcctctctcgccggcgcggcacgccgcccccagatccagttgccgtcggcgcatcctcttcccgtctcctctctcaccggccgccgagctcgcgtcccactgccgccgcgctcgtcgcccacgccggccgccgagctcgctgcccaccgtcgtcgcctcctctctcgtcgcctggcctggctgccgccgagctcacgtcgtcactcaccctagccgccgccaagctcgcactgtggtgagaggggtgacgcgacccactatcgctcgcccccgctcgcccgggcgctcgggcggctgcatccggccgaatcggccggatccccccatccagcatctggggggaatattcccctccgggccgccctatcccacctccgaccaggaaccaaacacccacaaaaaatgggccgccatgtcctatccacccatatccctccatccaaacacatccataattgtgtgatttcgcctgttcctcccactattccagaatgtgggatagttccttgatcaatccatgatcactttggtttggtttggtaactttgataaatgatggttggttggttagcgtgcagtcgtgcatatggtttattgatcaatccatgatgttgtttgcaaaaaaatgtagtgttaaatgaacgctaagttgccaaggaaccatcaactttgcttatcctcctggaattcaattctgaatatatggttctgtcttgtccaggattatcagttcagttagaaatgatgttagttactgcacaatagtagttcactgatcaatccatcacgttatttgccaaatggtgacaagcacactgatctctttattttgtagggtagtgctaagcgcaaggaaccattaaattagcttatactactggaatgcaattctaaacatatatgggtctgatcacttagtcaaatatgatcaaggattaagtaggaagatttgtggtttctgtgttgcttatggaatatgtaaccacattctgttgttgtacgacttagcaaaatccatacgaagaaatgatgctgatatatgtctcccatgtatggttcacttgtttttaaaggcagtgtggtagtaattgtacattcgtactgtcataaactcgtcatctatatttgctttcattttttttgtaccattctaaaatattactacctccgtttcaggttataagactttctaggcacacatatatgtatagactcattaacatatatatataaatatgggcaataataaaaagtcttataatatgaaacggaggaaatatctatattacaaggaagagaggatatgtatggaatgagaaccgcaaaatgttaagtcttcttgtgatcgatcagatacttgatagttgataatactgctgctttaaagaaatcatgtgccacatatattcctataactgaaatacttatctttgcagggctgaaagttagtggtgaagcaaatttgactgctgctttagaggttgccgaactggcactgagaaatcatgccgacaaaacactgagccagaggatagttgtttttgttggcaggtatctatctatctatctatctattatctatcttctattatatactgtccataagacttcctacaaacgctctcaagccgccaagtggcgctctaataaaatagagaaaatcctagaaattctaagaaaaaagcaaaaaatctaccccttgattttcacttaaattggtggatccaatattatacaccattagataaaattgatcttaaaacaaactaaatactatgggtcccacctatcctcctcctgcgcgttggcaggtggcaggttcgtacgtacatgtacgtatgcttccttcctttcttttccttttttttcttttttccatatatatatatatatatatatatatatatatatatatatatatatatatatacacacatactatactaaacccagggtgcgtaataactaaaatgctcctcctcacatcctacccc

SEQ ID NO: 60126 - DNA, 10651 bp, Oryza sativa
cccgtccgtagtgtcttgatccaacctgggggttttttcaacatgccggaaagctcaagggcaacaagatatcttgggggtgcggacatgttacccaaggagttgataaaattagattgaccttcctcattgatcgccaaagtctggagaccacagctgcaaagatactcaatagaagagcgtagttctgtcaagattttccttgtgcccggttcctctgggttgagcttgagcttgtaaatagtaagcttctttagacccgtcaattgatgaaggcctgctacagctgttgtctcatcgatcttgatcccagacagtatccggagtgctttcattccttccttctctttatcttgggtcaacatacttttgtgttgctgcttcttacttttttcttgaggcagcctcaaccctttccgtgggtttttgtttttactcccaccaagtattctgctgattagttttagctgctctacttctttcggcagctctttaacacgtgtttctcttatgtcaagagtttccaaatactcgagcttcacaatcgtcggcggaacatgggtaatatccgtccctcggaggctcaaatacttcagcacaaacatcttacaaatgtgtttcatatgcctgttcttgaatcccttcagtccttgaaaatccaggacttgtattattctgtcattgaaagcatggaatggaagctgggtgaggctcccgaaaacggtcagtgaccgaacttgtgacagattcatgccttttgttgaatctccatgcttggaactgctgctctgcatggaaagccgacggactttgttattactgggtgctatcatcatcagatgaccaccaaccacagtaataaaattctcttctcttgccttggtcacaatatagtcaagaaccatgtcatgaacttgaaaggtttttagtttcccgttgctgctgtgctccacaggacgtatcaactttcttcttaaaatatgattgaagtatgattccgcaacttcctccgccgtcagcccttgctttgcattgacaaaaccttcagcaatccatcgcctggacagacacttcctactaattttccaaccctttggaaatattgccaagtacagtaagcaggttctgagatatccaggcaaattattgtagcaacaatcaagtatccttgtaaccccatccaaattgagagaagtttcttgttcctgagccccagcagtaatagaaacctcttctggcaataatttgtgaagtccagcccagtaactctttggctggtcttggttgcacgccactagaccagccatggtaactatggccaaaggctgacccccacaccttttccataaatcaccagggacattgttctgtaccttgtgtctatctttggtgcttttggattcagaaacacttcggttgaatagctccttggaatcacgaggactgaggaaactaatcggatacaatagatccttgttttctggccggcagcaggtcgaaccaaccgcttgaaatcttgaagtaactattattctactgcgctctttattatcagttagcaacaaataatctgatattgttttccatgtttttgcagaccatatgtcgtcaaccaggattatatacctggcaacaaaaagaagacgacaatgtgaggtagacgaagagtccatcatccagtaacaagcttataaattgaaaactacaaacatacataatgtgccaccacgtacacaaaataataaggaataaagcaaatgatttaaactaggaaggtagcccgcgtgaatgcgcagacatgcatcacatggtaagtttgagatacttataagagcgaaatattaaccggagaacatctaccatgatttctctgtaaattgttttcatcagcattaattgcttttataattttctaacctctgaactttatattatatcatatttaagtaatatctatgagcaattatttataatcgtcttcatcatttgaaaagaaggtagatttattttctttagaaaacatgccaatgaaaagtaagtgtaaagtaaaactaaggtatttttctttattttaattgcatatatattatcatggtttattcgaggatgaattgggtgggacaggaagctccactaaaagtatggatcaatttatatagcctaatatgattgatgtagtttgagaaactactacaaaacttcaaatagatgttgacactataggtgctagaaatattacaaccggcacctataaaacttttcccaactctgcggagtgacaaaatagaaaacccacaccttttagtaactacatgtgccggttctaaagaaaaccggcacctatatcataagtgctggttttttaaactaaaacggtacctacatagaggttaaaagtgccggtttataaaataaccggaactttaatagagacgagcgaggattttttttttctagtccttatcttctcccgcacctcccaccaccgctcattctctgtctcgcctttcccctcacctttcccctcctcctcctcccatttcccctcacctccttctctacctcctccaccggcagcgacagtgtgggaaggccactggccacctcctcctctcgttccttcccaccagccaccggcgctcgcgggtggccagatccggcgccgctgctcctcccctccgtcccaccccttcccattagcgctcagagcggctagatccggcacgcccgcccccccccccaccccactggtgctagggggtggctagatccggcacccccaccacaccggcgctcatcggcggccagatccggcaccgctgctcctcctctccgtcccacccccttcccatcggcactcggagcgggcagatctggcacccccccaccacaccggtgctcaagggcggccagatccggcgcagccgctccaactctccatcccaccctcatcccatcagcgctccaggcagccaaatccggcgccgccctgaccaccggagcttgggggcggccagatccgacggtggtggtggaggaggccgggtgtagtggacgttggcggaggtggaggctgggcgtggcaggaggcccccacgaaggtgcagtgggctgcctccttgattgatttttgattttgtggtgtttttgaatgtgttgttggatggcgagcaacagaaatgtgttgttgttgttgttgattcactactgtctctttttgttgttgttgggtggatggtgagattgtgagaaatgttgttgttgatgttgatggatgtgttcttggatttgggtgatggggagttgcacgatgcacaatatttttatatttacacaaaaaaattgaataagacaaatggtcaaacgttggttaaaaagccaacgacgttatacattaaaatacggagggaagtacgtatgtatacatacaactattcacgggattttttttattcggggaggttacatgggatgtattttaaataaatctaatctaatggtttaaaaatagcgggatccgccaccgccgtcgtctcctgttcgggatccgcgccagccgtcctccgccgccttgtcgctcgccttcgccaggcgcgcgacggcgcagacgctccgggcgcagctcctgccgtcggcggcttggcgagttcctgacttcatcgcggccccactgctgcggcggcggcgggtaggaaccaccgaggctgacgaggccgtgcagactgcgactgaggtgagaggggcttgcttccccatccccctcggagggtgatttgtgcattttgttgcacaccacatgtttttttgttgcacatagtgtgtccatgatgttgcaatccgtatttttctggatgtttcttaaatcaatactggatgttgcatttggtctcttcgggatgttgcatatattggttttttgttgttgcagacaatgttttttagtgttgcattcgattgaaacatgttcgataatgcagtgaaacatcttcgataaagcagtgaaacattcctcaaagataaaacatcaagaaacaattcgtgttgaaacattttttttgagcaatgaaacattgcaacattcattcaacatactgtgaacatcgtctgggagatttcacgttgaaacattttttttcgagcgatgaaacattgcaacattatttaatatacagtgaaacattgtccagagatttgcaaatctccggacgtccgatccgtagctttccccctatttttttcttccggctaacagtaggaagctttatttgattttttttcgattgtattaacgtacatatatttatgttctctttccttttcccagccaccagttaaatatgttatttggagaaaaaactatcacctttttaataatagatctaatctaactgtctaaagtatcatgtccatcaatttaaataaaaatcgacggtgagattagatagtgccatgtggcggtctagaagtctttgtaggagcaccacgtggcggtttgagagctagcgtttgtagaaagtttaatgaacttttagtatatagatatagatatagatatagatagatggatggatggatgtacacacctctttttatccaggagcttctttatttggctttcgagtttgttgtcggtggtttctgtgcgctttagattggaggtctcctcaatactgcgagggctgctttgacggagacttcctgtgcgctgcacgtctcgcttcaatttgcttccaaagcgtgccagtgtcttgatattctcagaggttccagtcttgctgctgcattgctgcctgtaatctgggtctatttgcttgagaatatcattgagtacggcatcaaggtcatagttctgggacacagtaacccacgcccggcaatcaaattgatacatgactttcttgtacaatgccatggcaatggtggtcttccccacacccccaaatccaacaatggacacaacagcaggctcctgacaagcagtgccgtccacccactcctcaagatccttcatggccttctccatccctacaggctcattcataccaagctcatggcttgcgagctgatcctcagcaatgtcataagacgtcgcatcgggcgggcccttgcctttttgggtatttggattttccactccgtatcttatgcgtcggtcagcaatcagctgcgcccggaccttaagctcagcaatactggatgcaatctcacggcgaggcccgaacgtccagaggtcatacactagtgtgactatccaggggcagcattttgcatccaaggaatcgttggggaggcggtgagcaaagtcatctatgcagtcctcacagtcatatgccatgtcgcggatctgcttcatccagtgcttcttcctgttgtcagggtcttcccgggcgaggtcaagaaggaaggccttcatgctggcgagctcgtcactgatgtactggatgtcaccacggacgcccctgatcagatcatactcctgggcgagaaggttgcccagcttgcccaggagagagtccatggtggcagtcgaagcaccaaccaccaactccatcttcgtgttctttatgttcttcaatgcagtgtataaacagcaagcaaacacaaggtcagagtgaattgccaatgtacaggaccagctgaacatataaaaaagatcttaatcaaaatgtatgatgaatcacatcgggacgattgcgcgagctataaattatcggttttttttttttttggatccactggtaccaatagttagctagctaattattagcaaaggttgttctgatccatctcctaataggatgctaatagatggttgttgtcacctattagcagccatgaacctgctagtgaaactaatagttagcaatcgcctagcttgtagttactcagtcttacggctgaagtttgcaaactggtagatttagctgataccgttcttagcttgtcaagtaccaattcaagaacctatgcaaattatagcaatagctgtgctgaagtttttacacactaaaatgctaatacaatcttctttgaaatatcttctttcaggctcccttggtagtgcttgtgttctgggtgcagtttcttttctcgtcagtaacccaagaaactctgaagctggaactttggtttctgattcacttgataagataggagaaatattcctaattatcatacaagctgtgcagcagcttgacccaatatgatttgtgagatgaatcacctcctcttactcacatagacacactgaggaatgaaaaggccaacaaataaactagagaaacaggatgcaaaaaaagtatttctagttcaccgaagaaacactttcatgtatggagaaatattaatttcttgagaatctggaactatgccaagctcaagctcttcctgagtccaatctggcgaggaatagattgttcgacatcgagtaagcaaacctagcaatcaccgcggcttctagcgccaacaatttaggcaccagtagatgcggagaatatttcgaactagactagaatatccataactggattatcattgatacacagagtactcaataaataaaacaaactacccgacaacaactttagttcttgcttgcaaatacggaaagtaaaattaattccaatcacatagtacgtagtaccttgtaagttagctcaaggaaaatagttgttcaccggccggcaagagcatgagcgatcttgttagctggctcaacggggggggaagaacaaaggaaggcgctctcagtctcagatctcagtctcagatcgctcaagtgatagagaagcggaggggctccagttttgggtgcagaggagggacgcacctgcggcatgggctaattaatatacccaaatgtccattaacaaaaaataagcgttctcgaaatttgagtagctgttgtctcgctcctgttttgtttttattttatgaaacgttttggtcttcttctaagggcgtcaagtcaatggctagctcacacagtggccgtgtttagttgttttggtaaaaaaaattttaactatacggatacacatttaaagtattaaacttagactaataataaaataaattacagattccgtctgtaaaatgcgagacgaatctattaaatccaattaatccgtcattagcaaatatttactatagcaccatattgttaaatcatggtgtaattaggctcaaaagattcgtctcgcaatttacatgcaaactgtataattggtttttttgtctacatttaatactctacacatgtatccaaaatttaatgtaacggaaaagttgaaagtttaaagggaactgaacacagccaatatctatgagtacaactttggctgtgtttagttcatgctaaaaatgaaagtttggttgaaattggaacgatgcgacggaaaagttggaagtttgtatgtgtaggaaagttttgatgtgatggaaaaattagaagtttaatgaaaaacttcggatctaaacaccgcctttattacgggagtatctttcttccttccctctgccctcctttatgaacaaacccaccattggcctgtattttgagtgaggtaggtgtggagagaacagatactagacttttatctttctgtcttctctctcttccacgtaaacaacgtgttaaactcctgtaaaaaaaacatgttacactactcccttcgtacctatatttttgacgccgttgatcttttaaatatgtttgaccgttcatcttatttaaacacttttgtgaaatatataaaactatatgtatatataaaagtatatttaacaatgaatcaaatgataggaaaataattaataattacttaaatttttttaataagacgaacagtcaaatatgtttaaaaagtcaatggtatcaaatatttagggacggagagaatacattcctatgagttagctgaagtggcacagttgggatgcactaagctggtattcctagcatgctgtctgtgttgtcgcattgcttttaatataagcagagtaaactccttttttgaaaaaaaattaaacaaatatccattaataaccaacgaagccagtgccaaactggaagtccacaacactatacaaatcacatatgtattactatttctcacctctcttctaagttccaagctactttaattttatcactaagaaaaacttatctaagtttgatttagtttacggaaatatgcaccaacatctaggacaaaaaagataaatcctaaaaactttcacaaaatatacaaattttcaccataaattcagcgagctttaatcaatttttatactaacaagcattagatctaatagattttataaaaaaattacccatatctgtggttatgaaaaacagcacagagtaacactaaattttcatataaattactagtcatcttttctatttcgtaacacaaactaattaacctcttaaatttggatcaaaattacccattgataccattatcataaacaaactgaaatttactcccaaatgtacacctagtttgccaacctatgcacctaggactcccagttgtttttagataatgaaaaaatccggcttcagcttgtcgtcaatgccatagtgacagggggaaggggttgcttaactgatgccccataggacgctagctcatggtggcccttgcgacctcctcctcgagacacagtgttgggtgcagtgcctttacttgagctggtagtagtgtagtagtaggagccaaatctaaccattgatcctgatgggtacttaagaattttacttctacaccgtggaagggtattttcgttatttcagatgctcccaagaaggctagtgattcgctggttcccgttctttttgcgcgaacccacggccacggcggcaccgcccctcacctcaatgcgcggccgccgcccgctgcccctccttgcgtagtcgcgtgaacccacggccacgtacgacggcgccatccctccaccccctgtggccctgtgcaccgcagcaccgctttatttttgggatatgatggtgtatctgctctagggaaggtcgctttgtcgaaatgtgttcttgaatcactcaattgctatactgcaaaactaattactgaatcactgatgtttagctgatgatgtataatttaatcattttcgcattagcatcaggcaaatgagctaatgccgaagctcgtttatctgcagcagaactgagttgatggaccaagtactgagttctagactcaactgaaataaggttaaaaaagaaagctcaacgacttgcggttgcaagcacactctcactctattagcgtcattctaatcagctatccgaatctacaatttgactgacaaaaataactacaatcagatatgtgctaaaactgtgttagtgtcttcttataatcagctatttcaatctgcaatttgaccgacaaaaacaacaattgacaagaaattgaccaacaccagcatggctacgacggtcttgaacccttcatcggtttgatcaccttccggccttgtcttagattctgatatggatcatcccacttcaattaggtgttgctaaaccttgatgctacggttgaaacaggtgtactagcagagtccttttttttttttttgcgagagtactagcagagtcctttgacaggatctcatcatcagtaccaaattgacggcactgccaaacgcgtgaagtgcggcggcctccgtcgcgcacagcagcactgcaggtctgcagcatctcgcctcgcctccgttctccctctcgcatctcatttatcgacagaacgactctcctcgccatccccgcgtgctgcagttgtgaactgattgggcatattgacccgtggactagattacgaacttactcctaagccaattgcaaattcatcacaatgccatctattacatttctaacattacccctccacgaattatactacatctactaccaggtgtagtacgattgaatctaatccattagatcgaatcaaatggacgtctcacattcattttgaggtactttaaaaaaaatccttgggacaccttctcgcgtcgcggcatccttagccagtgctgccgaatgcattgaagatactgtttttacatggaaccggaggctgcgtgggatggagatttcgggaagaccttgctcagggcggcagggacttatcatgatgtgacatattttagtagagctttgaaaaattatacaagtcacatattttgtctatttgagtttaatttttctatgatgggttcctgtattctcctaagtgtgaaaaaaatatcaaaaaaaaaataaaaataaaaaaaactgcatctctctgtattgttcaacttatgacaattatttcatgtggttatattttgaattagagattaagtaatttcatatagtggtagagtgcattatgtttaacatgctgatcaaagggttttactaaaggaggtctaattttgatgaaggtgcaaagtaggctaagtggtatgctattttcgaatatctagctaagtggtatattccgtttgagtttaattttttttttgtggttggttgtatcgtgatcctaagtgcgaaaaaacatcaaaaaaataaaacatgaatagagaaacaggaatacaggaatggaggcgaggggtgggggggaggggggtt

SEQ ID NO: 60127 - DNA, 16017 bp, Oryza sativa
attctcaaattgcttttagagtgtgtataatcctgaatcatcatgagaactgagcatttttttcccctgtttcctcttcaggcaaagcagctcaatggaaacggtgaactatttagacagaagtatccaaaattaggagttcgaattatcgacggaagtggcttagctactgcagtggtgctaaaaagtattccttcagatgcaaagaaagtttttcttcgtacaggcacttctaagatagctcgtgccattgccattgcactatgtgacagaggtgtccaggtataatctatatatcaatttgcaaatcatcgttgtcttgaatatattttggttaatttttctcataatttttgccttaaattgcattacattaatctggatcaggtgatcatgaatgaaaaggaggtataccacatgctcaagtcacaaataccagagaacagggcaagctatttgaaactctcgagcgacaacgtacctcaggtaaaaaaattgttgcaagaaatggtgacaaactctcaagcaacatgatgcacctgtagactcttctactagtaatgttaaaatgtagcttatagactcttctacaagtaatgttaaaatgcagcttatattcatgctaatacttcatgttattgcagctttggatagtacacaatattgacgacaacgagcaaaagatggcgccaaaaggaacaatttttattcccatatcacagttcccccttaagaaacttcgcaaggactgcacttacatgagcaccccagcaatgaggatcccggaggaaatgaagaatatccactcctgcgaggtaatacagatatgttatctgctttgttaatctgaaaatatacgacatcaaagaacctcttcttaatagtgctactacctttgtggtcagaattggcttccaagaagggtgatgagtgcttggcacattgctggaatacttcatgctctggaaggatggaacatgcacgagtgtggggatgagatgatggatattgagaaatcatggtcagctgccattcggcatggattccttcctctcactaaagcttgacacctctggaagcatggatggtgtattccatgctagtagatgatgctatgatttccagcaacggcataatccattcattatctagcttgggaaccagatggattattcacttattatcttactatgtttgtaatactgagcttgggtactgataagtcatgaggaggcacagtgcaaacgaacttaattccaatagctcagtattttataatctatagtctatgtcagttctgtaacattacgtttatctcttatttgaatcttgtgggggaataattaaaataataggcaatgttttcttgtttagacttcgcaaagtaaaacctgactgatcgcacggtcagtgctcttgagacgagacaaacaagaccaggtaaagctaagcttactcgctggctcgctgctactatcgttttagccttcccttaaagtttgattcgacactgtaaaattcgcccatgacgctctgcacaaaatctttgaaactagtggcaacacagcaaaatcagatgcatcactggcttcacacttctaaggctgtgttctttcctgggtgatctgggtgattgtgagtgagtttgtttcgttttccgcacgcacatttcccgaactatacggtgtgttttcttttgcaaaaaaaatttatagaaaagttgctttaaaaatcatattaatctatttttaaaatttaaaatagttaatagtcaattaatcatttgctaatggctcacctcgttttgcgtatattcccaatctcctcgatttcctctccactatcgtttggtttgaaatgcttcgttcaaaaaggaaaccatcgacccttcaagcacacagcaccagtggtctagtggtagaatagtaccctgccacggtacagacccgggttcgattccaggctggtgcacgttttgttcttctcttacctttttttttaaccgatccgatgactatgatctccaaaaagtaaacacgcagagtatcagagtgtactctctatttgagtaccagagtactaggcatatgtttgtgtcatggaagagttgcacagtgtattcttccgatgactatgctctccacgaagtaaacacgcagagtatccgactatcaactgcatgtattgattcagagtgtactctatatcagagtatcagactactaggcatatgtttcatgtttgtgtcatggaagagtggacagtgtactcttctttcttgcatgccgaaaatgaagggaaatagtgctggaagaaagcagaaatgctccacatacaaatgattccccaatataatgcattgagctagagctatatcatggcagagagttcacattccagaattctttacatcacttggtattggtaaaaggaacaaagaacgggcaaccaagcatactgctttgcgggcaaccaagcttggaaaaaaaggacagcagttcgtatgagctgttggaatatttaagtgctgaaccagcagtctgtaactctggaatctggattgtttatcctattccagagaaaaattactatatcatctttctggacgataccatcaatggctctgcattgacttccttgaatcacttgaatagcagagtagagaattcataggttaaacccgcgccctcgatttagatcctgtggcagtatataaacttttgtcagctaatgcaatttcattgatgaaccagacgagtgcagcagcatagaaccactcatctatacatatggagacacaaggtaaatgcctcacagaatcagcattaataaagccatattttaggggagaacctcaacttcctaaatgcacatatagatgccatcaggaacttactgcgcgttttgtctcggcaaaactcacttccgcaatgacatttgaatgccttcacaggatggtcgacatcatcaaaatcaatcccatagtcctgcaggtaaacacaagatcatggcaaacttcgaaaaatgacttacaacaggtagtgctccatatgctacatgattcaaccaaacaaaggggggatactatctatgggaaaagcactaatgagtatcaagtcacaaggtggccaccaaaaggtcaaaaagcccaaaacataagatgaaagcaaattcaactagaatgtctgaaaatggttatagtccacatgaaatggagcttaaatttaaattgtggagtacaacctacccatgtgagttcctcaaaaggctctattatccttgttgtgaagaacgccagctaaccaaaaaatggaagacacagaataagctcaatatggtttaacttggactaatatatatcagttacaagctaaagttgaaaaaatacatggtaataatggtggtcgggcgtctcgatctcaacaggtattcctataatattagcatcaaagcacctgaaaaccgtacaatgatatgccaggtcaagaaggaagaagtgttagattcagcagagcacagaagcaacatttttttaagaaatacttatatattcaaaatttggataagactttgttctgttagctagcttcaaataagagtaacattgacttaactatcttgattaagtgctgacatcaggcaataatataggttgcagccaaacaatcactaatctacgacatcaggcaataatataggtgcagccaaacaatcacaaatctacgatgttgttcacagttttgtaacgagaaatatcatataatgacaactgaaaagcacatattaagttagttcacagaaccagggttaaacgctatggtccatgaggttttagttgggaccccactggtagccatttaccagtcacaccaattgtcaattttcaatgaaatttcctacactttcaacttgaagcacacatatcatggagaactcactaaatcgcagaacagtcagaaaatgtacatcaccaggttctcactgggaaaaccagaaagcgacaagaaccagctcatccctttttttacccatcccatagaagcaacagcttcatgtattacagaggactccataacaatcattagacgttctggtaaaaaaagaatccattattataaataataaatggatacctgtggtttataaatcttgcgacgttaccataaaacgtggcatctagacaaagggcttcctcatccttaagaacaccttcagtaccccagtcggcatcaagtaacaatgggtatgtgtgctttgctttaccagtcttttgaattgtacggtcatacaactcaatgttcgttaatatttcaccaacatactcacaaacaaaagcacctcgaggaagtttctcagtactgcgcaatccccatccttttttttcaggggttaagaacacctgaaattttagaaagaacaagaaaaattattaaaacacgtaagcaatgagatgtttactgtgacaagcacatgatcatacacatgatgcactatcacaacaaactgctgcagctaacatcataatttcaacaatatttggcagttgacaaattatcgtcaagctagcaaaaactttgatattattacttacctgtaaatggcgtgtgatgcctcgctgcaccacacggtttccacaatttctagtgcagccgcattttctccagcactccttgatgaatttccttgtaaggtgtcctttacaaggaccaggattcatttctgtgtttgatgaatcagaatttacttctatcttcattcgttcgtttgggcaaatcttgcagtagaaatggggatgtttaagtggttctcgaatcattgagatacagctatctagaaatgctcccttaagaaggccatctgttgtataagcaaactctcctcctgtttctgcagcacacgcacaaggaagtgattgtgccagacaatctctgaaacaatcagaacagcaattgtcatctccgattctagcaagggagatgtttacataggcttcttggagtgtgatattgtgtggtatgtagtgaaatggaggaggaagaatcccattgccatattcattaataattggaatccttaaacgttcttcaccttttgtgatatcattgacatcatgaggtggtctgttggcaccaatatgtagttgatgcggaacaaccggcatattactagaattctggctaactccagcaacagtgcaagaggaagaagtaccaccaaggctcatgacattattaggtggcataaaagcggaattagcttgatttgactgcaatatttgcggcactgaaggtttggacagaatgtccagggcaggaacagtttgtatgatgccttcatgtctaggtccactagattcaacaatacactggcaagtatctttaataagattcttaaaagagaaattgggttctaggctcttgtatttcctaaggcatctagcctccattttcttgcaaattaatttaatgtcaggcagatgaaaatcagaacggtttgccagggaagagttgtatgtgaatgatagtttcccagctccataatttgacaaaactacctcaatgttggatggagaatccttgctgcttacaatttcctggttgctacacgcaacagccctgttcctttcatgcgcaccagatacaccttcatgcttctgatcatggcgagcaccagaagtcctacgtgcatcttcataacgtgaaaaatagaaaatccaaaagacttgattagaaatgaagtaaagagctagcaacaagccaaaaaaagaatataaacatgacagcaacaacaatgacactttctgcaggaagcaaaggacatctctagaatactccaatattgttcagtatcactagacaagcatgctcgcaacagagtagaacagggatttaaaggactgacatttgtacagttattagagatcaaattctagaccaattctttgccaggagatatcaacatccagagctctagacctccctgccccatcccccaaaataacagacataagatcataatccctcagacatccacacataaaattctatatatccaaaaaacagccacatgtttttttttctttttgcaaaaagtgtatacgatatgtgaataaattccacaaaaacaacactacctttcacaaaactataaaaatcacacttctaagcaacaatttcagataactatgtgaacttactctctctctatatatataccattatagaggtatacgtccactctttgaccaaaattgacaacacaattcgaaataatctctggccaaatataaatggtctttaagttaatagtcacaatgcaagattttcacaacttctctgatcgcaatatattggcaacaacattatatcaatattagtttttttcgccgggaaggccgaaggaggccatctgaatatcaatattagttttacttttggatatattgacaaccctagttcaaaaggagtgaccacaaaatcccacagaaatattacttaaataacgggtctttttcaaatccaagtttgaggatcatgattcttattgtgaaagtagtagtaaaaaattctctttaaataataatgcactcatgtctagcaaaatgctttacaatacacgcttgctctcaaagcctcaacaccccattaactggaatttatataaagtattcctttcaactctaaaccataagtaattcatcttttttttaaaaaaaaaacgctacagtgatgtgtaggtaggaagctgattaacagaccaagactatattaacataatgttaacaaattgataaaatagcactgaagttgacaacaatacaacccaacaattaaacttactccatgaattcccaacaataagtagtcattaattttggatggtctatgaattaacagcattatgaaagtaaattgatgatggacacactaatattgcttttatgcagctgatttagatacatttgtcaaatttcaaaatgttgttaccgcaccacgcccaaaagatgttttggaacggatagagtggagagaagaatatttagattagcacactcaggtagacaacattaataggctgggcgacctgtatgttttagtttatacaataaaactagattaatttgtgggaatccatcaacaaagcattaaaaggttagcattttcatataaattattaacactatgtcgcctacaaagatattacctttgcgagtactgggggctacaacttgcggacaagtagttgctactgggacctcaaaagtttgaaggtcttgaccatggcataatacagcagaattattttcaacaattgttgtattctttgcaatgctagggcatgtatgtggttccttgatcagtaattgtgaagaaggcaactccaagtgggccctggtgactttcttcccattaacagttcgggcagacagtgtgcctcgtccctgctgtggtggagcttcaacaaactctctattgtcattgccatgcatcttggatgtaggattttgagaacgcttttttgtcttaagcttcttgttagattggtctgcatcaagatttgtctcattagcttgccttttctgtccttcctggtacatcaccaaaacttgaatcaaatcaaaatggcagattaatgaaataataagatatatggtgctcacataataaagaataaaactacactactgacttaaagaaccaaatatttaataatatgccagaacaaagcaaaaagattatactttgggatctgaatcacaaaatatagcatcagcaagagccagataattatcagcttctatatgcacccagttgtaatcgaataagtttagtagattattcaacacgggcgcagcagtttcctttaggataccaatatcagccatggctctgatagcagcatcaaatctatccttggaaatctttggaggagccatcctgcttgcagtggaacaaatcagcatggcacattaacacgtgatatcctttgagaaagcaagtgataagaaaaaccatatacacatactaagcatggtatcacaaacatcttacgaatgtacaatgaagttaagattgtgatacattacgagaagttgtggactaagcacactaggctacaggaccaaccacaagagtactccaggtacaagctaacttatttatccttggagaagggctgtgcttattgctgaattttcaatctattgtgcatgttaatattattctttcagtcagcatttgaaatagattactcaccggataattgccacataccatctacttgattataggaaaaaattaaatattttgaggaataaacttaacaaatagcactataaccagaatggttatatatgccaggggaagtgactagttttcatgacacagcagtgcaacaacaggaaaaacagaaaatgagtaattcatactacttgagcagctgacatccaatctgcattattatctctccatgtgcatgcaaagttagacaacttgagcagcattcagaaatgtataccttgttcagtgttacatgaggcagtaatgttctgtaagatgtgtctatggtttagtataagaattctgagtgtgcaagacatgtcatatattcgtgaattattttttttttgctgagtgagatagagtttggaatcggataatatcatcggatgcccataaaaacaattgtattaaaaaatgctgagtaaaagaataactcttacgacaatcccgtgtcacccgttttctctttgccattgggtttggccattccagtccttagctgagatgtggaaactgctgaccctgcaaatacaatagtgtccgtgaacagaagcagaatacatataacctttagctcaattgttcatgtttctctgccatcagaatgcagtagcaaaaacaaacatcataaggaaatcatgctataaaactgtgtcagaaattggcacttttaggttatttgaacagtactttctgttcagagaactgttcaagctacagtagtaataatctctttttgaattgcagtagtccataaataggtgtataatgatcatttactaaatatagttataatgtaagccatagtgtcgagttgataagactaataatatgggcaagtggtttaccttgttcacaatggacgaacaagttcaaaaacatataaatctggtttgtagaggataggatttcctcaaaaaagatataaattcccttcttaattaacatattgaatacaaacaaagtaaaatcaatttcagatcatattagtcactggaaacggggtcagtggcagcgaatcctagacccgggaacgccatccccgttaagggaacgcggggtcattttcgtgcccaccttgtaaaaacctctcacaagtagcataccacgtttctcgaccccgttcctcaatcccgtcgacccgggaactttgtgactaacaaacgcaggaaattgcagtactatccgatcggtattgaatattggttttgaaatccagtctaaaactttacatgggtgaatccacccatttgatactacaaatatcccattgcaattgtcatggaaggaagtcgcagtcctatctagatcactcacatcaccaagtctattgtggttctgaaacataagaatgccatttctgccctagctatattatatcctgctgcatttgactgagttaatccaaacagttgcttaaaaaggcttcagcaaaaaaaaagtgggaaaatcgtagctacaaacctatggaaatatatttcaatatttcccatgcaatcattttctttaataaaacatttgatatctggtcaaatttcccacccaaactatgcgcaactccattaaagcttatttgaatatataatttattatatatatatatatatatatatattctttcttctattttcaatctacatagctataatctagaccaaccatgactagtggcatatatctttctctttttttacctcattaacatggtaatttctaggccttgagagcaaatatgttggctccatttaaccttcactaacttatataatactccctctgtcaaaaaaaatataaacaggcgccccctcgctgtcgctacttcctttggttggtcacccttaaccgttgctggatagcggaccgcctcccgagtcgtggtttgtcacacccggatcgatgtgttctttgtgatcaatgcgaagagacgattgatcatctcttggtcgaatgcccggaatcgcggcaactatggtgggttgcattcaaagctatcgggcattcggagtgcttaccgctcattaacactctttcttttcatggttgtgtgactgtcataagaagatggtcaaggaacatcgccggggtttcgacaccatcgcaacattggttgcatggacgatctggaaggaaagaaacaatcgagtcttcaaccagaagagcagaacttgggtggaggttgcaagggttatgacgggtgaagcggagctgtggcggctagcaagagctgcaatccctgttttggtagcccatgttagtggagaagggtcgcaaaaatttagttggagattaggcttttagttttttgttctcctcctgtaccctgtccccttcgttttgtctttttggcccgctttatacatacatttattccttcttaatacaaagatacgctcctcgtgtattccaaaaaaaaaacacttttggagtttttcccggacattaagaagaggggttaaattacattagggatggttgtgattggttgagatgggaaagtagatgcagaaattaaatgagggatggttgagatgagggagtaagtggagaagtagctatattttctgacggaggaagtatatagaatctagccttttgaacaaatacccaaggctgcattctgatatattatgaccttttgaacaagtactcaatgttgcatgcatctaattcttcacatagaacgcctccaactcccgaacaggaagctcacaagtcggcacaatggtggatttgggggcaatagtgccaaaggcacgcccagatctcacaaattttcacacaagaaaactaagcaggagaagcagccttattgtgatcagagcaacaaacgagcaactcaaagcgactgaacaggcacccaaaatacaatacgagcaaagctcctcaacctcggagcgatcacattcgcacacccaagcaacgcgggaggacatcgaaacttcgcagaaataggccgaagaaaaaccctcatacgaggagccctcaccccgcatcacaacaggggcggacctaacgtggtgcatggtgcatgtcccacccggccaaaaccccaatttgcttcagagaaagaggtgcgtatagagagggatgaggaggatgaggatgtgcgcgtacgggagctcaccgcggcgagggtgcggcagaggaccgccggcaccgctgccgctcgcgggatggggatcgtcgcaggcggcggccggcgggcgaggagacgggaggggaaggcgaggggactagggcgcgaggaggaggaattagaggcgccacctgctgctgcgatgtttgggcggtacgcgcttcttgtaccctcggacctcggtcggtctccctgtaacctgtatgtgtgtgtgtggatccactgccatcggctgaaacaaacccggtgcttcgggttggtgacagcttcatacattccattttgcatccgtgttaatgtgttagtattacgtacatcaaccgggtgtgtctgtcaatataacttactttctttttttctcaccttataattaatgacgattgatcttcgttcgtggttgggaggatatcctgaataggagatgaccattttaatccctataaggctgtgttcgctctaacgtgcgcacagaaaacagaacggtccattagtatgtgattaattaagtattagctaattttttttcaaaaatagatcaatatgattttttaagcaactttcgtatagaaactttttttaaaaaaaatacaccgtttaacggtttgaaaaacgtgtgcgtggaaaacgagagagataagttaggaaacctgagtaagaacacagcctaagtgtttttgtttgttggcatgggtggatgagacgatcgaaagagaaaatattccacgtagatactggataaacatatccagccaaattgaccgagtgagagtatcatatttaaccttgaacatgaaccaaacgtgcactttattgtatccagccctacaacttccttaacttgtgattaatctccattcactgtattcttattccttccatagatacaacgttcactactagaaaaagcatttttgcatatggccaaaagcaattttttcagacggagaggaggatcgcctgcagaccaatgactgtgaaaatcatctattttcgcagttggggcaatggcccgcctgcgaaaatccaataaaaaaacaaaaaaaatcacctcgtcgccgtccatgcgcatgcctcgccgccaccgccctcccccggcctcctccggctggatctggaggggaggggatgggagccgccgccgctgcaacgggagccaccgaccacacgcgcgcctcgccgccgctgccgcaccgggagccatcatcgacgtcgccgaccacgcgcgcgcctcgccgccgccaccctcccccagcctccctccgtccggatcggggaggggaagggaggggaggggagccacccacgtcgccgtccacgccgccgctgccctcccccggcctccctccggccggatctgggaggggaggggaggggagctactgccgccgcaccgggagccaccgatgtcgccgtccacgccaccaccgcgtccgcgcactccgccgctgcgcgctctaccgccgccgcgtccgtgccgccggtggagggagggaggggaggggaggggagaagccggtggagggagagagagagttgagaagataagtttggggaaatgagtggtggggaggggttggaggagtagataagtatcatttttttttgaatgtacgatttttacaggcggaccacataaggtgcgtctgcgaaaatagattttcgcagacgccgcttaagtggtccgtctgtgaaaatacagcgaacttcaccctgatttattttttttaggcagttatttgactccaaggttcatgtctacctacgaaaaaaagaccccacgtcaggaaaaatgctttttctagtagtggttgtaagaaaaagtatgttttatctatattcccatgtacatcaacaatgtagtttaaatgaacttgtccatgtctgtttgtgcgcactgccaccggctgaaacaaacccgatactttgggttgtacgcagcttcttgtttcatatttacattcgtgttaccatgtatatcaacggtgtgtctgtcaatatgtcttactttcctattttcttaccatttaattaatgaagattaatctccgttcatggttgaaatgatatcgagatagtcatctaattgttgagcgtgtttagttagtggataagtatgtatgggacagtcagagagaggatattctacaagaattttgaatgagaatatccggccaaaatggctgaatgagaatatcctatctaaccatgaccatgaaccaaacgcatatttattgtatctagacatacgacgtatttcctttttcctcgacttctaattaatctctatcaatggctttcttgtttcttttcatatatatgttttatgggtgttcccgtgtacatcaatggtatagttttactgtgcttatcctacaacttactttttctttccttgagatataattaaggagtattgatatttgtccggcaacgcggctttcctgttttctatcatctttccatttgttctcctgtatgtagcaacggtttagtaatgttgtgtttggcctcacaactttgcttcctctttccttgatttaattaatactacatgtttgtgacttccctatttccatatccatgtttccatatatgctttcatgtgcgtctatgtttaagttttgttgtactagtcctcgcatcttattttctctttcctcaatttctaattaacaaatattgatctctatccagcaaccaacacaatttctcttatcccatgtccatgtgttacaatagtgatctccgtgtacatagttcaagtttgtgcttcatattttctcgacttctaattaacgagcatcaatccatttctagtaattgatacaccttctctctttccatatctatgtttccatctatatacatcaatggttcaattttagtgtgcctagcctcactttgatcttttgcaagcaacaatgatgtagcccccataaataacacatagcggcaagagcagccaggccatgcccattcactgacgtagcacaaatgcataacaatgttgcttctacacgattcatggttattgccttagtcctatattaggcttcattcggtttagaggatttttataggattattgtagaaattaaatccttaggattttttttctatatgcatcattcgtttcttataaatgtagcctaccaaattcctaaggattgtagtcttacaagctaattccataggatttttagcatgaggtaagacctcttgaaaaaaaatcctaaggaatggagtggatgtgaatcctaattaatcttttacttttcatattcttttgatttaaaaatcctatgaaccgaataagccctaagttctttgacgcggagcttgtgcgaaaaaaattaacagtatcgttgtgcaaataggggtgggtgtttgcttcacttggtcttatcatgaaagcactgtatcattcgttgtaattgctgatccatgctactattgcacttctcaacatcttcatataaggggaaggagaggagaacacaacaacataaaagactacaaaatcaatttaaatctctccttcaaatatgggactaatatttaattagttaccttttgtacttgagttaaaacaaacgcacgctataatgatcgttaatcaacctgtaattccatagattggctctagttgctagggagatggactatgaagatcgatgtggtttttgtataggttttattggcaaaacttatgagatgagcacatgggagaactctagattaatgtaagcacaaaacaagccgagtagttgagatgtaaacgcgactaattgagatcccccgtaaggtgacaccgataggttgtgaggcccacatgtcagtgagcagtactgcacaagcagtactgcaaatgacctgtatccaaacgcgacatgtggacaggggagcagtgtctagcatatgtatgtattatagatttttaaatgttgcacataatggtctttgatgttcaataagtatttttatgatgttttattatttcattttacaaattttgcaccgatgttatgtaaatgttttagtatgcactggtagagaaatgggctttactcccggttcgtaacccccctgtagtcctgattttctaaccgggactacgaatccgggactaaagatcgctatctttagtcccgggtgaaaaaatcggaagtaaaaatctatttttaagtcccggttggagttaccaaccgggactaaatatagagtatctttaccgggactaaagaggctagctcaggttgcaactttattctattcttttcttcattgtttttcatatatagattcattatatcccatcccaaaatcccaaatcaatcaaccccgaatagtctccaaattctcaaatcaatctctaaatacataacaaaatctttaaaaaattacatcacaacttctacaaaattcattacaaatacatcacatattcacatcacacacaaatcaaatacatcacatattcacatcacacacaaatcaaatacatcacatattcacatcacacacaaatcgtctcagatccgaatcacatatttaaaaaaagaaagaaataaaggaagaagatgaacggcctgcagccgc

SEQ ID NO: 60128 - DNA, 12418 bp, Oryza sativa
ttcttcataaaccggctgtatgagaacctttttaagtgaactaccaatatctcaggcaacctccataagtcaagctttttgctggcttgcttgtgctccgtgcatctcggacagtacctgctcagataagcaagaaaagtgatgcaagctcagacattgaccaaggtgctttctttatggaaaaaacagagcaatttgcaagtatcagtcaataagacagaaataatactaaccacatgtcatcagggcccagaggttcatccttcagaaaagcatctaagcatgaaaataaattgactgcttcttgccgatttttctttgacataaatccaggcttgaagaccacagaaagttcatccatgtacttaatgtcatatacttcatgttctctatcagaccagtccattaataacctcatggtcgacccaggaacaccgttagaatctgcatcaatatgctctctcttattagctttatcatcagtcaaccaaagctgaaatggcaaaacctcttcatcagctgcttcctcatccacatttgatgtagatacatcttcctcacaggtgacaccattgtctgtcacacaataccatccaggctaggtccattgctatttaacttggttgcagattcatccagagtatgtacttttgcccgcacaaatggagccagaagtgaagagacagttgcataaatatcagcttttcttgtagagtcacttggaatacaagtcacaagagggcttccaattagcttccgactaagattaaacatggactctgaagtatatctgcataaattaacaaaacaaatcaatgtgtaagcacaaaaatggaaaccagttccaaggaatagaatagtagaaaaaagaaaatcactaccatcaaatacatggcatgtatctgaggtaagaaatctcaatgtctgtagcattttttttgtcagctacactaaactattctcacgaatcataagcacaaaattctcactagaaccaaaattcaaataagggcagggttcacctattctaaggagcaacaatagatgaacggacatcatggaaacacatatgtggtccttgctaacataattacagactcacctatcaaccacccgatgcaggatctctaccctcaagagattttcagagccaaccggtagcctgtaagcaacaagtttgtcttcatcttttacatgacaaagtggttctgatgggttccaatagcggtaaatccgatgatcatatacctaaagaatatgatgtttattagctatttactgaaaaagagttatgcttcaaataacaccattgctacataagaacaaactggattttttacctctgcaagtaacagtgtttcgcaactttgtaagcaacacataacactcagagattttataagatctccacaaactccattcttttgtaccttcacagtgtaaggcatgggaagggcatctccagtaccactaaatacagttacattaatcatgcgagtaactgttgagggcaatggcagtgacaagtacatgaatgggtcaaatgtaactgaattttcttacaatctgggcaaaccaaagtggacttgtactgaccctgaaacatcaaccaaatgaattgatgttactgcagagatgtgacaattaacaattatcgtacaccacaaaatacgccaaaggggaaaatgctactgaaatttgaacatgtatatactccctccttataaaaatataaggtgtattcactgttattaacgtcaagactttgaccaacaatttctttattactaacatacatatcatttatgtgactcaaaagcatatcataagaaagttcctttgaatgtgaatctattaacattgattttgcatcacaaaaattatattctaacataataattgttggttaaagcctaatccaaaaataacatatgccttctatttttgtatggaggaaatattacagaatgaaagcaaaataactatactatctctcccacttcctaaaatagcttcaagaaacatcaatcatgtttcaccatcagagagcaatcattaatcaacgctataacattgttctttagtattttcttctattgaaaatacccatcactgcttcataaatcgaccaagtaataaccaacaattggttcaagccagattcaactcaagacatagcttgatacaacggtgccaaccacataagtgggttcacaggtcgacccacttgtcccaacatatatactaaccgatcagaaatatccaacaaattctacagtgctaactaataataccaagcaccagaactagctagtatcttgcactcagcagcaagtaaaaggctgagcagtttgtgaggtaaatcttggtacgctacatctgcttgcagacagacctggcctaatctttcaagcctagtctcaagaagataatcattgcaaaagcagcaagcaatggaaaaggtatactgatgcagtggtgaatagttgtgagcatacataaacctaataccaaaatgagccatgccacattcaagatttttgtattttcatttccagtttgattttaattctctttgttcggtaaatggctttagatcattatgccatgttaaagtacaaaatatgccaaccagcaaccaatcatcatgccaacggctcaagcacatctcacgcccctaccaaaccacaaccctacattcccgactagattttctattacatctctttcctccctcggttccacagtttcaccaaatcaattcaacgacagagcagcgcaaggcatggcaggcagtcacagagcggcagtggcacagcaggccagcaaaggagcaacgtcaagcggcacaggtcagcattggcatgttccgaggagaaacagatactgttttctaactgaaccaaactgaattattcggttcaggagctcttttttgtgcagcaatcattctggttaccactatttcaaaaccggttgtcaaaaaatagaaaacatccaacaaaattaaccaaaaactgaatatccccactacttatgagggctctacagaaaatagtacccgttctcatcccaaaaacggttaaatttttgtgatataaccactgttgaaatttcacctgatccctgcctcaaaaaataacctgtttctttaaaaaagaaaataaaaacctgttgtctgattacaaatagtttcagcattaccaagttcatttccataatacgaaaatccttaaagaccacccagagatagggaacctttattcaaaaaaatgcagaaatatctttaaaataattccagatccaaacaatatttgctccacatggtaaacatatacacgtagcaaagatttcattacctggaatttatcaccaatatatagaatcatttcgagctttatggtaattccagcattcctcagcaagttcttcatcaggacggccatcggcatcctttgcttcaatatatggtttctttttcacacggttgagatcttcatgcagaccatccaatagaaatgcaagtaactcctgcataaaagaggggcaataagtaacagatcaatcttctttaacaaaatgtgaacaatctaaattgccaaattttgtcaaataaatatagcttatccaaacaagaactaaacgacaagatgagggaggcactaatatatcaaaaagcataataaacaatcccttattccgaaagacacatttattaaaggttgcaacaggtaatattacacaatgaaaaaaaaatgtatggagaaatacatcaagttctgaaaacaagcaaagcagggatgcataagtagtgataaataggatgcatcagttcacaaaatgacaacaaactgtgtacaagacgatgacggttataaaagagaagattacagcaaggaagataacagggacgcaattaaaacagattctaaagatggaaaacatattcaggaaaagagctgaaaacttgtgtcaatgtgtggccaaaaaggatgcaccatttatcagaacagcgaacaagccaaaaagcagagacaatttatctctttgacaggacatgttgatttatgctacaagtcgttgactttttttctagtcaaacttctttaagtttgaccaagtttatataaaaatttagtaacatctacaacaccaaattagtttcattaaaactaacatttaatatattttgataatatgtttgttttatgttgaaaatgtgtctacatttttctataaacttggtctaacttaaaaaagtttgactaggaaaaaagtcaaaacgacttataacaaaagtttgagaaacatagatataatcatagtttgacacaatttaaataaacaaccaacactatggttaaaaaacaaatttcacaaaacctcaggtttggaacgattgtaacgcaaaatcccagcttttatatttgtttcgaagaaccccaaatttttggcccacactcttataccactatttatgcataacacttgtacaataaaatagtatgcggtattgtttttagtacatgtaagaattagacctgggagttttattacccaaaacctagggttttgtaataaaatctcacaagaaattaatgcatatgtacttcggaactgaaatgtgccttaacactaacagtgcaccggtgtgttgaaatgaaaattaacttcatagttctgggacacaacagcatgttatcttaaagtaagaaatacgtttataatgtacgactaattaatggaagttacaaaacagaacaaaggtgcaaaactcagtgtcagcaccatttaacagacatttataagaagtgtttaggagaaacattcggagcaacctgagaatcatgttgattgtatccactgaactgtggagcaaaacgagaaagttttgtcttgaatggacgtggagctatagaagttcgaccagctgaccaaagttttctcagtaattctccaaatgctgttgcaagttcaccctgctcaatggagatgttctcagaaatcaccaataagatcataagttcgcaatctacataataggacaacatgcattacctgtagcccaagtggattttctgtatttatctcccgactgtaatcctgtaaaaagtactccaccaatggaggtgtatgcaccaaggattgtatagcactgttcatgaaacatgtatttcccaagttatgtaaaccactcagtccatggatatcatcctttgtgccattggagaaactataaccatcttctgcgtcccttaataaaggactaaagctattatcttgggaaaaactggaaccaaatccagatgaaaaaccatttgaaaatgcaggacctccagcaattgaaaacgatgatgttgagggttccaacggaattaatgctagttcattatttgatcttgtaccaagatccgaacaccaagcatcatctgcctttgcctctatgataatctgcaagcataaagaaagaagttgcatcttcagttaatgtacagacagaaaatagaaaattgttggcttgccaacaaaataggggtaaatcgttaagaataataagattcaggacacccacaatacagatagtgaacatcttagaagcaatagtacatattcataccagtacatattcatacccgaacattgcaatggtgcaaatgtaaaccatattcatatgataaaacacactgatcagaagcatattcatatgataaagacaaatgagccaactttattaactcaaaaacaattctcatgtcaaccataatagaacttgaaaagtgcaaatgtaaattaagataataaattaagcaatatttaggagttagacaatttatgacaaagtcattatccatgtgcaaggtgacatcctaaggcagacagcagaccatagatgaaaagggcgcatagcaacaataacaacaaaaagccagcgaccatctcgctgccagaataaaggaaacaatcataggtttcagcagataaaacaatagatatgtgaatgggaattgcatagtgcataatacctcctggtccatcatcagttgagcttcctcaaccgtctcattaagatttatcagtttttttccctttgtcttttggtaaaaatcccagatgtcgatctgaagcattaaagtagatggagcaaagaatcatatacataaccataactgacactacagatagagatattagatgaataaatgatgatgcttgtaccttagactgttcgacggacaaaagtgagcaaaccaagctatagagctcactaactttggcctgaaagcaccaaatacaaacgtcaaaaaataagtcaagtcaattgcacaagaaactagagtatccaagaaagaagataatagaaagttaacaaatttactgttcaacaaaagagtatctaagaaagaagatagtagaaagttcatctttctacttttttagtaaaagtgctattagttcaagcagttagtaaaaccagcattcaaagtatttgccattgcgcatcaaatttgtaacatttttttccttctggtaatagtcaaccaaaaatatcagatcaaattctgaaattcaagggctcagcataccaaagtagaagatcgcaacaagcaggtgatgaacagatgcgatttctttgacacttcatcacaaagagggaatcctcattgctttatttcatataatgcaaatgtgtaagcactggtttttatttgacaaatgtgactctccaacaatgtgatcaaggtataaagaatgcctaaactgatcatctaacctatcaaatataagaaatgctccgatttgtcccacacaataagcacagatcaaggaggcatgatggctaagataagctaatgtgaaatacaaccaaatgttaaccacacaacctctttgaagcaataaattagggctggatagtggaatcatcattgtaataactacactattgatttcatcatcaatggataactatggagggactacatcccaaaagaaatgccaaacattatgaaaccagggaagtttcaaggagcatcagtcgcattattgacggttaattacatatgaagcacaatgtcacaatataaatcaaatataccatacctttctactaattctgataattctctccaagctgtctcttccatcaaataatttcagacggaggggatagacatccacaatgtaacttctggaagttggactactacaaattactcttcttgagagttctggtccacctttgtacctgaaaagtattcatgtgtccatgagttgatgatcccaattgaagaagaatgtattcaagtacattaggccatggacattagggataagttatggttacactagtattctggcataatccattgaagagcaacctgacctcatgagtgaaaacgcgtacagtatgcatttaccagttagcacatcattgttttaaacaaatatcaacaggaaacagaaaaattgaatagggcaacaactaattgccaacagactgagcaaacaggactacaaaccaggcttttttggtttgcacctaagtggagcacatgcaatctacaatgtggcatatcaaagccctggcagcccaagcttggccaaatgaacaagagcgcctaaagaaaataagaactaaaaaaatgtcgcaaaatggaactgtagttatatgatcaaattttaatcaggcaaccattttctctcatgacaaaaagtaaagagacaaacccgtggttttatgggtacaacaaactttctgacatgaaggcagttaaacagacatataacattgcataccattcatgtagcttcctccatacttcctggggcaccaaagcgtagtcatctccttccctcagggttctttgaagctctggctcatcaccaatactgctgctttcctctgaaactagctttgagttatctatctctcctggtctacttggagcttgaggaagcatgtcagcatcattctcatcaggtttgattaagcccacatagctttgccagttaagccaccagctgcaacatttgcaaagtccacacgatgtaatttatcagtcacaaaattcagataacatgtgcacagcaaccaattgaaatgaaatgcgaacggattaaacggatcaacatcaaacaggaaaccaagtcccacaagcaatgctggatgacatttacttgcagccaacgagaagatcctgcgcattgaactacttggacagctcagatatatatatatcatgccttactctataaactagtttgtaatatttaatacaggagtttgcaaaaaaaaacatttttattaaagatatactacaaaacaactcagcatggtgcctgacgattatatcattttactgtagcgccccaaccaacacatccccggagcacaacaagattggatcgcgactccgcatcacgcgccaaacggcacgcgtcggatccccagccccaattcgaacccctggattttcccgcagcatagataagatccccacggccgccacaccgcgggaagacgggtacctagatgctcgccggaaaaaaaaataaaacaaaatagaacgacactaaatcaggagaggccgcggcggcggaggcgacctgtgggagacgaggtagcggagatcgccgtccttgacattctcctcggcctccctggtgagcgcgacgacgaggtcccgctcctcctccgccgtgcacgggaggcagctcgcggcgtggaggaacccctcggcgctcggtatcgtcatcccctccccgccgccgccgccgcccgcgcgatcccgccgatccagccccctccccaccgccaccgaatcgagccctagggtttggtagctcgcgagacctcctcgcctttatttttattttctttttttctcgcgaaacaagaggaggaagacgatgaggcgaagagagagggaaggacagagaaaaagaagggaaaaaaaaaagaaacactctccaatttggaattacggcctgtctgtaataataataataataataagtaagcggacgaggcgggtcgtagaatcaccccacgtgaatgacaggtggggccggggaagggtgggcccacgtgtcggtgtcgttgggggcggtggtgtggcgggcgagtgttctggagaggaggcgtgcggcgatctggatccgtaccgtgaggggattccgcgttcttggtgtcgatgacaggtggggcccgctggaggtgggtttcggtttggcgtgtattggcggctacgaataccgcgtgttggagactgactgctacggtggtggtggtgggcccacgggtcagcgtgagtttgtgtttttgaggcccactgaaactgggccgaccatgggctggcccatcctgctccaacatcaagcattcaaaacccagcctttcttgcaggttgggccttcttgtcaggacttaaaagcattcatcaccttaggacatgttgaaagcatgttcacaggtggaatctggtagaggctttcagagactatcttacaacattcattcaagacgataaaagactaacaatcaatatactgaaatattttattattatttttccttccttttctccatcctcacgtagtaaagtttccttttataaacagacattatgggtcatgcatatctttatctattttatttgtgttagaaaacttatcttcttaacaactctaagagcccactattaattaccgttatacatgcccttagggcatgatcaatgatagagacgggtatggtctcttaaacaatacaagattatttagagaccatgtctttacgataattgagacgacaaaggctctaatcattaactcaaaaaatattccttttgttaatattcttttcatatttttatcctcatgcaaccatatttccatattatagtgactaagagtcgttgttaagccgttgtcatacataacaacgatgttttgtctctcctctttctctttcctccatgtcaacaagtatttctaattagcaatgctaagagaccactattgacaatcattgtacatgcccttaggccctacaagaatacttaccatatcgaaatttttgtttggttgtgataatttttgtttggttgtgatacacgtttaccgatctcacgatgacaattccctagcccactattacatatgtgtaatatttgtggacaacttggatagagttacacacccacaactccaccaccacactggtgctttcttgtacaatttgacatacaactaaacacataatatatatacagcatctaactacagtacatcttaagttgaaagataggtttagccctaattgtttgtaacactttggcaaaaaagtgactcagagtaaaatttgctctattaaaaataacccaaaaaaatccaatatgggaaaattggaaccataccattataattttgcaaaatttgagatatgccatcctgacccacatgtcattaactcatgtgggtcctacatgtcattgagatacatatggcatatctcaaactttgcaaaattataatggcatggttccaaattacccataaaaataatgcaatgttgtcttagaggaaatcattatacaaaaatgacaagaaaaatgttttatctgtaccagtaccactatgcattacttagaaaatggcagaccagatcagggttttgtcattatttttataaaggggcatttgcaaatttgccactggttttttcaatattgcaaggataccactcgaatgacagttctagtggcatttttataattttttagtggcagttttgcaataacgattcaaagtagtggtaaatttgcaattgccccttttatgaaaggtaatggaataacatcatctttttgcttcaaagaagctatagccacttattacatagtccgctcaacaaagagcaaataaaatttaggaattgaaagtgcaaagactaataactccaacacttgaggagacatacatttattcaattatatttgtaaatctccatccatagtatatctacatgaccgttgactccaagtttcaatatgtagtatgtattagttccttgttttcatcatacctttgtagttatgcccagaatcgaaaccaataccttgccaaggaaaatacttgcacataagattgatagagatttgtcaaaaaccataacattcctaataagccatagatcgcaacatatagcaaatgctcttactaaaataagttttttttttgtttttgagtcaatacccccttagccaattctcagatatatgtgagatactatttggaggtattaggccaaaagaaatatgaactgatatccagagaaatttagcaaaatggtgtaccatatatagtgtgacacgctcagttcaatttcacaactgaccatggtactcgtcctagctagctagctagcctcctgggttggatgctcttcaagatgcccaatgtataaaacccacttatcttatactttctccgtttctaaatatttgatgccgttgattttttttaaatatgttcgaccgttcgtcttattaaaaaaatttaagtaattattaattcttttcctattatttgattcattattaaatatacttatatgtatacatgtagttttacatattccacaaaagtttctgaataagacaaacggttaaatatgtgctaaaaagttaacggtgtcaaatatttagaaacggagggagcagcaacaaggtaaaaagctcaacaatgtatgaaacccaccgttggactcgatggacctacttacattaaatagcaaatctgagatgacaagctgcaattcacatactgtgtatgacgagtgggtttaagatattctctctcctttaaaactcgttactatgcctgatgccgactccttccagcaaaaatcttacatgtatgggaccggttttattgtcttttcactcctctttacaccttctaaaatcatacattgcacatgctcttaatgttcttgcaattgcaaatataacatgggacatacggcagactcatatatatcctaccttcggtttttaatataggaaaaagtacgaattacccccccgaacaatcgccgtcgtccgaattatccccctgaaccataaaaccggacattcttcacccccaactatgcaaaccggataaattacccccctggacccaatccgcagtggttttggtctacgtggcgtacacgtggcaatccagtcagcactctagtcattaaaaaaatgtgggacccacctatcatactcctcatcctctcatcccctctcttttctctctcactctacccctctctctctctcaaacgggtcaacagcggcggcaggggaggacgcggcggcggcgtgcgggttgtggcggagcgcggggaggacgcggcggtggcggg

SEQ ID NO: 60129 - DNA, 1577 bp, Oryza sativa
aacagacctacctaaaacataaacaaagacaattaaataataatttacatttaaaacttttataattgtgtctattattaaatttgagttacaatgaggccctaatacttaaacccttttacgtacatgggacatgtgaactgatatgtctcatgtgcgacttctctttacggttacgcttatagaatacatatgatggtattcagttcgtcagttttttttattgagttcagctcatcgctactttttttctcagcatagtagtgcaagagttacttgaaaacttctaccaaactcttgctaagattagtaagggcctttacaatgcggtgagctgttattcagttcggtcttttcacgtcagagattcggtgtcaatctttgccacgtttgtgggcaggcctaccaaattaaagcccgcatgatcttctttgatcacctgttcttggcgaggggagataaggctacagacgcgttaggagggcgaggcttcgttccactatttctacatgcaccatggacctttgtggcttttctaggtcttaaatcttgatggcctcttgcgccaatcctatacgtgacctgtattgtaaaggccctaccaatccagatacatggtgtatggcctcgcagtgaacacgtaagaaaacggcgtacacgtctatgtgagtcgaattcccagttggttgtccggcccttcacagggatgacctgcacctcgcctgcgtccaagatcagatgtccacgcgacacgactccacgcccgtattagatgcgtgatctcatcatatgcctttttaactctatgctcatctgaagctatagacattcgcttgccgctatgcgctgtaggaggtgtagccataattatttgctctttgcatatttgacacataaatacacgcatctaagtagcttgcaatgccctaacaagatctcggtcattcgattcaaccagttggtggttatgaaaaatcaagacgccgtcatagtgtgctactttactttttctaaagtgggataaaattaacaatccttttatctttggtggcaaattaataaatataaagctaaggaaattgcttaaaaaaactatcacaaagttttttttataaaaactttcaaatgtaactatatcaaagtaatagtgaaagtaatagtgtaacttagtaactacattgtaattacgcattgttacattttaacgacactgatagtataattacaatgtaacaatattagtaaactatataacttacgtataaaattggttaaatcatgttttaatcctatatatctataaagttcattcccctaaatgtagttaatgctaattctctcttctctcatgaagccacatcatctcaattgtttttagcctttggatgattcatcaagggtgtaaattccttcttttcacattacctcaatttattttagtatttggatgattcatcaagggtgcaaattgcatctctttcccccaaaaggcacaccatacaacccaatcatttataacttttggataattgataaaggtacaaaaatatataaaaacatgaaaaaaattataaagt

SEQ ID NO: 60130 - DNA, 26703 bp, Oryza sativa
cgattgagacggatggattagattgctaccgattgagacggagggagtaatccatgttaagtccaaacacaaatcaacaaaagaaaaactaagtgacatacatattattccatccatcccaaattgatcattacctaagcaatgctgagatcaagggcatcaaaatgttcaacgttctgaaattaatcctcgttgatcaaggtgctccgtcgcttcatattcaacataaattaattcacggtttgaatgttgcatgtgattgcaccagagaaattaatcttggctagttacatctatacggttgcatgcagggcattcaactatgcacatttacactttacacaaataaaagaatacacactttattaatgatgattatttcaggaagaccttaaaattcttaggtgatgaacaaattgaaatgaagggagtataaaacaatggaccaaactttgtttcacctcaaactgtctttttggaatactccctccgtcccaaaatataagaatttttagtatagtgccaagtcaaccatttttaactttgtaaattaatagaaataaaatcaaacatgtaaaattgatattattagatttatcattaatcaaaatattataatatgcaactctttttatttaaaatattttatttttatagatattgttggtcaaaataacatctcaaagactgtgtcgaagtccaaaaatgcttatattttgggacggagggagtatttattttatactagatttttaggaatatgcaaaactttcaggttttttatgaaatcactgcaatttgagaaatattactcccccctcccctctaaaagcatcggtaatcatttgtcaaagttaaacagcatagaaccaacagaactgatggtaagcccttaatcggaaatgctaaaattatgttgacagaaaatacaacctcaaatcttgcaaattttagatcactggatatgctggatgtgcttcatgattcgtgctcttcttctcaaactccggcgatcacctcttcttctccggcgttggtgaacccaaactccgacagagggccgacgaattagggtcccggggtgaggtgggggtgggagggggggagggaggggaggggaaggaggggagttcaccggctttagagggatggccatgggaggtggcagcccggcggtgggcggctgatcgggcgggcggcgaggcggcggcaccgccgccaaagccgtggggtcgggagcaagcggcgggccggtgtaggaggcgggggcaaagcggaaaaagtgataggaggaggcgaccggtggtggcttcccgccgccggcgacggggtagatgacggacagctcgccgccgtcggcttgaggcaaaggagaggagagggagggggagggggagggggctagcctggggggcctcgccggcactgttgacacctttcggccagccggcgaggccgggcggcgcccggggggggggaagcactgaggagcggcggcgtgaggaatcgggagaggagagaggatttttagggtttggttgtctgcacgaatcttaaagcaatcgggtggtctaaaatttgcaagatttgtaagggggttttttgtcaaatgatctttagacagtccctaaattaatatcctactttgattcggtcgtctttagtacgtttctccataggaattaataatctaactcatgtagtcagaaaataactaactcacgcaagaattatataaaaaaatctttgtactaaatgaactctaaataatatgcatatgtactattaaactaactggcacgcaaagtggcgtcccgattttctatttgcttccaacgctgaatgtacgtatctgtcagatcttccaatagcaatggatgttgagagaccagaaacacatgtaaataggccctttgggagtttaggttgagagacgagaaaaatactagggcaatccatttgagagagagctttgagccaaaagcaccccacgcactagccggaccggcgaaatggtggactcgctgctatacgggctcctagacctgcgcatggcggcgccattgcttgcagctgccgtggcgttgtacgtccttgtcgagcagctgtcctaccaccgcaagaaagggtccctgccagggccgccgctcgtcgtgccgttcatcggcagcgccacgcacatgatccgcgacccgaccgggttctgggaaatgcaggctgctcgcgctagaaagtccggcgttgggttcaccgccgacttcctggccggcaagttcacgatcttcatccgcgactcggagttgtccaaccgcgtcttcgcgaacgtccgccccgacgccttcttcgtcatcggccacccgttcggcaagaagctcttcggcgaccacaacctcatctacctgttcggcgacgaccacaaggacctgcgccgccgtatggcgaccaacttcacgccgcgcgcgctctccacctacgccgccatccagcagcgcggcatcgtctcccacctccggcggtggctcgaccggagcgccgccaacggcggcaaggccgagccgatacgggtgccctgccgcgacatgaacctcgagacctcgcagacggtgttcgcggggccgtacctcaccgaggaggcgagggagaggttcaagagcgactacaatctcttcaatgtaggcctcttggccttccccgttgacctgccggggctcgcgttccggcgtgcgaggcaagccgtggcgaggctggtgcgcatgctccgcgattgcgcgagggagagcaaggcgcggatgcgcgccggcggtgagccagagtgcctcgtggactactggatgcaggagacggtgcgggagatcgacgaggccaaggcggcggggctgccgccgccggcgcacatctccgacgacgaggagatcgggggcttcctcttcgacttcctcttcgcggcgcagacgcgtccacctcctccctctgctgggccgtgtccgcgctggactcccacccggacgtgctcgcccgcgtgcgcgccgaggtggcctccctctggtcccccgactccggcgagcccatcaccgccgataagatcgccgaaatgaagtacacaaaggctgttgctcgcgaggtggtccggcaccgcccaccggcgacgctgatgccacacatcgccttgcagaacttccagctgacggaatcgtacacgatccctaagggcaccctggtgctcccgtcgatgtacgagtcgtcgtttcaggggttccatgaccccgacgcgttcgacccggagcgcttcttctcggaggcgcggagggaggacgtggtgtacaagcgcaacttcctcgcgttcggcgccggcccgcaccagtgcgtcggtcagcggtacgcgctcaaccacctcgtcatcttcatggcgctcttcgtctccctcgtcgacttccggcgtgagaggacggagggctgcgacgtgccggtgtacatgccgaccatggtgccgagggacggctgcgtcgtctacctcaagcagcgctgagtcaagttgccgtcgttctgatcaagctggtttcccgtcatcttctcgtgttccgctctgtttctccgctcctctcgatccatgcacggctctaccccaccacctcgcctgcatggctgcatgggcgttccacatcgctgcatgggcttgggcatcccctatcttgttcattaatattggtcaaacaatcatctcccataaccattccatcttctctttaatttgcttaatatattaaaattgcacaccagtgtagttgcgggtggcacgtgtgcgtttgcatgcactgtgtaggtggtcttttgcatcaagcggtctgtgtcttgcgtgtcgtccttgtatgcgtaacagtgtaataacgtgctgcttgtatgaatattgtaatttgtggtatatttcgtttgttagcacgcgctccatgtatgctacttcctccgtttcagaatgtaagtcattttagcatttttcatattcatattgatgttaatgaatctagacattaacatcaatatgaatatgtttagattcattaacattaatatgaatgtgaaaaattctaaaattacttacattatattgtgaaacagagggagtatatagtttcatttgttagcacgcgctccacgtatgttatccacatggatgtcgaaaactatcaacgcattttatatgaaagaaatattagaatgctacctagcgataggggcgatcagattctgattccctccctccacctggtttccttttttggcaccgtattactttcctattttagtaaatttatacacctaaagtttgtacacctcaagtttacacatctccacaattttttttttaaaaataaaaagttagaaaaatttaggtatataaatactatatataaaaaaaattgaattcaaattcaaatttgaattgggtatgtaaactcttaacttataaactttggatcattaaacttttggtgtataaactttagatgtatagaaatactatatatataaaatatttgaattcaaattcaaatttgaaacgggtatataaacttttgacttataaactttaggtctataaactttagatgtatagaaatactatatataaaaaaatatttgaattcaaattcaaatttgaatcggatatataaacttttgacttataaacttttggtctctaaactttagatgtgtaaacttgaggtgtataaactttaggtgcataaatttactaaaataggaaagtaatacggtgccaaaaaaggaaaccaggtggaggaagggagggaggagggggtcgctacccccatcgccaggcgatcgatcgcccattaggcgtaccccatgcgagtttctaattatgtatgcttcatccattacgggattgttaaaattatggcgtcacacttttcactgagtcacttttttttcctgtacgattttctctctcctatatatataaaagtatatttctatatctcatagctagtcttttaagtaaacaataaattacttttgatcctaattttcttatacattatatatttgaaaaattaaaataaaatattgaaacttatacggtgtaattacgtaagtgtaaataatttacagtataaaaatgatttaactatttttttctgaaaaatatggcgacataaatatagctattccaatctattattcaccactagaaatctccatgttccatgttgtttagttgtttcctgttagtgtatacaaagtccatgcaaaaaatattgttccctatagtttttatatatgtagggaacaaagggtggaagggcctaccatgctcctagtggcttgaagagttctggatttcctttttttcaatcaaagttggttagctggtttgtgatgcagaataatatgtacaaacatgcaagtttaaatttaatatgcacttgaaaaaacaaaaataacaaaataggtattggagaatagaaacataaatgtttatatctctttaagtgtacattaaatttgtagttgtatgtttcttgaaaaaaatatagttgtatgtaatgcgtatgtaactatggtggaaattatgacatgccataggacaactgaattggcagttgagctaggagcgataaaagtaataattgaaactgatactatgaagtggtgaggatggtggctcagtcagaactaaaccgctctatctgtgggactaggatccatgagctcaagtctaggttacgtgtcttccacgagtcgaagataatctcggttcggtgctcagtaagtatagtagcacatacttcctctatcaaaaaaactcaacctagaagaagatgaatctggacattacatcccctcctaggttgagtttctttgggacggagggagtaggcttgtaaaagaaggtttttcttctagttgctttacaacctgggtctctatttccctgggttttgttttatccttccttaaggatgattgtaagaatgaaatgtggcttgaatagagttattatcagttcctctaaaaaaatatcatcaaatatattaagtttatttatatcacatgcgtatatctatgtgttgtcacccttccgcctcacttgtggctggaccatgccccatccacatccctgatgtctactgtccaccaggatctcccactcttcaacgttcttatatattctatcatcccatagtgtatttcttgcattatcctttcaattttgatttaacaaaagatatgatttggttgatgataatgactcttgtattatagaaagactgagatgttattttattaatgtgctaaacaagcaagctaactcctgtattacaaaaaaaaagatatattttctattatgcgctaaaagtccattaaacttcgtataaacgctcctaagccgactcgtgttatcctacaaacgcttctaaccaccatgtggcgctataacaaattagagaaaatactgaaaattctcaggaaaaaggaaaatctccaacaattgatttttacttaaatttggtccaatattctaaaccgtcatattagattatattaaactacatcctaatcgcaccttccctcctccgctatggagataatttactatttgccatcattccaaaatgcacatacccaaatgctactctcccaaatttttattctcatttacaactttactgtgcacccaaattacattgagccattcatttttctaaaaaaaaatatgtctattacatcatatttgtaattagagttggttgccaactactgaattggtaattacaaatattcgtactgtagcattgaactgttatatataattacatttcttcatgcatatatgtctgtactaatattatgcaggcattgaatatataataccaaaaccaaattgacttgattcgagaaggtactatacaatggcagctatatgatggtcttatagagaagtctatccaaattcagaatggttgtacttggtggtttgctacagtacagtacctctcaatccatttttgggttgtagagttccattacctagatagggcaatgagattgtttggaagaaaacaattaattccaccaccacttccacatggtgagactgagctccgcaagctgcacaaaccgaaacttattggaggaaaatatgtttttggaataaattccacgccaagtatgtacaataataatgatgaggctgaacaatgaatggatcaagaagatttatagtactagaatatgtctcatccagttctagattagttttttatgggacggagggagtaaattgctaaatatgctttgcgaggctatagatggccatatgacccgaggtctgcggccaggcccaaggcacgccattttggcctggcccaagcacggcatggcccgactggggtcgtgcccttttcagcccggcttgacagtcgagctatgcctgggctgcaccctcggcacggtgggccggctcgacacaacacgatcgaataaaaatagtatagggatggaaaatagacttaagtaaccatgtaaggcaaggcccaaagcgaagaggaatacaaaatagacttattttccagccatatagacatagcccacatagttgagggatgaaaaatagacttattctgtggagaagcacgacgggctatcgtgccttcgggccagcccggcactgcccgagtcgtattgagccatgcctgggccgtgtgtgcagcccgtgggctagcacgactgtaagttcaagtgccttaatttggtttcggtgattaatgacaaatctaattatatgagactaatgtttttatgagtctttctttgactagtcttatttggatatgaaagtaaaaatgataggaggcatgtattaaacttcacatattctaacttggtctctcttgtggatccaaaatatagtgtgagctccctcattaatcttgattgattatgtgcatatgcattccttcatatctatatgtatgcacatcttgagggggagcttattctatattttgttcattataagatctctaccttaatttgaaattatctttcatctcatctctttgtattgtttatatcggattattatctatcacaaaagagagaaaagattgaaagatcttggattaaacaatttgtgtaattgttactttggtgatagatgataaaccgatgtttatgggattaacctctcttttacataagttttcaacaaggttatttcccgataatgagatgtggtagatatgcattatttggtgatggaccttaatcatgacaaggatgaaattcatggagattaagcgatatgtatcacttcttatctcctactttttgataggttcatatatatgatttccatgttattgttatataagtgtgagactaatgtttacttgagtcttatcttatttagtctcctttacattgagaacatggagatcatgaaggtatgtgtttttttgtttatcttcatcattactacatatgccttctctatgtgtataggataaacccccattggttcttctttacttatgcatacacttgtctctcttgtatatttctttgtatgcatatacttagggggagcaaatcctatacatttattgtgcatgttttagatccatgttgttcacatattatttatatcggatctttgcacttgagcttgcatacgagtatatgacacttgtgatgttaatgaatactcaacaaacatatccatatctttcatatgcaaccggttggtcatcaagtgaaggatgagaaccgatttgttgagactaatgttctcctttgagatgtgaaaaggaataggtcccactacgatgaggctaatgaatgacaccatgggttaatggtcaccaagccaaggacatcgtcatgttggcaagaatgaagtcaagcttgtgatgagaataaagtcttgacaaaggatggtaaagacctcggcataaacatggttcaaccggatggtaacaagtgttgatcttggctcaagcattgaccccaagttggatggcgcaaggcaaaggtataatggagctaagagtgttttcttagtcctttcccggtcttggtgtttgctgtagaccggatttgctagatagacgccgtactatcaagaggggtctatgaagtgagcatgtggatgatcttgcgccatattagttcatatgcatgtaggtgcatttggtgggcttgtctagccaagtgtggtgagtattcttaagtcctaaacaaagagagatgtgggcaaatcctataggtttgggtagcctcatgtagttatgtccggtggagtatcctttggagtgtgagccctttctccctgagaaaagttgtgtttcttggatggattgttcatgggttggatagccctttgaataagctttccataaagtccaagaacgccaaattccgagacccgagtcaagagatatcgtcgttttactaacggtcggttgagctgaaaagtgacctgcggtctgaccgtgggccttaggccggtctaactgggcctgttagccggtctgaccggtgtggtaagaccggtctgaccggcctcactggtctgttgcactggtctggtttttggtggcgatacagagccgcaaccggtcagaccgagccgacggcggtctgaccgagccgtggacgatctgaccggccactacactgcggtcagaccggccaggttgagtgggctcaatgattgccctgtaacggctagttttctagccgttacaaagtagtccggtttgaccggcctcacaacggcggtctgaccggcagagcacaaagttggggagttcggttccaatggctagtgttgatggttaggggtatatatacccactccccagtagcaagggtaagattttggcactccattgcattatcttgaacccttgcaagagctctcacacccttgggcacttagtttatttagtgaggtgttagagagtgagttaagccaatccaagtgcattgcttcattgttgtagctagtgtggcacttgatcatcctcggcaagcatcctagacttgttactcttggaggttgccacctcctaaacggcttgtggaggtgttgtccggtgacctctccgagagattgtggaggaggcccggcgccgtttgtgagtagtttggagttcaccacctccggagtgaaggaaaaactaccctagtgatcgaggcttgggtagtcctctccgtgggccggctctcaccttgcccaccccttgacgaagggggcgtgcggtggcttcgtggttgagcggtggagttgggctcgcctcaacggggactaagaaactggtgagtttccgaacctcggtgaaaaattccttgtctcttgtctcatttatttgttacatttacatttgtgcaatttacattcatggagacatatttgagcccatatcacctaggtttgtaaaacttaacttagttgcttagttaaccttgcacctcaccttgcctagcaacgtaggttagttttgttgaagtgccattaagttttaaaaccgcctattcacccccctctagtcggcctccttgatcctacaacgactcggcccaatgtgtaggtcgggccgtgccaacagcatgatgggatgtcgtgccttcgggctggcccagcacggcccaagtcttattgggccatgcctgggccgtgtgtgcagcccgtggggtggcacgacacggcccgacgtgtaggtcgggccgtgccggcccgactaacctcggcccaagcacggccgagcctgggccgtgccgtgctgggcagctgttgatagaaaacacgaggcctgggagatctgcttaacttcaatgcaggtccaaagctcgccttcgaatatatgagcgtgctagttgatttgatcctgtaatcaacaggaaatagagacaaagaattcatggttaaatctataaatgatagccgatcggctaggtgccgatgacatatcatttatctttgagccgatgtcatatataaatcgatcggcggttataaatagatagtaaggaactaaatctatttgatcggctgtagatattaacgatatatagttcttacattaatatatacttaaattaagtgattgggatagatcggtcaccatgccgagacagtataaatcacttagatcgaaatacatattaataacagaattatatatttttatagcatagccgatcagatagatctagcatgtatcggctaatactccgatactactttatataaagatatcaaaacaaatataatataccaaacaaaagcttaatatacttaaatgcaataagatcttgacataaagggcggatttaacatgtcattgaagcacatagatcgaatatggttaaatcagataagatcggctgaaactccgatactaccctaatcggcaaccaaaggacatgctagagattgatattctaagcacgacttaatagatcaaactcaactgatgcagcattaagtatgaaaagaagaacaatatctagacaatcaagccgctgggtgtttcataaagtggtagttatcttatataatctaggacaatgtcgctatttaacctaatcggctgtcttctattaacagatgttagccgattgtaggttagatgatgatattgccaaaggttatgtaagatatatgataacttgacaaattatatagacaagattagagtgtcataaagatggaagcactaatctcgagaacacaagtcatcataacaagttttacctcttgttaaagatcgaaaccaatgcagctcaacccgaaagcaagaactcgtcgaaacaaaactaaagcaaaaaggtgacgatgcgccgaaattgtattaaacatgtgtgttaaaaattacatagggctcagagtctatctatacccgagaattacaagatatgtctataccggacacgatcactatctctaacaaactctaagataacataagtctttacggcagacttttgcccaaacatatctctaaggaagttacataaaacatcctaattaatagatacaattgccttctcaggactctatccatgtgcggcaatcatcttgaagcacctcaattcaacccaatgtcatacactaaattatactatcagaatcggctgcatcgggtcacctagtccgactcagacccagccgatcctaatcgtagccgatctggacttcagccgattcttgctctgttcttggatcaatctccgccttcgactccaccttgatctaatccccttttccgatactgatattaccaaatttggtcattaacagcagcccatttggccatctatacgcaaggctagactaccaaccaacgttgatgaaataccatcttagatgatcaccgattatgcttcctaagcaagatatttgaccatccgcctgcccatccacgcactgcccatcctccctccacccatccacgtgccactcgcacggccgccgccctcccgccatctgcctgcacccccgccctaatcggtaccaaatgggactactactagagttgaagacctttttaaggtcttaaaagaatttagggcagcctctatttagctttgaggggctctaaaatagaggttagtacgtattggagatgctctaaatcactagtagccatcatttcagctggcacatagtgtttcgtatctttcataatcaatgtggcaatagtatctgaaacggggaattctgttgaaagcacaactttgatggtacacattactttaatcaatgtggcacacatgctgtttttatatatataaatgcaacattacttgctgtgcaccaaaactcatctacatggcttaggcccctatgctatgcgggcataatatttttttttgtacttttcttcgttccaatttggatacgtaatgaacctcctgatacaaccttagttgtagaatttcaatagggcagaataatataagaaagcagagattgaaggaaatttaactaatctgaagaaactgttaccgcaaaaatagaaattcttaggcactgttacctcattaaaaaccatatgtttaacactaaaaaggaggatggctgtggcaagcatgccacgaggaactgatgaagttttggttggatcttaacaacagatatttgctttatttttttgacaggtcaacgggaggcgaaatgcccacctgacatatattatgtcaaacagacttacgcaagagctattcactttatgatatgattgagctattcactttatgatatgattatgtgaccaaagcacatcaaattatttatttttttgaacgaatcaccacttagaatgtgccttcgttgaatagagtgggagagaaaactttgaactaatttatccactagtaattgtatgggcattgcaaagatatattttacctcgaaaaccaaattcccggttgattctatcactaattcactctgccactccagatgtgtgaagagagcaaaggggcatcggccgtgccacgagaacatgaatgatgagggggaatcgggaaggccggccactacggatgacatgatcactgatggacttggtttcaggtaatctctgagaaaatggcggttgcacctagacttgatgcgagggtcccaagggagttgcagaagcgtagctaaccaacggtgagcttagattctacaaaggttgatcgagaaggaagagcgactgccatacttggccacaatgctatagagccaaccaaggaatagaaccaagatctgagcccccctctaagtcttgcgagaataccacgagagacgaaggatggaaagccacgcaaggtcgaagtggccaggctatgagatcaggagctgtgggtgtccccgatgccgaccaacgcgatgaagagggaggtcacaagagaagacatggtgttgggtcaaccacgtcgtacgctcttccgcgtgacgtccatggctagacgatatccataatagcgttcgtatctggacgccatccaaaacagcgtccttactagttttataactctttactctcaattattacttttttaatttcagaattgttaattattatgaataaaagaattggtcaatcctttacaaatatgtgtagtaccagtaaacgagcatagcaacacgagattgttaatgggcgatcgatcgcccctagcacgccccctctcctccacgtggtttacttttttggcactgcattactttcatattttaggaaatttatacacctaaagtttatacacatcaagtttacacatctaaagtttagagacccaaagtttataaattaaaagtttatatattcgattcaaatttgaatttgaattcaaatatttttttatatatagtatttctatacatctaaagtttatacacctaaagtttatagacccaaagtttataagccaaaagtttacatacccgattcaaatttgaatttgaattatatccgattcaaatttgaatttgaattcaaatatttgttatatatagtatttctatacatctaaagtttatacaccaaaagtttatagacccaaagtttataagtcaaaagtttacatacccgattcaaatttgaatttgaattcaaatattagtttatagacctgaagtttataagttaaaagtttacatacccatttcaaatttgaatttgaattcaaattttttatatagtatttctatacataaattttttcaactttgtgttttctagtttttaaaaaatttatgatgtagtaggaagagaagaaggagaggaggaaggaagagagtagtgtatagggggatggggggcgatcgcctagggcggtcacccgcccattagccggccccataacaacatatgtacggtagagctatgttaaggaaatgaagttttctcctatgctgagagagataaacttcttcatactcgagatatacctctttatgcaagttgccaaagctaaaatttacacgttgaaagtaggattggaatctcatcttatctgtgttcttgactttttgttccgtttttagaggtgtttgtattatgtgtaagctatactagccaggaggtatagacttacctcctaatgaccagaaagatctcgataatgctaaccataaatttgtcctcagatatatatctctaaggatgagaaaaaaaaatctctaggaaacatatcaaaagatgagcttaattaccagggcctgcatgccattgagaatttgagattgctagtccattgtagataaaggaaattcaaccactaaatacaaggtagttcaggccttcagtattaattgaagcatacaggcatcacttaaaccgaattaagccagcactagcgtagatacgatacgtgcatcccattccacacgaaaacacttgatgatgccactgaagaaaaggagcactgtatgaacggccctggcttctctgatgctccggcaacaattcaacaactccgcaaagaacagcctacatcaccacggcaatctaatccggccttccgccacaccatccaatcagagcaagtcacacgagaagaaagatatatataacaaaacaaaattattttcggttttgctaaatttttggcgacacattttctggttgattacagtcgcttgttgagccattggatcggtcataggattcatgctagcatacttaataacgcgtaactagttatgcttcataggttacaggtcgctaattagcggtctactggagaactttgctactatttttttgttcactgcatgcactcgatcaagtatgagtatttgtaccgaccagcgaaacacatatgtaattaaagtataaatatgtaattagtatatattagtagtatatttagacagtagttacaccctacttacacaccacttacatatgtaattagtatgtaattttgtgacttacatatataattttaatacttatatatgtaattttgggacttacattgtaaatacactaaaattacatatgtaatttagtgacttacaatgtaaatacatgccgactaacttttagtgaaaaatatggtgctataaatatagctactcccattatttttccttccatacattttccgcaaaacaaacagagacccggccggtgtcattatccacctgtgcccagcagtgacatggccttctagcatccgtctgtaccatgaagactgtatttatatggcgatggctctcgggctccggactgtgaagaaaccaagcgggtgaagaggaggacgaagcacattgtgccgcacagttagagaggatcggtcgtattcaggttgacatcctttatcataatagcactattattacagtcattgacatatagggtaataaaagaatgaaacccatatgttagtgattgtaatggtagtgacattatggtagaggatcaatcctcacccgtcatattcgtatcgtctctgttaaaatattttatgtggtttaacgctagtcaataataagggggagttgggaatttgtcccatcaccttatttctcattttgatttacttttatcttacctttttattactattaaatttatagttgtgtgtcttatgacaaaagctggagatgtaacccatttctattatctaaaaatattcgtatcgtctctgttgtggttgtggttgtgggctcgattagcaaagaagcctttggaaacagagcccacagctcaaggtcatatgaaatagaaaacaggaaagcgatctacttgggcatgaagctgagaacacaaacatagtataggtaacccgagttgtgagtgaagggcagacggacgaccgacttatatatgaaacagacgacggaaacctctttagttatagtagagacagagatataatgtgcaaattaatataaatgatcctcctcctataaaaatcctataaaagtaacatgagtagagttattacctaccagttaagggatctgaacctgtaaaaaaaatactgtctcccatctcttttatctcaatcttgcgtatatcctaattccaacaattatcattctttataaataatgtctacgggtatagcccgtcgacagtgacgaacatgtaaaaacactatcatgacagagtgtatgcttcggactcgaaaacaccaagcgaagcagggtgaggacataattacttttagtattttactagcaaaatgacaatatgatgtaacggatgaaatcaattttaattttacatacatacatcaaacatgcacgttggtagattagtcgaaagcaatgacacattaactaccacatggtgagtgcataaggagcagaaatttaccatctctcactaaatcgattagtccataattagccataagtgttacagtaatctatatgtgttaacaacggattaattaggctcaaaagattcgtttcgtggtttccaggcgagttatgaaattagtttcttcattcgtctctaaaatccttttcaacatccggtcaaacatccgatgtgatacctaaaatttttttttcgcgaactaaacaggccctaagaatggtgggactaattccactgtccctcgtgcacccaaaacttgctggttgcacaaccaccgccctcctcacgacacgtgccatcttttttaccctcttacaaaacttaatctataagagcaggtacaatagcaggctataagccagctataaacatattttaaaaagataaaagaagagagagaagagcagcgggctacagatctatagccagctacagcacggactccaagacgtaatgtgtgtatgatatgtaggaccatatattaataatatagtaagcaactattatatgaattgactattacattggctatatatgatttggagctagtaattgactatactattaaacttgctctaactagatattgacaaaactataaccagaatgagaccttgtcagtaccttggtcctagacgctgacacctttgacaaacaatataaaagaatggtagatccaactgaatattgaaagtgtaccataaatgacgtttggaaaaaaaaaacaaagaggttacggacggcaaatgagattcgaacccaaaatcctattagataaggagcaacttaccattgagttacttaatacacctagttaagaaacaacctaccttccttttgatttgtaccatactcaccaaggttcatggcgctgatatattggatcacagcgtcaagacccatggcgttgaggtagagtttcaattttggtaatagtttttgtcaatgcatatttataaaacaagttttgtgaaaggataggagtggaagaagtttgaaaattgctcgccactcccaaatacgcaaccatgaagtaatccaatggcgttgacccctctcactacttccaaaataatcactcccaaaataatcaccaacttccacatccacccctccaagcgcctccgcccttccttcggcatccctttcctcctccgcatccagactctcacgtgagtaggcaccgccgtgccaaaacctgtcgcaatgcatgcctcaccggcaaaccgagtccagtgttaagctacaagcctacaacctccaacagtccaatattgatccctagtccgtattcacacgggaatatccgtccttagggttttggtgctggccattagtctagcttcaggccggtggcactagaaaattggaggagcttcttgtcgaggagacgtggctaaaggtgtccctcaaggaactccgcaaagttagaagtgtaatctgaagctcgtaatcacgactgtaacacggactcgtaattgatacaaacgcaaacatagtcataaacaattgtacactgtgtatttggtactcattcaagaatctatacatgtaagcaattagaattaagtagcatcctcccagaaaatgcatatagcaaggagaataaattaattgataatcattatatcctctactaaaataggacacatgaacagaagtaagagaaaacccaaaaagaaaatctggaaggtgagatattgggtaaacaaacaagtatcgtatcgttcatccaggaattacaaccaaataatatagagtatatttttactgtatcctaagttgagtatgattcattgatttcgatccaaaggcttagattttattataatacatcagaaatagtatgtgtagtagtagaaattgtaagagggggaaaaaaaggaaataagtcttctaatcttcttcccgatttctgctactgctcaccggtttttcgcacaccatggcatcttcgtcctcacgattcagcatggcacgacttcattctcatgatccctgtagcttccagcgactttgtttgtcaccacgattcacgaaacatgatcccggctgccggtagccctcaagccatgtgttcctgatcctgactccctgaacagcatcgacaaggatcgatcacaggcaattttgtcatcttgtgtttctaggggctaaaagaaggacatgctgcacggcagcttggcggatgtgcagcttcggcaactgcacatgcagttttgcttttgggactagggaagctgcttagattctaacttttttccaacaaactttcaattttttcgttacattcaacttttctatacttacaaacttttgacttttccatcacatcgttttaattttttcaaacttctaattttgacgtggaactaaacacaacatagatgaagacatacaattcaattttggggttcgtccacatatttggggcacatttcaagaaaattgttctttgaatagcttcaagatgtatcagaatagaactgaacttgatgatctaccattcgtaaacagaaatttaattggtgctgaatattttaggacatgttatcaggataaacaaaagcgatcaaccaacgtttcgaattggggaactgtggctaaattagcgatgccttttcttctctttctcgtgttgctcaggcgtgggttgcttcccagaccggcttgtttgttgctcacgaggcgcgcggataatcgcgaaggccaatgctagtatgcatgactaaaatagtctaacggccatggaaattaacggttagatttaactcatactactctactgccatataggagtactccaatagtggaaggtaccgtagaagtgcacataatatacgcagtttagcatggcagttgttccaccacaatctgcaatattatttgagtttactgaaccatatataggtggtgttgggattcagggactaaactttagtctttgtcacatcggatgtttaacattaattagaagtattaaatatagactacttacaaaactaatagcatgaataagagctaattcgcatgacaaattttttaaacctaattaatctataattagcacatgtttactgtagcatcacataggctaatcatggattaattaggctcaatagattcgtctcgcgaattagtccagagttataaaataggttttatcagtagtctatgtttaatacttctaattagtgtccaaccattcaatgatgtgacaaggactaaaaatttttagtcccatccaaaaacaaccccatattacacctttcgtctcaaaatatagtaatgatgggatgagacctatcttagaactacgaatctggacatgaggcatgtccagattcatagtgttaggatgagttaggttgctacattttgggacggaggtagtatttgagacttgctctggtcaaataaaaagtacctcaagataccagtacttcacgctaccaaattgtttccgatagttatgtttagctagacaggatggacattgttagatccaaccatccgaaacaatacggtaccggtacctcgaggtactttctgttggacaggagcaaatttcatattatttgggtttgctcaattcctaaaaacagttcaagtcgaacgactagcatgaggtcgatctagtatagtgggccactgtatcggtttaaaacctggatgagatggtttgcggctagctagttatggtcggcttacttaggtgttggctcgataagattgaaggtggcttgaattgtgttgtctcgggttgaaatccctcactcacatcccctcccggtgaagctttatatttataccctcatatacccttatttaagtaaaagtaaagagacaaatgtagattttgaatcgttttaatcagtgacagatttatgtgtaggttgtggggtcagcccagcgttttcactatcatccagtgagtcttaaattttctatataaatctattcaaatctgcataaatgacctcaccaaaatatgaagtaataataattaaccccaccgagtaaatttcctagcttcgccactggttttagtaggaaccaaatagaactatgtctttctttcatcatctcctcccggctttacatatgtttgggtttgttttcatataggagtcagtgatatatggtattccgtcgaggtaagtatacgtctaactacatattaagttcaaactcaatctacaccagggtttgaaatttcggttcgaaatttcgccccccaccgaaatgctcacatctcacccgaaaattttgttttttgcaatattttgtgaatttggtcaaatttattcaaaatcagtcaaattttcaaaaaaaaaatcgtacaaaaaaaattcggaaaattcggttctttcgcccacctgtggtagaaatcttagtttcgaaattttaaaccctgaactacacattaaggggggaaatctaagaatagactcaagattttatggaacaagtcaagtaattgaaacgatttccccccctataaatacgctctttgttgagagtccagaagagcataagtgagacagtctgagcaagagctcgagccttcagtatcccacgcactatgggaaccagaactaacccgcccggctcaatggtggagtcatttcacggcctggtcgtggtagacctccgcacggcggcgccattgctggctacagctgtggcgttgtacatcctcatagagcagttgtcataccaccgcaagaaggggtccatgccagggccgccgctcgtcgtcgtgccattcctcggcagcgtcacgcacttgttccgcgacccggtcggattctgggacttgcaagcgacgcgtgctagcaagtccggcgctgggctcaccgcggactttctcttcggccggcttatggtcttcatccgtgactcggagctgtcccgccgcgtgttcgccaacgtccgcgccgacgccttccaccttgtcggacacccgttcggcaagaaactcttcggcgaccacaacctcatctacatggtcggaaaggagcacaaggacctgcgccgccggatcgcgcccaacttcacgccgcgcgcgctatccacctatgctgtcatccagcagcgtgtcatcctctcccacctccggcggtggatcgaccggagcgttgctaacggcggtaaggccgagcccatacgggtgccctgccgcgacatgaacctcgagacatcgcagacggtgttcgtcgggccgtacctcaccgtggagacgagggagaggttcgatagggattacaacctcttcaaccacggtttcataaccttgcccatcgacctgccagggtccgcgttccggcgcgcgaggcttgccgtaccgcggctgaagcatattctcgaggactgtgcacgtcagagcaagcagcgcatgcgcggcggcggcgagccggagtgccttgtggactacttgatgcaggagacggttcgtgagatcgacgaggccgcggcggcggggctgccgccgccaccgcacaccagtgacatggagaccgggaacctcttgtttgacttcctcttcgcggctcaggacgcgtccacctcctccctatgctgggccgtgtccgcgctggactcccacccggacgtgctcgcccgcgtccgagctgaggtggccgctctctggtcgccggagtcaggcgagcccatcactgccgagatgatgacggagatgaagtacacccaggcggtggcgcgcgaagttgtccggtactggcctccaggcccggtggtgccgcacatcgccggcgaggcgttccagctgacggagcagtacactatacccaagggcaccatagtgttcccgtcggtgtacgagtcgtcgttccaagggttccccgacgctggcacgttcgacccggagcgcttcttctcggaggcgcggagggaggacgtggtgtacaagcgcaacttcctcgcgttcggcgccggcccgcaccaatgcgtcgggcagcgctacgcgctcaaccacctcgtcattttcatggctctcttggcgtctctcatcgacttccggcgtgagaggacggagggctgcgacgtgccggtgtacatgccgaccatcgtgccgagagacggctgcgtcgtgcacctcaagcagcggtgcgccaagttaccatcgttctgagctggttattttccgtcacccatcaatttctccacggctgcacctccactgcatgtgcgttccctgtactgttcacgggtgtattctaaattctcaaggaaatatcgatatcctttatttgtatgtcatataaatggttacaaaataaaactaaaaacacaacaagttaaattaacatatgagaaaaccattctacaaatatacaagttaaaatttaacttttacaagttaaaaaaaaaactatgaacgtatattcacacttaaatttatttttttcgttgcaattggttgaagttaaatttgatcttgtatatttttatgaagtgatttatcacatattaatctatcttgttgatttttttttctaatcatttgaattatatgcaaacaacgaggaatatcctcttaatagtttaaaatattttccctattgttcactatttggacaatcatgtcatgaccacttcgtcttctctattgtttgctatattaaaattgcaagccgatgtagttgcaccttgcacatgcatgtgcgtgtattaggtggtgtttcgcgtcaagcgcttattgtcttgcgtgtccatgtttgtatacggttgaatgatttaaccgtataaataaagggatggctgagattaaggcaaattcatcggtggagttggccgcaactctatgggatctgcacctatcttttaggtgtgtgaattacaaactattaggaggatcacaaattcacaactgcaatcccgaaatattggggcagccgaaattcagaggattttattacttctttaccatatttttttttcaaatctaccccttcgctaattctactactcaagctacatgtgtagtacaactgattgtagagtccgtcagatgaaattcatagatggcggatggccatccctggctccaagggtacataaaaaatgctctatacttaatttagatacgttaagtagggtatggacggacgtacgattgcacgtagaagcaaataacgatttaatttgaaaattaggagtaggagggcgtagtatgtacatacacgaaagatttttttcgttttttttctttggtgaatagtactcaatccatttcatattataaatcgttttgacttttttcttaattaatcaaatcatttaagtttgatcaaatttatagaaaaatagagtagtatttcaacgcaaaacaaaatgtattatcaaaatatataaaatattgctatttttttatatactagaaaaatattaaaatgacttatagtatgaaacggatgaagtagtatgtatttatacgtaaataaacaggattttttaatagctttttccatatttctggtgaatagtacgtacacatacatatgttttctctggtatatagtagtacgtatttatgcgtaccagggtttacgattccgagatgaccttccactctgagctttggcggtatgacggttttcgtgaaatccgatagaaaaccggtaggtttcaaacaaattttgtaaaccaaaatttgaatactaattccctgagtttatcgatatgctcgcgaaaacctgtcggctttagcgatattccgagcgaaatcaagtgcacaaccacatcgcctctctattatattatctaggctaagtactaagtgggcctactatatggaatttggcacaggaaagtgtttttcttttttaaaccgttattcttttcttttctactgtaaagttcaagaaatacacggaatataccatttcttttggaaaatttatacccaatggattttgttttttttttattttttatcaattcaaattcgaatttgaatgaaacccttcaaaattacagacggtttctactttcgagccacctcgaaatcttggttttcgtcggatctgttaaccctgatgcgtacatgcgagattatttttcctagtttttttccggttagtagtacatacgtttttttttctctcatagcgcacgggagattagatgggaggaccaatcatctttttgttcgttttttcggtgagtggtaaagtacttacgtacgtacgtactaactattcaggacagacttttttattcattcccaggttacgtgtgatctaacctaatgttttaacttatctaaacgaatgtaatggattaaaataatgagtttattgattaaattgaaaaccaagggttatatataattttcttttctattgtaatttggaaggttttctctaatttattaaagcgacggatgacagaataagagagtttgtaggattgctatgtagtcgtttgatatttttcctagtgaaactttattaagtttgatcaagtttatagaaaaatttaacatctaaaatataaaattagttttattaaatctaacattgaatatagtttgatgatatgtttgttttgtattgagaatagtagtatatttttctataaatttggttaaacttgaagaagtttgaccagaaaaaagatcaaacgacttataatatgatatggaaaaagtagtgatttaggagcgtttgtgacaaaataatagatggatttttttggttctctctctggtgaatagttgtacatatctattatcttattaaagtaataaaaaaggagcctccacgttcgctctcacggcttaaaaattctcatattaatcgaagaaaaataaaaacatagtccatatagaaatacaatttagaaatagctgaaattcgaaattaaaaaaaataatgaatattgtaagaggagactagagtacatatagaaatataattaaaaaataaaagaaattcggaattaaaaataaggaatagtagaagaaaagcatagagtccatataggaatttagaatgtactaaaaggaataaaattaataaaattaaaattagagcttagagtccatatagaaatacaatttacaaacaactaaaattcaaaataaaaaaaatagcaagaagagactagagtccatataggaatacaatttagaagaaactaaaattcgaaattaaaaaaataaagaatattgaaagatgagtttagagtttacatagaaatacaattagaaataatgagaattcagaattagaaataaataatattgaagagaagcctagagtctatatagaaatacaatttacaaataatgaaagttcgaaaaaaaagaaatattggaaga

SEQ ID NO: 60131 - DNA, 10292 bp, Oryza sativa
  unsure (1)..(10292): unsure at all n locations
cttgcgcttaacgaacatgagaacatagtgaaccaccttccacaacatacaagagcgatatgtactaaagcctcaaagcaaccacctcttcaacaggtcagacgccttctttctcacaaaggtctagcagtgataaggtctgtaaatttaagatgatattgctcagtttgcatggccacatttttgttgtgcaattcaatactgcatatagtaacattatagtcaaaccatgtgcacagtaatagtaataacctacatacctcagctatggagagctcaagacgaaactttggaccatcgtaatggtgcagcactggtctgaaagcatcctcttccaaaggcttgcagagctttctaatgcggatcctcacctagtagaatgaatatagcagaatatcagtgcatgaaaccaaaagtaaatgagaaataaacacacgccagctgtaaccattacctgcgctgggaatctagattcacctttacacttcttatcttcccatgcagtgggatcaatattagatcctccaaaactagaagcctgatatgagcaaaaacagttatagcaacaataacctgttagtttctattggggtacattgttgattacaaatagaagtttatgagcaaaataaagtcccaaaagtattatcatgtcacagaaaagttccacaaatttcatttaaagacaaaagtatttcataataattaggcaaaaacaatttcaggcagaaacagtgcagcataaaaatgagaacccagatagcgttaaaaagtagtagctcagtacagaacaatgatgaataccccagaaatgttgtgtaacagtataacaattaacatgcatgcagtgaaatactatgtgcgtaatgaaaactggagtaggccagtcaaatgatgcacagaaacagtaatctggctcatttataagagtatggtacatagtaacatagatttggagtgcctcacaaagtgtgaggggcgaggtgttcaaacttcgaaagctatattcatacttgttggttaaataggctgaagcatcagatgttttccaaaacaatgatataaatacttaaaaagatgctagaataatcaatctataagtgaacatttgcacttaatttcatggctgcttatggatctttcgttttcaagtaaagagctccttatgaaattcataagatgatttatgagtatctgaaaaaggaaattaacacacctcaaataccccatgaagctgatgggtcgtgtagttatagaggaaaagaggtagaccaggaataattgctcggactgaatcacgatatcttgctggcaaccctgcagaacagcaatatatgattatatatcagaaggttatttgatattgatcatcgtaaatagcagcatgaatttattctcggaacaatatgccaagtgatgattcagaagataaggtaagttggatcacataccaaaaagctgcctcttgagatcctcctgcatggtgtcattgttgcaaacaaagatatatccaccgagcacttcattccttggtagcatctcacttgttggcaatgttttgaatcgtttgtcaacagcagagttgctgctgttgttcccgctgctgttacttccattgctgttggcaccactgtttttgccattgacatctttgccatttggactatgcaaatatttgttgaccccaacattcatcttgaacgagttaacattgccattgcctcccttggggtacagctgattcatgttgtaggccatgccgcggaaaggattcttcatagctgcgtcattcatcctgatgtcgttcatcttaagatctagattcataaggccaagattgaggtggtccatcttgctctcatcttggtggtaggataccttatcccattgcttgacatcagggatggtgttcatccgcgcatagtcaagctcattcgtcctctccgccttggacttgttgatctcagccaacttcgatgtcatgagagaccactgacggtcctccactaccttcgactgcccacggaactcatccccgagatgccacaagttgtccatagctcagctcagtctctccaccttcagcaagaaagaaattacccagggccggatccaacttgggaacaaacaaactcaaactggtacttgtattaaggttaaggcgctgaaattaagaggagagcttcttccagatctagaagagaagctagggttaacgaacaaacgcaagcaaattccagaaaaaaagtaagagagatgaatcagaaagaaagaggatgtagatgctcaccaggatcccctcccctgctctgctcgcgagtcgccagatggagatcgccgcctactccccctcttctgttcagccgcgactcgtcttggggaggcgcaaggagcggaggagacgacgagacggggggagatttctcttttattttacgccaagggaaggaatggggagagttacagggaatatttaactacagtatttgccaagtctatctggatccgagaaaccgaatgaattcgaattttttattcgaaaatgtaaacgaatatgataatgctactatccgttcaaaacaaatttggaaaatttcaggaaacgaatttagaatttttttaactggaaatgaagtatttctcagttgattagctccatacttttctgctccaaatatttagatttatactacgtgccatagtactaatgcagttatagatgaatatagttcttttttcaaaaaagaataaagtgtacacctaattgtattattattaattaataaaaattagaagtatcgatttagggcttgtttggcacggctctagcttcaagacataaattataaatatcgatttattgtctaaaaaatatattaagctacatgtcttcattcattttttaagaagttcagcttaaggggtttttatattccgatatcgtattcgcttcatttttttattcgataatattcgattccgttttcgtatccatggttttcgattctaattccgatttcgaaatgaatatggaaaacggaaacaataaaagtggttttcctccgtttctaaagcgttttcatccttactcgagtactccaccttttatctcaatttttttactactttaaaactagctatttatttacgatgactgatgaccaacatatcagcagtactcagagaaaaaaaatccaacaaactaggttggggattgtgtcaagagcaaactccttagaccaccaataaccactaattgacactccacgcaccgccaccatcgctctttctccatgagccaccaacgttcctcctctccgcctttacatgcgcaaccacaccccctagtcactgagatgtcttttctcctccaccatcgtttatgcacgctattgtcatggtcgtcgttgaggtaaggggtgtcgggcttgtcgggacatgggaaggtaggagtcgacccgatgaagatcagagacgctagatcgggctcctccttgctggatttgacaattccctaactgtcgaaggaaagaagaaaaggcaaagagagttagtgtgcggaatggttgtagtgtcaccggatccgaagatggatagaatgggaaggtccaaattaaaatataaagttagatgttgtgtaaatgaaaagaatggttaaatggtgatataatatgaaaaattttaagaatatacagtacaaactgtaatttacctttttttctttagcacaattaacgatgagttatctattatccgatagtctcgtgatatgctaagcccactgcagttttatcatctctgcacagtatggttggatcggtgtacttagctattactaataatctcatgatatattgatacatgacgatataaacttctactaatacgggatggttaattctattaacacaggctcattaattatgataagatagaactgactaaaaaaggataaaaataataccatcaatagtctcatttcctcattgcatgatatatgatgactatctctcatcaatatgtatataattatattggtattttcctaattctttcatattgtttttttagtttttatatgttaatttggactaatattttttctcataattaaatagtaaacagatcgtttttccatatttctccattaaaatgtgaaatattgcattgtataatttgaaagttgtattataagtgtatgtaatttaacgtgtaagatatggacttatagtataatatttggtttttttctctaaaaatgttgcaccatactccctccatcctaaaaaataacgtagtctgcatgtaacacatcatagtactataaatctggacatacctttgtccagatttattgcattagaatatgtcacatatggtcttagattctttttttgggacggagggagtagtaaataggtagttaagtgaacaaccataattttatccatattttacaatatgtcactgagtttgtcaagttctaatatatcatttcattttgcttaactcacagtataatataccatcgccgttcggttagcctccgttaatattatataattttatcgtaataatcgaaatagccttgaacgaaaacttctaaattttgatcaaaaattccgaaatgtcgatcgatcgacgggtctgcgctatcaattatcccccgccgctgatgggaggagaatcgacgagcgaggaggaggaggagaccttggcagcttggctggctcccaccttgctcctgtcagcgagccagggagaggaaaggggtgaggtgtcctctcctcttttagttatagagagcggcggcgagatggggcctcgatttggatgttatttacgtggactgccactggtggtgtactaccatttgtttgtttgctctggttggtggtcggcttggatggatggatgggtgatggttgttgcttgaggttgagctgatgcccttcaatgatgccgaccaagtacacaaattataatataaaaatttatgatgcataaatttcaaattttgaattgatatgccatgcatgtggattagatcttgtgtagtaggagtattcattttggtcataaatatatatctctgcatccatgggctagcttagctatacatggatggttgatgttgatttgttcttttatttcagacaaatgagttagttgcagaattgctttgctccattttaattgttaggtaagctgtagatgcaatgcaaggtagggtgcataatacgccggaagcgaataatttgctgtgattaagagagtttcagcgtgtgcaaattataaagggcgtaattagcctccttggttttgccaacagatagtactcagggcatgcagacattgattttgctaatgacttttaaggcatcaggcatcaatcaaagcttgtggtactctgccggcacacgaaaattcttagctggagtgccaagcaaaagcaagatgcagtccttgatggaccaataggacatttcttaaacatcaattgtcatccctaatttctcttcaagtagtatactacaaactaacccagtacagttctgctcaatcgaatttcttaattaggcctgcatgcaggcacatttttgttcttgacaagacgatttaattaattagctggagtacatgagaagaacacaacgaactgtgttagccaagaaacgtcaactgctgggaactgaacttccgatcaagttggtgagacatccacggcttagaaaccacaagtcagaagttcagaaatcagaaacagttagttagctaggaaaagagagaaaggaacacataaaagcaagggcaaatcatctgtgttatccatcgatccaactccatcaaccacaacgatcatcgccccctgcttttccgatggatgacgcatgcgtgttgcttaattggtttgtgttttcgttgcatttcactgcatccacacacacttcagcctgctgatctctgcattctgcgtgatatcacattacacaatcgcattcaacccgcacaataactagaagatgcatccactctccaaacaaaataatggtggatttttttttattttgttttgttttttaaactccgtcctcgtttgaatgaatgaatataatataaatccaccggccaagctacacacgcatatagactgtatatcagctaaaaaattaagctcttttttttagatgcaaattgagctcattgggatcgaagaggccggtggttttctctcaccttgattaattaagctgtttttaatccagagcgggatgcatgtgtgcgtcgtgtttgggggggcagagaagctgcaagttggacgatcgagttgcttggaacagcgggagaacgagcgcgcggcaaacggccgcggacatattcgatttgtcaggaaatagcgacaaatatatcggcacatgaaattgttctgccgatcgatcgaactagtactaactgttcgtatacgttttgaatttcaaatcgattaacctcttgctgctcttggaatattcttggtcacttggttttgaatttcattatttcaaatcaaatgaattaatgaaagaatgaagtatcaagacacagattgcagtttttgcaataatattcagaaccatcaaccatgcaagcatatcgatcatgatgctgatcagtgatcacaggctaactaattattcctcttgttgctgttggtggcttcttaggatggtatacatagattagataggaacagtgcaagttgtagtagctgaagccattaatcaattagggttcatcacatgggaacaccatgtgcatgcatggatcatggatgcgcccagcttcagtggatgcgtcacatgatcaagcgaaggccgggggccctgaccgtggagaagccccagcaattgactaaaaggaaattttatggctggtcgaatgaacatgtgaagagcataattaaactgcatttaattaattacagtgcctttaagcctgcgacgacgatgagtgaacannnnnnnnnnnnnnnnnnnnngtacacgaggaaacaaggagaatccgatgtaggatgtgagtcccatcaggccatcactatcgctactgcagtactagtacatgttcgacgaatcgatcgtacgatcgattgaggatttgttattttaatcatcgcctttttggttgatgccttgttttcctaataattgatcagatctggttgatcgatctccgttcgaattgaaatcgatacatggagatgcacagcaaggagatcgatgcatgctgctagtaccaaaatgttcgagcctacaattatcgacgaattaaccatctctcacatcacagaaaccaaaatgttcagtgttgctcacgtcgtgaattaaaaaggccaggcgacgtgcgacgccacctgaatcgttgggagagccggccacagctatctccggacagctatagtgagcgcgtcgtcgtttgcacagctatagctgctgcctgcactgcacgcgggtaaggcaggtttcagctttcaggccggccgtccatctcggtgaaagcgcgggagcatatggaataaagttttcaaaagaagagaagagagcaaatggaataaacaaggcaggaacgcaaaaaagaaaaaaaaaagttaatttgatccatgccattgtaaatgtggctatttagaaaaataacattataattcgtatattcataaacgtgccactccaattttacgaaattaaaaccatgccactgctgtcacattttccatcatcctctttctttccgtcttcttccttccttctccagcccgtccgccgccgcccacgcctccgcgaggctctccggcgacgcaacgaagacacggacgcgacgggggcggcggcggcggcgcgcggcgcgtggcgcgacccggaggcgacggcgacggcgacggcacgggtcactcctccggccgccaccttctttccggtgagcacgcttcctttatccccctctcccctcccctttcaaatttagggttagggtttccttctcttctccctttcccgtcgtcgcacgcaccgtgccgtaggggccgcccgtctggtcgtgctccggcgccgacgccgacgccgaccgcatgttcagctctggatccggcggcggcatggccgggacacgggagggttcttggacgccggagaggagaggagaggagaggaggaggaggagagaagagggttcttggttcttggcccgtagccttcaaagtgtcggcaccctccatgtcggcttcagcagccggtgcagcccctccacgtcgctgatcttgttctccgccaggtgcagctccctcagcgctgtgctccccgacagccctgcgagataagattcagaaagtcatcatcgcatctctgcaagactcgccaaaaccctgatgaaattgagagtcatgtagatgtagttgcagttgcaggtttgcgaaatctgaaggaattcagagtcatgctgcagtacagaggagtttcttctttctttttctttccaaaattgcagggttcgaacttgattcttctcaggattgcaaaatctgaagaaattcagtcatgtagatatagttgcagacttgcagtgcagagattttttttatttgctggtaataaggtgtcaagaaagaatcaaccaggtgtttcaccatgtacaaagaattgtactgttatgcaaccgcagaaagccgctactagttcactgttatacacttgagtctgaaactttctgcattataatgttcattgcattagttcactggttttattttatgtatgtacaacaagaaatggattgttgcattagttcagttcaacatgttttcataagattatacttcctcaacatgatacttgtataaaacatgtttatcatagctattcaagcactaatatgtctagtgttaaatgagctgattgggtaattaattctgtacccatgttatattgtatttgatgatgagatccttctatttgattgaaaaacagcagctcctactttgatgctagctagctctagttctgggttttatgtaactctagctctagttccggatatataatcttggatgctgaatttgaatagtcagtgatgtgtataagttgtgcttgttttgtagattgcacacgcacccattagacttggagaagaccaacctcctccttcctgggaccttgtaccctctccttcctgggaccttgtaccctctccaagaggtactagatctatttattccctttgctttaagttgtttatctatattttgtgatgtaaatataaaaaataaaagaagtggtgtaatgtagaccaaaatttcttttcctttcaacatacggttaaatttgtataaaaaagcatagagaatatacaagttctcagatttttcagatttcttaattctgaacatgctcggcgctaactaataaaagatcatctttaactaaatttgacaactaaatttggtaagtgctactgccatgtaatctgctttttcatacatcctgtaagtgctactgccatgtaatctgctttttcatacatcctgtaagtgctactgccatcaattattgttgcactgtgcactctttaagaaaaaaagatccttattgctcttttcattttcccatcaatttttaaatatgcttcataacttggatcttcttaagattaattcccatagtttagtgattcttttgtgattatctttctagatcttttgttgatgtgctaagtgcaaaattgtaaataatttgtgtgctatctatagtactactatggatatgagagcaagatacctcgctagaaagaggagggaagaggaggacgatgatatgatgttgtttattttccctgcactacatttgttgagttatagtggagcaagggaaaagaagcgacaccatacatcaaagctaacaggtgatgagcgtgttcgggagttgcttgaagggcatgtaaaaaattgccgggtagcattcaggatggagccggaaatatttatatctttggccaattaccttagaactgaaaagttggtcgatgatactaggattaaagttgaagagaagctggcattcttcttatacatgcttagtcacaatgcttcatttgaggatttgcaagagaaatttgggcacagtggggatagcttttatcgtcacgtaaagcatttcttcaactcagttgtccctacgctcttgaagcggtttttgaagcctccaaatcctaatgaagttcattggaaaatagaaaaagatcctagattttatccctatttcaaggtt

SEQ ID NO: 60132 - DNA, 8740 bp, Oryza sativa
tgaagagtcccatgatgacacagacgagcagtatgatgagcacctccgatgagaagtcccatgtcaggttcctgatgtagatgagcgccaagaacacgcccaagcacagcgtgttgttcatggtcacaccaccatatacctgcaaacaaagaatcaaacgcttagaatcagtaacatttttgtgtagatttagaaactagaaacggtttaggaagaataactgcttctataatgtacctcagagaaagtaagggaactggtccgtagcttcttcctgctagcgaagatgatggcagacacagcctcgctggagttggtcgccagcgggagggcgatgaacgaaatgaagaaggatgggatgtgcgaggcgttggagaagttgtggacagcatcaacaagcgggtctgcgaatgcagcagcaatggcactgccgagaagcaggagtcccacggctttggtgatgcaccagccagggttctcaacgctctcaactgtctcgtcagatctgtccaccagaaggtcgtgttcctgccttgttctctgcagaattcagacattttttcagcacttaaatctctagacgtctgagtcacattcctatatctgaatcttttcgtgtatcgcctgtctaagttatgctacttgatatagattttcagaaactaaagcactagaggaaggaaaatatataccgcatggtaatcagtgatgaacttattggaataggcaccactggtagggacgctgcgcttggcctcattaagccatctcttcatccccgagacaaactctgcctcctcgacgatatcattgcctgacgtgtcaaagtcatccatgatcttgtcaacagcgtcattcttgtcaaagtcaacctcctcaaagttgataccaatgataagtgcatgaagctcagcacgggacagggtttggctctcatccatgtcaatcttgtggaacaacctgcgtgtgaggatatacaaggttcatgtcaagttcacgagctttctgttggcatatcaagagaatcaaaatgtctaagcacccacttttttatgacatcttcattgggtgtgccatcctcattaagcagccgcccgagcgcttccatttgggcatgcctgaggattccggagatcacatgcttgtgttttgcgtatgcaagcttcctcttctgaatccatggctggaaaacctgatgcaaaacgcagaacctaacagtcaaaatctagagacaagagtttccaatctatgccatcgtttcaggaggctcaagtgtccttaaacataattgtgcttacctgataaaggcaataggcaagcacaagcgagaatgatacgataagtgccagcaagacagctaggcgctgtccgtggtgggtcttcaacattttggggaattgagcaatgataaagggaataacagaaatccccatgatccgagctgcatagctggtttggacatcagttgaaataccagtgcctgcaaaagaaaatttgtgcatcttacattcaatatatacagaaccagtaggtcaaagcagtgtaaaggtaaggttaacatagtggtggcttgtggtttttaacatgttaaccagaacctccaaattgaatgcatccttacaaagaagcagacaaagatcagtgtttgtaatttaaactccattctactttaggatttagatgtaacaggatcaacaattatcagaaagactacattaataacaatgttaaatacaagaaggcaatttaccagtcaagctgaagcccttgttgttctgtaaatcaactgcaacgccatttggaccaatgtcacacttgccaacaacaacacaggttccccacagaagggtgagaagaaagacggtcgaaccagcaagcaaccccattccaatcaggacctgactttgtgcggtctctctactcccggacagaccagacactgttaatgtgacagaacaaagagatcagaactctaattggatatagttggatattcagagcagtaaaaggtgagtagcttcatgattgtagcatatgtaccaggagaaatctgttttgagcaatatggatatgcaaaatgtcaaaatctgcatcataccataatacaagatcggtggtcaaaatcagagaactggtttttataggagtaaatattctttttattaatggcacagaagaacattgatgtttagacttaagagtggcagagccagaaacgctaaaaaaaatggttgaagagggccaacagtgctagttttttcaaagtatgccaaagctacagtaaatttagtgtgaaattagaatccatgggggaggacacacgcctgtctccgccctaggtaagactggtaaggtggaaaacaaatactaatagagcaaaatttctagaataatgagttgatcaaatgtagcattatcatataaaaaaggtgtaccagcatccacatttaagtctataggcaagtcctacatcggtagaatacatatttcatttcagatctcattgcgatcaatgaaccatgtgcagccatgctatcatagtaaagtgtagccaaatcagtattgtgttctttttaatgaatgagtacctgaaaatgagcagatagctacaaatttcactaatattagagcaatattgcctattatctatggagaattagaatctttatggcacacgaaaggatttaacgaagagggtttcctcttataaaagtttatgaatcttagagagtagttaaaaaaaacgttaatcactatttcctatgtcgcaaaataagtttatttttcactcatcccacatgtaccaacacaaaataaaaaagactaggatactcccactatatcaaatcccaacataattattacttgtactattttatttttttgctcgctctggtctgcattgcacggtttttcttttctcaaatcaaattccggcagagctcctgccgtcagtttcctcaaaaaaaaaacataattattacctactttatctacttacatttatttcctatttttacaaactccgatgcaatgatttcttaaagataaatttatattgggatagacgggaggagccaaaaatgaacttattgtacaacggaaggagtacttcagtactactacgtcacaaatgtttaccgtgatagttcaagcatgtgattagtatgatctgctattttcacgtgacaagatcggcaacggtcttgaaagaaagacggaaccgaaaaagcataatttctggaaagctaaactccaacggtccaaccactctatccagttgcacaacatgttgcctttcaatgtgttcagttaaactacaataatttggttgcatacaattttacaaatatataatttggaactttggatgtaaaattctatgagtaaaatatcaaatctatgccctattaatttcctctgaggacaaaccatcgtatttgctacgtacaagaatagtacaagataatgcaacacagtaaaagtgcatatcaaagcaagtcgatcacttgatcacatccactaatcagataggtgcaacgcacaaagaaatattccatacaaaaagggtcaattatgcaagaacgtaataatgaaaagtaaacagaaaaggggaaaggtcaaaatgacaggacaagcactggtggaactttatcatgctagcttatctgacacatttcagagaaaaagcagagctcagtagaactaattcctcgaataagcaggaggttaatcaaaaggcatatatactttgctagagcttatactctgtttttcttttcttttgaaatagtagaacatactctggttcagtcacaagactaacagaaactttagatctgaagcaaaccaagaacagacaaatctctaaatttacggatatgagttacttttttacccttcataaacacgcaagattttaccagtgctaattccaagaaaaactttgcatcctcgaatgttaaaaaattcaaaagtttcactataaaatccaaaagtcttactgctagagtgagtgagaagaaagcctgaataagtcctaaacctcaaccagagagtaggcaaccgatcgaatacttgtcggttcatcaaagaacagaagaggctaacgaaggaaacaaaccgaaatacgagctcaccgaggacgaggagcgcgtcggggagggcgccgaggatggggaggaggaggccgccgacgaggccgggccccatgatctcgagcagcagctcactgccggccgacaggaaggtggccgccttgtacatgaggaacccatacgcgagcaccaggaacaggttcccgagcacggtggtggtgcaggggaggaacccgtacgactgctcgcacttctcctccggggcggcggccggcggcgaggaggcggaggcggagttggaggtggtgaggcgtatcacggctgacacggggttggagaggagggaggtggcggacgccgaggccggcgagccgtcggagatgaggcgtccgtacgcggcggcggccaggaggaagaggaggagcgggacgagcgggaaggagcggcggcgagtcgccattgcgggaggcggccggaggcgaggggcttctcgggtagggatgggtttggtgcgcgtagctttatatagtgcgatctgtgcgatatttgatttatgtatttctttccttaattaatttagtaggagtactactagtttataatatagtaatatttttttgtgtgtgtgtggatcaacggcaaggagaggctgtctggctgaagagccggatccaatgatcatatgtacgccttggttaaagtggttcgttatacattccttacctagcgatctgtacgctttaacctttccaactagagtaaattccctttgtactcctgaaaactcacttaattccttttatatctctgaaatttacccgatcccttctatacccctgaaattttaatttgattccttgtatgccctcaccgttacattttccatcatttcactgttacgtttggttgcaaatgtcatttttacccttgatgctttaggtttaaatataagcttcaaaaacaattgaaaattttatttgagtgcacagtatgtgtattttataaaactaatgggactaaataattagtgcagaaaattttgacataaattttgaaaataaaataaatgtaataaattaaattttttatttgaaattttaataggacaatggatttttttatcaggagcattcataaaaaaaatgttgtgaacatgggtagtcctatctttatatgaatgcccctcatttttatgacttcttttaaaaaaataaatacgtatttttctatttcattatctaaaaatattttttgggataaataatacatcgcacaacaaactcataactataatagtctcatgcgagaagcttttatatttttaataatgtaattcatgaatttctttcttcatccaagggtataatagtcatttttatagaaaatacacggtcaactgacgggaagggtatgcaagggatcaaaatcaaattttaggggtacacaaggaagtaagcaaaattcaagggtatagaagggattaggtaaaatttcaggggtatataagggattttctcttccaagtaaccacactcaaacaatcaaactatgacatgttatacatacgcgtataaaaactatggaaggtgcgaaaccatattttggcctattgtgtgcagaaattaccatgagcttaaacattgaaaaattgtgaacaaggcaaatctataatttgaggtttcacaaaagaaaaaaaactagaattttaaaataatgctttggtgcgagcacctgatactacgagagaggaatgtgtggatctttttctctttcgccctcaatctcatcaatccctttctgcatggacgactaggaattcgtgggtggctagtagcttggagttgtggtaggggagagcacctatgcccctattgtagagttatggcgaccaatcacgtataacggtgattagctcgacgttaattcttttcttaagctagtattgagagtcaccagtttcgtggtggcgggttttttctttttttcctgattgtagcatttcagggttgtaattttatttttttaatgctacattaaaatgaaatctcacacctatcttgtgtggttcgtttcaaagagaaaaaaaaatacacgcatcatgtcagccatttctccgctatcttttctctctcttcacctctgatcccttctctcttctctctccagtcttcatccctattctggcaaggttgctcatgcggctacaacacataactataacgacggtggcaataactactagtgacgagcttgaggtggctattgcagctatgatgacgagcttctcacaaagtagtgcctatgacaatgatgagcaatggcggcagtcgcaagttggggcatgcggatgccccgatctggtacttgtgaagcttggggctaccggattcgatggtagtatcacttagggatgctcgatccgacatcagtgaaactcttgagacgctagactagtggtgatggagcttgggaggttcctcctttgtaatacgtgcctagcaataattccctgcaggctgaatggataaaaaaaaagccattcattatccaagcaatataaggcaatcaaacacacccttaatacttttatgatgagcacaggaacttagaatatatgttcaagaaatttgttcctcagctctccggaggatagatcctgaatttcgttttaagagtccatttggctcaataatgtgcataaacgatgcaaaaattatggctcggccgcatacgtggccataactggcaaagagattagctttctaaatcaaactgtgggacccgctgatttattttgatgtttgtttgagatctttggatggaccgtggaggatccagagttcacactgctgccacatataattttttagaatcagatcctaatttctcattcccaaataaaccgaaagttcagctctttgagctcagaaattgatatatcgtcttgctcttctcttttcttgcgaggatagctttggcatttggtcatttaagtcctactatccttagcttcgttgctatataaaagcacagtggtacatgatcgtgactcggtgatgccaacaggcaacaagttatacgacaataacatggcgattttcaatgctttttttttctttctgaagaccgtgtcaccgtgtgtaaagcctgaccccgctggatgtttgacaaaacaagtgcttatagatctgcttatgcactgcattagcaactggatgcagactgcttgtataagctacgaattgcttttataaaaaataaaaaactaggatggtcatgcaacccaccaacaattggtcgagatggacaaataaaaaacaaaggcaaatcgctcttgcaagtgcaaatttttaaacggaggcaactaaaatctactcctatatttcaattaagactctgttcttccctcttctttctcaactcatatctctctcttttctttttttttgttacgtacgcttttcaaactgataaacaatacgatttttttgcaaagttttctatagaaaagttgcttccgaaaatcatattaatctatttttcaagtttttaggctacacttaattaatcacgtgttaataagcaacaccgttttctatgggagtacttttcaggtcactcatgttccagctgattggcgctgcatgtgtccgcacagtaggcaccttgtttctataattaataatttggagtgatctgatcctgaggaatagatctaccactctcatccaacagatcagcaggttcatcagttattttattattattattattaaacttattttttagatcttaacttgtgccgttagtccaggacaatccagtgctccatccatccatccatgtgctatttcaaatctatttacaaataggcgagttatgtatgccatcttagcaaaacacaagtaaattcccaatcccgttggttattcttttcaaaaaatggattgttgttttttttcattatattttttttgaacaattaaaataaaactccctctaaaacatatgttgtttaaaacagttgaattgacctgcgcttagtagaatttgtgtgccaaaaacgacaattaatattcaccggaggaagtaactcgtctatgtaccaactaaagatattcacaaccatatttatgaaaatcaagctttaaatcccaataggtagacttaaggctttgttcgctactcttggttcccaactctcctatctcgttttccgtgcgcacgtttttcaaaccgttaaatggtgcgttttttaaaaaaattatatatgaaagttgtttaaaaaaatcatattgatctattttttaaaaaaaaatagctaatacttaattaatcacgcgctaatggaccactccatttttcgtgcgcattgtttgggttgggaaacagacctaacgaacgcagccacctacaaccccctaccacactttcggcatttccccggattaaaagagaagggcgaagcttagtaccaggatccaataaccctggtgtcctctatatgaaaccccttattacaagaaaagataaaatcatgagaattcacaagtagtgtatggtgagcacggttcaattcctcgtctacgcccccaaagagtttgttagtgcaaaagggttttctaaggctggcatttggttgc

SEQ ID NO: 60133 - DNA, 706 bp, Oryza sativa
ttaaaaaacataggataggagcgagaaacccatgagttgatcttaaaaatgaagtttaggtgagtttatttacttaatgtagaagaggtaactaggatatgtcaaacattacctgtgaatttttcgctagccccaacagaggacagtcgcggagatatcatgcgagactgataggcacggctctccaccagcccaaacaatagagtgatcgctggaagatggtttgcaattttgcaaccattgcatgcatatgggcaaaaaattctgattccagctcagtggctatgtgaatcaagcagcgtccattatcttctctcattcaactaatagggtacaaaacttgggatggcagtccaccatcatattataattatatgatctacttcgtattctcaatctgccgagttccatcagttcacgcatcatcgacaccagtcatagggtcagcttccttgggctcctcatctccaccatcgttgccctcttcggccagggcatccttcatctgataatccaccttgaaatcgtagtctgcatccatgtcggtcagcacgctgaacttgtttgccttgcgcctcttcttctcggctttcctcttgcgaggatcaagtattccctctgctgtgtacagcttgtcattctgtgtgctcgcgctggccgtcttggctccttcacgctcatttgcatcggacatcgactcatcatg

SEQ ID NO: 60134 - DNA, 1937 bp, Oryza sativa
aactagtctgtcactcgcagctttatgaaagataagctatacgctggcaatccaaaagaaactactcggattattgatcgctacaataagtagcgttggatccgcggaatacacgcgtaacacgaataagaatcccgtgttattatcctgtcttgtgcaattgttactattattgaaagttgtttatgacagtcggcaccagctgctggccagtagccagttcgtccattgtgacttttgcaccattataaatatcaactgtaaaacatagtggtcagtcatcactacgatgatgagatttagtttggttggttttgctgaaacattctctatgcgatcaccgtaaaaagactactccgtattaatctatatccgcagtcatggtctcatggaccatgaagtccactttaatagcgagttggtttgcagcggacatcaattctactaatcagtttccctaaaaaaaaatctactaatgagtttgctttatctgatatgcttacgtttgtcctatttttgtactaaccaccccttaaaattccgaatacgacaacataacaagcaagatcagcacccacaggttattacaataaaatactttttcaggaatgagatctagtggctctcttttgcctttagtcttgtcggccaaattcatcgattcgtgccgtaatcacgagataattccaggtggtcttaatcagaatggtttagttagttccttaacgcgggtcttacgcgccaatcccgacaggtgcagggtccatagctccatcaaaccacataattcctatatgacctgtggcatgtttatcagcagaaaacgtggcttctctttccttgccgttcccatcacaggacgaaaaagtgtacctctggcaagtcgatctcaaaagtacagatggctcaggtgagcccattctggtggccacggctgtgttttaaggtctgttagggaagcttccggctactgcaatttctcttaaaatcagaagctccctaaataatctagcttttggtatagttctgacaagctgtggttatagaatctaaaaaataaactaaaaaccagaagctgaaaaagctttttctagattctcgaaagttggctaccaaacagccgcttgttagaattttaagttcccaaaacatgcccttaatgtggttcaaactgagaataatgaagacaagcttcctcttattcttcttctcttttttttgcaggtgaataaaacatatttgcatacttaactggcatatggctggtttacagcctgcacattgcacaaaataaaatttttaaaaggttataatcgtacccaaaattgtatacataactaaaaggattccattaaccacctgcccatgcacattgcgaagaattccattttaaaaaatcttaccagagaaaaaaatcatgcagcagcaaaagaaacagttgggagtgaattttaagtgtaaacacgatatcagcttcaactcattttgagtaaagacgtgggaatttaagacagtaaactgaataaaattaatgctgatatgaaggacttattagttgagctacctctggtaagccattgaaatgtgaaaacaaacaacaataatttatgagtaaagtaaagcttttatatttgtattactcatggtttaaaaatcaaagtttaaaaatatactacgataaaaaaaaacctaaaattagctataaaatcaagttttaaaatttggctacagccagcaaacagacgatcctatgatctacgttcctgtcacaccactaatcacaatatttatccaaagatgagaaatgacccgcatcgacaggaccctttttttcaacttatcgattctagtaccctatcataaaagggatgtctccaaatcctattcagcccaaccaatctaatccgtacatcaaattatttgcttcaagcatgttt

SEQ ID NO: 60135 - DNA, 6412 bp, Oryza sativa
atatgatagcgggtatttcaaggaatggcttcaggttcttttgcataaagctaattttataattcttttcacaagcctaaaacctagcatagactgatcaaattttagtaccagtgttcactttaaacaacgacggttctgtccaccatccattgtgatcccaaggatagcttcccgccattgaatcgtcatggttttctgaggatgtccaccttccctcctctcgggatgtggctccatcagcataaaattcatcatgcaatatcccatcccccacaagttaagaatttaaagtctagccaagtgtaatacatgtcccggtgctcaataaccgcgagcacggctattcgaatagatttggtttactcacactgcagtggatgtacactttacccgtactccgcaacttgcccaacacatgagcctacgtcccaacgaatgagacttgccacggcaaagcctttcaataacctcactttggcagtatccgctccatgaacttaagccctcatgcactctaggcgtacacggtttctagcagtgagaggagttctggcgctcccgagggggaaaactcacgcaagcctaacatcgcattctgtagttgaacccaatccatgctgtccccttttgggtatctccttgtagtcttgtagtcttgccaagtcagtctctagccatccgtatcgggtatccgccatttggccatccgtatcgggtatccgccagcagactgcttgttcgtccacacacctaagtgaaaccactatgcagggatactgcctccgctcggctatctactccgctaggtctatacccattcgagaagtacggctgtactgaggtcgtttcatgtttaacttcatggctcggtccttaactgaccagggacggcactagcctttaccggacaccacccaagtccttcagccgccccagtcgaaaacatttgtttaattttatttctcctttcacaaatcatgtcatcaacatcatggcaatgtggtgctcatgtctccacatgccgcatctcaattaccttcccaaaggtaattgcccaagcatatagcatttgataaatatgagtatgcatgattctagaatagcatttctaagcaattgtcataattgactagggactcatacgtagacatggttacaaagatttaagggtaaacaataatcaaggcatggcataatcccaagtaggatattcatcattgcatgcaattttatttataaacaaaataatttcgcaattgggatcaacatgttcaaggaatagtgatgacttgccttgctcaggataatccttattattgctataatcttgatcaaccttcacctcttggaagttgcagacgttgcctcacgactaaccgatacacaaggtctataatacgcgagaaaaaccagtattcaaacaacaatcaaatatgcgcgacaaaatgtactattcgtgtttgctaatggattccaatcacgctaggggctaaggtttcttaatctttctattatcaacgtggcctatttaggagttaaccaacatagcatttatgggatacatatatatttggctaatcggtggtttagtctatcaaatggcttatggaaggattatggctaagcatgcatctatctaaataggacgtttatatactagaggttctgttgttagatggatttatgatcaatcaaataatgaatcatgtgtattattatttaattgatggaggctttactttaattatgaacatatttcacttgtcacaataaaaaggataataattatccatgctttgtatgttagagttgtttaggttaatcatattatggttacagattatcccttaataaacaatcctaatttacatttgaactataattataatcatatgaggtcaagatttatactagtatttatctaatatacatgtttgtcatacactccctctaattaatatatgtaacatgcaaattaatactataccgtacaactataatgggacgtatagtatatgtgtaagcaacaatgtcttattattggatcatatatttgagtagttgctttttactataagctatacaatacatgttgattttaagatggctctgtttgtttaaataatggatatcaactgactatatattctacttcacatgacattgtatcaactaatttttaagtggtccaaatacaactagctctgtgattactctcctaaacaagttaaagattcatctaggtgtgtttatatttttgtcacgaaatatgaggctaaacattatttatatactttggacgcatgcgtataattatatagggacatatattaataaatggcactagcatttcctatgctttaattaatttgaaacaatgcttctaattagtttacatgggttttacagtgagaaagcatgttaaagacaattatttgacatctactttacagtatattttcaattttatttattagcacatttttaagttaactattatgcatcatcttgatattaattaacttttaattataaacatattttattaaatagtgaactatataccattggaaagcttatgaatttatatgaatttaggttcaagtttcactcaaatccgagttaaaatgaataagttatgctagtgtaaatattcaaatttgaataattgcgaaacagtactgttcatagcggatttattttaatccggaacctatccacagctcagagtcactgacgggtggggtcaggggttttattatcttttctaccgaattatttttgttagagaaaaatagggagtgggcccggcttgtcagtggctcggctgctctctttctctctctcgttcttttcccatcgtcttctacctccagccatcgggaggcagcaccagggcacggctgggcgcgacgggcacgggccggggcggcacggcggcggccaggggatgtgcggaggagctcaggcggccctccaccggcggcggcggcgcaaggcggagtaggggcgagcgttgcggcacggcaacgtcatgaccgagcttggctgcaagcagctatggtgaacggaatggtttgcgaccaaattggtgagggcgtgagcatctatggcgcatgagggttccgtttttccagaaaaatcgaagggagaaccccccggatggcatgtccacggtgacctccacgggcggagcttcgtagctcgggcttgtcacaattatggccctaatcgatgaaatagttgggggaggtagttcctagaggaataggaggagtaacaggagtgaggacttaccgagggacggcggaatgacgaagttccgcggcggtggtggagccgggaagaagctgcggcacgcccacaaggtgttcgacgaaatgtgtagtagggagaagaaaaggcagagaggggcggacgagctcgtgggggctaggaggtcttttataggtgggtgaggggcttgtgctggaagctaagacggataagctcgccagctcatggccagccgggctagatgctgggctagaggcggttatggcataggcgcacatggcatggcgcggggcgcagggatgggacggcgcgcggcgacggacgtggcacggggctcggcgtggtgcgacgcgacggacgacggcgcagcagcggcacacggcttgccggcgcggggcgcgaggcgcgacgagacggcgcgcgacgcggcagcgaagctgatgcgacggcgcgcggcgcggcgatgatgtcgatgcgacggcgacgacgacggcacgcgcggaggagtggggctcgagaggatgcgaccgtcgacggcgacggcgcgcggcgggatggagacggcgcggcgacggcgacatgacgcggcagggcgacggcggtgacaagacggcgcgcggcggcgcggggcgcaaggcagcggcgcagcagagggcggcagcggcgcggcgcgcgcaggggcggcgcggggctcgagggggagcgcggcagaggagcggtggtggctagggaaccaaatcaaacacctagagggctaatgaacagtgttagccaactatttttgattttatagggtattttgcaattaggaaaaatatactattgccactaattttgtcacaatgtaaaatacaccaagcctaagttaatccatcgaaatttgtattcaaatttaatattgaacatatttttatttttattatatattttctaagtattcctatttttagggctttggtttatttataaattgagaaaagttgcaaattaaatttgtattttactcctcagcagttgagtgaccatattaagtgctcaaatgtgaatttccccaaaatttaatattgtccaatttttaaatatatatcctagatttttataatttcctatatttgggattttggtatttatctgttttcacacatattggtttatctttttggattggttttaccaccacatggatttctataatttagcatttgtgattcaattcaaattatataatatctaattattttttcccagtaaaactattctatagatagagttccatttatttgaatgattatcatttcctaagtgtttatatttcatggcacacatcacatggttcaagtatttaatatttgatccataaattaaattggtaattaaccttccctttgtctggctttgttttctcgtgcgtaaatatttatagagttcataataaatatcttatttttataattgttactcagttgtatagctttagcttaattttcagtggtgacaatttatagtttggcaagcaatagcaaccataagatccagcatgatgcaaaagttttaaaaagttcaaaattttagtgatttttttattgtcttgaattttcaggatgttacagaaggcatatatggttctttttagcataaagcaagttttatttgcataaaacactttcaaatcagatttgttttcaaataaatttcagcaagctagtacttagcatatgggcatcaaaagtaggcattaatcatccatgacagcaaggagatcattctcaaatctcatcacaatttgaaggtaaattttagcatttagaagaataaatacaagtctatactcaatatatatccacacgtcgctcatgaccgcgagcacgactaacactttacccacatgatgcgaaataataatcatgcaagagcatggcacgcgatacataagtacccgatttattactcacaacaaatcttttccaaaattcatgatttagccttacaccagcacgatacgtgtctctccatcctaagccatacacgttatataaccaagaaccgttaagtggcaggcccacgccttaaacttaacgccgtggtggcggacacaacgggaacccaccatgtggcacaatacagttgtattggacacgcttagtcacctaaactaccacatcggggtaaacaggaagctcctctgaattatacgaactcatacacaccagcctaccagaatataaggctaaaccataaataatttactaagcttgggctatcccatactagcacatgtggttgtactgtatatgtatacgaaatgaactgacattgagtgaagtccttaggtcggtttggacacactctccccctacactacaacaaaacatgtatttaaagacatctcatttgggtcctagagacgttttaaaccatccttagacgtatgtagagtcgtttcttaaaagcgtccatccttagacgtatgtagagtcgtttcttaaaagcgtcccagaagcgtctttgttgggaccgtctcagaattgtagagatgctttgtaaagcatctcaaacatatttgagacaccaaaatagcatctctacattcgttgggacgtttttatggatgtgatcaataacgtctctacagctattaaagcgtctcatgatgcgttgttaagaataattaatacgtattatatagtcgcatatctatatattgtaggatatcaggcttgagaaattcacaccatttacatccgatcaaacatcatactactataatatcgccatcaacagaacaatgccacaaaacaggaacacagtacaatccaatcgatgaaaggtaattatattaagagcaactgtgatcaacatgtcaggtaaacatacatacagaaaatgagatttgaatcatctccaaaaagaaattataactgttcataagctaatactatagctttagctcctcccatcttcatgatgtagcattcctatacaatccatttgcattgccctgcaaaatatattgtttgtgaaccaaatcagtagttattatgacccacaaaaaatgtatgaaagctagcccaaagaattagaaaacccatatatgtattgtttcatatcagatacacctgttcttgggatcgtt

SEQ ID NO: 60136 - DNA, 36767 bp, Oryza sativa
cacgatttggcgctgaaaaaagggtcacttttgaaataagttttggcggacggttcatttgtaaaattagtttttgcaaaggttcacattgtcaaaattaatggtcgcacttctttctttctctccgttgctcgccttctttctacatgaaaggttttcattttcctccggttgactcaggcagtcaccatgaaaaggcattttctttcataccttttcattttattttgagtaaatttcacaaaattagatatactttcatcaaactatcacaatactacaggtttaaggcaatatatctcaaaactataaattaacactaaaattaccacaaaactataaatttaaggccaagtatcacaaaactacagatttagtaacaaaattatcccaaaactaaaagtttagtaccaattcaatcgcaaaattgtaatgcttatacctccaacgtaatagtagtgctagagatctaaacttgtcgacgttttagcacgactacgatatttgcatggtatgaagatcgttggtacaaaggcatatgccagattgaggtaaaagaaacagtgacaaagatttttatacaggttcaggcctcttattcatcagaatcaggttatagctctactcatgttggccgaagccggtgttgctcttattcatcagaatcacaaaagtacaatatttgagataatctatctagctatcgtcgatatggcggcatgaacaccaacacatagtcgatgatagggtagtcttcctcctcaaatatgaactcagcgagatcagagatagcgctagatccctcttgtcggcctctacatgcactagattgggtatgtctaagctgatatctgatgtcgatgtttggcggcgtgtattagtgtctattctgactgttccgtggcccctctcctcctatggggtcttgtatttatacccatagatgtccccttttgtctaagtaaaactagggagacacgtatggatacaattagagtagtcattatagtttccatgtagaactctacttgttcttctttatccgaaactccttctgtatacaaggtatgattccgtataagatttggaatatggtgggccccgccgaacttaatcgattactattggatatgtgttatccataaccctgacaaaacttgataatttgcagttttgtgatacttagtttcaaatctgtagttttgtgatataacgccttgaatctgtagctttttgatagtttgattaaaattctgtagttttttaaaatttactcttttatttttataccatatttcaaattattaaaacttaacaaattcaagtaaagtttgacactaaatttgaaattttcaattcaaaacctgaaactttcaactcaaatttaaaacttccaactcaaaatttgaaaactttcgactcaaagtttgaaaactttaaagtcaaaataaaatatttcaactcattttttaaaactttcgacctaaagttaaaatatgaaagctttaaatgtcaagttgaaagttttcaaatttgatttgaaacttctaaatttttaattaaagtttcaaaaagtgggttgattttttttcaaaagttaagttgaaaagttttaaaatccatgttaaaattttcaaattctagtaaaaagtttactagattttttgaatttgaatttgttgatgaatattttaaaattaattttgttgatgaagttggcctacaatttgagcttgtggtcctagaggcccagtagatcagaggacgagagaagtgagcgcatgccacatgggagaaaattgaagatgcgtgaatgagaaaaatccatgtgggcctggaattatgcgccattttattctcctagcgcacctgcgctaattagacattccctcctcatctaaactaatcacaacatctcgcattttatttccccttctatttcatctaaactattttttgtttaatttttttgcgtatttctttatcttaatctagtcacaacctatactcattcaatttcacacctcatttttctaaaagtatttatgaagtgattattttgggacgtacaaagtactctctccgtccacgtcccataatataatttggagggatgtgacaaaatatagtacgacgagtttggacagattcgtctgttgacagaaaacacgaggcctgggagatctgtttaactccagtgcaggtccaaaactcgcattcggatgtgtgagcgtgccagttgatttgatcatgtaatcaacaagaaacaaagacaaagaaaccgtggttaaatccataaatgatagccgatcggctaagtgccgatgacatatcatttattttaggccgatgtcatatgtacatcgatcggtaagtattagtaagcaaatcagaactaaatctactcgatcggctgtagatattaatgatatataatcctcatatcgatatatacttaaatcaagtgattggaatagatcggtcaccttgccaagacagtataaatcacttagatcgaaacatatattaatagtgggattatatatattcatagcatagccgatcagatagatctagcatgtatcggctaatattccgataccactctatattaaaatattaaagcaagtaaaatataccaaacaaaagcctaatatacttaaatgcaacaagatcttaacataaagggcagatttaacatatcaatcaagcatataggataaaagtagttaaatcaggtaagatcggttgaaactccgatactaccctaatcggcaaccagaaagcaggctagagattgaagttctaagcacgacttaatagatcaaactgaactgatgcagcattaagtatgaagagaagaataatatctagacaatcaagccgctggatgtttcatagagtggtagatatatcacataatccaagttaacattgttatctaacctaatcggctgccttctattgacaggtgctagtcggttataggttagatgacgatattatcaaagattatgtgagatatatgataactcgacgaattatataaacaagattagagtatcataaagatggaagcactaatctcgagaacacaagtcgtcataacaagttttacctcttattgaagatcgaaaccgatgcagctcaacccgaaagcaagaactcgtcgaaataaaactaaatcaaaagggtggcgatgcgccgagattgtattgaacgtgtgttaataattacatagggttcggggtctatttatacccgagaattacaagatatgtccataccggacacgactattatctctaacaaactctaagataccgtaagtctttgcagcagacttttgtccacatttatctctaaggaatttacataaaatatcctaattaatagatacaattgcctttctcaggactctatccatgtacggcaatcatcttgaagcacatcaactcaatcccgattgtcggatacgagccatattgtcagaattggctgtatcacttaacccagtctgactcagacttagccgtagccgatccggactccagccgattcttactctgcctccgcgataacatcgtcgtactagattgtgtcacatccctctaaaatcccttatattatgggacggagggagtgcgatttttttttttgaaaatcttttcttcattagtaatctatataaagttttcaaaatcaacttaccaacttttgtcataatcaatttgtgttctagaataataatcagtttcagtttcatccgtcatccatcctaacaaagaattcatctaggagtacgacggagagagagtaggagttagcgtaagatatatctaggagtattttttatttcgaatatagaataacgatatacggtactataacagattagtatttgtttgatacgtaatgtagcatagttggcccgtaaaccaggactcggatctctttccgggcacccgaagaactccacgtccgatcaacttacgacgtgtttcgatccacggacatatagaccagccttccggccgctccgtccgttccccctcctctctctccgcccccacccccaaaaaaaaaaaaatccatctagtctctcaatctcgatcaccaaccatgggcgcgctcgtcgaggaagaacagccctttttgcccctcagccgcggcggcggcggcgcctctggtccgagagcagcaagggagcgcggacgctcacagacgagcgacccgtgcctggaatgctgcggcatgatcgtcgggattgccttatttggggtcctcttcggtgccttgggctggttggccatcaatcatcatgggggagtactacgtcccagcgatgccgcagtactccgtcgagatcgcctccgtctccggcctcgacccggcgacggacctccacgccggggcggcgctcgacccggtgttcaacctgaccgtcggcatcgcctcgaagggcgagtatcgcggggtgtgcatcgagccgcgcaccgccgtcaaggtgtcctactcgtacctcggcctcccgctggccgggggccgcgtgccggaggtgtgcgcggggccgaaggagccggccgagaagcggaccgtcgtcgcgcggggcgtcggggtgagcgtgccggggtacatgctggacagcctcgccgaggacatgaggagcggggaggcggtgttcgaggtcaagctgatcaagggagacggcgacaggtacagcaggacggtggcgacgtgctgggccagggtcggcggcggcttggacgataggtgcatctgaatacaaacttccaatcgcgaaaaatcatcacggcttcgtagtgtcagtttatctgaggttttttttcttccttggatggaaattcatggaattttgtcggtcagcatatatgcatttcttttctttgatggattctaccaattggtttatacgtacataatattgtttacaaaatatgcatatgttggaattttcaaatgttgactaaatattatcctaagtgtcaaatatttatgacttaaccaaagaaaggaaaatatttgcatggtatgatcggtctaaaacattgttgatcgatcgagatatataccaaatacaatcggatctatggaagcaaaaagggtgaatagcttatcgaaacccaagtctatttctaatatcaattgcatacaaattgcaaattgcatgtatgtaaacaaaaactaagagttgtggtatattaaatctatttctattttaaaatttaactccacgtaaaattatacggaatattattatttagggattatgaaaaccaccccaaatatcacattgagtttgagattcctccctataggatgatttcaaataccgcccccctataagatgatttcaaatactttcttatttaccagtttgatatttctccccaattgttgttcatgcttttattttttcatctttctgaatgtgttatataatttaaaacatggccctagacacatattctttctcagcgacacaatatcgtatcatatgctcatctttatcgtcctgtatgtaccgaagaaccgtgtactttcagacctcatgaggcaagcacaatagctcatcttttatcgatctcgatgttcaggagcaaagactcatgaccaacattgcccaacgacgtgctaagctccatgaggaaggttgccacggtcatgtcaatattcatataatcgcctgtggggtttgtggccacaagaattagtgagcaacgataatcggagaaatctcaaaacaaactgaatagaggggatatttgcaacaaatcttcttatgtttataggaggagttttaaactcaggtaggcatttagggtagccttttcaattcttttcttgttttaaggaaaattttaaaatccaaaaggaagagagatgatcatatctctaccatatagttcaacaaatagtttcactcatcactcattctttcatctccactatagtacgttcaacaaatggtttcactatcactcattctttcatctaccctatagttcaacaaatggtttcactcttcacccattctttcattcctcattgaacaaatggtttcacttatcactcattctttcattcctcatggaacgatctagatcatctctctaagatccaacgtccctatagttcaacaatggtttcgcttatcacccattctttcattcctcatggaacggttcaactgattcctctcatcttgcgcgtgcatgcccctcccacctgtgcgcataccgccgatctctcctaaaatcatgcactcatggtgatttcagaaaagaaaaaaaaatcatgcactgactatactgtgctaccccccctcaacccccaatctggtgttcatcaagcccgctgcctaagggagccatcgtttcgcttattcgtggaataagcgaaacaacatatttgcaaacgaaaagtaatttgtgaataaaacttttatatacgtgtttttagcgatctaaaagcaaaggttgaaaaataaacttggatgaaaaaaacctcaaaatcaactccaaatttaaggttgaaaattcaaattttggctgataagcataagcgaaaagatgagactgtacgtcagcgtgtcctatgcctaccaagaccccccgctggtcaccgggctggtgccggacttctgcatcgggccgcgggaatcgcggggcgagcttgccgtcgcacgggtgccaatgtgagcgcgctagggtactggctgccaagcctcgccgatagcatgagggcagtagcaatgcgtcacgcctcattgaggaaccaaaatgtccatgttggaaaaaaagcagtcgaagctcacctcagctcccctctccacattgcacttgagctttaggtaggtccaccaccttttcttttcaggccggccccaccaccttttcttctccttccccctctctctcttcctaaagctgacgacgctgacacaaagcggatgaagaacacgtgtctcagtttggtcacacgttcttggtttagtcacgtgaaatgcacacgtggctgagaatctcctatgtgtaagcttgaggctgaatgccacatcactacactgtgaaagcccttaggagcgctcaagtgatgtttgacgtcaatctgcagaagcggaacaggtgggatgagtgcaggacgagagtcggcgagaaggcttcatgccatttagattttgccgaatagttattaggagacattataattccttctgttaatatgtgatacatttattataagaaaatattatgttttcgtttcgttttttaagtgatgtttgacacatttattttgttcaaagattatgtacaaatgcataagatataaattatacataaaatatttttatgataaaacaactcataacaaaataaatgatagtttcgtaaattttttaaataagataaatggtcaaacgtgtatctaaaattcaaaaatgtcatctattaaaatacctaggtaacactaatggtattttctctcattaaatcacaacattctagttatttctaacatttggatgattcacctatatgatgcatatcatgttaatatttttaagagtggctatatttatgatgttatattttgcactaaaagacaatcaaattttcggatatcgaagtttaaactctcccgtatatccacggtggatagaacaaatcaatcgattcaggcgcataaatacataccagacacccgctctgtttggcaagataagattaaaactctaaagtagattccaaagcacaacgtgtgctgagaaagcgatgtccgccgtgatcgcgccgccggcagagcatgagctgcctgtccattgggccgtcgctgagccggacaacactcaacgccgaggtgtactaggaggtgtaagattgcgtatagacaccgtatgcctcgtcatggtttgcatgatcctcatagcagtagccttcttggctatgatgattgttgccatcgtcaaagactggacgcaaccggcctcctactccgtcgcgatcgattccgtcgccggcctcgacccggagacggacctgccccgcgacacgctcaacccggagttcaacctcacgctccgcctcgcgtcgcaacgtgccgacatgggggtctgcttcgaggccggcaccaccgtggcggtgtactacggaggagtcctgctcgccggcgccgccgtgccggcgctctgcgcggggccgcggccgtcggccgaggaggagagcgtcgtcgcgtgggggagaggggtgcccgtgccacgcctggctcgggaccgcctcgccggggacctgcggggcggcggcgcggcggagttcgacgtcacgctcacggtccaaaggtacacctacgccgagtcgtgggatgtcgtgttgtgcagcggtaaggtaggggatgccgccgcgttgataactccgtgcagcctgtacgacgaaaatgtgcaggagccgtcgctggaaccgggttacggcgggtattcttcgcagccggagtcaccaccagagaccggcgatgacggttaaggtgaaggttttgctttgtgatctgtgagccatctgaattttcagatgttgcaaatattgggtttttgttgttgcaatcggtgtgttgcattcaattgaaacatctttgataaagcggctaaatgttctttagtgaaagatgaaacatcaagaaacaatttatgttgaaatatttttttcgagcaatggaacattacgcgcaacattgtccggagacgtctgatgcataggtctatccaaaaagaagcagtcggatgcggacgtttagtcgtcaactcctaacaagaaccggtttcgaaaaaagtgccccaagcacgcacgtcgacatggccgatcaaactatattaatcggagtcgtgcactcccaatcccaactccacaccccatcgtccgtgaggccggcatccccctcccggccacgccacgccaccgtccaagccactaagccagttcatacatacgaaacaggtagcgccgcgtcgtcgacgacgacgatgcccgcggacttcggggcagaccaagatcggattcgacgtctcctccgctgtttcagtggcatcgcaatagcggtgttggtcgtagtggccgtgctcgtcttgtgcgcattggaggcctccaaggccccgcggctgtccgtcgcggtcgccatcgtctcgggcctcgacccggcgacggacctcgcccggccagcggtggacccgcagttcaacctcaccctccgcgtcgcctcgcggagcctcctgagccgcgcgtgcgtcggggtgagcagcacggccgtggccgtgtcgtaccacggcgtccggctcgccagcgcgcccgttgcgccgcgcgtctgcgcggcgcggaggaagtcggcggacgcggggccgttcgtggcgtggggctcctcggtgcgcctgccggggttcgcgcgggacagcctcgccgcggacatgaggaacggcgcggcggcgttcgacgtcgcgctcatggacgggcacctggtggtgtgcaggggcaggcgggtcggggacgcggacgccttgcaggctccgtgcgtcttgacccacgtggaaacgggtgcggcggtgccgcacacgggaacgtaaagaggctcgccgtaagagtatatctttgctcggccggccgtgatcatcttggcacagttttttcttagcccagatcttagcgcaattgtcttagtatttcgaactgatgcgatttttgggttacttttgtatttcctgcaagattattagtccaaattcaggttattttcttattctttaataatgtaaaatcctaaaccaaaatttctatacacacatcctttacttgtaagaaactcaaatggttatgaacaaattatacattttgactaacctagcctatgatgatttaagtcaatatataaatgtgtggtttcttcatctatatataccgttaaatttaaattttgacgtacatgcttatgaaagaatccttatattatcataatctaccgtagcaacttctattaaatgttcccctcaaaaatatttctattaaatttatctataacacgagcacgtacgtatgtgtgcaacatactctctccatctaacaaaactagcctagtattaggatgggacacatcctagctagtaaatctggacttatattttatattagtgaggttgtctttagttccacgcctaaattggaagtttaattaaaattggaagtttgaagaaaaaagttagaagtttatgtgtgtaggaaaattttgatgtgatgaaaaaattggaagtttgaagaaaaagttgggaactaaactcagcctgatacttactcctcctgtcaaaaaaaataacctagtacattttctattgtaaatttgatacctcttaatacttagatattatatagtattaaattttacattaaattaaatttaatacctcattatacctcaataataacagtaaaattgctcattatataaacaacagtttcttaaccactccctccatccggtcttaggaaacgtaacgtcggtgcgacaccagttactataccttcgttgaaaccaaacgctatattaggtaaaaaagaatacattaacatatataatttccgggatatggaaggctcaaactacgggaactatccgtgtgtattcgatttcagactgcaacatataccatttttaaggcttcagaagctaccaatatgtcagatcaacgtgtataaaaacccaggccgccgtacccctgctttatccatcaaaaacgcgaggacgaagcgaatcgaatacaaacagaggctaaaaatcaacgtacaacaatgctgcgcgcggcgccgatccaagtgcagccggcagagccagggccacctcctcgtcgctgcagcgcctgcgtggctgtctttatcacattcgtcatattgtccgggttgttgttcgtgttagtgctctcagccgctctatttggtgagcagaagtactacgtcgccatagacaccgcctccggcctcgacccggcgacggatcttccctggccagtgctgacccctgagttcaacctcaccctccgcgtcacgtcgtggagcgtcgttggagccgcgtgcctggatcccgccatggacgtggcggtggcctaccggggcctcgccctcgcgcgcgcgtcgccgccgccgcgtgtctgcgcgcgggggtggggccggacggagcaggtgccggtcgtcgcctcgtcggggaacggagtgcgcctgcccggtttcgcgctgcacggcctcgaggcggacgcgtggggcggggctgtggcgttcgacgtcgcgctgactatgccgccgaagggcagagacaaccggcatcagctgtggtgcagagctgtgccggtcggcgatgacggcggcttggggatcccgtgcaatgcaaattcggagtactaaaggtattagcggtgcgaattaacttgtgtcaacagtgatgtgcgtgcatgcacgcgtgtgtctgtgcgaacataatactatgtgtctttgtgtttttctcccgtgatatagacttgattatcttggatggtgaaatactgtaacgttactacagggtataactatttatagatacatgtgccataatttaaaatagggtctaaacctcggacttgctggtgatccgggtctagcaaaacaacggcgtttgtctactatatcggcacacagatgaaacctctcgttgcttgttcatagactgcagatacacaaggaaaagctaagacaccattgccaactagatagcctataaccccatcaaaccaacaaactgggtgcatgtgacccagtctatgattggtgggagtcacttgcaacacgtcagagcgcacccaagcgtagtacttgatccataattctcctagtctcatgggaaatatgaaaggaacggaatcactgaattttccgaaataaggagttatccacggcggccctcattgtgaacataaaggaagagtcaaaatctcgggctttggcgggagccaaacacctaacggagatgttgccatagttccccaatcttttttttttgtaaatattaccttactccttacttaaatattacttccttctacataatgagtgagacatggggaaaaggctagcttctcctctctttctcaatcggttttgtgattaaaagtaattaataattaaaaatagttttattactctgattggtattcgggctaaaattctagaaccaaatctggctcgggtaaggtaacaggcttagtcgaaattaatactacaatattgtgatgtccgattgacgaatttgttttttttcttataactcaaggttaccgagattaggatccatccaaacctgcgacgcgtagtgatcatcaatgaactcgccggaagaacgaggcatgtcagcggcagcggctacggaggtggaagcgcacgcagcagacagccctcctcgccgtcgcctgtcgggtcgcaaccatggcgataactgcctgacggttttgttggtagtgctcctcttgctcatcgtcggcggggtagttttcttcgtagtcgattccaacacgagaccgcggtactccgtcgcgatcgacgccgtctccggcctcgacccggccgcgacgggtgatgacgggcggggtcccacgctggacccggtgttcgacctcaccgtcagcatctcgccgcggagccgggtaagaggcacggactgctacgagcccggcaccaccgtggaggtgaactaccacggcgtcctcctcgccagcgggcccgtcgagcagctgtgcgcccgggcgacgaagacggggcgggggcgcgccgtcgcgtggggcaccggcgtgcgcttgccggggttcgtcctggacgcgctcgtgtccgacgtgcggcgcggcggggtggaggccacagggttcgacgtcacggtgaagatcccgtccaccggcggtggcgaccgctccagcccggccgggatgctcgtgtcgtgcagggcgaggcgggccggggacgacgccgccgctgtgttgaggactccgtgcgacgcgctgagcgcgaacatcgtcgtgccattgccgaacacggggaggacgcagacgggcggtgccagttaacattgtgtgaataacggcgacgtcgtcgtagcacgctgcagcctgcacgcagccatcgctacaagtctacaactcacaggtcgcgagtcgcgaccagttaattcgacggaaagtctgtaccgtaccgtccggcaacgaagcagaggattcaagaaaagcgactaaacagactttcactgtatactatttatatgtttttttttgcttcacttttgttgaagctattgatcaatgaacatagtgttcattgcaggattatatttgtaaattttttaaacagaattactaaaacaaggccggaaagtattccttcttctacgggaacatgcatctatatgtgggcatgttcacttcttttgttgctgaatagtaaaatatgaattgtaataatcattcgagggcataaacgaatttaattaaatattataaagttaaaaaggatttaaaacagcattgtaacatattcatatgtagaatttttttttgccaaaatctcttcatttagaagctcgggaagcatgcacaattatccaacattctactgcacagagagaaagtactccaggtagttaggtacctcgagttaccaaaacctttgatacttaccgtaaaatttctccttttctaatttgtgttttcttttgatattgtatgttaaaatgttcttagaattttaactggcaaacttttaagggcttattcagttaataggttttcaaaatcgaaggaatacgaaaagcaaaagattagcaagttatacgtactccactccttaggatttttatcaaaagttctcaccccatgataagaatcgtatgaaatagggttataagattacaattcttagaaatttgataggatccaatcctataaaacaaatgatgcatatagaaaaaaaaaactaagattttaattactacaataatcttacgaaaattctttaaactaaatgagcccttaaggcgtggatctttcggtgcttgataatcaattttgctagctgatcctggctcagctcgtagctatgtctcataccggtggttcatgctagcagagttataatcttgatggataattttatcatccatgagaaggtatcaggaggtaccatattttgtaatgtaaaaaaaataaggacaattttaccatacttaaaaagctatctagtgttaaacttggtacttctaggtactaagtatctcaatatatcaaaaattttattgcaaaatttagatacctcaaggtacattctcaaatactataaaattcctcaaaacttaatactttcagataataggtactttgagatataaagtttttattgtaaaattttgatactatagatactttctcaaaaactctagaattcctaatgtcaattggccgatgagtttcaagccgcggcgagatgtcgatttttcgttagtttcatctcttttggtaaatttctaactagtaaaattcaacgagttttgagccggctcgatatgctcgaaattcactaaattcatcgattgtgaatccgggcaccaatttgctccagcgggaagaaggaaagagaggagaagaaagaggagggaagtagggaacggaggaatacatattcggatccgacttgtactgggagacctagctagcttcggagtctccagttgtttccaaacaagagtcgacggaactccaaaaaaaactggcccgccttgctgatcgtgaacacaaaaatccctcgacatcgcccctggtcttcaagccaaaagcagcgacgcgatttgaagttatcgacgaagtccgctctagaaggaagagatgccaagggagcgagcgatgcagatggaagcgtcgccggaagaacttccctggggctgctgcgtctgcgcgtgcgtactcatccccgccgtcgtgctgttcgctggcttgatcttcttcgcaatcgacgacaatgacgcgctgtactccgccgctgtcgacgccgtctccggcctcgaccccgtttcggagcttggccgggatcccacgctggacccgactttcgacctcaccgtccgcatcaggtcgcggagctggttgcgcggggacgagtgcctcgagcctggcactgccgtggaggtgacctaccgcggcgtcctgctcgccagcgggcccgtcgagaagttctgctcgggagggaagaaggcgaaggaccagcacgtcgtggcgtggggcaccggggtgcgcttgccggggttcgctctggacgcgctggtggcggacgcgcggcgcggggcggaggcgttcgacgtcgcggtgaagatgccgtccaaacacaggggtcacgtgacggtcgacgggacgctgatatcgtgcaaggcgaggcgggtcggggacgccgccgcgctggggacgccgtgcgacgtgtccagtatggacatccccgtgccatccccgaacacggggaggacgcagaagactggcggtgccaattagcacgtgtatgaataacgtcgctctcggcttgtggtagtagctacagtacacatccgtctgctgtgcggagtttcatgttaagtttagagttggggctcttttttctttgtttaatctgtttcttttggaagagattggcagttgatcaattgatggcctcaatgtgtttttccgatatagaagatgcatacgtgcccacgccaatatacacataaacttatcacatatgcaacagcaaataagtcccttgcgcacgttataggggcaaagactagcggaaaattccagtcttaataaaatcctactcacccgttccatattactttttcctattaactcaaattttaccaaaattatttaaaaaaaatactcactccgttttaatacatgtcgcccttggctttttaatatacgtttaaccatttattttatttaaaaaattatgtagttattactccatccgttccaaaatataaaggattttggacggatggacactagtactacgaatctagactgtccaaaatctcatatattttgggatggagggagtatttatgttgttgtagcttgatttatcatttaagattcttgaagcacaacttatttttatgtttgtacaaacatcttcaacccaaaatataaatactaacaaaatgtagttaattgtagatttaataaagctattttaatattgtagatattgttacctttcttctaaaagggagtattaataaatatccgtatatgtgtaatatttgcagacatcgaaattttgatagaatcatgtactagctacttcacgaagatatgattccaagaaacaaaggaagtccaaattataacagtaagaaaaacaatcccgtacgggcctgggaatttttttagaaaaaaaaaagaaagagatcgaccaactaagatgtctgttgaagcctctaagaattgcaatagttctataaggtgacaattttagaattgtttctctacaaatccaaaagatcatgcatacccttatttgttccatcctattaaccgacggtccttattcagaaagtagtagccggccgccgactcaattttatcatatattttctggacgtgactacacagctagtggtagctggtttgtctaaaccaactaccactctatatatgaaagacactatccacctataattttaatacaattttctcttaaactactcatccgatctacgatccgattataccgttgtgttcgtaacaattaaatctttataacaagatcccacatgattatattttgatgaaaaattataaattaattttataatatatataaattacttttagatttcactaaattacttcttagacatatgaaagtaaattcaataaagcctaaaagtaatttacatactccctctggttctatattaattgatgttttggacaagattgaggttaaacttttataactttgaccatcaataactttaaaaatatttagtttaaagaaactagaaaaacatatatatatatttgtctttcaaaacactataataaaagtaaacatgcatttatttattgtatatattataatagaaaaataaggtcaaagatatatcttgtagagcgtgtcattgtccaaagcgtcaattaaaatgaaaccggagggagtatattatagaaataacttataacaaaaagaaagtaactttattgaatgccttttttctcattggacatgactacacagctaaaaatgaaaggaaaaaaaacaatcgatgattaaacagatttatagagagttacttttgaaccatgcaaaagttacttccaattaacattgaagttaggtggtgtttggatccagggactaaactttagtccctaacatatcggatgaatttggagtattaaacatagactacttataaaactaattacataaatgagagttaaatcgtgtgacaaaatttttaagcctaattaatccataattagcgcatgtttactgtagcatcacataggctaatcatagattaattaggctcaatagattcgtcttgcgaattagtccaagattatggatgggttttattaatagtctacgtttaatatttataattagtgtccaaacatccgatgtgatagggatttaaaagttttagtgccatctaaacatggtcttacttttaaaaattgttaaacttacgtgtgttgatctgtgttgattaaattttatttctagataaagtcatatttttatccctacaacgaatttacttctaatgtcgtgacaaagttacttccgttttgttttaagttacttttataatatatgtaacttacttttagactctattaaatttacttttatatgactaagaagtaatttagtcaaatataaaagtaacttatatatatgataaaagtaacttacatatatagtaaaagtaatttataaatataaatattttttcatcgtaatataatcatgtgaaatcttgttgtgaagatttaattgtaacgaacacaatggtgtaatctgattgtagatcggataaataatttaagagaaaactttgtttggagaggaaaaggacatacatgtgctgtagtagacttctcaaaaaaaaaaaatgcatgcatgcagtacgctatagtagacttctccacacgttgaggcgtcgctggttaaggcaaaaacgagaggcctctccaaatagattttacgatattttctctaagccaaaataaaatgaattttagtagatgtgacacattttaatattatacgaatctagatagaaaactagtactagatggatcataaccaaccaaaatctcttatatttcaaacaaagaggatatatttgcaatgcgtgcgactacagaaataaattctaatccttcgagagtcatgtccctcgatcttacatattatctaaatggttataaaaaaatgtaagaaaacttggtaagatagccacacaaacatgcaagttctgccgaatgttattccattattaaaaaaaggtacagtgtaaatttgatctacataagttgtaacaaaaatagaaaatttaactcttaactactctacgtgtgttcatagtattcctttttttacaatttgtataagtcaattttacgtatagtgacatattacatactgtattaatttatcttatcaaattttatcactatttatatactcccttcatttcatattataagttgttttgaatgttttttattaaacatttttaagttcgactatatttataaaaagtataacaaaattactatcacaaaacaacaatttttttttaaaaaatatattcaatgcttcttttaatgaagctaatttggtattatagatgttgctaaatatttcaataaactttgtcaaatataaaagagttttactagaaaaaaaatcaaaatctctatctcttctctactattataaaattttaagatgattttaccggtactttggtaagtcattcgtgtatgagtcgggttttaatttcctttgcttttgcaaatacgtatccgtatttgatattacatattaaattatcttatcaaattttatcactatttatatactcccttcatttcatattataagttgttttgaatgttttttattaaactttttttaagtttgactatatttataaaaagtataacaaaatttctatcacaaaacaacaattttttttaaaaaatatattcaatgcttcttttaatgaagctaatttggtattatagatgttgctaaatatttcaataaactttgtcaaatataaaagagtttttgtcacgccccgaactagtcccgaccggaactagcccgtgacgctccaaattaacctgttaatcgataccagtcccaggaaacagtcctggtatcacaggaagacagaatatcacagcaacagaggtctctttattatagagtagaggtacagtcatgttaggctgcggacagatcccgagctcacaactgcattacaaaagggaagcggaagccaagactcggaccaaacaacacaggcgcgacttgggaactaggccgaaaccctaaaactcatcgtagccggcttgctcctagaagaactcgtcatcagagggatccgcttcatcttcttcagcaactgggggggattatttatatagaggaagggtgagtacgggagtactcagcaagccatgggaaataagtgtttaatgcagacttcaaggaaaggctgttgtttttgcaattgattttatttgatatcttttctgaaaacaactaagtgagtgcttgtcgcgtcccaaaacgactctaaaatacatcctcgaatttatgcctagaataattaaaatccgtgtgaaagcctccacaattaaaatgtgcaaagttaaaagtcaaataaggcttggaggatttttgtatatttcctaaaagcctaaaatgcgtaaataaattttagtggaattttcacagcacaaataataattattaagaaataaacaaagttaaaatgattttataaaaagaaaaaccctaaaaagttccctttccctccccctctctctcttgggccggtccggcccagctctctatccctccctctcctctccccgcggcccattcggcctcctccccgcgcgcgcgccgctgacgggcgggcccgcccgccactctcgctgacgggtggggcccacccgtcatccccttcctcccgccgctcccgccgccgccgcgaatcccgccgcccccgtctgccccgcgtgcaatcaagaggggggaaatattccccgtgattccctccctctttccccccatttttccctccctctctccctcggattcgtttggaaatctctcccctaacctcgccggcgccatcaatggcagccggatcttccgcgcccgtttcctcctcgtccggccgctctctctcactcccgaccctatataaacactccccgtgcctccctccaccgtttccgccactcgccgccctctctccccgtcggaatcgagctcgcgccatcgctctctctctctgccgtcaccgccgagctccggtccgccgccgtcgtcgccccggaccacctcccgcctcggcgtcgccaccttcggcttcaccgcatccccggcgacctcgtccacccctccgtttcattcgccgaccgccggaacgccgtcgaccccgtccacccgagccgcgccgccgtcttcctccgctccggtcgccgtttccgtcgtcgccgtcgacccggggtgagccgtggaccgccgcttcttttccccctccccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcggctgacgcgtggggcccacggcgccgcccggtgcgagcccgggtgcgcccggtccaccgtggaccgtgaggctgccgcgtgggccccactcccgtggacccggtccgcgcgcccctcccctcggctgacgcaataaatccatttttaaattaaattttaaatgaagaaattcgcaaatattcatttaaagagcatataaacttcaaatggccataacttggccatttgaactcggaattggaccgttcaagtctctaatttttccttaagaagtcaagaacctatttttgtgctttgttcctgcttgttatatggagtttattagagtgaaagccttttcttttccgttggtcgtgtagacgctgcagcttcggaagatccgctcttcgtggaagttgaagccggcgtttgggaaagcgagcaaggcaagtcacatcatccttgaacatattgaatcccagtttataaaattatgttgatttaaattattgcattatcgctttatttaaattcccgcgtaatcactgttttatttagccatgcctatttacctttgttatgaccttattattgttattgttattatttccttgttcaccctagaataaacaaaaccccaactagtggacactctactcatggtaccactagtatgattttaggtagatgcttcgctatttaattaggtaacattaggcggttttacaactctagactttgggatattcatatcacctggacactttggaattgttggagtattgtggaattggattcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggagattccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctggattggcttgggacgagctgggacccagggtcgggttgccagttcggtctgaatcatcgtaggccttgggttaagacaggttcgtgtgggttcgccgccttgataaataataatgtatagttctagaatcgtgtctacaaaatagctttgagcaactaaatatctttaaatgccgtttactgcaaccctaaccctttatattctaattcccttgtactcccttgcatttattctgcacttgtgggtgtgtcttgttgagtacggtggttgtactcagtcttgctcaatttttcccaaacccagaagaggagcctctggaagatgaaggctttagtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgatatactctgaaatgtatcaactcttggtgtaccttgcctcctgggacaaggaataatacacgcacgtaaggaacgcccgttgggttaattccggtcgtgacaagttggtatcagagccacccttgaccctaggacgagccgtagatcccaagccttagcaatattttcaaaaataaaaatcctgtcttatttgtgaaaatcctctagtctctctctgtcttgccgcttcatttatcgccaaaatctgatctttaaaatgttgcttttctttttgtttttgtttgtagatggccggcagcatcaaccgtcgtggtctggacctgactggctttgttttggagctgcggggcatgtgtgttgtcctggggtatccgcatggagtggactaccagggcaggcagctcccggagcaggagggtgacgatgcagagccccacgctgcttgggaggttactgcagtgatcctcactggctctcccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgcggaggagcccgcgaccacgccacctttcgggatgctagctcggaggatgacgctaccatcatgcatctggcgcgcatggtggaggcgtacgacgcggcccgtatcgacttccatcagatggtgcgccgtgggatggtcgagaacagcatgaagatcctggagctgcgtcaggagaatctgcagctgaagaaggacctagacgcagtggaggcgcagctgcatcagctcaagatcgcccagggagaggtctgtcgccccaagcgtcgccgcgtctgccgcagccagaagatcaccgcccgcaagagtacctccaggcccgagcttgttcgccagtccttggcatggacctgcttcgtcgagacccctcgtgccgagcccgcgcccgtggttcctcaggagggggaagcctcaggcgttggtagcacggaggatgcgctgttgctcaccttccgtcctggcccgtcgcagcggtagacgagcagttagtaggcttgcgcgtgtgttctttctcgtttgtcttcttgttggagccgtgtggggcatggttatgccggtgtgtggtataactgtgtcagagcctgtctttattttatttgcctaagcaacttgaactttaatgaaccaatttaatagcagtaataaattcaagaattatggtagtcgtgggtggttagctttaattgtcagctctctctgtttgctggatctgtgtggggttgtcagatggtgacgaccaggagaagtgctaacaccggtgatggcaaccaacctgaaggcagcaaccacaacaaccatggcagcccacctccacctcctcctccgcctccaccaccaccactagacaccaatgccatcctcacccaaatcctagcccagcaggccaacatgatggctgctttcctccaccacatccaaaatccgccacaacataatgctccaccaccacccccacaacactctaaactcgccgagttcctccgcatccgtccacctaccttctctagctccaataaccccgtggatgcattggattggttgcatgccgtggggaaaaagttagacaccgtgcagtgcagcgatgaggagaaagtcgtcttcgccgcccaccagctgcaggggcccgcatctctatggtgggaccatttccaggctacgcagccagaggggcagcctattacttgggcccgcttcaccgccgccttccggaggacccatgtgcccgccggagtcatggcccttaagaaaagggaattccgagagttgaagcaaggcaaccgctccgtgatggagtatttgcatgagtttaacaacctggcccggtacgccccggaggatgtacgggaagatgaggaaaagcaggagaagttcttggcaggaatggaccctgagctgtccgtgcgtctagtctccggtgactatccggatttccaacgtctggtggacaagagcatccgcttggaagccaagcacaaggaactggagtcgcacaagcgccgcttggcgaatttccgcaatcaacagggagctaactaaaggatccgctacaccaatccctatccagggggatcgtcctcgcagcagcaacagcagcaacaacctcgctccgcgccccgacctcaattcgtggtgcgcatcccacagccgcaacaacagcagagtcagcaagggacccgtgcgccccgtcctcctacgacagccgcgcagtctggtcaaggccgcagggacgttcaaggtccgcagcgtctgtgcttcaattgcttcgagcctgggcactttgcggataaatgcccaaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctccgctcatcaccacccctggaggggttatgacagcaaagtattatagccctgctgttcctatagaaattcagggaattccttttccttcggatctgattcttctagacaccaagaacttggatgtgatccttgggatgaattggttggctcaattccaaggagtagtggattgcgcgagacgcactgtcactctgtaccgagggccggaacaaccggttgttttctttgcacccccaacctctgtcagtagtttagaacttcatcagataggactgtcagaaatccccatcgtcaaagagttcggagacgtgtttccggaagaactacccggtatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcaatcagcttaaaggtgccacggtattctccaagattgatcttcgttccggatatcaccagttgcgcatccgtgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgttgtagttttcattgatgacattatggtatactcacaatcagaggaagaccatcagcaccatctccgtctggtgttgggaaagttgcgggaacatcaattgtatgccaaacttagcaagtgcgagttctggttgtccgaagtcaaattcttagggcacgtgatatctgctaaaggagttgctgtggaccccgaaacagtgaccgccgtcaccgattggaagcaacccaagacagtcactcaaattcgcagtttcttaggtttggctggatactaccggaggttcatcgagaacttctccaaaatcgctcgacccatgacacagttgttgaagaaagaagagaaatttgtgtggagcccgcaatgcgagaaggcgttccaaactctcaaagaaaagctggtttcctcgccagtgttagtcttaaccggatactcgcaaggacttcatggtgtattgtgacgcttcgcgccaaggattggggtgcgtgctcatgcaggaaggtcatgtggtggcctatgcctcacgccagctacggccccatgaaggcaattaccctacccatgatttggagttagccgctgtggttcatgctctaaagatctggcggcactacctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtagccgacgctctaagtcgaaaaagccattgcaacactcttgtcgtccgtggcattccacccgaacttaatcaacagatggaagccctgaatctaagcatagttagtcgtggattcttggctacgctggaagccaagccttccttgctcgatcaaatccgcgaggctcagaagaacgatccggacatgcgtggactcctcaagaatatgaaacagggtaaagccgctggtttcacagaggatgaacacggaaccctatggaacggaaatcgggtatgcgttccagatgtcagagaacttaaacagctgatacttcaggaagctcacgagagtccttattccatccaccctggcagcacgaagatgtacttagacttgaaagagaaatactggtgggttagtatgaagcgggaaattgcagagttcgtggccctttgtgacgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggaccgattaaccaaggtagctcggtttattcctgtgaaaaccacctatggagggaacaaactagccgagctctacttcgctaggatcgtgagtctccatggcgttcctaagaaaattgtatctgataggggaagccaattcacctctcacttttggaagaagctccaagaagagctgggtacccgattaaatttcagcaccgcgtatcacccgcagacagatggacagaccgagcgtctaaatcagatcctagaagatatgcttcgcgcatgtgtcctagatttcgggaagacctgggataagagtctcacctatgccgagttctcctacaataacagctatcaagccagcatacaaatggcaccctatgaagcgttgtatggacgcaaatgccggacaccgctattgtgggaccaagttggggaaagccaagtgttcgggactgatatcctgagagaagctgaagctaaagtcagaaccattcgggataatctaaaggtggcccagtctcggcagaagagttatgcagacaaccgacgccgtgacctggaattcgcagtggatgactttgtgtatcttcgggtcacgccattgcgaggtgtacacaggtttcagacgaaagggaagctcgcacctcggttcgtgggtcctttccgcatcattgctcgacgcggagaagttgcttaccagttggagctgcccgcctccttgggcaacgtgcatgatgtgttccatgtgtcgcaactcaagaaatgtcttcgagtgccatccgagcaggccgactcagagtaaattgaagttcgccaagacttgacctacgtggagaggccagtgaaaatcctggacaccatggagcgcaggaccaggaaccgggtaatccgtttttgcaaggtccaatggagcaaccacgccgaggaagaagctacctgggagcgtgaagacgagctgaaggcagcccatccggatctcttcgccagttcttccgaatctcggggtcgagattccgtttaaggggggtaggtttgtcgcgtcccaaaacgactctaaaatacatcctcgaatttatgcctagaataattaaaatccatgtgaaagcctccacaattaaaatgtgcaaagttaaaagtcaaataaggcttggaggatttttgtatatttcctaatagcctaaaatgcgtaaataaattttagtggaattttcagagcacaaataataattattaagaaataaacaaagttaaaatgattttataaaaggaaaaaccctaaaaagttccctttccctccccctctccctcttcggccggtccggcccagctctctatccctccctctcctctccccgcggcccattcggcctcctccccgcgcgcgcgccgctgacgggcgggcccgcccgccaccctcgctgacgggtggggcccacccgtcatccccttcctcccgccgctcccgccgccccgcccgcgccctagcgccgccgccgccgccgcgaatcccgccgcccccgtccaccccgcgtgcaatcaagaggggggaaatattccccgttattccctccctctttccccctatttttccctccctctctccctcggattcgtttggaaatctctcccctaacctcgccggcgccatcaatggcggccggatcttccgcgcccgtttcctcctcgtccggccgctctctctcactcccgaccctatataaacactccccgtgcctccctccaccgtttccgccactcgccgccctctctccccgtcggaatcgagctcgcgccatcgctctctctctccgccgtcaccgccgagcaccggtccgccgccgtcgtcgccccggaccacctcccgcctcggcgtcgccaccttcggcttcaccgcatccccggcgacctcgtccacccctccgtttcattcgccgaccgccggaacgccgtcgaccccgtccacccgagccgcgccgccgtcttcctccgctccggtcgccgtttccgtcgtcgccgtcgacccggggtgagccgtggaccgccgcttcttttccccctccccttcccctctctcggccgccgctccgccgtgcctatggccgccgccggcgaccataggggcgcgggcgcgccgcctcccgccgctgcgccggcgtggccgccttcgggcgcaccgtgcggctgccgcgtggggcccggctgtcagccgcccgcgccctcgggtgcggctgacgcgtggggcccacggcgccgcccggtgcgagcccgggtgcgcccggtccaccgtggaccgtgaggctgccgcgtgggccccactcccgtggacccggtccgcgcgcccctcccctcggctgacgcaataaatccatttttaaattaaattttaaatgaagaaattcgcaaatattcatttaaagagcatataaacttcaaatggccataacttggccatttgaactcggaattggaccattcaagtctctaatttttccttaagaagtcaagaacctatttttgtgctttgttcctgcttgttatatggagtttattagagtgaaagccttttcttttccgttggtcgtgtagacgctgcagcttcggaagatccgctcttcgtggaagttgaagccggcgtttgggaaagcgagcaaggcaagtcacaccatccttgaacatattgaatcccagtttataaaaatatgttgatttaaattattgcattatcgctttatttaaattcccgcgtaatcactgttttatttagccatgcctatttacctttgttatgaccttattattgttattgttattatttccttgttcaccctagaataaacaaaaccccaactagtggacattctactcatggtaccactagtatgattttaggtagatgcttcgctatttaattaggtaacattaggcggttttacaactctagactttgggatattcatatcacctggacactttggaattgttggagtattgtggaattggattcacacctccccctctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggagattccggccgtaggtgggattgggtcggtactcttgtctatggctaggatgggttggaaactatgtcacgtcttccgtctgtataccgtggtggtatgtggcacgtggttgcacgtgaggaagatgtgtcttgtgggtaaagatgtacacctctgatcagagtataacctattcgaatagccgcaccctcggttatgggcaagccgagcaatgtacccaagttagtgttttaattcttaaaacctgcttaacaactaaaatgtggaatggttggcctggattggcttgggacgagctgggacccagggtcgggttgccagttcggtctgaatcatcgtaggccttgggttaagacaggttcgtgtgggttcacggccttgataaataataatgtatagttctagaatcgtgtctacaaaatagctttgagcaactaaatgtctttaaatgccgtttactgcaaccctaaccctttatattataattcccttgtactcccttgcatttattctgcacttgtgggtgtgtcttgttgagtacgatggttgtactcagtcttgctcaatttttcccaaacccagaagaggagcctctggaagatgaaggctttggtgtctagctcgtgcctgccgtcaagcgcctgtggtcgtcgccctagtcttccgctgtttcccgtttgtctttgtgtgtgctgggccttcgtcgcccatgtaataaattaactatttacgcttccgcttgatatactctgaaatgtatcaactcttggtgtaccttgcctcctgggacaaggaataatacacgcacgtaaggaacgcccgttgggttaattccggtcgtgacaagttggtatcagagccacccttgaccctaggacgagccgtagatcccaagccttagcaatattttcaaaaataaaaatcctgtcttatttgtgaaaatcctctagtctctctctgtcttgccgcttcatttatcgccaaaatctgatctttaaaatgttgcttttctttttgtttttgtttgtagatggccggcagcatcaaccgtcgtggtctggacctgactggctttgttttggagctgcggggcatgtgtgttgtcctggggtatccgcatggagtggactaccagggcaggcagctcccggagcaggagggtgacgatgcagagccccacgctgcttgggaggttactgcagtgatcctcactggctctcccgagaggacttcgttggcagtcaccgcgggtggagattctttctccgccgcttgccagaacgccgctctcctcgccatcggcactcttcaccagcgctacccggacgagttgcagcactcgccctaccgctaccaccctcgccgcggaggagcccgcgaccacgccacctttcgggatgctagctcggaggatgacgctaccatcatgcatctggcgcgcatggtggaggcgtacgacgcggcccgtatcgacttccatcagatggtgcgccgtgggatggtcgagaacagcatgaagatcctggagctgcgtcaggagaatctgcagctgaagaaggacctagacgcagtggaggcgcagctgcatcagctcaagatcgcccagggagaggtctgtcgccccaagcgtcgccgcgtctgccgcagccagaagatcaccgcccgcaagagtacctccaggcccgagcttgttcgccagtccttggcatggacctgcttcgtcgagacccctcgtgccgagcccgcgcccgtggttcctcaggagggggaagcctcaggcgttggtagcacggaggatgcgctgttgctcaccttccgtcctggcccgtcgcagcggtagacgagcagttagtaggcttgcgcgtgtgttctttctcgtttgtcttcttgttggagccgtgtggggcatggttatgccggtgtgtggtataactgtgtcagagcctgtctttattttatttgcctaagcaacttgaactttaatgaaccaatttaatagcagtaataaattcaagaattatggtagtcgtgggtggttagctttaattgtcagctctctctgtttgctggatctgtgtggggttgtcagatggtgacgaccaggagaagtgctaacaccggtgatggcaaccaacctgaaggcagcaaccacaacaaccatggcagcccacctccacctcctcctccgcctccaccaccaccactagacaccaatgccatcctcacccaaatcctagcccagcaggccaacatgatggctgctttcctccaccacatccaaaatccgccacaacataatgctccaccaccacccccacaacactctaaactcgccgagttcctccgcatccgtccacctaccttctctagctccaataaccccgtggatgcattggattggttgcatgccgtggggaaaaagttagacaccgtgcagtgcagcgatgaggagaaagtcgtcttcgccgcccaccagctgcaggggcccgcatctctatggtgggaccatttccaggctacgcagccagaggggcagcctattacttgggcccgcttcaccgccgccttccggaggacccatgtgcccgccggagtcatggcccttaagaaaagggaattccgagagttgaagcaaggcaaccgctccgtgatggagtatttgcatgagtttaacaacctggcccggtacgccccggaggatgtacgggaagatgaggaaaagcaggagaagttcttggcaggaatggaccctgagctgtccgtgcgtctagtctccggtgactatccggatttccaacgtctggtggacaagagcatccgcttggaagccaagcacaaggaactggagtcgcacaagcgccgcttggcgaatttccgcaatcaacagggagctaactaaaggatccgctacaccaatccctatccagggggatcgtcctcgcagcagcaacagcagcaacaacctcgctccgcgccccgacctcaattcgtggtgcgcatcccacagccgcaacaacagcagagtcagcaagggacccgtgcgccccgtcctcctacgacagccgcgcagtctggtcaaggccgcagggacgttcaaggtccgcagcgtctgtgcttcaattgcttcgagcctgggcactttgcggataaatgcccaaagccgaggcgccagcaaggccaagcgcctccccgctccaacaacggtggtaaggatgtcattcggggtcgtgtgaaccacgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctccgctcatcaccacccctggaggggttatgacagcaaagtattatagccctgctgttcctatagaaattcagggaattccttttccttcggatctgattcttctagacaccaagaacttggatgtgatccttgggatgaattggttggctcaattccaaggagtagtggattgcgcgagacgcactgtcactctgtaccgagggccggaacaaccggttgttttctttgcacccccaacctctgtcagtagtttagaacttcatcagataggactgtcagaaatccccatcgtcaaagagttcggagacgtgtttccggaagaactacccggtatgccgcccaagcgagagattgagttccggatagatcttgctccaggaaccactcctctgtacaagcgaccctaccgtatggcagcaaatgaactggccgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccatcaaaaacaagtaccctcttccccggatcgatgatctgttcaatcagcttaaaggtgccacggtattctccaagattgatcttcgttccggatatcaccagttgcgcatccgtgaagaagatattccgaagaccgcattcaccacgcgatacggactgtatgaattcacggtgatgtcgttcggtttaaccaatgctcctgccttcttcatgaacttaatgaacaaagtgttcatggaatacttggataagtttgttgtagttttcattgatgacattatggtatactcacaatcagaggaagaccatcagcaccatctccgtctggtgttgggaaagttgcgggaacatcaattgtatgccaaacttagcaagtgcgagttctggttgtccgaagtcaaattcttagggcacgtgatatctgctaaaggagttgctgtggaccccgaaacagtgaccgccgtcaccgattggaagcaacccaagacagtcactcaaattcgcagtttcttaggtttggctggatactaccggaggttcatcgagaacttctccaaaatcgctcgacccatgacacagttgttgaagaaagaagagaaatttgtgtggagcccgcaatgcgagaaggcgttccaaactctcaaagaaaagctggtttcctcgccagtgttagtcttaaccggatactcgcaaggacttcatggtgtattgtgacgcttcgcgccaaggattggggtgcgtgctcatgcaggaaggtcatgtggtggcctatgcctcacgccagctacggccccatgaaggcaattaccctacccatgatttggagttagccgctgtggttcatgctctaaagatctggcggcactacctcattgggaatcgctgtgaaatatatactgatcataagagtttgaaatacatcttcacccagtcggatctgaatcttcggcagaggagatggttagaactcatcaaggattatgatgtgggaattcactatcatcctggtaaggccaacgtggtagccgacgctctaagtcgaaaaagccattgcaacactcttgtcgtccgtggcattccacccgaacttaatcaacagatggaagccctgaatctaagcatagttagtcgtggattcttggctacgctggaagccaagccttccttgctcgatcaaatccgcgaggctcagaagaacgatccggacatgcgtggactcctcaagaatatgaaacagggtaaagccgctggtttcacagaggatgaacacggaaccctatggaacggaaatcgggtatgcgttccagatgtcagagaacttaaacagctgatacttcaggaagctcacgagagtccttattccatccaccctggcagcacgaagatgtacttagacttgaaagagaaatactggtgggttagtatgaagcgggaaattgcagagttcgtggccctttgtgacgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggaccgattaaccaaggtagctcggtttattcctgtgaaaaccacctatggagggaacaaactag

SEQ ID NO: 60137 - DNA, 15955 bp, Oryza sativa
cattttttaataactagaatgctaactggattgccacgtgtacgccacgtagaccaaaaccactgcggattgggtcgagggggataatttgtccggtttatatagttggaggtgaagaatgcctggttttgtggttcagggaggtaattcagacgaccgcgatagttcaggggtaattcgtactttttcctttaatatataacaccgttaactttttttatatgtttatcattcgttttattaaaaaatttggtgtaaacgtataaaaatataaggaaatatttagtgacaaattaagtcataaaaataaaatgataattacatatttgttttgaaaaagagtaaattgcattactggtaaataaccttgtcaggtgcgtgcaatttagtgtatgaacttataaaatgcttattttggtgtatgaacttgtctattacgtgcaaactaaggctaaaatggctcgataaagaccaatttttctacgttgaacattataaattacaaattagtagatgacttgcatgtacatagtagaaatgttatatttgtaaacttagattccactttatctttctttgtttctgtcccttgcatcagtactcatatttttattttttttatgcaattattatgccttattatatgtttatccttcttatactaatgtttacatagagtttaaatcaacaacagaatcagcaagattaaccttgcagtgcgattttaaccttgttcgcacgcacctaacaagttcgtgcaccaaaacgagcgctttacaagttcatgtactagattgcacccacttgacaaatttgtgtaccgccgatgcaatttactctttaaaaaatggagagagtatgaagctcgtgtgagcaccttttgcaaagctgacctgcacattcggcaaaaggtcacagattgttttgtgtatttttttttacagaaaatctcattttgaagttcttataaaaatcacggtcttccccaatatccgaccttcgctcgtcgttaggatagagatcatgatggctcgatgcctatggtttgatccatataggtctagtgttcaccgattggatctatcgatctggtcttagttgattctattcaacaattaggtttgtgttcgtcgagggatgaaaccttacttgaatgtgttaccatgatgaatggaacttgagatttatggaagaaatctgttaatctaatcttccttgatccaatctggcatcgacgatgaagcgtacccttgttggggccatcttttagatactaatagataaactagcagttgcatctaagctgcacaaagccatgacactcttggtggatgcattggcatgaagacgtactaaaacttcacaccttctttctgtatattatagtcgagttcatatgtgtcctcgtagtagttccagttgcgagttttatgcttttatcattagcccagcattgatctgtttgttcatctttgtttggatttttatcattagtgatgttgtcaataccttctcttttttaaaatatgtagcttaagttcatgtcggcataatttacttactttttttaacaagtaaaacatccctaccattcatcaatctatccaaacaaatcaaccccctgcgctgcttctgtcttctgatccgatgctgtctgtccacgaccagatcaactcttttttttaccggtttccatcagagaactgtacttaaatactccagcacgagacctattactgccaaaatgtaacctatcacttggatccaaccaattttttttcttcagcttcccaaactttgcagttctgcagttgcagttccggattcagagaaagacaataaatagtactctctccattctaaaatactactataagagaaagacaataaatagtttacgccaaaattggaagcatgattgaaattggaacgatgtgacgtgaaagttaaaagtttatttacgtagaaaagttttgatgtgatggaaaagttgaagtttgaagaaaaagttggaaactaaaccaggcctatttaggttgtgttcgggaggaggggcacgcaaaacgatgttcgcattaacgcgtgattaattaagtatattaatattttttaaaaaaatagatcaatatgattttttaagcaacttttgtatagaaactttttgaaaaaaaaaacgcagcgtttagtagtttgaaaaacgtgcacagggaaaacgagggtggggagctaggaactccaaacaaagaacgcagccttatagaggtttttataggaattatttaacattcgagattaaatagcagaatattataattgattaagaatataaagtaattaaaatataaatggagatgtctatgattgatgggatgaagagataggtgaaaaaatagttatattttaaaataaacttaaactttaaaaataactacttcctacaatgtaactcattttattattttccacatttatattaatattaatgaatctagatatctatatatatatatatagatagatgtatatgagaaatgttagaatgaaacggagggagtacattataagatgatgtaagtgcacatgtactcctataataaaaaataactcaacctaaaagaagatgtgacatcttctagtgtaaagaatctgaacgaatagttgtccagattcatcatcctagaagtctgaggttttttttcttctgatggaaggagtagatttgtgccagtgtaggtgcaggtagtacagttctacatgtacacccattctgccactcagtcccacaaggagttaaaaaaggtgtccaacagacagcacacgtgagaggacatctcatcccaaaaagaaaagattcattcattcagtagtactactgcctttgcaaaacaggtgctcttttgtcagtaatttacacatgattaaattaggctatgatgcaccaagatgaccgtttgtttggacctaaacaagagggtttcccagttattataatcaacacagccattgcatgactgcatctgcaaagctaaaagctagtggtacaaagtgaagctcactagctagctcacaagtcagagaaatgtgttacttttggttgtagtaactgataagatgaaaagcaacagtatctgatcctccagttcagtgcaggtgcagcctacttctaaggccccgtttagttcacaaaataaaaatttttgggtgtcacatcggacgtttgaccggatgtcggaagggattttcggacacgaatgaaaaaactaatttcataactcgcatggaaaccgcgagacaaatcttttgagcctaattattccatcattagcatatgtgggttactgtagcacttatggctaatcatggactaattaggctcaaaagattcgtcacgcaatttccctcctaattgtgcaattagtttttgtttttatctatatttaatgctccatgcatgtgttcaaagattcgatgtgatgtttttggaaaaactttctggaaactaaatagggcctaagctttgcagggagttgcccaaacttcaatcaaaaggtcatgtcttgttcagattcatagtattaggttatgtcaaatttggtaatatgttgtaatattttggaaaatatagagtagtgactttgtatcgtatctaagccattatctgttaatcactagtgttatctccccaaaatgaacaatttaatatcaaaattcaagagaggaagagcttcaaaacagagaaaaaaaagtctagtttaatgacactgaccaacccattagattaccccctcaattacaaggccatatcaattacaacaacatggcaaggacagagattaaattaagggacattcaccaccatcaatgcctttgtccactgcagcaccagcaagaagcaatgcatcccaatgtgcgcctcctctgactccattagaaaccagaggcttccttcctactaccatcacttgatctgctcacaatcacaatgccatcatcctcatcaggacagccacacatgctgctacagctgcttgtgtccaccatgtccaccaaccctagcaagcacaagcacaagcaaaacaaaagggaacacctcagcaagtgaccaaaagggagcaaagctccagtgaggaaacaacaacagacagatcatatgccactgaaaattcttcttcccttgcatgattgcaggttatgcatagatagatcgtaataggggacgacaatcgtgcccgattgcccgtttaccgcctagtaacaatcttattactctattagggtcgggcatgttcctattcttttttataattgctacttcattgcctgattggtttatgcttatgctagcaagaatagggagaatcatgttgatggtgatgcaacatgtcacatctaatctatttcagcttgagcccaaactttatacattgatcattgtgtatgtactaatgttgattagccattcttgctttgaatgctttaattgcataaaaatttgtgattgtgacatcaagttgttgttggatcagacagtagtcttaacctgcatcatgctcctttatgccttgacattccttgtgtttgcaaaagcaccaagcatgataaatacaacacttttcagattatcctaaacatttttttcagcatttgattacactgaacaagctagtcgttatcatctaatccaagaattaactttgctaattaatctacttctaatgaaaagaagaatcaaagcacataaaaattatgcagcataattaacaggagagcaggggagagcttactgccggctttgctgaggccgagatgctgtagtagccgccatcctcgccatggccattgtactcgccgccgccgccaatggtgccgctgccgccgccgatgccgccgccgccgccgccggagttggtgttgtccttgggcaggcggtaggagagctcgtagaccggcgtgccgtcgggcttgaagaggccgtagtttcgctccgacgtcgggccgggtttcatgttctcgttgaagagcgcgaacatgtaggcgcgcagcgccaccgacggccggagcggcgtgcccttcccgtcggcgacgaggcgcatcacgttgccgttgtacctcgcggcgttctgcggcgtcgcgccggtctcgttggcgtcgccggcggacggccacccggtctccgacacccgcacctccaccgcccgcgccgccgcggtgttggccgccgcgatggcgtggtacacggcgtccacctgcgccacgagcaggttggggtagtgcaggccggaggaggggtcggcgacgccggcgtaggtcggctcgagcagcgcgtactcgagctcgacgccggtggggtcctcggcgtaggcgaagtaggggtaggcgttgacgaggaacggcgagccggtgcgggcgtggaagtcgaggatggggcagagcagcgggaggaggtccttgcggaagtacgccgacgacggcgggtacgacgtggcgagcacgccgaggttgtgcgccgtggtgacggccacctgcttgtcgagtccgagctgcgcgagcgcgtcgtggaggcactgcatcgccgggagcagcgaccgcgacagcgacgagctgttggcgccggtgagcacctcgttgccgacggtgagcaccgcgatcttggtcgccgggagcgccggctggacgacggagcggacccacgacgcggcgccggagggggttgacacggcagccaggcactcgtccgggacgccgacgacgagctccaccccggtgttggcgaacgcgcggagggtggccgggtcggcgtcgtagagccggactcggccgaccccgagcgacgacagcatcggcggcacggcgttcgccgggggcaggttgttgccgacgcggccgtagttgatgcccagcagcaccgacgacgtcgcgtcggccgccgccgggagcagcagcgccgccattaccaggatgaggggcggcattgcggcggcggcgagacggcgacgaggagctgagtagctggagctcgggtgagcttggagtggacagtggagtgtgggagtgaggggaatttgggctggagcgttgtgggggcgtggggggtggggggttggtggtggtggatgctgcacttcaccagttttcacagttgcaagttgcaaaccgtaccgttagtggagtgtgagtggccgtcggatatactccttccgtcaaaaaaaaaaaacctggaaaaaattaaaaaagacaaatcacgcataaagtattaataatgttttatcatctaacaataataaaaatactaattataacaaaatttcatataagacggaccgtcagacattgaacacggaaacccagggttcgtcttttttttggacggagcaggaaagttgagaaaaaaatgaggatgttgagggaatcaatcaatctattgataaaaaatgggtaaaatataccccctccatctatttttataatcatattttatcttggcacacagattctacttatcatccaattaaacatgctactagtcattcctcgtaaacaagcaattcattaatatttacatttctcgatacctatgtagccaatcttgtgtggaagaatggagagtcacgcattaaatccaagaaagtcattaagaggatatgttgttggattgaaatatgcctatcaaaaataaatttttcaaatttggaaatatgactatcaaaaatagatggaggaagtatttggttgggtctgattagtgtatatattactctctccattccaaattgatctacaaatttcataggcacaccaataccaagaaaagctaatactataactctctaatactatatttactctagcaacaaactcgatacatgcaccatccccactatttcctagccaatagcaaatcaagatattgcacgttggttataaatacttgtgtgcatggatgcatgcatcaatgtccatttactccaatgcacaaataacgaatagacttaatgaatgaacacaaatatgatgatcatttataaataacctaaaaaaaactatatgtagatcaatttggaatggagggagtagtaagcactatattttttttatttttaattactatatgcaggtttatgtgtcgtagtgtttctttgagatggactcaagaatagggtctgtcacgaccgaaaataacccaacaggttttccattcgtgcatgtattattcctcttctcacgaggcgaggtacacaacagttgatacaatatcagagtttaacaagcggaagcgtaaataatacttttattacatgggcgaccaaaggccaaacacacatagataaacgaaaaagcacaaatgactaggacaaagaccatagacacttgacggcaggcacgagctagacactgaagccatcctcttccaagaactccttttctaggttgggggaaaaattgagcaagattgagtataatcaccgtgctcaacaagtcacaccgataaatgcacaataaatgcaagggatacaaagctataataataaagggttagattttgcagtaaaacaacattttaaaccacttagttgctcaaagccatttggtaaattcgaacacaggtctacaaagtattataattattcacggtcgtgaacccacacgaacctgccttaacccaaggcctacgaagagtcggaccaaactggtagccttaaagccgagctccagctcataccaagccaacccaggccaaccattccaggttttagttgattaatatgttttaagagtgaaatcactaacttgggtatattactaggcttgctcataatcgagggcacggctacgtactcgaataggttatactcttatcagaggtgtacatatttacccacaagacacagcttcctcacgagtcatcacgcgccacataccaccacaatatatggatggagggcgtgacatagttcttcactcaccctagccctgaacaaaagtaccgactcaacgcccacctacggccggggttcccgggacaggtaggttatggtcgagccctacggcatcaggatacccttggggagtggccacccggatgcccgtcctgtgccacaacatctcgactaccgaacactcgcccatgtagccttcatttgcctcagagatatccatcacccgacttcatccatctttatcagtgtccttttgttcacgaccagactaggctacaaactaagccttacccattagacatgtggacttatgatagtgctttgtaacagaggtccgaagactggtccttatagtggccgaggtgctactgtcaaaaccatgcactccgagcccagcctaaaaccattttgggggttttgaatagagagaaaggtgtatgtccaattccagcatatgccaaccaatcacgaacataaatatttttttcatcatatcataatcatgtaagatcttgttgtacagttttaattgcaatgaacacaacagtgtaatcggatcgtagatcagataagtaatttaagagaaaattttatttgaaatttagatgggtaatgaggatgcaagtggcaggtgctactactttcagtaagaagggtaatgagttgatacaaactgtgactatttttggtaaaaaggatggtcgctggttagcactaatgagtgcatgcgctccctgtagtcgcgtcctaatatttagaggccaaaaatctagattttacccaaaagttgtgatgggcaaatatatttttattgcattatttaaatgaggtttaatccttagcctagataatttggaggcgttgatatatcttaaaagttttttttaaaaaaatattctaagtagacataatgatactttgttgctccatttctttacatgaccatttattttacatgagtggattttatgccatgaaatgcttgatgaaatgttctaaatattagtttgaatattccaatgaaacactcttttggtcattgtagtggtgaccattatttcatgacactcatcaacatggttaaagcatttaatatttgatttgtaatttgtattaaagaattaataataagtaaatttcacttcgggccaccttttgttacctatgtttcattttggaccaccctttaagcaatattttcactttggactgggtaaacttacctttgtttcactttggaccatccaactctcttctcaagcatatgaacgatcttgattacgccgtctcctactcgtcgatgaactgccacagttatatgtaagactatttcttcgacatattacaagtttgatgtagatggataaaagagtaagggtggtccaatgtgaaacaaaggtaaaaatacccggtccaaagtgaaaacattggtcctaaggtggtccaaagcgaaacatcggtaataaaaggtggcccaaagtaaaattaactaatataataattaacttgtactttatttggctttgctttttgtgcataaatatttacagggttaataataaataatgtattctcgtatattatatttattactcaagcgtaggtctctactttactttgtgatcatttatggtttggcaagcaatagcaatcataacaactagcatgatgcaaaagttttaaaatgttcgaaattttagtgatttttattattaggaattttcaggatgttacgcattcttttagaggtgaatctcctatgtgtccactacctcatcaattattatcctaacatctgtctgggctatggtgaattaattttaattgattaaagagatataagcatgtcatcataccaccgcattccttgtgaaaatataaatacgatacccttgggaatactcatgggtgaaatgctacagcggtatccgtgcgcttgcggatttatatgtgatagtaagaaataccaatagcagcattgttggaggcagggaagtgtagctggaggacagggaagtgtagctagaggacgtaacatagcttttctcccttgggagagattaggaggcctgctggtgtacccggttgttgttcttccgtccattcagtgatgaagtcagagagcacttgagacttgatggctacccgaagttggaaggagatgtcaaacgccatcagctgtgcccacttggcgatgcgtccggtggcctctttgttaaacatgacatagcggagggggtgagaggtgacgactgacaccggatgagcttgaaaacagtggctgagtttgcggaccgtgatgaatattgcgtggcgtagtttctgaatctgcgtgtatcgcgtcttcgactcactaaggacttcactaatgaagtagactgatcgttgtatcttcttgatcgatccatcttcttctcttcgacacctaggactgtgctgacaacgcttgaggtggcggtaatctataacagaatcggctcttttgggagtgttgtgaggatgggtggacttgttaggtaccgcttaaagtcgttgaaggctgcttgggcttctggagtccaggtgaagtcatcagactttttgaggagcatgaagaatggcatgccacgttcgcctagttgggacgtgaagcggttaagtgacaccatgcacccagtcagcttgtgcagcttcttcaagtcggcaagcggctccattgagtggatgacggctattttgccaggatttgcctcaaagccgtggttggacaccatgaagccaatgttggaattttctacgcacatagataaatccgcaagcgcacggataccgttatagcacttccccttagagtgacccaagggtatcgaacataaggacatgtgtgtactatatacgaacgggattctatccaagggcaacaataaatgctaggcttaagctagagaggattcctatggacttaattaactaacttaagttaaaggtaaaactctatcgaatgcttcgggcaccgggcctcccctggtctgccaagctgagtccgaccttgagctctatgatgtacccgaacatggaggaatacaagggacggacaagctatcaccacttgccgtctacctcactttccctggagcacacaacaaacgaagctaatgttgatgtgaaaacacggtggcctgggagatctgcttaactccagtgcaggtccaatgctagcctcgagtgtgtcaagcgcgtgccaactgatttgatactgcaatcatcaagtgttggcggctgttaaatgccaattctatgctgccaatgcctgcataaaacatcatgaataacacattcaacatagtggtagggtttaattctaacatattccatgagtgttggtgtatatttggatgcaggtaataaaccgtcaaagttgggatgaaaaccagacttcaatgaaggatttcttttatccatctaagagtgggccttaaactttgtagaattattagaaaataggcccatcgctcctcgaattggataagacagagcaaggggaaggcccaggctgaggcaacaggccatctagcccagcctaggtggtgacaaccgtttgattcatgttttggtatgtacgttcctgatttgctcctgatggcggttggagggcagattagacatttcgcatcatcatacctaccctataaatagaattcacttcactcatttcaacacgcacttggaagcttgagctgaattataagaggctctattgtactatattgtatactaaaatgaaggagagagtagagtacaggaagtcggaggaattccggagttatcggtaatcctcttcttgtttcttttactctgataagtattctgctttaattaaatatcattacgagtatttaaaatttattctatgagagttacctcttagttagttcctaatgaacgtacgggatcactgatcactataatccagtaatttatagtggttgctttagtgtttagctaacattaaagtagttattaaactgcgtagacgtagtgtctgggtagttaatttccggtgtttgctttgtatctcacagtaggtttgagggggtgtagaggtggtgacagccctcgaaacactaaagtcatccctgtccggtacgttgtagagtcatatctgggagccagactttacaggcaacggttcgatgtcggggccaatagaccacgagcatccccatggaaggcgtaaagttccaactggcggctttttagtggcaaagggtattttggagtaaaaggagatatttgaaaagcaaataacatttaaataaattaagaaaattcaaataaaatagcaaattgggtatcaaaatgtagattttgaatttatatgaatttaggtccaagtttcactagaatcggatctacggtttaggagatatgtgcttctaaagaattggatttgaattaaatagggaaaataggaagagttactgtgctggggtccacctgtcagggaatattcttaatttcttctccttcccgtctccgtcttttttttctcctccttccagccgggtaacagaggagagagagggagtagggcgtcggtgctccggtgagtgaacggcctcgacggcggcggccaagcgtgttcctgcttgctgcgtatccggggaggtcggtggaaggaagagggagagaggaggatggctggaacggcagtggcaagagtttggttgcggttaccacaaggaggggcgatggtggccaagctaggggtggagggagaggggaaggtgggaaaatggactctcctcagtgaggcaaggtcggtggtgaaaggtagtaggaaggggatcaatggaggaggagatcgtccagtggtgggtggcggccgaacatggcaggagagagaaaggaagagctcgaggctctgttgatgtgtggagaaaaggggagggctcgccttctatttataggcggcgagaggcggtggctaatggcggttcggaggagaaggacgacgaggatacggctgcagcgacgtggagaaaagaacggcggcgccggctctgtcctctgattggctgacgatggcggttcgtccctgctgctgacgtcggcgtgatgaagtgtagctgacgtcgggcggcgattccttcgcgtcgacggcaagatagcagcggcggcgggaaagccgcgggcgacggcgcaagactacaaagcggcggcgccatggctgtgggcggcggcagcggcggcgtgcgcgcccacagagagaggaagagcggctcagctgggttgggccggcttgggctgaagaggaagatgagccgaaaaggagggagaaaggaatttcggcccaaaatatatttcgtggattctagagaattacttgtggctaaaagaaaattaatttggaagaggaggattaaataaaaatatcattctaatatttataatattgctattcttgtgccgagaagacttagttgaggaaattggaatgggaggctagatcaaaataggagcatgaccaaagagttaatgataccccaactaaaagaacaattgagagaaatggtggaacttttgtatgaaggtaaactggacatgaggagattaaactatggagtcataactttgatccccaaggttaaagatgctaatactatcaaatcgtttagaccaatatgcctcctcaatgtgtgtttcaaatttctcaccaagatcctaacaaggaggttgtctgaaattgctcagaaggtaataggggagagtcaaactgcctttattccaggaaggcagaatctggatggggtggttatcctacatgaagttttacatgaactaaaaaaagagaagaaatcaggtatcatcttcaagctcgattttgaaaaggcatacgacaaggtgcaatggagttttttgtttgatgttctgcataagaaaggtttcagtgatagatggattcagtgggttaaaatggcaaccataggagggaagatggcagtcaatattaatggggaggtgaaagacttctttaagacttataggggagtaagacagggggatccactttcccctcttttattcaacttggttgctgatgctttatccgaaatgttgaataatgctaaacaagcagtaccacatttagttcctggtggcttgacacacttacaatatgctgatgataccatacttttcatgaccaacacagaggagaacattgttactgtgaaatttctgctatactgctatgaggctatgtctggtcttaagattaactaccaaaagagtgagatcatggtcataggtggagatgagatggaaactcaaagagtggctgatctgtttaactgtcaagctggaaagatgccttttacttacctagggatcccaatcagtatgaataaactgaccaacgctgatttagatattcctcccaacaagattgagaaaaggcttgctacttggaaatgtggttacttatcttatgggggaaaagcaatcttaataaactcatgtcttagcagcattcctttatatatgatgggagtttacctattacctgagggagtgcacaataagatggattctattagagcgagatttttttgggagggattggaaaagaagagaaagtaccatatgattaaatgggaggccttatgcagacctaaagagtttggaggacttggcttcattgacacaaggaaaatgaacattgctttgttatgtaaatggatctatagacttgaatctgggaaagaagatccctgttgtgtgttgttgaggaataaatacatgaaggatgggggaggttttttccagtctaaagctgaggagagctcacagttttggaaaggcttacatgaggtgaagaaatggatggatttggggagttcttacaaagtgggaaatggtaaagcaaccaacttttggagtgatgtttggattggggagactcctttaaaaactcagtatcccaacatttacagaatgtgtgcggataaagagaagactgtctctcaaatgtgtttagagggggactggtacatagaactgagaagatctctgggggagagggatttgaatgagtggaatgaccttcataacacaccaagggagatccatttaaaggaggaaagagactgtataatctggaaactaaccaaaaatggcttttacaaagcgaaaaccttgtatcaagctctaagttttggaggagtcaaggacaaagtgatgcaggacctgtggaggtcctccatccccttgaaagtcaaaattttattctggttaatgttaaaggggagaatacaagctgctgggcagctgaagaaaatgaaatggtctggaagtccaaattgtaaactgtgtgggcagactgaagatgtagatcatttgatgtttagatgccatatctctcaatttatgtggtgctgctatagagacgcctttggttgggataatattcctagttctagggaagatcttttagagaagttaaacattcaaaaagatggacaaaaatctgttttgcttgcatgcttagctgcaggcacatgggcgatttggctgatgcgaaacgattgggttttcaatggaaaactaacctctgatccctctcatttgcctccaaagctgtttcttttcttctacagtggagacaactggcgccgcagatccagcggagcgatttggacgcctcaagggccttactgcttgccagtactcgaagggcaacaggctcaaacccctgatgaagacctgaatgattttcagcttatactccagggatgtctttttggttgttcactctgagtagttatttctggcttgtcttttgggctgtgccagcagccattgcgctctatcacttactgggtagtctccagccccttttatcttcatgtcttgttttactttctgtatgaaccttgttggctttttaatgaaagctgggcaatgccttttctccaaaaagagttaatgatactgtagaagattttggatggagaagaactaaggaattttagaggcaa

SEQ ID NO: 60138 - DNA, 1321 bp, Oryza sativa
aagctgctacaaaagtacatgctcaggaccttatgcaacattctatggtattggggaagtaatatataatctataagatttgacccagcaggccttttccatgctttctcaaactgcatgaattgggctgttgtttctcttatttaggtcaggtccagccattggtgggttcacatgaaaagctgattgtcttgtatttgtcggtccagtaagctgaagggaaagagcagagggttctatggagttagagctgccgtcacctatggtaagcttggacatgccaacaacctcatcagccttattgatcacctcctttccattcactggagtgggctttaggatttcatgatttgtgcctgattcacccacattagcaacatttggaggccaaagagttagtggaacaggtattaatgccgggtagaatgttggcattgtcagaacaaatttagtcttgaaaggtgcagcatggttcatctccaagtgtagtgatgctagtgaaggttctgtgaagtcagattcctcatggttccttagctgcaaatccgacaggtgtgtaccaaactcaggttccttttgtttcacaagatgtgatattggcaattgatttgagcttgtggcttcgtcttgagtactatggagcataagctgttctacgaccactggggattcgtccatgggctgcaggttgaagatgaaattcgaacataagatggtcgtgatatagaaatatcaggacacaatttaacatatatggagataatagacacctcctgtctcaagcgaaaattgcaagcaaaaattgcataccatttctgggaccatgtcaaacaagcttgacctcctcttccttcttgatgagtttgtctgtctaatgaagtacttttgagcatggctagccacctgagttggtgtcctggaaacaacaaaattacgagagatcccacgccagtctcctttaccaagcttctgcagacccattagaaacattctatgctcttcttcagtccaaggtgtacctgaagcacaacatcagcccttgagttgaaactggactgaaaaatcccagatggtttctgtgaaaaaataatccacgaccccatttttttagaggaaagatcattatattgatagtgacctggctttttcagagagccaacagtagttcaacaaagaggtaaaaccaactcacacaccgagggttacacccactggatcattccagctacggagtacatgacaagctcagccaaaaaacacactggaactgcagggaccagcactgtagcatactccctctaacaccagaatactccccatt

SEQ ID NO: 60139 - DNA, 34512 bp, Oryza sativa
gatcgatcgatgatcggtgcacatatctatctattatactagaggcgcggttcctcgtcgtcgacgccgagaatggtgctaaggttcatggggtgcatgtattcggtgaaccggtgcatgaactggccgacgacgatgcggttggctttctccgttgggtgaacgcgtcccagaacgcgaacgcctccctgtcgtcgcacacgttcgacgccgccgtgcacagtccgatcccgttgtacggcccctgcccgcagcacgccacctgcacgttcgtaaaacctgccaaagcaatcaacgggttcagatcagtcaagttcggcgttcggcttcgatcgatcaaacggtcgccgccgtcgcgggagcacgtatataccgtagttctgggggttggagatgtagtcgaagttcatgcggttggtgttggcggtgacgaagacttcggcgccgatggcgcggttgaggccgcgcaccatgttcaccagctgcgggttgtacaggtccacggcgcgcgtcagctccgccgcgcactcgccgcggcggctgtgcagcgccagctccgccggcacgcaccccagcggccccgtccccgtcacgatcacgcgccgcgcccccagctcgtacagcctctgcacgcacacgcgcaagcagccggtgtgtcagcgcgtgcgtgagcgtgacaaccaccaattgagttgacagttgcgcggtggtaggtcgtgaactagtacactactctactactgctactgccacaaggcgatctcgtgcactttaattaccgagaggattttcctgtactcggagatgatgaacgggacgtagtcctggatggcgtactggcgcgaccgcacggacatgggcacgaggtagtagttgttcacgaagtcgttgcctcccagcgtgatgagcaccagagcaccattcacgatccgcttcgcctgctcctcgccgaccagagcccttagcttgcgctggtactcccggaagtactgcagctgatcgccgatcctgattatgttcacctgtgttcacgcacaaacacccacatggttgcacatgaaaatcttgagaagaaacacggaaacacaatgacggccgtgaattgaagtgaaatgaattgagcattttttatcgtacgaattgcaccccggtgtcattcaggatcccgacgccggccgacgcgaagttcgcgccgacgagcagcttgtcccctcggagctcagggctcaggtacggcaatgcaggctcggccccaagatgctcgcctgaagaaaacgcccatggtcgtcagctcttcggcaaaacgtgtcgacacactgtttctgaaatatgcaggagttaaagtactacgcactgataatgtcggggatgttgagcccgttggagaaccggcccgtggcctggtgcgtcgggtagtcgatgccgtacggcggcgcgtcggcgcgcgccgtggtgatcaggtagttgttgttgccgttgtcgacgagggagtcgccgaacacgaagaaggcccgctccgcggacgccggcgccggtgcagcagccacagccaataggccgacgaggagaggaacgacgagagcagcgaccattctcgctcgcggacgtgagaagcactgctgactctctacctgtccttactgtgatcaagatgcacgctctactagtccactagtgccagtggctcgagtagtagctgggtagatcgatccctctttttatagaggccttggctagctctggctcgatcgacacacgaacaacttgttttgcagcaaaggtaaaaaaaattgccaggtgagatactggcaaatgcggtgaatgatgcgaggtggttggttgatttggagccgcatttacgtgccccggccgggaggtagctaggccggcttgccgccttggatcgtgttcatgcgcgcgcctgcaggaagagtgtgaccacaggggcggtttcggtggtggtctggtggattgcacgtccggccgttgcccgcagcgggttacagaattcagatgcatatgagagctgttaaataatggggcggtcctcgatctgctgtcttgtttggtgtttggggagagatttgggattgttcgttgaacagtattaatttactcaagtacggtgtgcattcattgtagatttgtattatgtagtccgagttttgtgtggtaaagaagtgattaccttattcactggttgatctggttgttttgcatcatctatttagctggtgtttagcagtgaatctagaataaaaattatggagtgtcctatatgcatatttggcatgtataatacttcctccgttcagtaaaaagttaatctagtactggatatgacacatcctattactacaaatataaatataaatatgtgcagatacatagtactagaatatgttacaatcacatccgatattaaattctttttttaagggacgaagggaagtggcactaattgttgtgcggagaaaatttgcgtgatgagcaagcttaacaccctgtgtcctgtacatagggaaggcccacgtggcttcgcctctgtatctatattgttgagaaaatcctttctatatataccttttaaaatttagctttctatactcttgaattttgcttatttctttatatatctccaaaatttgattttgatcccttccatacttctcccgtcagttaaccgttagttgactgtctaattttaataaaaatgactattttaccttttggatgaacatagaaattcatgaattacattgttaaaaatgcagtagaattttgtcgcataagactactagagttatgagtttgttgtgtgatgcattatttatcacaaaatttatttttagataaataaataaaaaaatatgtatttattttttaaaagaaagtcataaaaaatgagaagcattcatacaaagataggactaccaatgttcacaataatttttttatgaatgttttgatgcgaaaaacacacactggcctggaagatctgcttaactcctgtgcaggtccaaaatcttgcttttaggttcgtaagcgtgctagtcaatttgatcttgcaatcaccaagaaacaaaagacaagaaaaaccgcggttaaatccataaacgatagccgatcggctagttgtcgatgacatatcatttatctttaagccgatgtcatatgtgaatcgatcggctgttataaataagcaagataagactaaatctactcgatcggctgtagatattaacgctatataatcattctgtcaatgtatatttagactaggtgattgggatagatcggtcgctatgccgagacagtataaatcacttagatcgaagtatacattaatacaaagattataaatgtttatagcatagacgatcagatagatctagcacgtatcggctagtactccgataccatttactagaacaaatagaatatatcaaacagaaagcctaatatactttattgcaataagatcttaatataaagggcagacttagcatatcaattaagcatataagatataaaatagctaaattaggtaagatcggctgaaaccccgatactatctctcttgataatcataaaagaagccagatatcataattatagatattacttaatagatcgaacctaaccgatgcaacattaagcataaagacaagtataagatctagacaagatgatgaaaacctacaaaagatggtatatacacgatacaatctagatcaataacaaaacataactctaccgattgcttcctaacaataagaaccaactgataacaagttatatagcgcaactaacatagattgcaaagtatatatgataactcgacagattacataatcaagattagagtgtcatagagatggaagcactaatcccgacaatgcaagctgccataacaagttttacctctagttgaagatcaaaacgatgtagctcaacccgaaagcaagaactcgtcgaaatagaacgaaagtaaaaagggtggcgatgcaccaagattgtattgaactattgttaattgattacatgggttcgggttctatttatacccgagattacaaaatatgtccttgccggacacgacacttatctctaacaaactctaagataccataagtctttgcggtaaacttttgcccaaatatatctctaaggaaattacatgaaatatcctaattaataaatacaattgcctatccgagagctttatctccatcatggcaatcctcgtgaaacacgttgatcgattctagaaacatctttgaaaccattatcatcggaatcggctacatcacctctatcggctgtgtcggatgttatctgtccgatccatctcagtcgatgcagactccagccgatgccttcgtagccaatgcatgctctgttcttcgaatccatctctctaccgaatccgcctcgatttcaatatcgaatctggttcatatattaccaaatttggtcgtcaacagaatgcttccgatcaaaaatatccattgtcctattaaaatttaaaatgaaaattttaatttattacatttgttttatttttaaaatttatgttaaatttttctacactaattatttagtctcattagtttcataaaatgcatatactgtgcactcaaacaaaattttcaatcttttttcaagtttatattcaaaactaaagcatcaaggataaaaaaggacacttacaaccaaacgtaatagtgaaatgaagaaaaatgtaatggtaagggcatgtaagggatcaagctgaaatttcaggggtatagaagggatcggtaaatttcagagagtatgaaagagattgagtgagttttcaggggtacacaggaaatttattctatattgttttgcatcatatttgtaattttttttattgatagaactatgtttcttcataaatataatatttttatacttatctatatagttagtgaaaaattcttatatttatagtcggaggtagtagttctgaacatcattgttttttttttgaaaagcaaggtaagaaggttgtcttatatattcactggccgtgggagttaggattatccctgaccaaagaaagaaaggaattattcttgcaacagatatagctctgctagattcttcactcccttccgtaaaaaaaaaatcatttttccgtcaaaaaaaagattcttcactcccgcccacgccattacccacaaatgtgcttcctccttaattcttgccatgagcccgtgatggatcttgaagtgttagtgagatttctgaaaactcttgagtttctctccttcacaactctcgggagactatgataatcatcgacttgagagtactttctagggcatgttttgtgccgagatggttttccctcaccactcttgcacagttgcatggttcatccattctgttggtttgatgtgtagttgcaactaggagatcctcttagaaagacggtggtgagctagtaaatggactacaacgaggacaaaagacctcattttgctgaaaatcattgtgagcttctccgctcctatcctattaaatacgtagagctcttgctgttttagatggaattagtgttttctaatattgatagctttcttatgtagtactatcacatgtcattttttttagtaatggaataacgtacattttggcctttgctcagcaagctacattcaattattacaaagttcatacatgaataaactcagcacacactgatatagcataaaataaatataaactaataaatatcaacacaagataaaagaacccacaattactaaattctatttgagaatctccactcccaagcacatagcaatgctaactggttcttagtgtacgagtatataatactatgaatttttttaccctttgcacttctcattcatggatgaactgacaaagattgaacataagttattctctacaattttctacttttactactactcccttacatacacatctgaaagttgaaaatagatatactgactgataatctgcataaaggccccactcacacagtatatcaaccacaagaagttagcttcatagttcggtcattaaaatccatggccatactaaacatgataacctgttttccgacttcagtaaaaccaatgcagtactccaagccttcaacgaacacctaatttccaaaacttacaaaaagatacaccttccagtcttttgacactgttgatcccgccttccatttattacaatgcagaagcattccatcagtaaagtagcatgccatgtgaaattcataaaacagtggggtagaattttgaagttgaactgaccaccaacaaacagtatgcaattacagattacttgttttagctacaaggaccacagtaaattaatttccacactggcactgaagtgagattggtattaacttggtgatcgatgaacggaaatgagaagaactgatgattcttatttccctcctcacgcattaatgaaaaaaccatagtaataaaatgtcatgttcactagattcctatgggattttaaaattcatgaagttttgaaacttccgtttgattgacacacaaaaaaaacacaggaaaccaaaggaagaaaacatgagatgagatctcataattttttttcttcaaatttactctagaaaaatttgtgggaatcaattctttgtttcaaatgtcagtactttcataatatataaatcctgtagaaaatcccctctgtctaggccaccacctcatttgatcttgatctctctttcttttctcaattttttttccttttcttttcacgaataagctaaacgataggaccgttatatatacacttatttcatttaaatattccgtagtaacgtacaggtacaataataataaatatataggtaccccaaaagctgaaagagagtaagatggcgtcgtgatcgtcgttaagtgtacccggaccggacggcatcctggcggagatcctctggggctccgagcctccgaggccttgacctgcgccaactacggcctttgtgaatcaagatccggtgcagttattatagtgactgcaagttaggcagtcccgtccattcataaccgttggatcaagctgatgaacgacagatagctgtgccacgtcacaaccaagcagccaatgctacaataacatgctatagtgcgctacagtgttctggtcgaatctgatatgttcttttttgatctaacgatcacgcgaggactgctaaagttgcagtccacgttgcaaccgcaggtgatctcgatccggcctttgcttgcctctggtgactggtgggtggcgctgcccgccggtccgcgtgccaccgatcgcccatgcccctcctcggcatctgcctgctgggatgatctagcctaccgcgcgtacggcgcatcgtacgccgccggcgtccagcaagcccgtccacgccaaggcgacgcgcgtggtgacgaatcgatcggaagttcggaacagctgtagcctgtagcccgtggacgcatatggttcctgtgtgaccatccgaccacgggctcatgggttttccgtcaccacgatggacgcaaggtagagtttgatgcttgaatacttgtattttgtatagttgtatgcgctcttgtattttgtatatatagttatatgcgcttattgcgtgtgtatgaatctaagcaagaagaccttagtataatcttgtactgtataatctaagcattttctggatcgtacaaagctttatatattaggctctgttttgattccctgataaaaatttttaccctattatattgaatgtttagacacatgtatgaagtataaaatataaacgaaaaaataactaattatacagattgcgtgtaaattgagagatgaatcttttaaccctaattgctccatgatctgacaatgtggtgttacagtaaatatttgctaatgacggattaattaggcttaataaattcatctcacagtttacaggcggattctgtaatttgttttgttattagtctacgtttaatactttaaatgtatatccgtatattctatttgacacaacaaaactttacacccctagatctaaacacagtcttaatgtatcccatttccgttctgcaaataggtcgaacagaacatggcttttgtattgctgcaggctcttgaagttgagaccttcttgttgccttatgccgttgagtggaatgatccaaagaatcgcgagtgcatttactgaacactgctgcagtagtacccaagatgaagccatcatccgtgccttgctactgctagtctggctcttcgcgtcggagaaacgagaaaggtggagtttttcaccgtcggagaaagagcacatttgcctgtgctttgcctgcctgctgagctagtccattgtcaccgtgatttggctgtgtttagctcacgctaaaattgaaagtttggttgaaattcgaacgatgtaacgaaaaaatttaaagtttatgtgtgtaggaaagttttgatgtgatgaaaaagttagaagttttaagaaaaatttagatctaaacacggtgtttgttgaactggacacaagaaattcttccagaattagtgattcttcgtagtaccagtatcatcgtcttcatgccgtcctaaaagtgagaaaaggcttcccgatctggtgatacacgagttgaacaatcaacctgtactctttcgccgatcgattgctcctgacatgttttgggtagcagtacaataatactgcggtgatcaatgcagatctgtagctggcacagcgtcggggagattgtcgcgacgaacgcgcgatgttcgtgacggtgagttagctgcgagccacggcgctacgcaggagaaaatggtggctgcgccgtcgcgcggtgcgacccggaccgtgaaaaccgtatgtttatcatgaggattatcaaaaactaagaagattacggtacgcgataatcatgataactcacgctgttttgtaaaccactagccaatttgcacttagcattattatccaggagggcatacggatcggacgaccgatcatgacattagcgtccgatttacgtgcaaaactactttaaattgatttttctcttaaattacttatccaaatcatgatccgattgcaccattaaattcgttgcaattaaatcttcaaaacaagattacacatggatatattccgacgaaaaaagattagcttattattgaattttttataaatgttgcacgatgttccaccagctatatcggaattgtctcactaggtgattgaaaatgtttcactcgtttaaatcgggtgttgtttcaccttatataaaaacaatgtttcagcaaatagcgaaaaaatatttcagttcactgcaacattatatctatatatagtgaaacattgtgattacattaggtgaaacatttttcggtgaaacaaaaaataaaccaaattctcttaatagggggtttccaaaatatgtgggtttttttgttgcaatagaatatttcgttcactgcaacattagatctatacatagtaaaacattgtgagtacactaggtaaaatattttttatggaaaaaaataaaccaaatttccttaatagagagtttccaaaatatgtgcgttttttgttgcaaaagagtattttaattcactgcaacattagatctataaatagtgaaccattataaatacactaggtgaaacatctattgtggaaaaaggaaggaagaagtgtgtgggacaacaggtagcacgtgggggagaggcgcgcgtggggggagtgcttgatccggctccccccgcgccggtcgcccggcgacaagcattatcgttattacccaggtgttttaaccgaatgggtcgtgatgggctagatcgttacaggcccaagttggctgagaattaaaatcattcggcccgtcctcttttcttttttttttttgtctcgtgggccaaccggccgtcagaactcagaactgtgcgttccgtgaagaaattagacggggaaacagtaaaaagaagtagccattgattatttcatcgatctagatcttgccaatgttcatatcgatctcgatccgaagaagaacggcattgattggtgtgtcctgcatcgcctttttctttttctttctttctgaagactctgcatcagacatcagttctgtggaggtgaaaacagccaagaagaggcgagcatttggcttgttgtactgtaccaatgtaccgtttcatgtgctcttcgctggcgctgtgatgaaccaattgatgatcagctctaccgccttcaagttacatggagtttggtagtatacgttggtattccatggcgtgacagtgcctgtgcttttacaggagtatctcacattcagtcattcagacatattctcacccaaatgagaagctatgggagatgggaatgtgctttttacctagagaacatatttactccctccgtattaaatataaacatttctaacattcaaaatttatactgcaatataatcatttatgaggtactaattttaatacacgaaaatccatacattttcagccattcacgtacttgaggagatcatactataaaagagaatcttttttccttaacctcaatatatggtatttttcacgaacgcgcaaaatgattgcatgtcatatattagaataaaagagttatagttacatgatgcaatcagtcagaccggcttatgcaaagggaaggggaaaaaaagcaaaataagaagctggagcttaaaaaactacagcggctaaatacaaactccaagcagtaggaaggggctgagccacgctacactcccaacaggaccccaaaagcggcaacgccagctaaagactatagatagccctctgagtggatggactccagaaccactgagactaaagagagcgcagagtcgaaaaccctagagttccgtttcttccacagctgctaagagaccaggagcaccagggagtcgaagccagcacagagatgctcaagtaagcaggccctagaggacagccaccagtcctgtaaccagctgccacgggggagagagggcagcccagccaggaggtgacagcacacggagccaaacctgccgagcaaacacacagtcaaggaggatgtggttcgccgtctcaagatcctaagcacaaaaaaggtaggccaagtgactatcgatgctacacttatggaggagatcagccgtccagcagcgctgctagaatgcataccaaaggaagaacgtgtatttagcaggaccctttgcgtgccatagaagatcagcacaggcaaaggaatgctgaccatggaagaatgcctggtatgccgaacgcgcagagtagcgctggtcagacgtccaacgccaaacgagatgatactagtagaaatacttatattttagaacataaaaagtacaacacacagtagaaatattgttcacatgccctcgagagatattactcgagcatgttttatactgttttgcaaaagagagaaggagagcaatttttttactgaaaccgtgagtaccagattgatatatctacaacaaagcgataaaaataattttagaatatgattttatatttctgttcttagtggtataaaagctaagcctgaaaagataaataaaaaaactccgaaatcagctctaacataaatttctaaaatcaaattatggttacgacctaaatctgcaaccttattactacctccgtttcaggttataagactttctagtattgtccacattcacatatatatatatatatatatatatatatatatatatatatgggttacgctagaaagtcttataatataaaacgaggaagtagttcaatatgttatttgaaacgaacagcttggcttcaatacgaccgagagtcttgaaagaactactactattaagttctaaactcgtaatgctcgctacaagtacaatacaaaacctggcagaagtggtccgtatatgtacgtacaaatgctggtggttagcacgattaatggcgacggttcacctgctggcaggctaaccacaccgtcgtgtgatatgtgatgaagagtcttaactgtagttctcatcgatctgttgagtgttgactggtgaagtggtgattagggatgaaaacggtcggaaatagtcggaaatagtcggaaacggtattattattttattaactttttaaagacaaatagaaacagtcgtaaaattttcatatttatgaattcatcaacttcaatgccacgctgacagaaattaaaaaaactaaattttgaaaatagtaaccatcggtaaaaatattattattatattaattttacggaaacgatatcggtatggtcagaaaatttccataccgttttcattggtgattgcgtcaaaaaaaaagagtgttgacttgtggtggtggtggtgcttgaccacaatcagcttccttttcgggtctgttcactttgatgccattttcaatcttactaaattttggtaaagttgtcaacaaaaaatggctacgggccagtttggtttgcgacctaaattggccttaccaatttttggcaatgccaaattttggtaagttttggcatgacaaattttgggaaggtaaagttgtgtttggattgaagccaaaatagcctaagttaattattgaaatggcctattttcttaggcatgccaaaatttggcttcaaaccaaatagacactaaacactattaaaattgccaaatattggtaagccaaatttaggcctcaaaccaaaccagccctacatttagtttgctgccaaattttggtaactctataagaaatcatgtcaaaattttagtaagttgccaaaattttggcagctattccaaaattttggtaataccaaaatttggtaaggttttttttggcattaaagtgaacccttcttttttacaaaaaggctgcattgtcacaaaggccacgaatcagaaggcccggtctccgttgtgcggtctcccggcccaatatgcatgcggcgtaccaaacggatactactttactactctgaattttctctgaattttctgaagaaataagggtctcaaacgctcaaatggacgcagaggctgaggctctatttatggcgtcagccaacctgcaattgcgatcttttggtggtggcatactatgatcattcggtattttgatgactgatggatatgtgctaagacgtggagaaaagcaagataagataaagaaagcaagcaatgctagctgccacacacacacaaacagagcaaacagacagagagagcaaaacagaccaaacaaacagagagatcgaaagtgattagtgggtgtccggctgctcttcccctcagcctgcgctgcatgctgcagatgcgtcgtcgcgtcagcaggatggagatcgtcttcgtttgcttctgcaggagccgagcggaaatccctttctcctcctgctgctgctggtagcccgacctcatcaatcatcacaactcacaagcatcagagcaagccaggatggaattgtgaattttttgaggttttggaggttcagcttgagcacaatccaatcagctgctgatcgatgcgtcgtcattctctacggctgccactccagctaccagtcctgactttgcactgagtacctaccaagtaccaactgtttgatgtcagggctctgctccacgctcatcagctcatgcagtatgggcctcttcttcacaccaggctgctagccgcacaacataactaatcaatggcttaattgatcatcattgttgtttaaaggagaagattactcggattagctcacttgctatcaggcccgagaatattgattattggactttggagcaggcaggttactctgtcatgtaccagatgtcgctccgctttgtaagctattaacaacactggacggctcaccagacatgcatgattatcggtttagatggtaagtatactttatgctaataattatatgctcttgtccagataagatatgtctccagtaccaaacgggatttttgctaacgacaataagaagctaattaaatcagggcatcaggcataatttaggcttgaacttgggcagctatgtatggctgtgaaaataatcattttcattctctgatgaacaggtgtaatactcttcttacggtagtgattttcaggagacggtatgtacggataccgttaggctgtagacatcaacgatatctcgagacgactggcggcatctcgatcgatttgtgatgaggagaaaacaagctttcccatactgatccaacggaacagatgaacaaacacactttgccatcatctcgtttgattaatttctgatccattttcccctcataaataagccagcgcgacaattcgctgcatcagaactttccatcatctcgtctgattaatttctgatcgatttttccctcataaacaagccagcgcgacaattcgctgcatcagaacatagttaggtatggtgtatgtagcagtactatatagctttttatcacaacttgtaggagtaggactccaaggattggaagctttatccaacttggtacttattaaacacaacaactttatccaaagccgaatcgaggtcttagtacgctcgtattacagtaccatctcaaatcgagttttttttttgaacgaaatcctcatcgagatttatttgtttttgttctgcggaggaccacctatcatcatgtcaatcataagatgcacttgcaccaactatgatgacattacgcttcaactaatcctagctttatcaccccggctctcctctgttttcccccaaaaatagccctatgcttttgcaaaattacaagcataattggggtgttcatctcactatctcaggtatatatctactcccataattctgaaggccgcctaatttcagcatctgcttggtaggttgatttagcttataaacattgagcagacaaatttaagaaagggctttctttattagactgaaacatttctaaaattgaagtgaacaatcacgtgcggtggcttgtaagccggagctcaacgaatcaggtttacatgctacatccaatagatatccaactaacttgaaaagattgtggcaatgtagagaccaaatttgttagatttcacttactgaagggatatgttgttagatgacagtgccatcccagcttggttaggtgacttcatgcatgatagattgaaagcttgactgcttaacttagaaagctcaacaaactaagatgcgagttcaaatccagcaaagattagggatcgaaatttcggttgctaacggcatgggactgatggatggtattgaaacaaatcggcacatacgattcaaacttttaattaccaagatttcacatttgaatgatttgtgatattatttgaggttacaagcggatgaattaaatgctataaagttgaaaaatggattcaaacaaatttataagaattttatatattgaatgtttttaataactgaatgtctagaagctcggaaaacatgtgtatttgtccatcattccattccatgaaaaagaacagggcctcacatacgcttgttaaccctttctttcacgtgatgactttttggttggactttccaccctactactatctcattatgctacgctcgttccatccttttcatgaagaatggagttctagtggtacaaacaataattgctgtaagtcacaaactcataaatttgctaattcaccaattgcacgacaaactacactaaagttgaaaaataaactaaaacttgtatacttattattagcagattaaaaagcctaggtcgaaaaaagaagaaaacgaaaaacaacccaaaattaactctaaacttaagtttcaaaatctaaattaagctgcagtagtacatacgagtcaaacggtagtcaaatatacggcggtagtacggtggacttctccgggggtgctacatgcgacattacgaaatgacagggaccaacgtgcacaaaattctctgaaactactctgctcgctgctgtctcacactctctctctcccctcccttttcgtctctctcagatccgcgaccactcccatttcccccaaaaatcatcgcgagcgcgcgacccaaccaccgcctactggtcgccgccgccgccgccgccggtgaggagtaggaggaggaggaagcttcggtcggttggttgtcgggtgggggtggggcggagatggaggcggcgctggaggcggcgcgcgccaaggacacgaagcagcggctggccggggtggagcggctccacgaggcgctggaggccgcggcgaggcgagggctgacgtcgccgaggtgacgtcgctggtcgacgcctgcatggatctgaccaaggacggcaacttccgcgtcgcccagggcggcctgcaggcgctctccgccgccgcggtgctcgccggcgaccacttcaagatccacctcaacgccctcgtgcccgccgccgtcgagcggctgggcgacggcaagcagcccgtccgagacgccgccaggcagctgcttgtcaccctcatggaggtctggttctcttcgctgtgtcgccttctgctagcgacatcgtttgctcttaccggtttaggtttggggaaaatgcgggttcgattatgtgtatatttagttatgataaattactcttcgagcggaaaatctcaattcgtctgtgctttgatactgcatggacgccacttgcgggttaaatggcgtgggttaagtggatgatgagtggagctttggggttggcggccttgctcatttcgagctagattattagctgtaaatatattagttggccgtgatctaatggattatcgttaaatttaggtaaaaaaatgtgccatttggatttaagtgcagctgtgaaattgaatccttgaaatcattagcttgaactttctacaatatctgctttgtaaatgcatgcagtacataatttgagtttaaggaggtagttacttatttaggccaaatccattggctggttctgtaaattgaaaatgtcccttgcccttttaagattatggcttcaagccttgattgcaaactagtttagttgtgcactttgatcattcactgtagtttgaggatggcgatattggagtataatttattttggtaagtaagccgttgagcaaaattgcaatcacataactttcagggatatctttggatgcctttcagatggtcacattattggtgtgcgtagtcatgtttggtactatgttataccaacaattgttggtctccttgtaaggttatgcatttttttttgttcttaacaaaagagaccattgctatccactctttcccgcaatcaatattccaagggaatagtgatacttagttgaagcaggtgatagttactagttaaatgaacagactcgtgaactggactaaggctaaatattgtgacctgaacaaggctaaattcccaagttttcaggtgaatggaggcactagtttggagctcgttatattcctatgtgctattaatcaacaaatgctttcatgagtggatgaagatagaaatttggaggagaatatgtgcatatagatatacctaatttgttactgtattttgctttccagtggaaggatgttttagtctgctactctgcttcatgatatatgttttaaggtgcccagtgtagattttggagaagcagagacaacatttttactcctttaaaagatgacagtagtggtggttgtcgatctgccaccacatcttctctatactggattttcccttaaatttcttcaatattacacaatagtacttccacatgttaattctccttgtttgccattaagaaaaatcaaatttaatatggaacagcccaaaacgactgaattgtcatgtctataacacacacgcacacacaaaaggtgaaaatacatgtttgttcgaaaatcatattcacttattttggatatagaacatgtttgattatttttttccatagccaattaccaacacacagaatttagctagttgaacctatatttctccttttctgcatgctgcttcttttttactccctttgtctcaaaatatagctacctttagctatgaatttggacagagcccttcaaaatcaatgttttagttgcatttgaaacatggcattgcctgttgctaatttgctacaccattgaaaataaatacttatttgtactttgaatttaaaaaatgtccttggtggcttgagcttattttccaggctgtatattctcttgtatgcatggagatttctcatcttttgttggactgttgcttttccaatgttaatattcatttatattcttatggacctttatggttctgatattattttgcggggtatactaagctgtttttactctctacattctcaggtttcatcaccgacaatcattgttgaaagagctggaagttatgcatggactcacaagagctggagggtgcgggaagaatttgtacgcactgttgcaacagctgttggcctctttgcttctacagagctccctctacagcgagtgttgctttcacctgtatgtcaagataatttttatatttcaatctgttctgcttacaattattttgtttgcatgattgctaatggtagctgctacacttgtttggctttacaggtcctgcaattgctgaacgatttgaatcaaagtgttagagacgctgcaatctcatgtattgaggtgatccctttgcaaaatgttgtgcaactcacacttttgctatttgttcaaacttttcattgcatttttcaggggttttacccgcatgcaatgttcacactttgcacccttcatatgctaagtagattgtatagtaggtttactttcttctgttaccaagataatatatgcaatggatgcaaattattttgcacattttcttctgtgaactttccatttccaatatgcagtctctgctgtttaatccattcttcctttgaacaatgtttgaactagttaatataacagtggagtattacttctttattacttggatgctctctgggtaacaacattcactttagcctgggaccacttatctggatgcaaaaataagcaatactgattttgtgtggtcatgtgatttgcctatactcaaattctaggaagtggaatatgactgaagaaaagaatgtagaggtagccttcactttccattggtttggtacacggtagaccggataatcttgatgagtgaacctatgaataaaacgagaggaatgttagaatcatctgtattctgtagaatgaatgtgctacaagtttgataaaatgtgctacattatattttacttttgttcttttgaccaaactatattttgcttcatttattttttgccaatgtagaacctgttgactattcttcatctgtctttgcctgatgcagtgatgctctgacatatattttgttgaagtgctttctgtagcttaataatttacattatctattctcactgcaggagatgtatagaaacatgggatctcaattccatgaagagttgcagcgccataatctgccttcttacatggtaatccatgtggccaatctgatctccatcattattggttgctttcctgtcaaagttggattagtagtaaactgcgtgagcttgtcttatccttgcatgtgcaaatttaaggtaggcatcctgtcatatgctgattaatctttctttgcctttttttagctgaaggacataaattcaagattggataaaatagaaccaaaggctcgctcatctgatggtgctagaatgcaatataaggttattgaaagatctgtaagtgctaatgcaaaaagaggcagtccaaggaaaaaaagttcaacaagggaaagcacattatttggaggcaagttttacttttgaatttcctggaagctttgtttctattttgattaaaagtacaaatatgaaaaaaagtgttattggtttgtatcgacaaaattttaagtaatggctaagcataactggagattccatgctcttcgctgtaaattcctattcatctgagtggacttttttggagttccagatgattgttactagagcatgcaatcattactatgactttactctaaacaaatgttaggcccttcactatcttctcactgcggtcagctgccttattgtagctcctcttatactgggagtttacactattagctcttcttgattgtatggtcaatgattttaaactttttggaagaagtatgtgttaacacatataagtgttgatatagctctttcaaattgccaaatctattgccacaatttggtgctgatctaacaacgcaatattagcatcttttccatgcacagtgagtcagtgcttttttccacatgtcatttttcttatataatcatgcaactgtgatttagttggttcatgattttaaaattcttgcagagatcattggcagatgccacatgtagatcaagggaaacacatgtagtagatatacatgtttgttctatatgcatgctgatccttcacaaaattatactgatataggccttgaaagattttgcgtattaattgttggcaaatactgtacattcctgtttttgtgaaattcattttgatgtgttaaaatgcacctctttttaccaggtactcaaggtaaaaggcatgcactatagaaacaacatctttactttgcttagtttatacattagaggctttggattccaccattttagtaggagcttttgtagcaatttaggaaatttattagttattggtcagaagacagttcttttctggcaacattgggtctagacaaaacttatcatatgtgaagctttttatcattagcgacatcagcatattgatcatataccactggattttgtgccatttacaggtgactcagatattaccgaaaaaccagtggaacccataagagtacattcagagaaagaattacttagggagatggagaagattgcatctgcccttgatccagaaaaggactggtctatacgtattgccgcaatgcaaaggattgaagccttggtatatggaggttagatatttgtcactgctgtatctttttattgaacattggatagtgttgataagtagctttctttagaaagtatatgtcacaggcttgaagttcttccagcatgtaaaagttgaaaagggaactccagagatagatcatgttagtaacaaaaacagtgaaatagaactgaggtaaccaatcccctttttcaaagtcaaggggggaatgtggcattgctttgttacttaacttggtaacccaccaaccaaccatgattttgaatgccatattgataagttcatatcagatttaccaataatgatgcatatagctggtagaaattcattcaagaaagacaagctaagtgatgaaaataaatatattggaacagtgaaattaaatttctttacgtttataattttacagggatgttttaggtctcactgttgactgtacaaacatactgttacataattatgtattattccctttcttgttaacattgttttgcatgtttttgtttgaaataaactcttccttttatcaggtgcaattgattatccatcatttcttacgctcctgaagcagctagttcctcccttatctgctcagctgtctgaccgacggtctagcatagtaaaacaggtatttgatttaacaccaattcttgaggggctgtcaaattagttcatccaaaaatatttcattttagaagtacatgtgtgttatggaattctgttagaaaaaaaagaattcttattgaatttgcaatgactgaacaaaccttggtgagaaaaaattgctgaccaagtttttttccaggcatgccatctacttaatatgctatcaaaagaactccttggtgattttgaagcatgtgctgaaatatttattccggtaaccatagaagctgtttcagtgttttgcaacagtaagtcagtactcttatacttcctcagtagggctaacatactgatcaaattatcaggtacttttcaagcttgttgtgataactgtgcttgttattgctgaatccgccgacaactgcataaaaactgtgagatacctatattcttgtatgtaactgtggcacaacctctcagtactcatttttctttttgacaattattgtctttcagatcctgcggaactgcaaggtttcacgtattcttccacttatagctgacacggcaaagaatgatcgcagcgctatccttcgtgctaggtacttgtgtttagcattgtcttttttctcagtacctgtgatccttgtttattaaagccactcatgcctatttcctgctatgtcagatgtagtgagtatgccatcctaatattggaatattgggcagatgctcctgaaatacagcgtgcatctgatatatacgaagatctaataaaatgctgtgtggctgatgcaatgagtgaggtagggctaacaccatccatttttcctgacttaagtcaccataatgttcagtattaattattaaatgcctgaaaatttgttttgatgttattcttgtgccgtgttgcaaatgcaggtccgtgcaactgcaagatcttgctataggatgttcaccaagacatggcctgagcgctcacgtcggctttttatgtcatttgatcctgcagtacaaagggtatacgattatacttttctgcatgtttttccttgtaaagaactaaagatcaatcaaacattcaaagcattcctcataaagtttaggttgacatcttaaagtgctatggaggttgacttacatgtgctattgccttgtgttgccagtttaggaaaataagaggaaacattagctctgtgtaccatgtacctatcatcatatacctaagtcaataactttttatacctttctttggatcttactgaaggaaagctccagatatccttttgtaatatcttctgctagtttatttaagaatatatgccaaattatcatattcttaatttgcaaatacaattctgtatttggctattgctgtaagctcttgtaaagcagtgttcagtgtatatcaattacccatcccatgcatctgcatgtagcaaataggatgtttcaagcttactagttcaaggcagaggagtattctctcaagatgagttgcacacaccaacgagttcacccgaaagcttaaccttatagaggaggttgggcaatgtacttatatttcaatactccccctcacgtggaggccccctcaggcctcgcttgtggaaccaaagtgggctgcaacagttcattgcgctctaatactacattgagtttcatgcaccatacattcacctagaaccttaagcttatggagaagggcgagcaattcattcatatttcaggttttcaacaagttgcttgtactagttagttgtgctaggtatcctgtgtaaattctttcaagcctaaccttgcagcatacgcatttgaaagaaatgatttttgtataatgaaaatcgaccaaattatgaatgaaaaattatattttgttacagaaaaatgatattctgaactaaaatagtatggttatttgactctgctattacacagtataactgtttgtttgatctgataaatgcaagcacttgcagataataaatgatgaagacgggggcctgcagaaacggtatccttctccatcattgcgtgagaagggtgtccaactttctcatgcttcatctcatgcaagtggtacacatttagccggatacagcacttcagctattgttgcgatggacaagagtgcagctatttcttctgaatcatctctttcgtcaagaagtcttctgtcgcagtcaaagaaaataggtagaactgctgaaagaagcatagagagcgttctcagttcaagtaaacaaaaggtttctgccattgaaagtttattgaagggtgtaagcggccggcaaaatttctcagctatgcgctcaacaagcttggatcttggtattctttaagctgcttaattggagtttgctctttcattatgtagtttaaaattcttagctattgctttccgacttatattataaatacttaagaaatctcaatttcttttttcttttcctcctagtgcaggagttgatcctccatcctctcgtgatcctcctatcccacttgctgcaactgcttcggaccatctgtctttgcagaattccatattgctggattcatccctgccaagcattaataacacaagaaatggtggttcacgcttggtagatacagtgaaccctcatgtggccaataaagagaggtcaaggtcaccatatttgagtagtctgtcgtctgaatcaatatcaggatcgtcactgccttatgcgagaagctcttctgggaggtctccatatggtagcactatggaagagagtaatgatacatggtcaaccaggcggatgccacaaatgcagatggacagacactatcttgatatgacctatagggatgccagccacagaaatttacacaatcaccaagttccacacttccagaggcctcttaggaagcaagtggcatcaaggacatctgcaagttcgagacacagttttgatgatggccatatctcatctaatgacatgtcgcgatacacagatggtccaacttctataagcgatgcactctctgggggtcttagtgcaagttcagactgggtagctagagttacagcctttaattttattcagacactactgcaacaaggacagaaaggcattcaagaagttatgcagaattttgaaaaggtcatgaagttatttttccgttatttggatgatcctcatcacaaagttgcacaggcagctttctctacacttgcagatattattccagcttgcaagaagcaatttgagagctatgttgaaagaattttaccgtatgtattttcaagacttattgatccaaaggaattagttaggcaaccatgttcatcaaccttggaagttgttggccgcacatatcccattgacacattgctacctgctctagtacgttcactggatgaacaaaggtctccaaaagcaaaactggctgttcttgagtttgctaataagtcattcagcaggtacaaagtagactcagaaggttatagtaacagtggctttcttaagctatggctttcaaagctagcacctttaatacatgaaaagaatgcaaagttgaaggaaacttccatttctggaatcatagcagtttattctcattttgactcaacagcggttctaaattttattttaaatttgtctattgaagaacaaaaccttgtgaggcgagcactgaagcaatatactcctcgtatcgaggtcgatctggtaaattacttgcagagcaaaaaagaacgttcacgtcccaaatcttatgaccaagttgattttggaaattcttctgaagatggttatgcactgacaccaaagagtagttatgcatttgggcggttttctgctagttcccttgataatgcatcagggaagaagatgaatatggttcatggatcaatattccttgatatttctactggccgaacatcctctgatgtcagcattgataatgttaagcaatgtttcaaacctgaagctgaagttcttgcaacaagtagggaatcaaagaacattgctcgcacagttgtagaagctgcacgttcatggacagactatcctggaaaatcagatgctaccattgatgatgaaaattctactggtactcctcgtctggagtttggtcgtcttgctgtttctgatggacgtggtgctgttatttcaacttctgtggaagacgctcaagagggaaatccacttgtggagcttagttctgtgaagattaccccacacaccagtaatggccctagcatcccacaacttattcatcaggtacgcctgaaatatctcctttttccatcaactttgttagtaatactggtatgtgttaattttaccttttatcatcgtatacataaatgctacttttttttttatgtttctagataagcaatgtcagtgaagttactagtctagacaagcgggaggcattacaacagttggttacagcttccaccaataatgacaactctatatggactaaggtttgcaaccttacctttataatttcactttaattttataagaaaaaaaagtttcaatactatagctttgtttcatatgttcttttgttcatgtgaacttttctctttaattgggttaaacagctgcagtaaatgttttaggccattcaattatatagttctgcatctcatgctgcattccttttgtgactactagtatgagaataaatgagagtttctggagagagagagcatagttctgtgaagggatggagggaaaaagaatagcaggataatgttacgtgttatgtgagggaactcaaactgtttccattatcccattgattatgaaatactgttatactactatagcttaaaacatcaccattctagaacaatttgcctgatttatcttgatgcagtggttgctgaaaatgatgaatgcttcaccgtttcagtaacagtgaaaagaacctttttgattgtcattgttctatgaactgttcattgtgagtgttgttctccagaatgcatagctacagtctgttactcttgcagcttagttgacaggttttcatcattttatgctgcctttgtattgatagtatctttatcctgatatgggtcctctgtctcaatagtatttcaatcaaattttaacaaccatccttgaggtgttggatgactcggattcttctatcagggagctttctctatcgttagttgctgagatgctccacaaccaggtacgctgtccgcaaactgcatgcatgttgggtaatctagctggtagcttattgattaataatgtattttatcattctcagaaagatcctatggaagaatccattgagattgtccttgaaaagctcctacatgtgaccaaggatgtcgtggcgaaggtaaactttcctcatttaggaagccctcttgcttctgggctaatccctttttaatgccggtgcaggtttcaaatgaagcaaaccagtgcttaaatgtcgtgttggcaaaatatgatccttttagatgccttgctgtatgtacagagctcccttttttgtataaaagagtatatattaatgcaacactacttgtttacacttcttgttactagcagcttatacttttctttatctttgtgcttgcactgcaggttattgtacctttgttggttagtgatgatgaaaagatgcttgtcgtgtgtaccaactgtttgacaaaggtatcttagttacacgctttaattatcattgatgcaacaccaactccaaagataattgaataaaaacatcagacaatgaggagaagtaattgacctacatttaatttgtaataactttatatgtctatattcgtaaattcaaattcaaaataatctcaaaattctagattcctgaagtgttactagtacaatgaggcagtcattaatggtatttttatctctaataaggcctgtcacaacttgaatatcttggcaactaccaactaccgagttgattactggtgtaccttatacaactatttcattgaagcttcgttgctggtttacttgtgaatgagattaagtaaatattttttatattacaagaaacatgttagcttgtagagctgttccatctcatactggaattttattgttcatacataccatactaaccttatttggttgctggttttctcctggtaattttgcagcttgttggacgcctatcagaggaggaattaatgactcaactgccttcatttttaccagcactttttgatgctttcaataaccagagtccagatgttcgcaaggtgctttgcttgttctttgacactagtaatatgcccgtgcattgcaatgggcccatactactgagaatgggttgtggattagcctaaagcatgcaatttttttaaccaattgtttttttttgtttttgtccggggaattttctatttttatgtgggagcacgcgctgcgtgcgaggggaggacggatgactccacttttatgtagtagagagttttcatagggatatgctagtaaagaaggcaatagactgatagttaacatgatagaaacatggtaggcatgtaaagaaggcaatagactgatagttaacatgatagaaacatgtaaagaaggcaatagactgatagttaacatgatagaaacatggtaggcatgtgatagactgatagtaaagaaataagtacggaatccatttatacaacaaaagtttacttcatacacaggaacagtatggcccatttgtagtcattcctaaaattatttaaactgatttatcatgattgtttaaattggatatatgaaaatgatatgtttgggtttgttcgaatattatttccattatattataatttaccatgctctatgttagtgccatagtgcattctctattttgagtttctaataatatgtccatgtttggtcactgtcaattgcactttaatcacaagtgaccatctgcctgctgtctaccattgttatctggattatgtatcaatatgttttagataattaaattcattccagcctttgcttcacagaagctacgtgtaataatatatgactatgtgcacgtttaatacatatcacctttaaaaaaatgaatgttttgtgtttggaatctgatatcgtattcactttcttccagactgttgtattctgcttggtggatatctacattatgcttgggaaagcatttgtaccatatctagaggggcttaatagcacgcagctgcgcctagtaacaatctatgcaaacaggatatcacaggcaaggtctggtgcaccgattgatgctaaccactagatcatattgttttgtgtatcatatgggtatctctttggatgagctggtttcattcattcgatctgtatataacagacagatgccgttcatgtattgagcagttggcttttcgtgtgtgtatgtattccttttatttttgtttccttttccccttgtgtgcagaggcattgagttatgcgttaacttgtactaccatcacactgtacaaagataacaggatgtagctgactgttttcccttgtttacctgaggggtttgttggtgggcatatccttgtgctgtaaacattgggtgtgccggaaacagagaatttgctcaacagatccttgaatggttttgcttactactccttccttccatgaatgtttgacgctgtttgacttttttaaataatgtttgacgccgttggcttttttaaacatgtttgaccgttcgtcttattaaaaaacttttgtgaaatatgtaaagctatatgtatacataaaagtatatttaacaatgaatcaaatggtagaaaaagaatcaataattgctgaaattttttgaataagacaaacagttatacatgtttaaaaaagtcaacaacatttagggaaggagggagtacatgtgaaattatcgttggagattagacctcgagattgtttgcaactgaaatgtatgcattccaagtgccaatccagatgctccaggtgacccggtcgagtctcctctacaatatttgtcatctaaagttggttactgatatgtggtgggtctgccggatatggggcttttatatgtggcagtactcccaaggtctcttgtgtttgctagatggtattggtagatatacaatgtcacgttctttgtcaatgctagtgctacatgcttacattcttcaaccgtattgatatcgttatgtaaaaaaaaagtttttgattgtttatgaatgtaaaatttagtttttctaatttttgcgggtatggtattgaagttgtcattaaatatactatatgaatataaaaaattcccaatcatacctgtactgttttcttaaaaaataataagagtaaattttacaaaactacacgttttttttatccaagttacagaaaaccacacactgacacttagcgtttaagtacatatattttggtagtgtagttttacaaaaccacactatcaatgaattgattcacctgtgatatggcgtggctgttccacttatgatgaggacatggcatcctattaccagccatcgcacaaaattaataggatgccatattctcgtcctaggtgtaacaaccacgtcatctcacaggtgaatccatttatttactaaaaaatatatatacttaagtgccaagtatcaaagtgtgtgtggttttttgcaacttgatcataaaacgtgcagttttgtgaaatttactcaaataataatgatgatttcgttttgacgttgtgaaatccctgggccctggcaccggacaagctaattctgtctccggtcgtcgtccctggaccgtgcacgtctgatcggacggctgagatgcgatcgacgtttttttaataaggctcgtggacgaatccgtaaggctgatactaacgcgaggaccaaacgagaaaattgccaaagggcgaaggcttttcctcgggttttggcgcgcaccgaccgaggcggcggcggaggcggtggcgatggatcgcctccggcgtcggaaccctaaaagtgtcccttccggctcctcttctatgaagcccccacggcccccgcgtggcccgtccttccaggccccagcggtgccgaggccccttccagagccctcctccccaggtatcgcccagctccatcggtggcgcttcttgtttctttctttcttggctttagggatctttttattgccggtgcatgatgcgagctaggttcgtggatcgaggtagaagtttctagtttctgggctggttgagttgggattgcgtgggattgggggttcgtgaatgaagtcgccgagttcaattaatccgcggttcaattctaaacaactcgcaatgcgattccttgcctcttgctgaatacaaaagagaggcgttcatggcttttatgtgtagatttgggatcatttcattggcaatttggtacgatttggtgttggtttaagatcgtgagccgctgatctccacttttaagtttttttaaaaaaaattaatctgccctttcaagaaaaatatttatttgttattagctatactgtttcggaattgatgagctttgatttctctataagtttctaataagcattttttttggggtgcctttgcttatagtcctcttgtagtctttgttaatttccagctaatttatccctaagtactatcatgttggttattgcaacctttattcaatgagattttctccagaaaattagtccgcatttctaatttgattaaatagttgagtatctaatgacaggtgggaggccaaggaaaagggttcgatttgctagtgaagccagcagtcatcagatatgcgtgagacaggatgctaacacaggcaaaagaccccaaggtacatttccatatggccctggcctcactgtaattcctttcttaacagtctggattttgataatcccctttaggtttcatgacgtatgaaaattctatcagaaggctacccatttccgtatcttcatgttgcgtgcttcggcttgcagggggattggtttgtctttcaaaatatattgtgggctccatgccattgtagtcttctcaatgttacagggtccttattttctcatccatattcccagttgtaataaccaaacagatctttctttgaggtgtggtgagttgcgcaatttccaagcatgaatcaatggtggatgaatgctacatatccctttgaagttcttttagtattttctgcaatgccatcagagggatgaagcatggaagcaccactctgtaaatattgctgttaaattgttgaggccatttgcttgttgttccttacgatagtgattttaatttacatttacatggttttctttgtgtttctatgtctttattctatttcacaatcattctccatgcaggttgtgatgcgaaaactactgaatacaaattctttaagaaattgtgggagcagtcaggctgtagacctcattctttctccaaacaaaacgaagaaaaacagatgggtttgtaactctgtatacatttccatagggtgtactatactcctgttctctttggcgctcttactaaatgacttgaaacagatcattcatatgtatcttatgtgatttttctgtgccttgtagaatcgcataatgtaatgccaggcagaaagctccctgcccagaagagcactttctcttctgaggagacccccgctacaccttgtaagaatgaagaaatctaccatgagcaagtcaatgcgaaagcttcccattctggttgaattcgttttctctgatctcctttagccatgaatgatgcagttttagactcttctaactattaattgtcttctctgcagaacatggcaataatgatacacctcagttgaacccacatgattacttgactgttcatgttcacacacccataactcaggtttcgtttgaagccgtaggaatttcaagaaacactggtgagacattttcatctttcaataagaaatacatagcatagtgactgactactatactgctgttgccggaaattgtcactatgatatatagacatttcctgtgtatggatgttaacttgttttagaaatgcactattttgtagggttatcattccatcataaataatggcgcccatggtagttgaggtttttcttatatacatatactctttgaatgaaaataacagaaattactatcaggcaaggcagtaatcctaggctctttgtattatttatgtttgttttcctcatgctgcctacgacacatcttttctgaagtgtgttggttgctgatatttggtctgcaaccgttggctgatacaagaacatgttactgattcaccatgcataaattagtattgcgagatacatatgattagaagtgttctcacagcaatttacgtctgctatatttatctaatgtgctaagctcatattcttttcacttttgatgatagacatagaaccttggagtggacggatcttttcagaaaagagaggaaaattattaaagctagctgcaaaaactatgtcaatggaaagttctgagtttttgcagagaaggttgacattacatattgaagaactcctttactttatattttcatgttgtccgataatggttggcctgatgacataaatttctcagatcagaattttttgctgacatcctgcaaaggctaggcgccaacagcatgataaaaaaggtatcctttgctgaacctatgtaatgcactatcacccactcaaaaatgtttgtctattatttacaagttccatgatttgatttgattttttttttttgctgtaatgtagcaccgtaaggagtccatgagaatgatgaaggtctgtggccatactcctactggcaccggatgccattttgaaaatatgcttgattacaggattagtgactttgatttgcgaactaaactgagaacagaaaaagagtcatcctcttatgcaacccaggaatcccgtcaattcatggctttgccatggggatacaatcagggcccttcaggttctcttgattggaaaattgatttacctcacaggggcaatgaagcacgtgagagcatggcattaccatgggtgcacactgtgggtcttccaaattctggttggaaaagagacactgctcacaaccaggtttctaatttgttgctagaggatgtccaaccacactccgaaggcaaactggcttcagctactgagttgaactgtaatgttgaaccaaggccatgcacttatcatggatgggtgcctatgttgtcacaaggattctctggatccattccaaatagatttttcaccccctgtcagattgaggagacacatgtggtaccatatgaaatatcaaacacttaccggcgacctgacccttgtaaccccttggaacaatgttttcctccagttggattggataggcaaggccaaaagcaggcaagattctctcataattatggtgctgaacttctagagcaatttacttctagttcagttggactggaaaggcaagaccaacatgggtcagaattagttaattttgacactggacttctatctagctttgatcagttatatgcaaaatgttctgcttcaagctttttggacactagaaatggaattctcaatcacagtgattttagctatatctccaacttagctgcaagtgagagcaacgatattgtgtcgaatgcaagcatgagttgtctgaattccatattttcaacttcagagcatccttttcaattgggctcaaagaggttgcatgaaacttctttggctggactggaggagaaatattcgaaggaggcagagatttttgataattctgatattgggcctatacaggaattggatcagttacctgcgaaatta

SEQ ID NO: 60140 - DNA, 542 bp, Oryza sativa
gatatagagggttggtagcaatactgggcagaaaagcaagaagaatatccagaactaagaattgacaattcacgaccccatttgttcatgctttgatgcagattgtacaaatcattcaattgttgctgagagcctgagacacttccatcaatagcttcctcaattacatcatactcccttattgatactctttcaagggaaccagatgaactgagcagccttctaaagtttcccaagcggatgtttagtccttattactttaagttcactcttcactaccagccaaccaaattattactccctccattccataatgatcagcgcataacgaaagtggagatattccgatttgatcagcatattaacgctggtagcatgtgcatgttggatggattaactagttatcacggagatcgagtaggccatgcgattttcgagctgcatgcagcatggaacattccttgcctgtgcaatcatgcaccggcagtaacgtcgtttcgtttctccaagccgattaatatggagattaattacaaggatta

SEQ ID NO: 60141 - DNA, 835 bp, Oryza sativa
tacagatgattcctgacaaatatatgagcagaacttttatgcgaagtgttaaggcagagaagagaaaaagagtcattgacagtgaacattacctttagaactatcaaattgctagcatcaagtaacgatgttgcaactattgaatctccaccaccatcaattaacattttggagttccacataagaagcatctttacagacattctcaaggcaccaaacacctgaaaacaattcatattggtgcatagaaattggcatgcgtttagcacatatagtaaggtgaataccataaaacaacacaatacatggcaagaacaaatagtaaaataacaccttgattgttgagtcactcataagaagctcctcagccatcaattcaaactccgagtatggataacgggtcaaaccaaaagttagaatagcaccggatagaagactaagttgcccttggacctgaaagtataaataaaaagttgcggactatcgttaaatattgcgcaaagcaatattgacaagcattttcctaattatcaggtaatggcaactcccacatttgcataatgtacgtgaaggaagtgcagtgcaaaataatggaaactgtaagaaatatgtgacttgccaaaatgcagagacagcctcaaactcagaaaaagaacatgtatagaccttactgattgagtgtaaattatcatactgtaccagtggcagacgcagctataaaataaagatgggggcaaaaattctcgataaagataataaaacgcaacatatactgtaccatatttatattgtaattgtattaaaaaaacatattacagtcaataaactaaggcac

SEQ ID NO: 60142 - DNA, 677 bp, Oryza sativa
attgaaattggaacgatgtgatgaaaaaattggaagtttgtgtgtgtaggaaagttttgatgtgtttgaaaagttagaagtttgaaaaaaaaagttggaaactaaaccagtttaaaaatgcctaaaatttattgattgatggataatttgattttatgatagctgtttgagggtataaaaaataaattaaccactaaagagcagaaaggttgtttttaaaaggtatttcaagaaaaaaattatatataatttatttaaaaacacaccgtttagaggcgaagcgtgcaaatgaaaatgagcatctcaaaatcagaaaagaacgggccttaatgctgcctacaaatcaaatgggtggaatattgcatcataacttgcaattaacgctaattaaatacacttttttctctaacaaacttaagcaccaggtggtggtttgatgcctgaagaggaagacatctagaaagtcatcacgttttttgcagatacattcatgtattattaccttcttttttcaccatttctttgccttattataaactggatataatttgctttttgtttctagtgccaaaaaatgctttatttccctttgtcaataagtgtgttgtctctccaaataattgaaactttttggtaaaggctcttagcaattgacaggtaatagtacacaagtactg

SEQ ID NO: 60143 - DNA, 2697 bp, Oryza sativa
ggcggcggcgatccatcgatcccctcctcgctcccgcgcgcgggcgcgttgacgtaaccacctcgtcctcatcatcatcctctcccgcctcgccggctctcccatctcctataaattccgatgataataccatctcctgatcagttcaattttgtcataatcggctgcttcttcgcttcaattctgtgttggtagcaggcgacgctcggtgtcttagttcatggctcggagggatcagctggtctctttcctctgcttcttcctgatcgtctctgccgtcgccggcggcttgtgcgtctcggccaccgtgctcccgatgcgggtggggaagcagtacgtcgtcggcggccgtagcgggtggaggacgccgccgccggctagcgtcgacttgtacgccaagtgggccgccggcatccgcttctacgtcgccgactccattggtaaggcccccaagctagctataaaacaattcgaacatcgaagaatttgttcttgattcaattcatccatcgatttcatgctgcaaatcgaagagttcgtgtacaagaacgattccgtggtgaaggtggacaagttcgggtactaccactgcaacgcgacggcggcggcggccaacgacggcagcgtgctcttcctcctcgacgcccccggcttcgcctacttctccagcgccgacgccgatcactgcaagaagggccagcgcctcatgatcaacgtcgactccgccccgtcgccggcgcccgccccggcggcgtcgcccatcgcgaaacctcctgccgccgtgactgcggtcacgccaccgccgccgccaacggcgccgttaggctctgcttccccgagccctgcgccctagaagccgcatctggaagcgcctaaacctccgcttagggggggacatgctgctcacgcattgctcctggcctcgatggccatgatgggcttgattcttgcagagtggtagtaacaacagagtttgcattgagctaggccatcagggtgttagttaattaggatggttaattacttcggtgcagtatggaacgtactggctggagcttaattaccgtcgctgaactgaataatttcgatgtgaattagacgattagttgttgatttgtcgctttagaatcgaagaagaaattaagatctctccattttcatgcaaatttctgatttgtgggaagagcttgttgtttcggttcattatacacaccacgtgtcatcaacatctgcaccgtgtgtagggtgaaaacgggcatctcctaggaaacgaagctcgatcgaccggtaattgattatatatatttattatttaaactacttagtgtcgacattaatatgatgcacaaaaaattagaaaaaacaaaatttataaatagataaaaaacgatatggtcggaaactgtactccatatacgaaaaaggcgttttggtcgatcaggaattttcgtgaccgctttcaccctactgtgcggtatgaaaatgccttacccgcatgcagtctatgctagtggtaccaactgatgactaaactaggtcccgatcttttcataggtattgataattctcgatttggaggaaacttgacacatacgatccgacttccgatcaacacttcaaaccctgcaagcgcagcaccacgtctattctagttatcaaccgtgtcaaaacccggttgacctcaccgagaagactaatgactgcatgtgaatcgaagaatacaagcaagaataaagtatagcaactcaattgcatataaataattaagaactcgaatttagggttccacaaaccaaacaagcggcaaaactgcaatggcagaaataatctaagcaaaacccaattctaaattatgacggctactaaataaatataatttaggacgtcgtagggttgctctaggatgcacgctcccttgggcttagcccacgacacaattgcaaagtccaagacccaaatcaaattcgaactggacgaggtacgtggcttgatttgtagattcctgacaagttggtgggaatcttgaagtgtgaccaaaaaccatctgaaagtagactccataagttttctaataaatactcatgggcccggagattccttctagatcagtggctagttccgtttgaagttgacgttgtcaggagtcccgaatccaaatctaaaacatgtagaaatttatctcttatcttatatggaccaaaagtgacgtgatgaggtagaagtggacttggagaaggtgttgatttggtcccaaattaactttttgatcatccatgcattccttatgattggtctcttttccttcacccatataagtacctctctaaacaaaaatatacgaaactcattgtgtagcaatgtttgttcaaatatataacaagtacatctactatagaccatatgtacccttagttgataaatacataaggtagccatgatcatatttgagctagttgtatcctcgtcaacttggacatgggcttgaatcaaaggtagaaacaactggaatggtgcacatataaaaagaacgcacaaatgtctatgttttctttaataatggaattaaatctggcctttgctttaatgaaaatacaaccaattattatagtattctcttaaaaaaagcaaacactcaagaaaaaaataacttaaataataaagccaacacataaggagtaaataattattgaaatctat

SEQ ID NO: 60144 - DNA, 2313 bp, Oryza sativa
cacaccctacccctacgagcacctctggaagactgagctggcatatctttagattgacgaagttaccacatgtgtctcgctgttgaaaggtacgtcgcctgctactaaaaaaataattaatcgtaaatatgatcactcttgtcaaatcttgaatttgaacctgggtgggctggttccaccacaaggaacttaagtagctgagctacgctcatttcacattaatttttttgttcgatggtaataagcgttgttaactcattaattgtacggcatttgcaggctatattaaatcgcccgattgaaatggtgcaactttgaagatgcatgtatggctattacaatagtgcttgattttgatgcaaaatactactagcatgagtagggtgttcgtgagaaagaaaatagatgaaaaaaatggcaaataataatgatagattaggttggtatcttgaccatgttttttcggagcatatggatagttggtgtcagggtatacgtgagattgaggtaaaagaaagacatgaatttttatacaggttcgtcctcccgcttactgataggtaataaccctattgttattggctgaagtctgtattgcctttatagatcaatatcacacgagtacaatatatgagatgacctagtttgtcgctgtcgacctagcatcatcgctgtcgacagtgtagtgatctttttccttgaatatgaactcaacgagattggagatgtttctagatctctcatgtcagcctctctggctcatacattgggtttgtctatatttgtattggcttgtcttttgacttggcatgtcccctgatttcctcctagggggtcttgtattcatactctgggtgtcccattatacaagtagaactagggaaacaagtatggatacgatccgagtagttcctgtagtgtccgaatagaactttgtttgtccttccttatctagaacatcttccgtatatgaggcatgatttcgtatacgacttggtacatgatgggtcccaccgagtcttaatacaagagtattgggtatgttttatctataacaccgatagtcggctccaagcatccattgcacactaatgccagagataattaaggaattgatagactagctagctaggggatgtctggatacgtttttgttgcacacagcgatgtatgaaccgttctagaacgctttaatttattaagaaatcatgcaaaaactaataaatatttgtattagttggaaattcgccttatagcttcactactacagaaaaagggatcggtgctagttaaaaacttgtcataggtgccagattttctaactgtcatctagtaggcaatacctttgaggaagactcaaaggtgtaggttctaagaatgaaaaaaagaaaagcaaaaatcccggcttggtgcatcgcttcgaatcgagccaatacatcaaacagctctccatcatcactgagatcaacatcatctccatcaaccaaacacaatgatatcaccgtcatcctatcaaccaaacacgatcacaaactcaacaaaatcacaaatacaaatacatagaaaacgacattgtcatcatcgtcgatcccgcctcccccgtaagcacaacagtgatccggtcgcctccgtcgtcgtggcggcgtcggtcggatggagaagaggaggaggaatgaggggaggcgacggttaaggaggaggagtgacggatctagaaagaggaggagggaggaaaaaggaggagcggcggcgagggctaaggaggaggaggaggaatcccttcttacgactataaagttatcacacggagttctggacaagctctcgtcatcattgaattgcatgatgtatgatcgctgaccattcacatgatgtcacactcgagcacatgaccaataatttatcacggacctcctgttctttcagaaactgtactcccgcttcttttgcaggtcatatcactcgcaaacgccagtgaagcaactcccattagttacaagcagtgcgtgcgtgcattatcacaagctcttgggctgatgcacaattaatgtgggaaggtaaggaataaatgaagttgtacaattatatcctacctcttccgttccataatataaaggattttaacttgttacttgtactgtttgactattcgttttattcaaaaaattttagaaatattttttttgatcgacttactttattatccaaagtactttaagcataaatttttttttatatttgcacaaattttttgaataagacgagtgatcaaacagtgcatgaaaaagtcaaaatcttatgggctgcaggaat

SEQ ID NO: 60145 - DNA, 1255 bp, Oryza sativa
atgataagtagaattgcttatccttggtctgtgtgccaagatgaaatatatatgactatcaaaagtagatggagagagtatatcctagcaatttgaatatgaatatgtttcttgtctagattcgtaatcctagaatacgtctctaccacccaaaatcttttatatttttggacaaacggggtataaactagttaagtccaatatattattacttgcttcgatttgataattcttacgtttgaacaaggttaagatcaaatttttataacttttactttcaataagtttaaaaatatttagtttaatgcatagaccatcatatacagatttgtattgtaaagtactaagtaaaagtaaaagtaaaaatgtatttattgattgtatatattataatagaaaaacttagttaaagatatattttgaagatcgtgtcattgtaaaaaatatcaggaattatggaattggaagaagtaagtttttaataattatttaaacaacatataaaaacgatgcgacggtatctgcataaagacgaaattacttctgcgagagcattcccatttgatttgttcagcttattactgccatagccagccacctgtgccatgccaatcaatcgatcactacttgtccttctcttgcagatcgaattaatgaactactccaatcaaagtctaatagcaccatttaatttgacagcaactagctagctagtgacagtctgacagagcagcttcagtttcagttgtcttgttttacccacgtacacgtacacacgttcttggctgggagcaatccatgcatcatgcatgcatgtgtacgtacctacttactccctccttcttaaatataaatatgtgacgctgttaacttttttaaacatgtttgactgttcgtcttattcaaaaacttttatgaaatgtgtaaaacaatatgtatacatcaaagtatatttaacaataaattaaatgataggaaaagaattaataattacttaaattttttttaataagatgaacggtcaaacatgtctaaaaaaaagtcaacggcgtcaaatattttgggatggagggagtacatacggagtacagtagtatacatacgtcgtttagcaaccgttccatcatgaacatgcttgagttgagcttcgtgaaccacatgttttaattaagctttctctggcttgtgtcatgccatgatttggtacgctcttgttggttgggagttggaacaacctagatagataggtcttttt

SEQ ID NO: 60146 - DNA, 3238 bp, Oryza sativa
agtgaccatattaagtgctcaaatgtgaatttccccaaattttattattgtccaatttttaaatatatatcctagatttttataatttcctatatttgggattttggtatttatctgttttcacacatattggtttatctttttggattggttttaccaccacatggatttctataatttagcatttgtgattcaattcaaattatataatatctaattattttttcccagtaaaactattctatagatagagttccatttatttgaatgattatcatttcctaagtgtttatatttcatggcacacatcacatggttcaagtatttaatatttgatccataaattaaattggtaattaaccttccctttgtctggctttgttttctcgtgcgtaaatatttatagagttcataataaatatcttatttttataattgttactcagttgtatagctttagcttaattttcagtggtgacaatttatagtttggcaagcaatagcaaccataagatccagcatgatgcaaaagttttaaaaagttcaaaattttagtgatttttttattgtcttgaattttcaggatgttacaaacctaccccccttaaaggaatctcgtccccgagatttagtgggactacggtgtcattaaactagttcgactaaaatattgtttgatagacagacatgctaatcgaatgtaggaaatccagggtcttcgtggcttccggacgtcatgagttgatgagcgaagcgaagcgacactctttgtacttccgctgtcttggtcagcaacggacttagttggcagtcttgtggcacatgatccgtcttttcgcaaaggaagcacgcgatcttcgttgtagggcattctccattttgatggtcttcgtcacagtaggggcattgagtaacgcaattactaccgtagtgtcctatctctccgcaacgactatatgccttaatcttcgaaacttctttggatgggtctgaaactctatgctcttccgggctgatctgtgaaggcagtgtttcttgttcttcattggtgtcttgagtacagcctatcgcataatgtccaaattgtccacaagaaaaacaacagccatctctctttcgttgccatagttgtagctcttcaacttcttcaggcaaatcaccgatttctattcccattttactgagatcaagttcagcatatgttattagtgatgacgcttttcttttccgttttcccttccaccaatgtggtgtagttccttgtctacgaaattgctgatacataggttttggatagggtgaatgtggcatcggttttggtggtatttctgccctcattttcctttttgggtgtcagggtatattccttacttgtccatttcctagctttttcttagggcaatccaaggcacaatgtccttcctcgccacatctataacacgtgacatttatccttcgttttgctggagtcaggtggcacctttcattcgaagaatattgctttaggtgattcagattgatggtgtagtcttcaggctttagtgaggcttggactcgtcctttgttcttggaagcttggggaggatcttcaaggagtagcatgggctggtttattcccatattttgggggtcttgtagcttggaggagttcttgtttctcgatgtctattggtccatgtcttcacgtcctgtggtaggttcttcttgttagaagttagtaggttgaaagttagtaaactactatactaggcatcaatagtagcatgacaatgctgcattgttgtttttcttcatcatttgttcaatccttcgttccttaatatttattatgaatcttgccgtcgagggttgaggttacaccctttgcagttttactatccaatgatacttcaaattccttgtacaagggcgaatataccttgatatatagtattccttgtccatattttcccacaagttattgatttcctcgaggtttttccatcataggctaccccccttaaaataagaaattttgaaagcaatttaaaaggagatatgcttttgcgttcacaaagtagattttttttttatcaaaatgattttgcacaaatatcctttggaagtgatgtttgcaaaacatttgaaatttccaagagatacattttcttaccaaatataatttgaaaatagattttttttttcaggcaagattttgtataatcacacatgtgtttaacaaaaagcaacatggcaactaaaaacttttgtaatcaatttttctttgaaaacaacatttgattttatttcgcaaaagaaaactcttgcccatagggccaaaataccatatagattgtatgcatggttcaaagttgaaacaacaatacttttgaacacctcaaagaaaaactcatgaaaaaaatttttttttttactattattattattattattattattattattattattattatttttaaacaaagctttaggcaaataattattggaattcagcttggaaaaccttttgaaaggaggctttcgaagacatgcactgaaaatttggttttgaatgaagttttattttggaaaactttgcaatacattatttggaatcacaatttcacaaataattttcagagaaaattttcttttcaagctaattttgaccattcccaaaatttaatataagttcagagcggctttggggacaattttgcaattaaatagtttgaaacaaacatttcctttctttttgaagcaatctttcttcgtaagactatatttcaaagtgcaaaaattcatttgtttttcaatattttctaaagacaactcataaaacaaagttttaaggggattaaatccatataagtttgacttgtccttggaattttgaagcaaccctagaactaaaatccaataaattccactctcgttcatccttcgcccatgtactattattcaaaacatggctccttttattaaatttccatatatgcataccatcttatgttccttttcgatccataatattccgatccttatatgtttatggaaacaacttagcaatcttacatggctttctcatggataagcagtctgtttctcttctctttattgtccttcatgatactcccatgtcgcagatcgagcttctatggtcactaacggcttagtcgagacttcacttctactatacgagtgtgtgactagaggaaactagtactaacaacaatgagttatcatgattgatgag

SEQ ID NO: 60147 - DNA, 1531 bp, Oryza sativa
  unsure (1)..(1531): unsure at all n locations
aaactctaaccttaacttatacttttacatatttataccaaaattttgaataagatgaactagcaaacgttatgtgcaaaaagtcaacatatcatatataaaaaaacgacgaaggttgtattttttttaaagttaactagctacacaagagaacatatctggtgancccttaaaatcaggtcgaaaagttttgtaaattaataaaaaaattaatagagatggatgtaggcatggaatacattcttacttcaaactcaattttatttgagagtaaaaaagaaacaaatttcggctaaatattaccatgacactattcacctaaaatttgtccttttctcttaaatgacgttgactttatactccgctaccaaagatttttgctgatgccaacctatttttttttaagcagacaaagtaaaaaacttgtgaaactgaagtcggaggtccaggttagtaaaccgcttgcaaaaatatatttctacaagcggtcatcttaaaagggctacttgtcaaaataacgctacatatgggatatacttgtatactaaactcgacggggcccaccatatacaaaggtctctacggaatcgagcctgaaacgttgttgacaagaaatccgcgctcagccaatggtgcccgaactgtgttggcgcgaactaagtcaatgaacacaacggcctgggagatctgcttagctccattgcaggtccaaatacgatgagatgcgggcgtaccagtcagtttgattctgcaactgacgagatatatatatagcagatgaaagagccaatcggctgacaagccgatggagtagttccagcctatgctgataccagccgataacgataggatttgagctattggctaaatgtttaatgtagagtctgacacgatgtaaataatgatatgaagacaatccgctgatgataacaatagaataatctagtagaaaccaatcggctaacaatataatagaataaacactaatccgatggttaaagcatacatcggctggagatccgatgtcataaaatctaaatgattagataaacagtgaaacctttgttgccattggctaaatccaacttgcatgttatccttataaaccgatgcaacgtcctgataacttaccggctgaaaccctgatgaaacccttattggcaaccaagaagaagactagagattatggttctaagcacgacttagtagatcaaacttaactgatgcagcactaagtatgaaaagaaacataatatctagacaatcaagcccttgactgattttcagggtagtggatatcttagctaatctagtctggtaaagcgatttagccgatactggcataaaccttaaagcgaatctcagccgatacaagtaaatagagctaccaaactagattaactaagatatatgataaatcggtaggcaaatatattaaccaaaccagagcaatccaggaggtcgaatgtactgatgtagcctttgatgctgccaatgtagccgatacaattgtctgggccggtggaacgta

SEQ ID NO: 60148 - DNA, 1754 bp, Oryza sativa
atgtcgccaagaagcgcaacctgcaaatggggagcaagagctcatcggacgatagggaaacagatgaagaagggagcaggagaaggctcgccggcgcgtaccggagatccgcgagacgtcgccggagatcccctttccgagtcgccgtcgccgccgccgccggcggatatgggtgctggggttttagagggggagggcaaacatgcagcgaacaccctgtgtttcgtggaaataacaagatgtttctacattctttttttttataaaattagtttttctttcgtttcaaaatatcaagataaagttttattttccagtcgacctaagctactccctcctgtgatctgtcaaaggattctatgatatttctacatttcttgtagaataccccttcgtatttgatttttttcaactcattgtttttaagttcgatcaaatttatagaaaaacataactacattttcaacacaaagaaaaatatataaaatttggtgttgtagatgttggtaatttttttaataaatctgatcaaacttaaaaagaatttgatcagaaaaaaaagtcaaaataatttatatagaaaatgaatggagtatcatgtagaggaatatgctgtgttcagcaaaacagtttgggaactaatccttgcgcatgcagagtgactcattagcacatggttataactactagcttaataaacttaaaaaatagattaatatattttttcaagcaacctttctgcgtatatatatattttttaaaaaaaacacacgtttaatagtttaggaaacgtgtgcgcagaaaatgagacgtggaagttgggaaatgggataaaaggactcgcctcaagtgaatacagttttttttttttgaaaggaaaggtggatacagtttagccgtgtattttttcaaactaagtcgttagtagcatactctttgttggttgttaattctatagcttacaaacaaagttaggtgttatattgtgattaatgtgacagtttgttaatattcacagtttgttaatattgcctctcttaacgtgcataagcgaattcatttttgagaattttgaaatttttagcttggttttccgccacatattcttagaaaaaatgttcttgatacataaatggatccattgtttgagggtttgaggctggttgggacgtactctgatttgtagattgtaccaatttgttcacacgtttttgttgatgtgttaagagcaggtacaatagcagactcaggctattagtcagctataaatatattttaatgagataaacgatgagagagaagaacatcgggctacagatctatagttagctgcagcacagactacaaaacacaatgtgtgtatgacaggtgagaccatatattaatagtatagtaagcagccattgtatgaattggctattagattggctatagatgaattggagctagtagtaggctatactattaaacttgctctaatacctgcaaattaaaatggagaaagcaatatttgagtttcaaaaaaaatgaattgatattttttgttgatgtttttttactagcaccggcaattgaccaaggttcctacaaattttcatgcaatgtatgtttccttttagcctacaacttgcatgcagactgtaattgctcaaatgacggcctggtgtataatgtctgaagtttccatcagtgattgatccagaatatcatttcagcagatgaaagcctaactagattttctcctattgagtcgg

SEQ ID NO: 60149 - DNA, 10609 bp, Oryza sativa
cataaatatatttatgtctataaacagtgagcttgctatgcttatggatgattcatgttgaggatacaatgtaccgatgttaagcaccgtccctttttgtttaaggcagtgcctcgtattcatgtaatgagggagaaatgtgtaatacagacaagttccatgaggattcgtttgaaagatgcggatatgtgatcatgtgtataattgtttactgacaaaggagacctagggtctcgtgtcagaggaactatattctaacctcgagttaataaccaacctgtggatggaaaagaaaaacaattaaactgtgttgggttaaaaagccaacgagacagtagttgaggataggagtttggatacgccttttacagatcaagataaggattgttggaggaaacccctaagggtacccgccatgcctctacattgataagatcggatatacctgccaacagataaggagatccaggagacatcaatatttgagaacataatagtcgatggttggtaattagtttatctggtatcagaaaaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagcttttgacgaaccacatcaaggtttcactgaaaggcagcaagccaaaggacctcatcatccccagaagcgttcgcaatccacattaaagaataccacctgttagagataagccgaaagaagattgataaaagagattggcaaagatgttctctagcatgaaagaagtaggccgaaaggtgattgataaacagaaacatgctctgcatcgctcacggaagacccctgattgtaattgccccgcaacagtcaccttgtcattaagtaagcgagatgacctaggtagaagtgtttctatgaagacaaggagtgaaattttcagctcggtatcggatgctacacggagtgaaaagtgcaagcaccggttaccaggtaatgccatgtcctgggaggtgatccaacgggaaagaactcatcaaggttaaaggtgtaaaggaatacgttgagtgctaactgaggacaacctgaagataataacgggaagtaaactgaatgtaaagaaagtgaatccgagctgcttgttcgtgggaactattcccagttatgaaccaagtgatatgttcgaagatagtctatagaggtcagattaaaatcacctctcacaacgaagcttcagatctggcaggatcacgatcagacaataaggagtccagcagtaaaactatttgggaagacgtcaaagtatatcaagtgggataagctggttctcttgggaagcataattcaaaggcaaagctatcgacccttgcatcaaatagcagaagtagctatcacccggagacccggaaagctaatatgaggcagttggtggcgagttagaagcaaatgacaagcatggtatcttagtaatgacgagctgatctcgacgcatgacatgaagttgataacttgtatgaggttgactccaaagatatgaactatgcgaagttctggaactgaagccccatcttcaagcgccgcaacccagtcgaagtcagctaaaggttcaaccctggttcgagtcaggtgaaaagaagattccacctgcaacaggaggtcaagccaagcagttccgagtggtgaagttttgctgaaagtttgtgaagacggagcggaagaagtcaatcaagaagagaagaccgcccaacctatcttcttgctagcctcctcgaatctcggggacgagattcttgtaaggggggtggatttgtcacgtcctgataaattcatcccgaaataaaaatcattttccaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattattaagaaataaacaaagttaaaaaggatttataaaaagaaaaaccctaaaagaagtccttttccccccttcccttcttgggccggctcggcccaattccctccctctctctcctctccccgcggcccatcggcctcctccccgcgcgcgcgccgctgacaggcgggcccgcccgccaccctcgctgacgggtggggcccacctgtcatcccccacctcgcgccgcgcccgccgcccgcccgtgccctagcgccgccgccgccgccgaatccgccgcatcccgccgtccccgcgcgcattaaagtggggggaattattccccgcgattccctctcccgtttcccccgctttcccctctctctctccctcggattcgtccgattttattcccgcaatcctcgccggcgtcattgatggagccgagatctccgcggccgattcctccccctccggccgctttctccccctcccggtgctatataattgttccccgtgcctctctcctccgtttccgccgctcgccgctcgctctccccgtcggattcgtgctcgcgccgtcgtcctctctctccaccgtcgccgccgagcttcggttcgccgtcgtcgtcgcctcggacttcctcccgtctcggcgtcacctccttcggcttcgccgcgtcgtcgtcgacctcgtccgctcctccgtttcgcccgccgaccgccggagcaccgtcgtcctcgccgtcccgagccgcgccgccgtcttcctccgctccggtcgtcgtttccgccgtcctcgtcgacccggggtgagccgaggaccgctcctttcgcttcccccttccctcctctctctcgggcgccgctccgccgcgccgttggtcgccggcggcgaccatcggggcgtgggtgcgccgccttccgtcggccgtgccggcgaggccgccttcgggcgcgccccgcggctgccaggtgggcccggccgtcagccgcccgcgcccgcgggtgcggctgacgcgtgggacccacggcgccggccggcgtcagccgcgtgcacctggtccaccgtggaccgaggggctgacgcgtgggccccactcccgtggacccggtccgcgcgccctctctcccggctgacgcaataattcgtttttaaattaaaatttaaatgaagaaattcgcaaatatctatttaaagagcatataaacttcaaatggccatatcttggccatttgaactcggaattggaccgttcaagtctctaatttttccttaagaagtcaagaacccatttttgtgctttatttctgctgttttatggagtttagtagagtaaaagccttttcttttccgttggtcgtgtagacgctgcagcttcggaagattcgctcttcgtggaagtagaagccgacgtttgggaaagcgagcaaggcaagtcacatcatccttgaacatattgaatcccagtttatcaaattattttgatttaaattactgcattattgctttatttaaattcccgcgttatcactgttttatttagccatgcctatttacctttgttatgaccttattattattgttattgttattattaccttgttcaccctagaataaacaaaactccaactagtgggtactctattcgtggttccactagtataaatttaggtagatgcttcgctgattaattaggcaacattaggtgattttataactttagactttgggaattctcatatcatttggacactatggaattgttggattatggtggaattggacatacacctctcttcctctttcaaaacccctaaaacctgttttcggtggggtttgggtgcatgccagttgtgggaagtagcaccccggccactataaggattaagctcgggcctctgttgcaaagcactaccgtactaaccacatgtttaatgggtaaggcttaactcggtgctcaggctagtcctgaacaaaaggacacggatagagatggatgaagtcgttgcgacgatggatatctctgaggcaaatgaaggctacgcgagctgcggctcggtaatcgagatgtctaggcaaatgaagactacacgggtcggtgcccgttagtcgagatgccatggcactggactagtacgcgggtggtctcacccctatgagtgtggcgcacccggtctagatcttgttgctaggggctcaaccctggcctgcctgtcccgggataccggccgtaggcagggttgggtcggtacttttgttcacggctaggatgggtgaagggttatgtcacatgtttacgacgggttccaaggccatggaatgcggagtaaagatgtgtcttgtgggtaaagatgtacacctctgatcagagtaaatctattcgaatagccgagccctcggatatgggcaagcctagcaatgtacccaagtcagtgttttaattcttaaaatttgctcagcaactaaaatgtggaatggttggcctgggttggcttgggacgagctgggacccaggtcgggttgccagttcggtctgaatcatcgtaggccttgggttaaggcaggttcgtgtgggtccacggccttgattaataatattgtgtagctctaggatcgtctttataaaataactttgggcaactaagtgacttttaaatgctgtttactgcaaaacctaacccctattattatccccttgtaccccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgcctttcgtatcatgtttgtgtggtgtaccccggcttttcctgggacggggattaatacactagcgttcgggaaaaggaaattttcccggtcgcgacaactataaatcaggacagttgtgctaagttcttatattttgggacggagaaagtaaaaaataatttgtaagtaaaacctttatatgcatgcctttaacaattgaaaaatcaaatgctataaaataaactgcaatgagcaaaccacaaaatcaacttcaaaactaagttttaaaatttaaattttggtttatgagtataagtaaaacgatgatgctcctaatacgacgagagaagcataggacctttttttttaattaaaactgatgcagaggacttccatgcaccttgttgctagtcagccagccaggtgtttcttcatcagttccttctgaatgcagcaaacaactgccattgctctgtttgaagctcaagttcaggctgatgttgttgcaagcagtttctatggtattcacatgaaactttttcagatttcttctatttaacgactcaagcatttcacaagatgaacatgtaaagtatgttgccacttcctccaaatgctttggtacggaaacgcacgcactttccacttgattttgccaaatgccaagcatcacatcttaatgttgtcagaactgacacaacaaactcaaactcttaagaaacaaaataaacggctgttttcacatcctcaaactttcagatacctacacataaaggcattcagaggtagtgtgacacaatgtttttttcttggcaccggccatcaggcagagagcagagtttggaagataatgcacgagacaatatgttgggggaacactactagcaccacaaagtaaactgatatgcgtataaatcaaatactcctacaaggtaagccgcgcagcaggcaaaattgcttgcaaaatcaaagaattttttatgatgtaatggtctcagccaaaccattcacttcccccttaattccattctccggtttccgaagagtatatctccaccccaacaacataatcacaatcatccatcacaaactcaaagacatggaaatgcgaggggaacaccactattagcaagaagatagaggggaactgtttcaaaggtgcttactcaaagtgacaaattttaagttccaaagtggcaaagtctcgatccatgtcaactactccaaaaaaaatggtcttacttcactatagtatatcatgtacttccatgtcattgtttcatgtgcatcaaatttactaattactagtattgtcaaaagctcgcagaagtagaaatatgatgaggaaagcaaaaaaatataggcattcattgaaatgtaggtgctgtttggattgagaaatgagataagtgtcacgactggaaataacccaacgggcgttccttacgtgcgtgcattattccttgtcccaggaggcaaggtacaccaaaagttgatacaatttagagtttaacaagcggaagcgtaattaatttattacatgggcggcgaagacccagcacacaagaagacaaacgaaaaacagcggaagactagggcgacgactacaggcgcttgacggcaggcacgagctagacaccaaagccttcatcatccaggggctcctcttctgggtttgggaaaaattgagcaagactgagtacaaccaccgtactcaacaagacacacccacaagtgcagaataaatgcaagggagtacaagggagccataatatagggggttagggtttgcagtaaacagcattaaaagtcacttagttgctcaaagctactttgtaaacacggtcctagagctatacaatattattaaccaaggccgtgaacccacacgaacctgccttaacccaaggcctacgatgattcagaccgaactggcaatccgaccctgggtcccagctcgtcccaagccaaccgaggccaaccattccacattttagctgttaggcaggttttaagagttaaaacactaacttgggtatattgctcggcttgcccataaccgagggcgcgactatttaaaaagggtttattgcgtcagccgaggggagggggcgcgcggaccgggtccatgggagtggggcccacgcggcagcctcacggtccacggtggaccgggcgcacccgggctcgcaccggtcggcgcccggggccccacgttgtagccgcacccgagggcgcgggcggctgactggcgggccccacgcggcggttactctgggcgcccgaatgcgggcacttcgcgtggcccgcgggaggcggcgcccgcgcccctatggtcgccagcggcggccataggcacggtggagcggcggtcgagagaggggaagggaaggggtaaaagaagcggcggtccacggctcaccctaggtcgacgtcgacgacgaaaaagacggccggagcggaggaagctggcggcgcggctcgggtcgactgggtcgacggcgttccgacggtcggcgagccaaacatagggttgcacgaggtcgcctcagtatgcgacgaagcctaaggaggcggctccgaggtgtagtgtggtccggggctatgacggcggcggaccggagctcgacggcgacggtggagagagagagcgacggcgcgagctcgattccgtcgaggaggaaggacgccgagagacggaaacggacggaggaggtgcggtgagggtttaaatagggccgagggcgagagagggtggccagggaaggaaggaaactggcgcgggaggtccggccgccatcaatggcgccggcgagatttgcgggggcaaatccgcccgtttgaacgcgagagagagagggaaaaatggggggaaagggagaggggatcacggggagtgattcccccctctttattgcacgcgggaacggcgggaggcggcgggattcgcggcggcggcggcgctagggcgcgggggaggcggcgggagcggcgggaggaaggggatgacgggtgggccccacccgtcagcgagggtggcgggcgggcccgcccatcagcgacgcgcgcggggagaggccgagtgggccgcggggagaggagagagagggggggaggagagatgggccgggtcggcctaagggagggaagggggacttttagggtttttctttttataaaatcatattaactttgtttatttcttaataattattatttgtgctctgaaaattcaactaaaatttatttacgcattttaggcttttaggaaatatacaaaaatcctccaagccttatttgacttttactttgcacattttaattgttggaggctttcacacggattttaattattctaggcataatttagaggatgtattttagagtcgttttgggacgtgacaacaatcctcacccctaagggatggtttggcgaatcgggttcatcatcactactgatatcataaacaaccctcaaagatgatggaggacaaacacaagctaaactataacggcgacgggcgatcgcctcttggcgaaccgatcttctaaaatttcgccagaagctcgaactatctttgcgacgtgatacacgatagcgatcgtagtcctctaaagttcggcctggatgcacgcgcatccattcagcaacacttacaaccttatagctgttgccattaatcaacatctcgcggtaaataggccaaaaagggcacttaatcttcagcatgctttttatcgccacgaacttctcgttcttgttccgccatttctcaacgggaggtcgaacgcatatctttcggccacaagcctgctagcaaagcacaaaaggaaaaagtgcaaaaaaggagggaaatatagacgaagatcggttccactttcaaacgagaacaattagataagcgaaaggataatacttcatcaatagaacagagttcatattgattacaaggcgaaagcggcttaaagccgaacatgcaaaaagcctatatacaaaacctaggctaccagaaagcccgaaaggaccaaaggaagaaaaaaaataaagcacacgagggcgaagggcctcacacctcagggtggtcttggcctccatcgccttcgccctcgtgcccggtggcccgttccgatggcccgggatccctttcggtgttggcagcggcggcttcctcgtccctcgcgatcctttcaaggttctcgcggagtcgagtcttcgcacaatctcgaccaccatcctcccaaaaccctcttcgaaaggcccttaaggtagccccagaacactgcgtgttgctaggccattcttctttcacgaaataggggaaaactcccgatgtggtcgctgccgtgcgcgtgcaaaaggctaaggacgaatcccgtcgaaacacgagcgcagcagtccccgtaggcgcctgccacttcgatgaccgagccggccgcttcctgcgtccattcggaaaagtcgaacgcggttccaccttcgcccggagcaccttccgcccgcgccccaaggtcattaagggtcagccggagagtgtaacaggcctgcttggcagactctgtggccggtaccagtgtcgcggcggcagcttcggccgacacaaggcgagcttcgagggatttaatcttctcctcggccgaagcaagttgtcggtctcgttcggcatcccgcttgttcgccgcttcaaggtcagcatggagagacttgttgtcccccgaaagagccttgttttcagcattcgccttctttagagtctccgccacaatgcgtctttcgtcttccttgtggcgaaggtcttcttcggacttccgaaggcggaggcggtacccatctagcctctctaaggcagatttcttcatgcttaagtgcgcggcaaggccctagacaaggagaaacaaaaaacattacgaaaggacaaaattcggcgcgcagaaaactcatacccgcacaaataggctttccacggccgcgcagctttcgccgaactcgtttagctcggtgaagagcccaaggccgtcggtcggtgcaatgacctggcacacaccgtccacaaacggagtgatctctggccgcgtggcgaaattagtggggacgaagtgtgggcggtgagcgtcatgtccgaagcggtcggttcgactgccggagcttttccctctcgttgacggacaggcgaaggaaccgcctcaacccgttcgtcctcggaaacaatcgccttagcggccggcgccgaagcactcccacccgtcgccgcttcagcatcgctagcaggtggcggagacatgcgcctgctacgagaaggtgcgcgccgcaaaaccggcgaagtaggagtcccgtcggactcttcgcttttcgaaaagccgcgggcgacttgcacaaccttctctttctttttcttcctcctggcggtcatctccggtttcactgctgtgttggatatcgccaggagggtgttcgccacaacgacatcttgcggccgcataggcgaaacatgagaacctaccccagatttcgcaggggtaggactgggagtacagctatgggacccatcatcctcagaaccagcctccccatcttcttcttcctcctcctccccatcactttcgaccgcccccttcgcgctgcggcg

SEQ ID NO: 60150 - DNA, 3214 bp, Oryza sativa
caccttaggaaaccttatagtacaataaagaaactttacataaccaatcgtatcaaatttggactccttccaaattagactccgcatcccatacgcacacaatacctccatcgtatgccatatggaatctccatcaaccacgtgcatcaactctagcctaagtatcccgcatgatctctgaccaccacagacgtcgtcttatccccaagccgactcccggtccatcaccgcaaatactctcccgaggcatcgagttacctacacatgaaataaacaaagaaaccatattccgagaccaagttatctccaacttgactcattagtagcaaacaacagtattacatatgtatagtatccatctagaagtcataatcatgaaataatcacggatatccaaataaacaacccgaaaccgaaaccgacacagcgtcggccggtcagaccgcgggctgcgccggtctgaccgcgcattacacgccggtctgaccggctaccagagcccggtctgaccggtcacataaaatgacagcacctgtaattcacctgtaaatccaatcatctccaaaaccacttcgtgaataaattccaattaacaaaaccaataatctccaatgcccaattattcatcacagaataataatcaaaaacacctttaattttacagtagataggtaagttttgtcaggcactgatacggacggaagaccatgataaggaaagcagtatctacccagtcaaatacatcagcacacatagacacactgctatggttcagcgtggtccagacagtaatgatgctgaaagggagatttgattcacccatgattccttcgttgaagattgatgaactggtaacaacaaaattgaaatcgagatcttcctgcacagtggcttgactggcttcatcctccagaaccttcagaacgtacagttgacatcgaaggccttctgttgctatgaagctgaaggcaccacattgcgagatgcatcatgtgcattacatcttaagaatgaagctgcatgtcatccatcctgtggtcaatcatatctaaaagcttgtcatttctggcgctatcttgcaacaagctcatcaggtgaagggcttcctctggctgcgagtgacactactacaaaagtgatttttctgtacgaggccccatcatttttccatgtggaccgtaactagtggcgtctgcaaaaatcgagggtcattttcccatacggctgcttaagtgacccgtatggaaaaatcgattttcccatacgggcctcttaagagggccgcatgtaaaaatgagctcatttttgcatgcggctcacttaagcgcctgcatggaaaaatttttccatgcgggccacttaagaagccgtatgcgaaaataaaatttgaaaaatttaaaactagtgtatctcacccatattaactccaaattggatgatttttttcctaaatgtttctaaaatcatgctctatcatgttattgtgttcttactggtattattttggctattttttcttgtgactttgttttatcaattaaaaatttgaatttcaaaacttcaaataatattttgaagtagtaaatgatttcaactgaaaaagtcatcaataacaaggttgtataactcatcaagatctataacttctattttggttattttttcatccgacaaagtgatttgtaagattgttcacaaaatacacatctcttatataaatataaggggcgaccatctttttcatcaaagatccatctgtccagcaatccatttggcatgtactcataaaccagaagcctgtggttcttctcagcgcagaatccgatcattcgaaccaggttgacgtgatgaatgctgccgatagtctgaacctctgtaagaaactcctctttacgccgaccaacactgtccaaacgtttcactgcgatgttttcatcttctatcttcccttcaaatactgtcccagatgcgccttcaccaatcttgctggagaaatccccagtgactactttcaactcctcaaaactaaactttcttggcattccaggcagatgttcaatattttctccatccactcgttctctgcgggttctcatcctgatgagcagagcaatggagaaaagcaaagaaacagttccaattattatacccactagaattctagtcccgaacgtctttttcataggacgaactctttctgcaaaagtgatattgttcaacttgataaatgccctggagttgtagaggcttggtgctgtagtctggagtttgtgcaacgagaatagctgtgactgaaggaaacatgtgccgtttgtgtcgttcatcctgagcttgaaataagcagccttgcaagaacaattcgctacgcagcctgaaagacaatctgatcgcgtcaccttgtcacgcatgattgctccagagccgttgtaattgaagtacgtcacatttggaagctccaccatttcaatacctcgtacatcccggcaagaaatcggcgtcgccagcttacatccgagacctggccgatctctgtagattggagaggaatgaatctctgatgggcaactgcaattcccggcaccagagcagatgccatagctgccacaagccatcgggtactcgcagtcgccgccggcgatgtacttctgtagcacctcgtacatgatcacccacgacgatgaattccacccgtagagcctcatgtgtccatcagactcaacacggatatactgaactgaatgcgccacgggcagcgagatcaggatttccgacgaggaagaaggcgaccgtccaaacgcagagatgctgaccggagcgtccatggtgtttgcaagcgtgtccatggtgtcactgaccggagctgtgaagtagagctgggaaggatcgtgtccaacgaagccggacatggcgttgttcccgacggagacgtagagcgagccctcggagaagtcggccgccgaggcgttcgccgtcagcctcatccccgggcggaggtactgccctgggagaagcacatccgccgggtggtcgaacgattgccagacgggggagccactgtcgtcgaagagcactaggttgccggagtcggagaggcgcacgccggtgacggcatggccggccgaggtgttggtcgaccagacgaacgcgccgaccgcgtcgcggaggaccaggtcgccggcgtcgctgagctggagcgtggcgttgtcgcggaccg

SEQ ID NO: 60151 - DNA, 5669 bp, Oryza sativa
tgcactacaactcttagaatgtgaacagagtgatccaagtggtagaaatattttcaaaaggccaattttgaccaaaagtcaattttatgagaaaaactataattctggaaaactactacttgaaaaatgtttcaaaaggactccaatatgttttccaaactttagtttgcaagaaaaactatttgtaaagtggaaatgcattttttggccaaaattctagcttctaggatcttgttttggagcaaaactatttttctctctacaagcatttctaaagggaatgtgaaaatgagcccaaaacaagttagatagagttggtcatttcaaatgtttttggtttttgaaccttatccaaaaggccaacctattaaaagaaatttgatgccaaaactcaccaaaaatcttaactaggccatatatggtcactttctagcacttgggtgagtttatttcttaaacctgaataattgcatctttttggctcaaaatcatatttgaacattatgcatattagtttctctcaaataccatctcatgtgcttcttttcgcttttttttaaaggtatttgagaagagagcttttgtagcctttgcaaaaaaaaaaggcctttactatcaaatcatgaatcaatggagcaaaaaagagagatgcataaggggggtgggcaatctgaatcaaatccatattactcttgctctcaaatttgaattttccaaaaagttgcatctatagcctttcaaaagaacctttttggtcaaaagtcaaaaaacttatttaaatggcccaaatttgtgaaaatcctttcaaaagtatcccaatatgtattttaaatcttttgcaaggattttggagtaaaaatttccatttgtgaaacaaaatagcaaaattggtctcaataatatcttttaggatcttgtttttgcggaaaatgttatatttccctaaatcaaaatctattgagtttttgaaaaagttgtatataaaaattttttagagttgatcatttcaaacatttgtgtagttcaaagtttttccaaaacaccaaccattcaaactctacaaccatttgagtttcagccaaaatcttgacttgaccatttttagcctaaacttgcatatggtgggttaacccttttgagccaaagctctttgtgaatattggcttagaagtgtatctataaccctcctaaggctttacaaatgtcaaactccatggatttaaaatttgaatgtgatttgagctctcaactcaaatttactcaacctgaaggcctacaatgctcctttttatcttttcttttgataaaaaatgatttttatgaaattctttttggaaaagttactcacaagtataaagatcatatctgcaagggttcatctcatttggatttgatttgcaattattttgactctttctcattttgctcagcttgctggaattttcagaacaagcatggttttaggctgatttgtgatttttatatctcaacatgcattgcaaattggaaggagcttccagtatgacttttgatcccctatagttgaaacttacttgtaaatttttgtttgaattgtttcagctcttttggactctgtttgaatgctttttaaagcccttcttgagttgtgaaaaatttggaatttcagcttgctgacatcttgtgatttttgttttgtctatatgcttgagatattgtcacgtcccaaaacgactctaaaatacatcctctaaattatgcctagaataattaaaatccatgtgaaagcctccaacaattaaaatgtgcaaatctaaaagccaaataaggcttagaggatttttgtaaatttcctaaaagcctaaaatgcgtaaataaattttagtggaattttcagagcaaaaataataattattaagaaataaacaaagttaaaaaggttttataaaaagaaaaaccctaaaagtcccccttccctcccttgggccggcccggcccatctctcatcccccctctctctctcctctccccgcggcccactcggcccctccccgcgcgcgcgccgctgacgggcgggcccgcccgccaccctcgctgacgggtggggcgcacccatcatccccttcctcctgccgctcccaccgctcccgccgctccgcttgcgccaagcgccgccgccgccaaatccgccgcatcccgccgtccacgcgtgcaataaagtagggggaatcactccccgtgatcccctctccctttccccttttttcccctctctctctcgcgttcaaacgggcggatttgcccccgcaaatctcgccggcgccattgatggcggccggacctcccgcgccgatttccttcccctccggccgctctctcccctttcaaccctatttaaacctttcccgcgcctccctcgcccgtttccgccccttgccgcaccgtctcccaccggaatcgagctcgcgccgtcgccctctctctcctccgtcgccgacgacctccggccggccttctccgctcgccgggaccgtctcccgccccggcgttgccttctccggcttcgccgcaccgccgtcgaccccgtccacccccttgtttcgctcgccgaccaccggaacgccgtcgaccccgtcgaccctagccgcgccgccgccttcctccgctccggccgcctttttggtcgtcgccgtcgacctagggtgagccgtggaccgccgcctcttttcccccttcccttcccctctctcggccgccgctccgccgtgcctatggccaccgctggcgaccataggggcgcgggcgccgcctcccgccggccgcgccgagtggccgccttcgggcgcgccgagtggccgccgcgtggggcccggccgtcagccgcccgcgcccttaggtgcggctgacgcgtggggcccacggcgccgaccggtgtgagcccgggtgcacccggtccaccatggaccgtgaggctgccgcgtgggccccactcccgtggacccggtccgcgcgccccctcccctcggctgacgcaataaaccctttttaaattaaaaatttaaatgaagaaattcgcaaatattcatttaaagagcatataaacttcaaatggccataacttggccatttgaactcggaattggaccgttcaagtctctaatttttcttaagtcaatatcccatttttgtgctttgttcctgcttgttatatggagtttattagagtaaaagccttttcttttccgttggtcgtgtagacgctccagcttcggaagatccgctcttcgtggaggttgaagccgacgtttgggaaagcgagcaaggcaagtcacatcatccttgaacatattgaatcccagtttataaaattattttggtttaaattattgcattatcgctttatttaaattcccgcgttatcactgttttatctagccatgcctatttacctttgttatgaccttattattgttattgttattatttccttgttctccgtagaataaacaaaaccccaactagtggacactctactcatggtaccactagtatgattttaggtagatgcttcgctggttaattaggcaacattaggtggttttacaactctagactttgggaatattcatatcacctggacactatggaatggtttgattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggattagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcagtcctgcctacctgtcccgggggttccggccgtaggtggggttgggtcggtactcttgtttatggctaggatgggttggaaactatgtcatgtcttccgtccgtataccgtggtggtatgtggcacgtggttacacgtgaggaagatgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtagaccttgggttaaggcaggttcgtgtgggttcacggccttgattaataatattgtatagctctggaatcgtgtttacaaaatagctttgagcaactaagtgtcttttaatgctgtttactgcaaaccctaaccctttatattataacccccttatactcccttgcatttatcctgcacttgtgggtgtgtcttgttgagtacggtggttgtactcagtcttgctcaatttttcccaaacccagaagaggagcccctggaagatgaaggctttggtgtctagctcgtgcctaccgtcaagcgcctgtggtcgtcgccctagtcttccgctgtttcctgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcctgttgggttaatttcggtcgtgacacttgtataggattagttcctaatgtttcattcttttttgtacatactcttgattcacacaaacattttgtatgcatacatttaggggtagcaaatcctatactttagttatgcatgtaattgatccaagtttttcattttcatttaattgggatctctgcatttgagtatacattcgagtatatgacacttgtggtgttgattagtactcatcatttattcatatcctttttcatacgcgatcggttggtcagcatgtggaggttgaccaccggatcattgagactaataattttattgagatgaatgagagaaataggtcccaaggattgcaaaggtgttgatgctcaagtgatatcattacacctaacgataccaagaatgacaaattgaaaatgttgaagatgtgggatacgaagtggctactatggcaagacggtgaagggcaagcggtgctcggtcatgatagaccatgcggcagtgatgggcaagcaagatgctttgcgccaaagaaccaaatccggtggtgaagggcgagtgacagctttgtcatgatggaccgtgcgaggccatttgaagctacaagtaaccgcatcaatcatttgaagaatatatgtgaaacggtttcggcatttgtgtactattaagagggaaagatggaaagaaggcattcctattggtataattctcttcctatttacatttgagtttaggaatgccgtactattaagagggatgtaacgtcgaggtgtttgtgtatgtctcggtgctaaagtgacctatcatagtgctaccttgagagaaacccaagctttaacctatcctttgagtagt

SEQ ID NO: 60152 - DNA, 4860 bp, Oryza sativa
tattggtataattctcttcctatttacatttgagtttaggaatgccgtactattaagagggatgtaacgtcgaggtgtttgtgtatgtctcggtgctcaaagtgacctatcatagtgctaccttgagagaaacccaagctttaacctatcctttgagtagttttagaccttgtttttggttgagttgggtagttctctgaatgagctttccatagattccaatttcatcaaaaacggactcccgagcgaaaagttatagtcgttttactctgtgcttttcggaaattgcgaaaaattatcggaaactccgaaaatttttcggaaaactccgaaaatttcggaaattccgaaaatggctgtgaatttgagaatggctcctgtaaattttcggacatatccgaaaatgctttttgaaacttctgaaaattacagtattagcctccaacggctagtttttgaggggctctggtatataaactcctccaccggcctcctttgagttgctgttgttcttgggcaacattagacacatccaaacccaaatagccatccccatttcccatcctttgtggtgcctctttgtgagggggatttgagaagggaagagagttggattgagagattgagaagttgagagctagtgagcttcactccatactttgagtactcgagttcatagcaagcaaatatattcgattgtgtttgttactcttggggactaaggtctcatagacggctaggcgtcgccggtgagcatccaaggttgtgttgagccacgaaaagtttgtgaaagcttcgattttgcctccgcaagggaagaaatcaagagtgaaaccgaggagtgtatttgtgtagcctcgtgaggaaagggttgaaatagacccggccttgtggcccctcaatagagatgttggatccgtggattcgaactttgggaaacaaatcaacgtgtcccctctcttggtttgctcgttcttgcgatctctcatatcgtgcttgagcttgtttttacctgatctacttgcatgcttgattaatattgttggtgaccctatatcttgtttagacaccttttttgtcaccttttgattcatatacattttagttgttcaagctacaagttcatagctagtgtttattccgttattcgctgaactttttggttgagaccggaacttccaatcccataccggaagtttgatttgaatcaaaaattctcatcactctaatatgctatgaagttgtgataattttttggaacgcctattcaccttctctctaggcaacatcaaggtcctttcaataaagatttaattgcaacgaacacaattatgtaatcggattgtagatcggataagtaatttttttagataatggaatataatatcccagcctttgctcaaaaagaactacagccaattattacaaagatctactccagaagagagtgtagttcaagacaagttgaacacaccaaacaagagaagagaggacccaaactaagaaaagaaaaacaaaatatggagctagaaggcctcgtccaggcctaggactgaagttcgccaatgcatagaccaatgacaatatccttgcacgaagaggtttctccaaaacagtgcccccaaggaggatgcgacgtggatcgccgccaccgctcgttcggaaccgaagcaaggctttcacccggagaatatggtagggaaaggaaaggggtatgctaaaacaacacctccaaggaggggaacgacaccaaaaggcgtcgccgttgtcagctggccaaatggctctgcaaggctttcgcccacgattcccagtccaaacccacaccaccaattcgcacaagaaggatcgtcgtcgatcaacaacattgtcccttcagcgatttggccaaggccaccacccacaattgttcccgccgtcaacggcacgcccgcacccggactcctccttccccgccgctagacccctttcccgcctccacataccgccgccgatgacgacgcaccatcagccggatgatggccttcaaccatcgccgccataggtaccatcgtcgacagccgccaccgccactgtcacagccaccaccatcgccagccgccacctttagccaccatcgccaccggcaccgccaccggcacagacacccccgtccagccaccaccgtccagccgccaccgtcagccgccaccgtcgctagccagcgccgccatacgccagccgtccagatccggccggattggcgtggatcggaggtgcagcgcgaagcgtgggtcgccggcatcatggaggaaggcgacacgggcacggcgttcacagccggagcattgacgagggcgccgcgcctccctcgcggcggcgaggttcttgacgagggccggcgtcgcggcacgcgccgcagtccgccgccgtcgtcgccaacttcgtcgccgccacatctgccaccatcatcgccgctagccaccccccttgccaggtccgcggagcggcgccggcgtcgaccgagcccgtcgccgatcaccccggccaagcggggagaccagatctggcagcgccgtcgcccgtcgctggagccgcggagagccgacaccgtggagcgccccaccgccgcgcccaacgccacgccgtcgccgtgccgtccccgtcgccacgacctcgccgtcccgccgccctcgtcgctaggcccgcgccggggcgaggtaatatgagagaaaattttataaggaaaaaaagtaatgtataacataatagttaagaatacatgcatgtatgtgggcatgtagtagttcttctcagttctcacgtcactagttaagacaaaatcgatccccgcaaaaaaaaaagttaagacaaaattgagattactctcatgttgacgagagaaacacacactggcctaggagatctgcttagctccagtgcaggtctaaaaggttgatgagatgcggacgtgccagtcagtttgatcctgcaactgacaagatatgcaaacagcagataaaatccacatgagcccttctgcactataaattaatatatgaattaacaaagatggaggagagaaataatcctgaaaataattggaaaaccattttcactcatgtttccacccacctattttaccctagcctagtttgccacgacctgggcccacctggcagcctccctggcttgcccacgccctgtccatcttctcctccaccgctctacccgaccagcattcaagaaaaacagccgaaagagagaggggaaccgagagaacgacctgctcgacgcgtggactcggcgtggcatcgccaagctcgccttcaacctctcccagacgcgtcgcccatctccacttcacacccagagccgaccagaccaagagaggagagccctcagcctctccgtcaccctcatccttgtcaccgaccgtggagaagacgaaggctgccgtcgtcgtcaagccgcgcacgccgtcatctctttttcgttccatacttctctctccatgccgagcaaatcctcttttgactccactttgtttcgtccgctgcagcgacgggaacgccgccgtgcccacgggtgttgcagtgcgtgcaccgagcgccgccgcaacgacatcgtcgccgttgccgtcgatttaggccaagccggagcgagctaccacgccaccagcttcgcgtagtcctcctctccatttcccctcaaaaatcccaaagaatggcgcatcgaggaaggagatcggcgtcatcctcctcaactcgggtcaccgttgccatttgccgaatccatcttctccggtgagtcccaatccgattccatgcatcagtagcatccctgtgacctcaataaccccatgaaaacacatgcatgtcaatttgatgagtggatcgagtcgttgccgtcttcccggagctctgcaccgtcgccggaccatcttcttcaccgctgctgttgtccagactttcccgcgcctcgttcaagcttcggtgagcatcgttgagcccataggatttcattcatgcatttcattcacttagaatcgagcaccaactcaacatgcagtagcagcctaagcacagccgccgctcggactcgccgccagctactccgatgttccctaaccaagaaaagtagaggaatggaatcaggagagcgttctcttcattttgtcttttgacctcaaccccaaacgagccaccaatcaccgccggcgagcttgacaatctcacagccgcctcccctgtccatggcagtgctggaggttgaagacgaggacgtcatcctgtaaataatcaaaactaaaagggtcaatatgtaactttcttacccaatgacatatgggcctaggactgcgggtttattcttagaaaactcagatctttttgcatattgatctctcactgctatgtggaccccctggagagaaaatctgagaatatacaagagagatacctagaaattgtaaaatccatataaaatcaaatatgactcattttgagatgatttaaatttctctgaaatcaccaaatcattaactttaactttatggcataaaaacttgcactcacagtacaaatttagcctctaaaattcatctaatataaatcatacataaagcatatacaaacttataaaatgcatataaaattcatctcaactcattttggaacaaactcaaatcctacagactcaccaacatgcactcattggtaaagagaaataaaataatatacttattttataccaaaagccactgaaacgattatctttaaaaatagtaaattctagataagctgaaatttagaggtttatataaaattcatcttagatcctttttgagtaaacctaagttctgtagaattaccaaaacat

SEQ ID NO: 60153 - DNA, 772 bp, Oryza sativa
gccacttgtctctgttgtgtcggtgaactaatctccatcgccgtcgatcttaggccagccattttcagcctgcgacttgacaaacgcggccagtagcttgatatcatcttcgaccagccgaggtccgaaagtgcactgccctctcggggtgcatttttctccgaagcccttaacgcagcaaacatacaatcaagaaattaatgagtatctatctatactactcaaacatcatcatgatagcagctaagaattactcaccggcattcttcccttcccgtagtacgttatattgtatagctcgtcctccgtggcaactccatttctgcagcaaatttgcccttaattttgccttgatccaatccaacaatgggcagtaaatttcgagcagttaaaagttttcaagagcacacatacctctcaagatccttcatgtacagagtggcgccctgtacatgacaaatcagcaagctaataaaaaggttgaaaatttgtgtccggccatcgagtaatggtttcagaagcttaccggctgtaggatatttcctcccatatcatggcagccgatgcacgccttccggaacagcgctgcgccttcggattgagcaaaagctacaacaacaaaagggggggaaagaatgtgatgtgcgacgcgtacatttcagcaaatatggtaaattggcaattaatcatgctcggtgtacttgtgtagaatcattcagagttacttctgttatgttcctctactgcttcccccactaaaaacttcaagagg

SEQ ID NO: 60154 - DNA, 31615 bp, Oryza sativa
agattcggcccatcgaacccgagggaggcaaaatagacttttgcggagggattgatttgggaaagatttggattcgggattgaactcgatgatagatcggggatttgagatctgagatggcacgaacactagacaacaagcaaagaaacagatttcgcaaatagggtttttaagagataatttttcccgctaggcgccacgacggaacgggcgctacagaccaacccccctaacaagaatctcgaccccgagattcagcacctaagggagcagctccgggaactcggcgcggagaagatcttcttgctcccaggttgcctcatcttcagaatggttgctccattggactttgtagaacttgatggtcttccttcgagtctgacgttctgcctcttcaaaaatcttgatcagtctttccttgtaggtcagattcttttccagctcgatattacccagggggacttgctcttctggaactcgaagacatttctttaactgggatacgtggaacacgttgtgcacatatgcgagaccttcaggtaactcaagctgataagccacttcgccacgtctggcggttatgaggtaggggccgatgtagcggggtgctaacttgccggacatcccaaacctccttataccacggagaggcgatacccgcaggtacacatgatctcctttttcgaactcaaggtcacgccttcgattgtccgcgtaattcttctgacggttctgcgctgtctttaaacgttctcggatcagtttaacttgttcttctgctgccttgagtacgtcaggaccgaataccagtgcttcgcccacctcattccagcacaagggagtgcggcactttcttccgaacattgcctcattcggcgacatctgaatgctggcctgataactgttgttgtatgagaactcagcatacggcaaacaacgatcccaagtgccttcgaaatccagggcacacgcacgtagcatgtcctctaggacttggtttaccctttctgtctgaccatcggtctgcggatggtaggctgtaataaatttagatcggttccgagggcttcatgcaactgcttccagaactttgaggtgaactgagtgcctcggtctgacacaattttcttgggacagccaaatctacacacgacatgggtcatgtagagttctgctagtttctttccatcaaaggtggttttcactagcacgaaatgagctgatttcgtgagtcggtccacgattacccagatggagttgtacccgctaggggttcttggcaaaccggtgatgaaatccattccgatctcttcccatttccactcgggaatcggtaggggttgcagcagaccagctggcctctgatgttctgccttgactctttggcaaatgtcacacaaggctacgcattctgcgacatctcgcttcattccagcccaccagaagtatgccttgatatcttggtacatcttcgtacttcctggatgaatggagtaggcggactcatgagcttcctttaggatgagatctcttaactccttcttggccggtacacagatgcgtggaccgcaccaaactgtgccttgatcgtctatggagaaattggtgtcattcttctcctgtattctttttattaattcttttatcccttcgtcatctttctgagcctcccggatttgcgattctagggtaggctgcactgtcaagctggcagggacacctgactgtaccacggtcagccttaacttctccaattctctgcacaggcgatcttggtaagaccgtatttgagctacattgcaataggccttgcgacttagcgcatcagtgaccacgttagctttactggggtggtaatgaattccaagatcgtaatccttgattagttccaaccattttctctgcctcatatttaactcggtctgagtgaagatgtacttgagacttttgtgattggtgtatacttcacatctgttcccgattaaatagtgcctccagatcttaagagcatgaaccacggctgccaactcgaggtcatgggtgggatagttgacttcatgaggcctgagctgcctggatgcataggccacaacctttcgttcttgcattaggacacatcctaagccttgtcttgttgcatcatagaagatctcgaaatctcttcggatatctggcaaggtgagaactggggcagtggtaaaccttttcttcatttcttgaaagctgtcttcacaggctgtagaccattgaaatttcttttccttctttaacagctcggtcataggtctggctagcttagagaatccttcaatgaatcttcgataatatccagctaagccaaggaagctgcgaatctctgacacattcgtgggcgggttccaagcaagtacagcttcaaccttgctgggatctacttcgacaccattgggggagatcacgtgtccaagaaatgctactcggtctaaccaaaattcgcatttcgagaatttagcgaatagttgatgatccctgagcttttccattatcagcctcaggtgttcagcatgttcttcctcattcttggagtatatcaggatgtcatcgatgaacaccacgacaaactggtccaggtattccatgaagattttgttcattatgttcatgaagaatgctggagcattggtgagtccgaaggacatcactgtgaactcatatagaccataacgcgttgagaaagcggtcttcgggatatcttcagatctgattttcaattggtggtaacctgatctcaagtcaattttagagaaaactcttgctcctttaagttgatcgaacaaatcgtcaatccgtggcaacgggtacttgttctttatagttacttcatttagggctctatagtcgattaccattctctcacagccatcctttttcttgaccaggagcactggggctccccaaggggatgagctaggtcgcacataacctttactctccaattcttcgatttgtcttttaacttctgctaactcattagctgccattcggtagggtctttttgcaattggtgcggtgcctggtgccagttctatggcgaactcaatctctcggtctggtggcatacttgttaattcttctggaaatacgtcgggatattcacagactatgggcaccgactccaaggaggtgacttgtaaacaggttaggatagaccgactcgcggtaggggtgttagaggtaaagcggacttgctttcctccaggtccttgcaaggtgatggacttttcggcacaatctatctgccctttgtgcttagccaaccaatccatccctaggatgatgtccaagctttgcgagtctaggactatcggtttggctaggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaagaatgggaagcttctgaatcaaacagaactattgcgggtacggagttgacagagaacatacccatcacaacgtctggagcatcctgagcggtctcagcttgaatgtggttcacccggcctcgaccaaagttgttggaagcacgagagccttgtccacttgcctgagagctaggacgagactgagctgccgctggagtaggagttctggcagtgctgccattagcatgccctgagttggtgttggtaggattctgagggcactgtcgggcatagtgacccatctggttgcaccggaaacactgaactgctgacggtcctagcggtgacttgaaagaggtaacactgtttggtgcagtattgccactaggggcacgctgctgtggctgaggtgccggacggttcatctgaggacgaggggcgtagcctggctggcggttagcctgagtgaccgactggtggtattgcatgggttgaccatagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattcctactgcgattcccttcaagaacttcctgatcttcttcttgtctgtgtccacttcctcaggggcgtaccgagccaacttgttgaacatacttaggtactcattgacactgttgttgccttgcttaagtctgttgaattcctctttcttcatatcaatggtgctttcaggcacatgagctgcacggaaagccgtagcaaactcatcccaagcaatgttagtgggttcagggtgtgcattgcagtaattctcccaccaatctgcagcaggtccttttagctggtgagaggcgtagagcgtcttctcaacaggagtacactgcactaagttgagttttctatcaacatctttcagccaatcgtcagcctcgacgggctcgacggtctgagagaactctggcggacgagacctcagaaagtctgttagattggatctattgttgcccatgtgagggtggccatttccatgcgcattgtgctgataaccggctacggctgcggctaatccttgcaagatttgtgtctgaactgccattaagtgttgcatgttgttttccacatgaggtggggaagggaggcgttcttctccagaattgtgactggcagtgcggtgagagcggtgagactgttccatctctgcattacgggaagctgtgtgatgcgagcggttgctgcggcggggttgctcaacttctgcgttgcgggaagtagtacggtgcgaacggttgctgtggtgagactgctcattagctgactcatgatttgcttctggctcaactctaccttcctcaaaaccaaagcgggctggtgcacgagcagcacggcgggggcggctagccatctaaactcccagatgagggcgaggtaagaatcagataagcacttaggagggcaaggagcaaagtaaatagcaactcagatagcacacactaggcataaactggatttttcaaatcataaaaacacctaatacaacgggtgtggacaagtcacagagctacgccgagcttgactgtgcgcacaccacctaggagaaccggactaccaaacaacacccacatcaaacacacgcacgcactacctcgccacgactccaaaagagttggcggcggaacaaaagggcctaacacacggacggctgctgaagactgcctcctctactcctcgtctgcctggctgcctcctgtagtcggctcctcagtcgaagaaacgtcgatcggctgacgcgaagggaccggcggaacctgtcgagggccgacagcagcacgggccgctggcggtgtgggagctgggtagtcgaaacggaacacggtggaagaaccaacaacacgcttccgcgcagtgcggataaagcgtgggccacggtgggaggaagcaactggggtgtgtccaggggtgtaggaggggctaactgggtgagggtagggggagtacactggtgagtacggcgcacgcgagctgggggagcgcaggccactgggagtgcgagcagagccgcgggagctgtgggaggacaggtggctggcgtggtagaggcgacctgagtcccaagagacagtgtcaactgaggtgacaccctcctcggccagacgggcctccagagcggcgtagcggcgggcaagggagcggtaagcctcaaggagtaggtcgtgctgagtggcctgagcctccgaaagctcaaccatgcgagtcagcactggctgaaactcactgtaaggacaagggtacctggcgtttgcgtggccagaaggaaggcgtggaagctgccggaaggcagagcccccgagacggtggctgtagtcgtaggccaagcgacgaagcgcagtccaggagaggtcctggcacgcgatctggagagtgggcctggccacagtgaagtggtgtgggcgaaggccagctccgtgtatacctccacgagggtaaaggtacacagagagctcacagcgagggggaacacggtccacggagtaccccgtgtactcgggacacgagaagccaaggaagcgggcgaggtctcgaagctgagcgacatggtgaccctcaccaaaaccgtgggaactgaagctggcgttcactgccatctacaattttgaaagagggagaaaagatcagtaaccattttagaaacaaactattgaaaataaggaaaccaaaaaaagccttagcttttcgcaagtagttttgaacttagtacccttagggtcgtcctaaacgtcgggtttcgccctaggggcaagcctgtgctctgataccatctcttgtcacgcccctaactagtcccgaccggaactagcccgtgacgctccaaattaacctgttaatctataccagtcctaggaaacagtgctggtatcacaggaagacagaatatcacagcaacagaggtctctttattatagagtagaggtacagtcatgttgggctgcggacagatcccgagctcacaactgcatttcaaaagggaagcggaagccaagactcggaccaaacaacacaggcgcgacttgggaactaggccgaaaccctaaaactcatcgtagcgggatccgcttcatcttcttcagcaactgggggggattatttatatagagcaagggtgagtacgggagtactcagcaagccataggaaataagtgtttaatgcaagcttcaaggaaaggctgttgtttttgcaattgattttatttgatctcttttctgaaaacaactaagtgagtgcttctcaaacgacacggatgagacagtgcgtctcgtccggtcggagtatgtgcaatgtatcagtcttttgaattgatcaagattggcacccggccaacaattttcaaacggccacccgggccaacaactttcaaacggcctcccgggcctagctgatcccatcagctgcagattttccaaacatcgatcccctttccacaacagcaatttcacaagcagtagtcaaacaaaactatgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccataccatactgtgccaggaagcccaggggtcctccccgacactaccccggcgaatccacatgtctctcggcatcaaggctcccctgataagctagttactcagccaggggtgtcccattccacccatgtggtcgtacttgtcttatgttcggatgaaattccaaggaaacggtccttaggtgcaagagcgggaaaccgtacacccggtacgttccccggtccgcggttttggaaaattcatttagttcgcaagcaccgacccaggtgtcgggttttccaagtcttttgtaaaacccaagttttacccaagatgtttatcatattttaagtttgaaggcgaccgtcgatactcgtgcagagtgcacgatttccgaggcgcaactgggtggttacaagggaacatggtataacaattaacgaaggaaggatcaaatgcaacaaattaggtaggctgccattctgccttgcagacgggacaaacagattaagtgcgatcctattaatgcataatatttttcaagcaacataattaagttcaaatataggctcaagatgttcaaaggtggcttgccttgctcgagatcttgagcttgatcctcgaaatccttggactgcgggtcttcgggtgtataggaatcaggagatcaggaattctggaccgtatagaaatcgtacgacgtcgcccgttcccgagtgatcaaacgttcacgaaactccgcataaaactgaccaagtcgtatcgatcttccagggcgcgcggaaaacgaattaagcatgccagctgcgacgacgattcagatggaagcgtcgccggcagaccattggtctccccgtcatcgccggcggtgcggttgccatggtgtaaactggtgccgtgtcgtgagcactgccatcgtactcctgttcgttggcctcgctgtcggcgggttgttttacctcatagctgtgtccaccagggatctggtttactccgcctcgatcgacgccgtctccggcctcgatctcgaccacccgacgctggacccggtgttcaacctcacagtccgcctctcctcgcagaaccaggtgaccaactacccaaactgcatctggcctggtacaaccgtggaggtcacctaccgcggcgtccagctcgccatcgggtccgtggagcagctctgcgtcggggcgcgggagacgaaggagcagcacgtcgtcgcgtggggcgccggcgtgcgcttgccgggctccgcgctggacgcgctcgcggcggacgcgcggcgcggggcggaggcgttcgacgtcgcggtgaagatcccgaccgtcatccacagtggctaccacagctacgacccccgccacgtccacctggggacgcttgtgtcgtgcatgtcgaggcgggtcggggacgaccccgtcgccgcgctgaggactccgtgccatgcgtccagtacggacatcgctgcgtcatacccaaacaaggggaggacgcagcctgggggtgccagttaacgtgcgtgaatatgcaatccgcccgtcatgtggtagtgagcgagaccagtttctacgttactagaatataatagagttcagtttttttttgggtcaatatatattttgtggtgcatgaattatacatatatagccgaggaatcaataatagatcatgatataaaacaacagtccataatgtccattgctgtacactctattatgcaattttgttgctaatttcccgatccgttgagcatgccttcttgtacaaaagggagagacacaccagtcgtcacatcatcaccgtttcaggcacacgccaatccgcgagcctgacgctccgatcgagcacgaaacatatagtcgtacacaattaacgcagctagccaactaatgaaacgcataaaacttggggggaaaaatcatatggacgatccacgagggcgctcaaaatcgaccttcgtcgtccatctcacgctcgaccgccgcgtcctccaccgtgtcgccaatgtacaagtacgggttcttcgccaccggctggaagttgtagaaaacgaacaggtagaaggcgaggctggcggcctcgatggccacgttgacgccccactggtacttgtagctgagcaaggcgaggaacgccgacgcgatgatccgggtgaagtagaggtagccgacgacgacgaggtagaagcgcttgaacagcgtgagcttctggaggttgagcgccgccttgccatcggtcttggatgcctcgcgcatgctgcggatcgaccagatgatcgggaagaacacggcgcagcagcagatgacgtccaccagcaggaacacctggttccacacgacccagtcctgccccgtcggccccgtctccccgatcaccaccagcaacaggttctcgaccacttgcagcgggatcacgatcataagcatgttcttctccctctcctggaacgagtaattcgcaataattctgtaaaaatggaaaattctatagcctggaattctaggttcgttaatggcgagagagagtaattaagatcaatggtgatcacctggaggtagggcttgaggatggaccagccggtgccgatgaggatgatgacggtgaagagcaggacgcccttgaagaagccgaagacgtagaacgccacgtcccagccgtgcggcgtgccggtgcgctccacgtaccacgagtcctccgccgcgcacgccatcttgagcgccttgaacagcagcagcgcgcccatgacggcgtggatccgctccaccgtcgcgcggtgccgcacgcacacgcacgcccacagcgccaggaacgcgaagtacacctccgacacgaccgtgtagatggtcggcagcggccgcaggcccacgggtaggtagtccctgggcccgtcggagatgccgtcccgcacgttgtacatctcggtgtacacgtcgacggtgacctccacgccgtcctggcagttgctgaacacgacggcgtactggtctgggtcgtcgatgctcacggtggtggtgacgccgccgggcgggacgtcgccgagccggagcaccgggagggcgtactcgctcgtcagcacgcagtaactgcccccgccgtcgtcgccgttgtcccccgggtcggcggccgcgtacgcggacgcgttgttgatcttcgggaactgggttccggagatgaggacgaaccccatgaggctggggtcaaccgcggtgcgccgtgacccccgccggagattccaaaacgagcggcgtatggagatggtcgccttcccgccacgctcgaagccaaactgctcgaacagaatgagaggccgagcgtccgacacgatgagcgtcgtcctgatctcggcatcggcgccccgcacgaggagcagcagcacgacggcggcggctgcgacggcgatggagagggaggtgtccatggaccttgccggcgatcgtacgtgcatgtcgtccaacgctgcggattagccgttctgcttgttgcatcgatcttaatctgcccttcccgatgcagaaatcgcaccatgcatcgatcttaatctaccgtgcaggaggaggaggaggaggaggaggggcggcaatggaaatggacaggcggttcgtcgatgaccatggcgtgttttagggatggccatgagaggagagcgaacggagaagggcgacgtgttgtttctctcccgtttttgcaatgccacggcggccatggtgggcacatttggtacggtgctcccgcgtgcatggtaaatgggcctcatgtgatttgggctgggcgcctgggcagtatatgggcttgatgggctgggtgtaatatttcttcagcgcacaccttctaatttcaattgccttattcaaaattttccacttatcgggaacacctttgcatattttctacttactccattattaaatcgctgtaacatatgcattattccccaccatccataggcacatcgtcgtttttaaacttctctgtacccatgacggggcatacgatctgtctgctttacgattctagcttctctttaagctaaattactttatatttacaactttcttttagagaatttttctatttactttcatgttccctagctggaatcctattttgtgctgttttccactgcattccgtcctactatatgtaaagcggaatatgtctgtctagagctctagggttcttttttatgtcttgggccaccaatgaattgtttacgcatatatgtatgtgtagattcttgagtacatccagaagagtgtagagatgctcagaaatgtaatggattccttttggctttggctctaagattgtagtaaaagagaatccattatattacatgcgggatagagattaattaactcgatcatcaacataggataaagaggcgcaaatataccgttttatattaaagccaaaacataacctaccaaaattttggtgacttaagtagtaaaataaaggaaaaactaaggagttatttagtatggaaatcctacaaggaaaaaaaaactagaaattgctactccctccgtactaaaatataagtgtttttggatggatgagatacatcatagtactacgaatctagatagtctcttgtccaaattcgtagtaatatgatgtgtcacatctactcaaaagccctttgtgtctcgaaattcctatgtttttcatatagtgctatcaaaaaacattttcacaatcttgtggatttactttctatagtatttaatgaggtgtggcatcctattttacaaatttgtgtatttactttccatattattcactgaggtgtggcatcatgttcttgtattttctaaatcctgattttcaaatacctgaatgtatactcttggagcttaatttgctctaaggcccccgcgtcgcctcccgctcgggcgactcgggcggcgacccaagccaccgccgccgccgttcttcccccctcccctctgcctcgccgccgcctgagcaaacggccggcaaagccatcagcttgctaggatggtggcggcggggctcgtggcggcggccaccctagatccggcgcgggcgaatctgagggtggaggccggccggagcggcgctgtcgtcgaggccggaggcgtgcagggcgcgcgggcgacggcggcaggtggtcgtggtggcgacaggcggcgcaggggcgcggggttggcggcggtaggtggaggcagagactggcggtgggatgtgggccacggtggtgaaggcggcggcaggcggaggcggcggggtgtgggccgcggtggtgaaggcagcggtggcggagtctacgacctcgggcatcaccggatccgcgtcgaccattgccggatctggagctaggtgcgggaggggaggcgggtggcagcggggatgcggtggcagcggggatgcaggcggcagcgggagcataggaggcgtggctctggtggtggtggcgcgtggaggagcgtggaggcgaggccggtggtgtggaggccggcgcggcccgtggagatgcggccggcggcgtggcgtggaggccggctcggcagcgtggagtcgggtgcgtcacgtggagtgtggaggccggctcggcagcgtggagacgcgactggcagcgggaggccggtgcggcatgtagaggcgcggccggcggcgtggaggctggcgacggcgcgtggttgtgcggccggcgatggcagaggccggtgcagcacgtggaagcgcggccggcggcatggatggctagccgagcttcgacgaccggtcccttggccgccttggctggttctagtcggtgcagcaggggaatgtgggcgacgataggttgagtcgagggttgaatgcttgtgagacgtcgtggactatcgtgtggccgtcgatgtggggggcttgtgtgggtaatgtgtagacgccggtgaaagccttgccgtgcctttggccggttcgatgacgacgacgccgttggcgccgtttcccttcttgaaggcgttgtcatggcgctctgccatttgccccacaaatctccaggtgaaaaccttgctccggcctcggacgagcggtgacgacgttacgcgtcgtgtccttcttgggggcatcgcttcgggaaagttccttacatcgatgactattgatggtcccttcggctcaaaagctttctttccttggcattcggcgaggcctaagcctcttgggtctgcttcgttctatgatggacgacacactcttcggttgcttctgcggatgaagttggagctgctcgctgttggggtgcggcgacgcttggcaacgatgacgtgttgtagtctcttccaaagagttggtgctggccatgtggaggaagtggctctttggtggcttggctgatgtccattgtggatgtcggagctgctttcgctttggcgacttttgtggcttcagtgtcgctgcagtggtgaagtcggcgctgctgggtcgcttgggcggctagctcggcaacgataatacctcttctgtgatgtcggagctgttgtgccgcttttgtgtttagcttggcaacgatgtcctgtatttgggctccgctgttgttgttagttgtgtgttaggtcccatgctttcttctgtccgttgggttttagccggttccccataattaaccgtgcagctgtatggttttcgggcctgatttcccttataaattgggtcgttgtctcttgtctgtacagtttctccctctcttaatataaaaccagcaatgctggcttaggtttcaaaaaaaaaaattgctctataagtaagaccggttcggaaaagctggttgttgcaacgctgctgagcagtatctacagtgctacagcagccagccaacagcggtcgtaggagcttttcagccagtacaaaacaactagctgcattcaaaatagtccagaccgctgcagccgaacggttaggatgtgcatcacagctgagattgacgtggaaacaggatactaaacatgccttaattcgaagttgttccatgttctaccaaacaaaatgtcttatcatccatcacattcatatatatgagcaaagttcttgatcatgtcctttgggacgaacagaaaagattttgcctacaactcaaggtcgtaggcaaagaactgtttctcatgcatcgtgacgcaagcatattagcactgtcttttcgctgggccggcttggagccctgcatgatgcatcaatatttttcttcctctgaaccagcagcagctcgcttgcagcacgggcaaatcatacgtacagatcacgttcagttcgccgaataataaccaaaactagaatactaatgagatcgacccttctagtagtagaaatgcaaagtgcaaaagcgccagggagaataccatccgaccagaaagacgcttgagaatcgacgtgccatcgcaagaaaacaaaagcagagaacatatataaaccgggcgatctcgatctcgatcatctgcaaatgcttaacaaataataacagtagtagcaatccaaagccaacgccctgcaattatatgtgcgcatatgtggatcgcccttccctttccggtcgctgggctttatccgccctcgcccatttaacaatccggcgcgcgggacacctgtcgccggctcgccgcgcgactagcgcgccgtggccgcgggcgacagcgacgccgcgcgtaaactaatcggccgcgggagcttgcccgaaatggcagccattgaacgccggaatagtttagtctccccgcgagcgcgcctcgccagaaagcaacgagccgtacgtcgacgtagcagcggacagcgcgcgcggatggtgggtgtgggtgtgggtcgtggcgtggtgtgcgacggcgaacgtcctggcagggccgtgtggcgtgtggcgagagagagggaccgaatgcgtgagccaggtgggcgcgcgggctggagcagcgcgtcgcatcgatcccactcgccgtgacagctacgccggagataaaataaaccggctgaatcgatcgcccggccgtggctaagctagccgtgtaggaccaagctacttacgggctaggctacagggctctacgtggaggcgagggggctctccggtcttgccggccagccggccaggacggcatcgtgaggctgtgacaaagatgccctttgctcggtccccggttaatttagtgaggtctaaagagaagagtaaaagaacatcccattgcaacattctggtgcctcgactgctctcccgccctgatgtgatttattgattaattatacggagtagtaagagtgctgagtctttttaatcagtgcaggaattaaattctactgcaaggttatatgcaacgtgttcccctgttgctcgtaaaagagatacgaccgacagggagaatgactgaatatgcaggaagtagagtgaaattggttctgcttgcctaccttgggctaactactcgtagtcgtagcaaaacgaacaccattacaccaatattcatgcaaaagttttcaaatcaacgcctatttgcagagatcaacacacgtgttaattaattcgttggtcttccactgcaaatctgcaagtcgacggctgtggtctctcctatgtcctatctaggctagttagctttcacgggtttccacaaaagcaatgtgtagccaagcgagttggcagttaacgaaacatctacttcgatctgatccctagtttaacaaactgttcaaacttcaaagcgtgtaaaaggattagatttgacaaaggtgcattaaccagtgatcagtataccattgtacatgctgcggcggcgccgtgcgtgatcacgctccgagatagcgttactggtttggcggcctgcaacgacgacacgtcaatatataccagtaaccgcgtttccccgcctgacaaaacggagttttatacaattctagtgcactaatcaaaggttagcgtgttcaagtgcaagatgttagcacgtaactatatagttttctatggcaggagagctttgctctggtccttctaaagtccagctaaagtgcccgtctttttatctcagctttttttcccatcttacaagctgatgagactaggggtctttctctgatctgccgagagattaggaagttccggtcggttctgagatgtcaactggtggattggcctttctttgctctgccccatcacgcatgctctttatcttcagatcaacagggtaaatgatgagtgctgaactgctgactgggaggatcgactgtgtatggctccgtagtataccatgaattaattcttttgttattttgaacgaaccgcaactgattgtgcaattcttttgttatgaattaattatgaatatactccctccattatatatttataagccgttacaaattatttttattaaatattatgtaaatatattttgataatatgtttgttttatgttaaaatatggctatattttttgaaaaaacttggttaaacttaaacgtgtttgactagataaatattaaaactacttataatataaaacggagtgagtagatattaggatgtgtgacacagcacaaacacgaatggaagtggttttcattttttactccaaatctttgtgtcatgataaagtgaacgcacgtcactactaagcgattagtttttgttctcttgaactagcgcaacttcattgttatatatccacttgcttctttatatattacattttccttggcaagaagtattgctaagttccggatgcaattatgcagaaaacgacttatcgccttaagttcacaactaaaacatggagcatatggccaacttaaatttcatgcacgaataatatagaataaatagcatgatattcttctacatgtgtggttactattacaacatatgtccacacatgttctcattcaggtaataataacctaacttaaaaggctgtaaaagttatactgttggacaaagcctgacaaccattcaaatgaaaaataacttaaaagaccactaatctacacgataagaatatattggtatacgcttgattgctagtagtgcttacctaagtggtgtgtttatttaagagtttgaacaattgaacagaaaacaagtatatgcagcatgtttttattgaaaattgcctgattttgcaccaaaaaaaaggcatagcctaacggcaaatctttaaggtcattaaatttctaactaaaacaaacccacatgcgtttactattagcgtgcaccaagatttaatctcaggtgagtgtagtcatacacttcaccatttccacataattcacattataaattagaaaaggacattactttattctttcgacgccacaaattactgtagctacggtgtaaagaaccatacagtttccatgctatactcccgtcaaagctagaaatactgttttaaacattgacaagttcttcaaaatacatttctgttgtaaaacattttaaaaacctaatgatattataatttcataaaatatttttaaaagcaaatgttctacacacatgatttttatacacccatctagtagtaattaaatattgggaaaattgcaaaaccaccccaaatatcactctaagtttgagataccctccctgtaagaaaatttgttgcaaattcccaccttctaatttaccttggttttgatttaggcaccttggtttggaatatatagtgagtttaccatgaaaaacacaatgaaatgaccatgataacacaacgaaatgatcgtcttatacagaacaaacaacataatctcttgctcccgccgagtgggactcggctgattttgccacaagattcttcatgaatcacgtacgtgtggagagaatgtgtctaaatcaaaccaaggtgaattaggaggtggggatttgcaacaaattttcttatggggaggcatctcaaactcagagtgacatttggggtggtttttgtaattttcccttaaatatttaaaaggatgcatgctaattaattagttttgtatagtttgacttaaacaaatttgaaatgatatgatatgtcgtatgtaaaaaagaaaatgatatgaaggaaacgctagtggttttgtgtggatacatgacttaatccactaccactagagtataaaattcttatacccataaaatattcgcatacgcacttgcgctatcaattcagtgatattagtgattttctgctagcctttatctgtttagcactttctccgttttataatgtaagattttttaacattgtctgtatgaatatagatattaatgaatctagacatataaacggaggaagtatgtattagagtacatatattttttatcggaaactagagtacatgcatcagcgtgtacgtgtgtgatggtggtgtacgtgcgcgcatctatctcccgtgtaatctaaaaacacaacacctgcatatgtcatatctgctacctacttttctcgcgaacgaaatcggacggcacgcactgtacgcaccacgtgcaacacgtaccaagtaccatgttctcaacctaataaaaatcagctaattacctgtgatgatcggtctttccacgcgataataccattgtcacgaacccatcatgcgcaactaacgaaccccgcgccgcgcgaggatgacggatcgctctcatgaaccctacctatccatgaatccatccatccatccagcgaaattcgcttccggcatcatgccatccacgatcccagcggcacaacgcgccacacaccacgggccgctcgtacaagtccgttgtgctgcgtgcagagtgcagcgtgctcctcgacaaggaatctctatctctctcgtcaattctcctctgctctcttttttttgttttttttgtcccatgttaatccctactagtactaagctaaagcgcgctctgatgggggtgatattatcacatcccgatcccgcgatatcatcagcgcccactcactcacgccgcgcacagccgcgcgcactcgcgagcacgcgcgctttacgctttttcttacggcctaaaccgtgtgagcgagcgcgcgggggtgagcgagcggtggattccacagtgtcgcgcgcgcttgaccccgagtcagcgtgcggtcccgactccgactccgcgggcgcggttgcgcgctgttggttggagtacgccgcggcgaacgacggggagagtggtggactggactggtagcgtgacggtggtggggttaggccccggggctcccgtgttgacgacgcggcgacccggccgaccgtataaagggagacgtactccctccgtactcgtaaagaaaatcatttagaacaatatttaagttaaatcttagaaatataaatcatgaataatcacaagttgttgagtttaaaaatacaaaaattatataaatagatttatcttaaaattaatttcataaaagtataaatatattatttttcaataaatatttttataaaaataagaagttaaaattgtgttttggagatcgtgccgtttaaaaaacgatatcctttacgagtacggagagagtataacacgagtacacgaggcgcggcgcgcgggcgcggagcggcaccggaggtgaattcgccaaaacgtggtgtggtcaaagagaccgccccggccttttggcggacggcgacgggtagctatattaatcgatcggatcaaggcgctgctacgctttttacgctgctaagcgcgtcgcggctggcgaagccttgaagcgaccgtgatgccccccgcgacggccaggtgtttaacgagttaggctagcgttgcgcgcggtcgccgtcaggttgtgcttgactgtccggtgaataccatggagaggtagccaaagggaaattaccagcaaggacccctgatcgttgccagtggtcggcctcacacacgtgccaatcgagaagagatgttgtgaccaagttgaagcctgtgctgctgtgcccaagtagcctgtccgtccatgtgttattgtgttgtactactaccatggtgtgtactgctactagttgggcacagtcagatacatcggaccaggagattcggagatcgcttcgagctggatggactgctagcatggtgtacaggaaaagcgacgtgaaggagcatgtccgtttgacttgagcagcagaaactatatatatatatgcgattcggcgaaggcctacaggctacaacttgacggaggcctacaggctacaacttgaccgacttgaatgcatggtaggccatgcgcacgtttcggcgcaagtcaactgcacatatggcaacgcacgagtacgacactcttaagacaggtcaactgtcctaggccagggcttgtcccaatgggcacctgagctggggccatatgtgtatcttgtatctcatcctaaaattttaagccatgtgacatcgaatgtttaaacacctgcataaaatattaaatatagtctaaaaaaataactaattgtacagattgcgactactttgcgagacgaatattttaagcctaaatgctccaatgtggtgctacggtaaacatgtgctaatgacaaattaattaggcttaataaattcgtcttgtggtttgctcatagatactttaattagttttttattagtgcccgaacactaggggtgggcattcggtctgactgaaaatttcggtctcggtcttcggtctttgaaaagtgaagaccgaatttcaacgcaaaaatgtcaggaccgaaaaattcggtctcggtctcggtctcggtcctgaccgaaattcaacaatattttcatacatgcaaagaaataatgaaaatttttaacacaaaaatcacaaaaaaaaattataagcacttatgagttaagactgttattaggttgcatgcctagaagaagtagggatgtaaaaattatagtttaatcctatttaatatagtggattgtaagttgcatttacacttttttgataaatcgatcttttcgatctattcggttaaccgaggagactaactaaattcaccgaacaaaattcggtctttcactgcctaggatcgacttgatgaccgaatttctcggtctcggtcttttcggttcggtccttttctgcccacccttaccaaacaccctatataatacccaatgtgacatgccaaaactttacacccctaaatctaaacaccacctatatagcagtattgtgtagtatcctactgtagtatggatccatatccttttccattactgcacagtgcatagcagtaacaagctaacagcagctggcatgtgggtttatgatgtgtgaggtctacctgtcagctgtaactgttgtatagcaataaatgcgtacaattcatgtcatgctagtatactactctgttaaaaaaaacacattcatcccaacatgtttgtccagattaggattggtttttttttatggaggggtatgtgttttgcatggatgtaaatgcactgtattgttctaaaatctaaaatcttaagtgtacaaaaatattgcatacattcttagatagatagaaatattgcataccacttacatctcttgaaaggaagatatatattggttcaacctaaaaggccacgcatagatcgaacaatcatcacaacatagctatatttttaggaaattttattttgtgaaagttagaaataagtcataatcaacctgggactcaatccaccaattcttgtatgtggctcatattaatcacatactcaagcaagtatattcatgctaaagtttccacatattcacacttcatgttttagggaaaaaaataatcacctttcttttactaaaaaaaaatcacccataacctttgtcaagtcgatgtactagcacgtctacatatgccatattgtacttctcttccaacacatggacactcagctcaacaataggatttaacaagcatgttctcattttaattttgtttggtaaatcggccaagttaaaaaaaagggtaagttgaagtacctattggacctactgttgcagttaggggtgataatgggcctaatattattttctacgaaatttgagggttagatttgaagtggagtggactgaatttctatatattttctttactcaaaaatatattgagattgagttcttttcttctctttttcaactcacctctctcgttttccacgtgcacacttttcaaactactaaacggtgtattttttaaaaaaaaatatacgaaagttattttaaaaaattatattaattcattttcaagttattcttatctaatacttaattaatgatacattaataaaccaccacgtttttcatgcagggaggtccacctcacgaacacagcctgagtaggattgtgaaaggacccattacaaccctgtagtacatgccacaccgtttgacacctatttaccggaaacaacacatttgtagtgatatggatctaattaaccttaccatatttagtttcaaagtgcaaaccttaaaaattagagttatttaagtttcaaaattcatacccttaaataaaagtgattttaaggccttaaggaggaggcacctcatcttaattgtattatttatttattttgtaggagcactgctacacgtactaaatttcttactaaatttgtgtagtatatatttatacatcaacactagattagagaaataccgagagatgcaatactctgttcgtactaaaaagtgtggtaccccggtccatcctaccgtaagaaaaatttgtaactactatcacatatatacttggttgattgagtttttgagtgtgattaaaaggaatcattttgcaaattgtagcgatctggccctccaggagaaatagctgcctagctacaaagtaggaaacatggttggttttgtccttgtcgtggctactccaagcaacaccaaaaaaaacgcatgcagctaagctaggcagaggcagcgctttcggcaggaaatcctacggtaagtcggtaatccatcatcatatcagcggagacaaagtgcggaaaaaaggtttatcaaaattacccgcgacaccgatcgaatcaccgcgggggcatttccggcaaccccgtgctcctccgaaagcagtagtggcagtgggatgcccctgacagcgacatggcctgggccgtggtgatgagtgatgacccggagaatgagagaggcgactgtgcggatatatatgcagcgatagctcactcggttgttgcatcgatcgcttcatcactcgctagctcatcactgcgagcggagacagctcaggagggaggaagcaaaagaagagagagagagatcaagagatagacgaagagatttgtctgtgtaaatcaatggaagggcagcagttcgcttggggaagggaggagggagggtggaggaaagggccatggacagcgcaggaagacaagctgctggttgagtacgtgaggcagcacggcgaagggaggtggaattctgtcgccaagatcacaggtaggtgctatagctactgattgagtggtgttcttgcatgttcgtgaccatttcgatgttctctcgcacgttgtcccaaatcaagaagctcgatatatatagccttttaggaagaaattatagctagtagcatcagtttgcatttggtttgttaaattgcacgttggggcagtcaaacatgcaattagtacatgtttaaggttgcatatgtcgcccatgattgtcaagttgcatgatttgattccaattgcggcatttggtacgatcgtgttttcggagaataggcatttggtgcttgctctagcacatgcattaattaattaaaccgcgtatgaactgcatgcacgcgcgtgtaaattcgtcagaaccttttcctagctgtaaccgtggaaatccttttcctagctgagagttagcttcagatgattagcattaaccaagctttactttcttagttaagtacaaatgggagtggtaggtgtgtcatgtacatgttactttttctgcatatgtacgtcagctaattctgtctgatgctatgtatcttacagtactgagcctgtgtatgtcgtgctttgcaggtctgaagagaagtggcaagagctgcaggcttcgttgggtgaactacctgagacctgacctcaagcgaggcaagatcacgccacaggaggagagcgtcatactcgagcttcatgccttgtggggaaacaggtaacaacccatttgcaaatcctttcgtgatcgagctcgatcgcgtttaattttgccatgaatgtgtaactgattcgatcgatcgcattattctctgtggcggtgtaggtggtcgacgatcgcgcgtagcctgcctggcaggacggacaacgagatcaagaactactggaggacgcacttcaagaagggcaagccgtccaagaacatcgagcgcgcgagggctcggttcctgaagcagcgccgcgagatgcagcagcagagccagctgatgcaaaccggccagcagcagcagctcggccaagacgacgacgccaccagcgcggtggtggacgacaaccttgcggaggtcgcgccaccagccgccacctcgctgacccacgacggcgagctccagataatgcaggagatggcgccggacatggacgacctgctgtactaccacccgggagacatgtcgccctattcctacgacgacctcctcggcagcggcggcggcgagtgcggcgccgtggcggccagcgctggcgctgccgcctcgacgagcgagggctcaagcgaggagctcgacggcggcgccgccacgtggggcagcctgtggaacctcgacgacgtggtgcacgacatgatgatcgactgcgccgccggcgccggctgctgctggggtagcttccctccgctacaggataaaggcctcgctttctactagctatagcttaacgattactaaattgctagctagctatagctacaagcctacacactctacaagtagatgttccttttggtcttgtgcatcgatccaaactgatagcacacagcagcctgtgcgtgtggaggaggtcacacgtagtgactatgcaggtgagagcgagaggccattttgtgtacacgaagtgttggtggataaggatgcaacaccaactatactccactttgagtagctagctcgcctcgatggcatgtttggctcatttgagagcgctttttctaggagaaaaaggaagggaagagtttttttctttgttttgcttttggagaaagaatataggaggactgcaggggggaaaatcaggtgttaaaagtgcatctgagctcttgaaatttgacagttgtccattcgaggccatgtacttccaggcaaattattctatacatcatggtgagaattcattcatagagacgctagtaaggaccttcttatagtacttgtggtaataggatattactcttagggtttgctaaggggcgagcactcgttggcagcgaatgtattccaacaaactccacgtttgtcggggtgttcacgagagccacagacacggactctactacccaaaccccatcggatcagagtttcagggtgaggaacggggggagggggttcggaagtggatgatggctgacactggtgggatgggaaaggatggtggggaagatgggtgccaaccagttaagttgcacggagttgtggattgcggcaggaaagggcatggtgcgagggtttggtagtggtgttgtcgactaaaggaggtggtgaaggggtagaggttggcgcaaagaattgacatggtaaataggacaagctcaatagagggaaacctatcgtggggctcgttggcgtcgagtttcccggtgttaattttgctaagaagaggaaaaatggggcgggtgctagagggtgagggaggaaggtcgccttagtctcttgtgattggaggaggtcgtctcaaggaagaggataaggcgggggaggtttggggtaatcattgattctaagacaaaattaaaatatatttttatatttgtgaatgtacctttgatgttgtctagagggagtgaatagacacacttcctaaaattcactttgcaacaatcagtataggccgaaacttccagtgcgcgcatgaggacctacaaaacaagccaagcaaccttaccttaaaactttcggtttctataatagaacttatagtcaactagtccttggcaacaaagagcactcaatcgaaacttctagtctatatatgtactagaactttcgggaccaacaaaaagctagaacccagtgctcatgttgcgtaagatgactctcatctgtagatcaagcgatcgatttgagcacttgagtgacaattaaaccattctcgtgcatcctcttcatgtacagcatacctggaccctaattcaaaatcaaaattaaagttaacttaaatcgctttgacacatttacaaattctttctcttgtttttaagggtcaccattcgtcaatgaatttcttgaataaaactaatgtctacttatttgttaaatacaccaatccattaatcatttttgacatcaattagtcaaaatcctcttagaggacctagatgcacttcaaatttaaaccaacgtaatttccactattaattcatctatctatcatagcggcctccatcagtaccctcctaaccaccggtccatccccttgattttgcctaagtaagtgggataagtacttttattttttttctttatttaagaggacatccctcatatcttttcatgccatttaaatagttatatttcttaaaaaaaatgagagcatagataaatatgtgatatgattctataaacatacaagtttaaataaaaggaacaaattaaactctgcgtgtactattcacaatcacatttttttaacttgtatatgttgaatttaaacttgtatatgagtaaagtaatatatcacatattgatatatgatattaaaattattactattttgcatggttgacatgtacaacaacaaacgggaggcgacctcctcgagggaaataaaggttatctcctaactcgcgtacatttccatttttttagaaatcacctatgtacgaggagaagtgaaggaaaagcactaaagcagcatggtgttccaatgagtggtccttaaattaaaatcttcttttttaaaacgggcaaaagacttacacaccaatatattagtggaaaagagagagatttgacgactatgatctaccgacaggggcgggcccaaggggtagtccaggtaggcccaagactatcctaaaatttggtccagagacccctaggtattcatttttttggcccatgaaaaaagcttggcccatcaaacaaagaaaaccctaactcctcttcaggatggccgtctcccccgtgcgcggcgtgcgctctctcccctcccactcgacggcgtcacggcgacagcgctcccgcgacgcgagccggcaggccggccgccggcgcgactccggcgctcctgcccccgccactcctcccggctggccggctcctgcggtcccgccaggtgcacgcgcccagccgtggcggcggcgccgcgccggcgcccgcacggacacgtcctctctccgtcccgccgcgccttccggccatcgcctggtggcctcccgcaggccacagtcctgctcccgtcgtcccggcgtcccgctcccggctcccgccccgcccgagcccgacggtcgacgctgccagcggctagcacagcagcgcccagtcggcagccgcccaggccggccggcggccggcgccactccatctccggctcttcgcctctccggactccggtgagcaattccacagtccctctcccccttctagaatctagagactagagttctagtagtaaaccaacaggcagcactagtgtactacccctttatataacaattttgcattttttgatggttcatggttgttaggagtccaggagattgaggcatggagaagtcaagcattgcgttgctttttcaaaagcatgaagcaaaaaaaatgcttgtgaacttcttgcaaaaaaaaatttacattttgatttaggtaatatttaaacttatttgttattttctacttgtattgaaccatttagagttatatactgtatcgtttaccacattatatatcgaatcatattgtattgcattcgaattttttttggctaggcctaccctgggttcaaatcctgggtccgccactgtctactaacacatatcatggaggttacatgggagagggagggcacactaaattaactagggaaaaataatcgaactcctgagaacaacgaggaaaggagaaaaaggagaaagagtaagttactaagtgccaagaagatctcctagggattgggcaacaccgcaacccaaagcttctcttattgcacgatgcgatcaaccaccatctccgtcgtggaaataatcccctctaagacatgagcattttttctagccacaggtgccaaggaggacgagggagttgaacccctttcttgtgtgatcctacagttgctggcaagaagactcccaccaaactggaagcagagcctgttgacagggtgatagcctcttgacagggtgatagggaggctaacctggcccggttgaacagcaacttgtgctaaacttgtggtgcgaagacacactgcaccaagatatggtcacctagatatctattgattatctctatacaaacaaatcattagtgtttattattccgatgatcagacgggctagaacaatcagcaaaagataggatatgtgcattcttctggtgcatatatatgctttcgggcctgtaagatcactagcactctatataccatgtgcatttaaacttatatactctgcggcaaaattaattatactactctactttaggggtgtttgccttatcaatatatattaaagcagaaaagtagtgagaatatagggagatgagcttctttttcatatggacaaactgaatggaagaactttcttttcctagagacaactgaatagaagaaacttcaagtgcaccgtttgcactctccactaataagaatctaatcattaaaaaagaacaaaaacgacaatatgcacttggtagtgctgttttttttatcgcacatcagtttgcatgttaatttcgtgaccatatttttacttcctccgttctcaaataaaagacgtttcaaaatgcatacattcgaatcttgaatcttaaatcactactatatatgtacaagcgctaagatttaatgtcgtaaaaatgacattaatagatttgtcataaataatatttttacggagtctttttttttgtttttttataagcttgtgattagaaaaatagttatcagacatgtgctggagaatgtgctgaggtagttcttgatatgttcccattgctttgttatgtagttgggtaattttactatccttaataaggtatgaggtaccatattttttagtgtgaaacttgatatctccatatactagacatcttgatatatcaaatttttagtgtaaaatattggtattacatgtactttcttaactattataaaatttctctatatagttatgtgctatgagcatatgatatacattgtcaaatgcatatatagcacacaagtgacaaatatgtttatagtgatacatacactctccatctcataaaaaaacaaatctaatactggatacagattcataataacatgatgtatcacatattcacattttgtactaggcttgttggtttgttttttaaatagagggagtaagtagagtgagctatatgatcatttagttggtcgtacatacatactgcattatatttcattaacgtgatgcgggctacgattatcatgtatgaatgtcaaaactccattatatttctacgattgtttgtcccttttttatttagatgctttaataatcgtctgtacataggatagcttataagttatttctaagatctcgtttagcatcgtttatattttgttacatatatttttcttgctttacttaaacggtatgaaccaaacctgcactatttggtgtataactacgagtgtcgggatcagctatatgttaagttaatatcaaattatgattgttcaattgaaaaacaaaaacatattcgatttatgtagtcgtacatttaaatcacaaaagaatgatatactaaattatgaaatatataaaatatttacaaacattaaattttcgtgtagttccgattaatcgctgaacctccttccaataaccatatttcgggccaagcccatgtgtgagcaggccgaacactggtttcaagcccatcaacaccgcctccacgccgacgcccgcaaccagcccaacccagccaaaccgccaacttagaaaaacggagcaaagccggctaacttacctcttctttagggtttgtgccttccccccaatccctcacaacgcagccgccacaaaacccttctccccgcgcgcgcgccctccgctccttcctccgcccagctgcccgccgctcgttcgccaccgccaccgccgccgccgccggttggtcccatacttctcttcttctgatctttccggcatagtcgtagccgcgtggtggtctcagaagtaaatctcacccctgtttcgacgaatttctcacggttttgtcctgcagctgcgtcgatcgaagatgtatctccagtactacatcaacgagaagggggacaaggtgtacaccaccaaggttcgtataggctttccccttgcgcttacttgtttgattagtgattattactgtatggtttgcgatgttagtccatgcctgagaggtgtgtctcctcgttgcgttgcagaaggaatctcctctcggtgttcccacgcagtctgctcacccaggtacggtcacttcctctgatttctttatctgctcttgggtcataaaccaatctatgtgctgtttgttttagtgtaaataagaacttaacattcggtttgtatgtcaatctcattgttggcctaactataaacccgcaaacagtttgaagcatgaaaggtggtatactttttgttgagattttatagtctcgttttgtcatgcataccttgagctatcaaagggtgcttagaataggactggctaattagtgctggtctgctgggaattttgctgagcacgaaggcattgcctaaccagagttttgaatctgctggtgtgccttatactagtattttgggtttttggaactgattctcagatgatgtacggacattttttactaagtagaacagtttttttattgttcttgacttaggctgtgtttagttccacaccaaaattggaagtttgaagaaattggaacaatgtgatggaaaagttggaagtttgtg

SEQ ID NO: 60155 - DNA, 1054 bp, Oryza sativa
tttttacatggatatcatacggtggatggtcaaagaatctaagccttttttccctgacaaaaattgtgactgatagataggaactgatccacctaaggttgcacctctccatccatgcactgcaactgatatgactggttggcattatctgtcttttgtttctgcttcacctgattcattgatgaggtttatgctccatatctaaaagctaatctcgagccaatggtatgtaaacatcaggggataaaattacactgttcgtaatcaggacaccagggcgggacaagaagggttacttcactgaagaatttgtcccgtatatggcacaatatcggaacgataactaattactctgtttgccttcgttttcagttttcaaatcgactgataaccttcctgcagaatcagggcattttagggcacatgacaagagatggcagattagagaggttgcaccgccggtctgccgaaaccgcaaaagcgagagcaaatcaactaatctctttttagcgcagctaatcagccaatgaagcacgcactagtatgctaatcgatcgattagtagcccactttgtcaagtgcaagtactgtttttcctgtaaaaagtactgttcgcaaagacttgacatgttttgtttggacattggagcaactgtatgggtctgaactctgaagaggattaattgttcagcacaattggtattttaagcttgaacatattttaaatctgcagttattctaataagtaaattacagctacggtgcacgaacttaggtgcaatagaaacaggtgtaacaacctatataaattgttcgcttcagacaacaatttgcttgcgtagtcacatgcaaaccaaagtcaaaatgatctatatacgcaatcaaaacatgcagccaaaatttactaccggatattctgatgttgtggttttagctttagacatgacaaaagttgatgcctagaaaagacactgtcaaaatatttatctccagttaaataggactataggttagaaatgcccctagctagccccaatgatcagactctcttcct

SEQ ID NO: 60156 - DNA, 55972 bp, Oryza sativa
  unsure (1)..(55972): unsure at all n locations
cttttccctcatatcaaatgtctagacacatgtatggagcatcaaatgtggacaaaaagaaaaactaattgcacactccaactgtaaattgcgagacaaatcttttgagcctaattacgtcatgattagccataagtgctacgataacccacatgtgctaatgatggattaattaggctcaaaagatttgtctcgcaatttacaggcggaatctgtaatttgttttgttattagtctacgtttaatacttcaaatgtgtgtctgtatacgtcaaaaaaaaaactggcgatgaactaaacacggccttagaagattgagcttaaagaggtcatagctctttgttcacataagccaatctagtgattgcgttccttgtttagtttcatcaagtgttctacatgtatttttgagggaaaaaagatctctgaggttgtgcttgtgttgcagctcgcttctctccagatgacaagtactcacgccagagatacctgttgaagaagagattcgggttgctgccaacccaaaagccagcaccaaagtactgaaggagaaacctcggaccaccatgttccatggatccctcgaagcgaatcagtcttgcctacctcgctatttacctgtatcactcaaatgatctgatgtatcgcgatgctatctacgaatcgtacttcctctcgaccatattagtatgatcatgaaagtcattcaggtgtcttcgcatgttctgaactgttggcatgattataatctaaaaagtatgaatctagactgttactagtatattgtcacctttgtgctattaggaaatcatatggtggttagctgataaagcaaggaagcaataactgccattttattcaactgagcaataactgaacactcgtgagttgctactttgctttcatgtatagtactggtcataattttaaatgatggctatatgtcggataaggcattctgatagctcgcatggcttacgcggccattgtgtccaacggctaatcagtgatgccggtggtggcggcgtcgctcttggcttcggtaatgattgtagcagatgctatcgccggtgagggatcgagctggcggagcaatggactgttgataccagagctggagcacacggtgacggactgtcgtgccagcacaaatccgcataaccacagaacgtttcactgacactgaggaactctccctgctgatggacctttcctttctcatccatgatccatcaactatcccattttatgaaatgacctcgtctgattccttttcaatgagcatttattcattaccgtgcttgaacccacattactttgcaattcatggaactggaactgagatttcgcaaattgcattcatggatgtgcgaatggaactgaagtttgcattcatcatgaaaattatgatgatgatcagtctgcttcctagatcagaaactgtggtattatctgtgtgtgtgcagacaatttagaagagaagaccgcagagatacaatagatgaacatgacaaagtacagctacaaaatatatagtcgacatttgtcacgaatatacatggattagcagtaaagtttttgataggggcaaaatcaatattgaagatgaaagtggggggaaaaacgaaattgtccttagaaagggacaatttcctagaaatattggcactactcagaacagtacggtaggtcaggtcgctagtgtccttgttttcaatggtgctcgcaaacttctgtgatagaacacaaagttcaaacatgtacaacctccaaaatcgacttctgtggtagaacacgatgttcaaacatggacagcctccaacatcgagaaaatggaagtaaaaacgtgtctaagaaggagcactgagtaaagtcctataagattctgaaacaagatggttacgatctagactggcctatgcatcactaactagcataattacatctcaccttcaaagatgattttctccaaaacgtccatagtaacagtgatggatatgccacaagttccttgggggacaaaaaggatgtattgtgtgtgagcgagtggatgtattgcctagttaaaagcagaagaaatgtattgcctacatctaatgagttgcaaagtgagcagtaatcatctgcactctattttacatataggaaaacctttcaaactactctggagaagaaaccatctctacctccctggaggatggatcatcatcttcatcttctgagatatcatctccagtgctggttatatctgtatagtttgcctgtctaacaaattgccctcgcaccctcggccttgtttcagcaagtttcttcctattcacgtacctcaccttcttgtcaaaacaacgttccttccttttcagcctgaatttggcaagtgctgcagctctccgttcagaccgactacatgtttcctcgggcattggtgtgcttgatgcctgtggccacatattttgtgttggcagttgatttgattgaatgctcataccagcaggattatactgaaatggtggcatcatagatacaccatgacattggggataaacattatactgagggagcaacgtttgtggtgtatgcacttgagcgttgtttatgttcccttggaaattttgcaccggaggatgtgtcataccgtggtccatcatccctgggtaataaaagggaaaatgatatacaggaggagttcctgaagcatcattttggccttcattgcttcgctccagatgcaagttagaggaagaaaagcataccacagggtattgcactggcatctcaaaggcttctttatcccgaatatttacatcagtgccagtgtcacttctgtcagttgtactagagaaattacccctgtgatccgaagagtctaaccgatttccacctttttgtagttcgctgtcaaatgagctggtagttggggtgcttgacttaacataagctagaaaagcagaagactcagcaaccctcaagttagtctttattggacgtgaaaacattactccgggagatgctggcataaaagcaaaggcataaaccttagaaactattcttcaattgggggatctgctaaatcagctaaaggaaatggtttaaggctcaagatacttacaagcttggtcgccgccttcagtagagactagtaaaccctctggtgtgcctttttgtttaggctcagcatcagaaggattagactgcaaacatatcaagaaatgcaagggcatttaacaagtagactgatgcaaaaaattcagcatcttatcatcatcaattgaacatatgaggcaaaaaggcatgctctagcatctaaacagaacacaaaggtagaaagatactaaatagagaagtagtatgttggacagcaaaatataaaaggataactagtacttgattggttacctcatattcatgttgattcgaggtgcttgtttcttgattaatgttttcttttggcttatcatctgtgtcatccgagagaagagtggtgctgttggtattggcgtcactaggttccgataacgccaactcgaaattgtcattgaagaagtttttctccgacaaaccaagctgccaacaccaacattcaacttaagatcaactcatacacgctacagcaacgccacagccatctcagcttagagcatgcttttcaacacagaatttgaagatgaatcaacatagtcccctttaccatccgccttcgccgccacacatgggtccagaggttcagcagctcgttcatgcgcagtggcttgaccaggtactcggctgccccgagacgcaagcacttgacaacaacagagacctcgtctctgttggacatcactgcataattcgcatcaaagatgaggatggtcactacaacaaccctacgagcatgggcatcagaggaataggaggacagcttacttatgatggggatgtggcgcaattccttgttcctggcgatgtatttgagcatcttgaagcacttggagacgggcagatcgacctcggccaagatgatgtcgatctcccccgcctcgcagttgagtacgttgatcacctgcctcggagacttggcgcaagtcactgaaacaaaaacaaagacgtatcattccatgcgagaaggtgtgatagaactgctaattcatctactaaagcaatcttaatccttaattataagagcaaaccaaatactaagcagacaaagctgaactgaccttggtatgagcagttgcagaggaggcggagcacctcccgtgagctacttgggtcgctgtcgcagagcagaatcctcaccttgctccggtccacgaactgctgccctccccctaccgccgccccgccgccaacgcgatccccctcgccggcgcccaccataccccgacccgcacggattccccccctagccacttgtcaccagctgccgacgcgtccgaatcagcacgaacagcacagcagccagcagcagctgccggcgcctagactagacgacgcaggaggacgaagcggttgttggatctgcgggcggcgcctcctcctccatatcccgtgccgtcgccagtagtatcgcccccagaggctaagcagtgtgctaccgccgccacccgccgccgacgccggcggcgtcctcctccgccgcgcgttgcggtccggcccgcaccattatccgcgcctaatctattcaggaggcggcggcggtggtggtggcggcgttggtgtccgctctactggcacaggatattttcctccccctaccttttgctttcctctctcggtggggcacgcggctcggctcggctcggctcggcgagagatgaaagaaagaagaaaaggcctcgtcacgccgcgccggggcggtgtaaaaataaacgaaacggctcgtcgcgagcggtttgtgtcgcgtactcgcgtcgcgcggtgcgggtgtgcgtgtgcgtgtgccggtgtcaatggattcgtcacgggacgggacgggacgagccgcgagccgcggccccgtgggtgggagggccaggttggatggaggggaagagccgggcgtggttaagccagatgggcccggcctggcggcgtgtgatttcggtgagaaaatatctacgcctacctggcacggaaatatcttaatcgcggatgcgattaggggcggcgggcgtggtggggccgtggccgtgcgatacgggagccgccacgcgcgcgagctgggggccagcgaacgaacgccagggagacgcgctactgtagtagtactgtggaaacgacgacgcgagaggcggagggaggtggtgccgtggtggtgccgtgggagtgggagcgccacgcccacgtacgtgcggcggcgtccacggtggccgcgtccccgccctccgttgcggatcacgacgaaagccgcgccagcccaccgcggacgtgccaaggcggagaaaaatccagagggaaacgcggctctcacgttttcacgtagtacagaccttgatgggcagcatggcgatacggtggtggctgggctgatgagtaaaagattttgagctaccggacgagacgagtggccggtagagagcagcagctggatggggggtgttttttttttccccgtgttggcaacttgggatgcccattgccactacgccgatccggagagcgactggtcgtggacttgtggtggcggctcgtggcgccggcctagcgctttttctgtagctttgcttttcttgtttgccactggcgatgtacgtggtggcctccgggctccggcagcaaatcagcgatgctgcaaaatgggtttagcgttaacagcgctgtcgtttgtttactgatctgttaccagcgctgtaattcagtaattcagcagaatggtaaacacaaccaagatttttgattgcagctctgaactatggccaggcaaaacaatcattttgacgaagggtgtttcctccagttcactggctgtatttcttccaccgagaggagtggatggttggtatcagtgacgacacaacaacatctcgatctcaaaaatctggaggcaggctggcagccagtagcaggagcttggagtgccgatgtcatcagtctcattcacaggacgcactaatcatatttattgctaccaatgaaatcatacaaaatgagttattagctagagtagtgctgcatacaggcttgaaagtcacccaaagctactactatcagcaataagttgttctgacagtggaagtccccatatatattcgcctttattctatgacattgacacaccacaaacacgttttggcaaaggtatttatctacagggaaggagtggcgattgctcctgcctccgtcagcagagggaccaagttccctcctttgtgcatcgccatggtatctgtttgaaagacatcaatgaagatcgacgttaaaatagtgtagaaaaactctggcctaagtgacccttgttctagcgattttcttgttcagaaaaaagttaaacagcgataaaaatgcatgaaaatgttgttggtccgatgacattagtatcacaagttcacgacaaattaagaacaaggaactcaccgtcacagccaccaatatgtttccctttaatgaagacacaaggaacagttctctgtccagtccaatcggcaagagctgactgcagctcagacccatcaccttcgtattatgaggatgaattagttcaatgataaattacaatgtatgaactaaagaatagccaggacattctaaaattgactcatgtaataatatatgatcttttttctacactgttttaacgtcgatctagtcctccctactgagtgttgatgtatcagagctataagtgggtccctgtagtttcttctctgttcggttgtttagttctcttttatgcactatttgtcagaattttgcaaatgcatttctctttttttttcttctctttaaataaccggccggtttctttcaaaagagtgaagtttacagccattttcagcatttcaatttgattaaactcattattgcaaccagttttgctctaaactcaactacaataaatccaatgatatctaaaatagatgcagcacggcggagtaatatgttgtatatagattggagagcaaagaagacgaaatttagcatatgttagtatgtacaataaaaataaccagaagaaagaaaataacagaaaaaaaaataatccactcactttccacatccaattcaacagccttgtaacttgctgccagctctgccagcaatcgcttcactcgggcgcagaaagggcaataagtcttgctatggccagtccaggaagaggaatgacacgaagaaagatcaaaattggagtttaggacagcataggtcacaattttgcagaagtagggagataatcatgttaaactctgttttatatgattgcttgattggttttaatttgcatgatgtaatatggttgtatacagacaaaaggtaacaattatttctcatttctttcagaagctacttaaaagttgagcgcatatcaaatcaactcgttccacattatacctgtgcattccttacaaacaaaatatttcgattccatcatcagcagacaacgacgtgatacattggtaacattgctacaccaactaattggtatgcattggctggtaacttgcatgaatatggtcactatttagctccagaaagttcagcaaaataaatttatagcaaaaggaacatctttggtattgacctttttcatgtgctatcagcttagtgattatcacgaaatttaagcacaaattcagcagaggtttatcatccttgctgctacatcatacacgcgagtgaataaaaaaaggaaaaggtgtgagagagacctgaagacgacgacgggggaggaggcgacgatctccttggccttgtcgagcgccatgaccggcttgctgggctcctctagctgctcggagtcggaggggcgcgaggaagacgaagacgactgtgccatccccatgatgcccgacctccgttttatggccgggcagaaggaggctgggtgatttatttacttatttttatctgcgtttccgcggcagagtcgaacgcaagcacgtcaagctagccacgatttcgaacgcaagggggatcttttatggccagtaccgtgtttgcctatttgggttctttcaaaaaagaccaactttgaattggatatttggaagaatcgttgctttgttgaaggggcttgccttgaggaatggcaggcgccagcactgacgcagctacgaaaccaggatgccaaaactggtttttagtcgttcaaatgtgaggcgaaatatacggcgaaaggcgatactagtattttagtttttcgattatacggcgaagaaaggtgagtactacgtagtacttcttccatcccataataaaagagattttaagtttttatttgtattgtttaaccactcgtcttattcaaaaaaatttaaaattattatttattttttttgacttactttattatccaaagtacttcaagcataattttttatttttatatttacaaaaaaatttttgaataaaacgagtggtcaaatagtacaaacaaaaacttaaaatcctttatattaggacggagggagtagtagtttattagctgttcaaacttcaaacaaacggcaaaacagatagtcgccgtgcctggtttttcttttctttaggcacagcatttgactttacagagaaccggcgagatcagatgagcgaacgtgcctacggagtacctattaggcccatattcagaggcgaggggccgcgacgaatgagatgagcgaacgtgtctacctgttaggcccatatacagaggcgaggggtcgcgacgaatgagatgagcaaacatgtctacctgttaggcccatatagaggccgaggcccggtaaagagagccaggcatgaggcccacagcggcccagacaattttagtacttttcctaccgactgacgaatcccttcttccaaaagcttaaacctcgtgcttttcagaggttagatggaatgtaggattgagcccaaccaggtgagtctcttcgtcttctcagtgccaaatatagcctatatgaacgtctcctcaatgccaaatatagcccacatgaacacatttgcccatctccacacacatcacacatttattcagcccatcaatctatataaaaatagtatgctacctaaattatctccaaattctagatagggctgttaaaaaaaatttctccaaaaaagctaattgttatttatttcttctatttcttcttaagattgtcttctatttctctatttcttcttgagattgtacctcctgtcatgttaatcaatttgttaatcccgcagcatcgcggggcattctctagtagaattaatgatttacatttttttttttgaaaaacgagaagattttttcggaggccatctccaattctccattccaggaacgtgcagtttccgcggttcattcgttaagatcaatattttctgtacgcatgtttttgttccaagacaattttagaagaatacttcaaatagtagtactaaaaaagcgagtgtagatgtagttcctcgacgtccaatcgcatcaacaaattccgcgccggatagcgagaggaacacattgcttttgcttcacatctcaccattgcccacgaaccaaaaattcatccgaaggcacgattagatctgagagaagccgagacacaaactggcaaaaatcgacgacgcaaaagtaaatcgaaccgaagctaaaaatcctattggttgatcatgagcgacaactcagtcccttagatgttctttgaccatgcgatcatctccgcaggagtcattacaggtctgtaggactcatcaccgttgctagcgaccaacagatcgaatcaaattgtaacgaagatctacataaagaacaacaacaaaaaattgattttatggcgactattgtttcgaggggtgttcggatgtatgtaacagccgccgagtgccctgcggcgagacgcatccgagggcacgattggaaggcgagctcaggatacaacagggcgattttgcttcaagggaacgagtcgattgggaaccgattagagactaatcctcccaatgaccagatgacgaagcacgaacacaatcaccagattcaccacaaatccaaaaacaaacgaatcgaacacagacgagacgagcaaaaacgaaaagagaaacgaaggatcgaacactgaaggcttctgcggcggcgatggtatccttcggtggaggggggtggacgcattttataggctcgggcgttgtcagatgctcgcggagcaaaccctaatgggccggagagagtagtggacctgggagtgagttcatgggctggaaattcgatgttaatagcctgtgttggataattttgtagttgtgtctaactatatttcgcctacgatttgcaagaaaaatgcacaatgaacgaacaaacatgtgcttgcaaaattttggcaaccttacaaataggtgccaaagttttggagctagcatgattttgggcaagtttgccagacatacctatgactttctatggtagtctgtataaatgcctgcagttgatcaaacttcacacaaccaagagtgaacatgtttggtagtctgtgccttgaggaaagaaattcagttccagtttaactggacagcacaagataatcaactttgttttcagtggtttgcgagtggataggtcgtgcgtgatcaggatcaaatgatcaaatctcacttttatatcacagcaaatttgcaaccagtggcatcacctcatgcatatgcctccagacatggacgtttattagagccagagaaacagctaacatgtaacagacaattcagataatatatgctgcctatcaagttctcttacaaaaaagatgtagctaaataatagtcaacatgcagcagacgatgaagctacatgcactaagatcagttcttgttttcaccataagaaaagcataactgcaaagatgctctgcgttcttgcaaaacacaaacaatgcctagagcatccataagatcacttcttgttttcactagtctctgctgaagtggaggatgccgatgacgctgtgatgtccctggcacattgtgacacgtacggcttcaactgcagtcatttatacaggaaatttattactatacacacaaccataattgaaaagggaaaaaaaacaggaacaagatgattccttggtcactcataccacataaagaagaattccatgttataccattcatgatcaatttatctgtcttgcctgagttaaacgtttcaacagtaatggattatggagcattcaactcattgcccaaggaatgaagtcatcatcttttcagataaaatttggacatggcaagttatttccatcatatttcttaagaaggacctcaaacagaactgagagctttgattatgttatattagctattttctgtttgttaggtgccattaagttacttttaaaagtttgcccagcaagttcagactggaattaaccagagaagcagtggacactaaaccgtggcagtatgctaattaccttgaaatcagtcaagtcagggaccacaaatcttggcaacttctcatccaccataacatatccacctgcagaattaatcaatatttcgaaaattagactaagcaagtaggttgctttactcatgaaagaaaagggatggacatagataacgacaatcagttgaatgatcatataatagttagtacaaatgtcatttgaatcaagtatcaagtaaatcaggaatacaatggagaagtatccgtcccttgcacaaaacaatcaaactaatcaatgataactaaaatttaaacatgtccgtgctccaaacaagaattgcatagaaaggtcaaggctaagttatagctaagagcaaatatccactgatggataagtctttgcgttatcctgtaatttgttacccataatcatctagcactggtaaaactgtacttgcatacagatatgtttgggcttctttgttgaatactgcctacatattttcaaggtgaactgaataccaccagactctgctcttcaatattttatgtttgggcctctttgttgaatactgcctacatattttcaaggtgaactgaataccaccagactctgctcttcaatatttttctttctggcagactaacaaacaggctgttcggatctctttgctgcggttgtgtgggctgcggctgcaagccaatgcaatagtgctttgcaccttgccatggctgcagcgtagccacagtacagctgcagccatgatagcaccaagatttactatgttctgtaggatgattatataccatacaaattaaaataccattatgtaactatgatagatagagcatttttcaatgtgtccatgagaaatttctgcttggctgaaccaccagttgaaatggacctgttgaattgaaatgttatttgctactcactagatctttaatgccttattaaactttggttactcacaccttttattgaagcgatatttgacattattgaaagcacctcccaaattacagtaagcagacaattacttgcacggttgactcagataaatcctggaacaaaacgattcacataaagaacatcccttcctaggttcttccagatttccggttgggcaaatagtgtggtgactagcaactgtcaccatttcattctccatcaacgttcggtttaattaaactatccggttcgaaatcacaaaatttctcagctaagcaaaacctggtcgcaatcttatatgcgattatacacaaagagagcatgcttgagcaatacagacgactagaatcagatcacagagcgtcccgcaaggcattacctttgcgggtgtggaacccggtgggcttgcagttcttccccttgtagtaatcccgaggcgccctcttggaggagaggatgccgagcgaggacagccgcttacgccgcatcgaccttccgagcgagctcagtatcagtcccagcggcatatcctcctcctcctttctgatgattcctgcacacccacagaagggaaaatcagcacgatgaggtggagatagcgcctcgccggcgtacagggcaacgcgaggggcacacccgagcagcgaggggtggaccggatgcggagacgagggaggtccggtggtttgcttgagaagggaggagcggaggaggaatacggcggcggcggcggcggtgggggggcgtttcgcgtatgcgtacgagggggagaaggctcgtagcggtggacggccaggatgagtacatcggagaatggacggtcgatataactttgatgatcaaggacaattaaacgtctgaacttcatagaattttcgtgtggacaaaaaaaaaaggatctgtccataatgaccactgcttaacagaaattttgtaggatttttgtacgaatgaatcgttaatattcgaggttcacaggcactatggtattgatgtgaggcttagattaagtgtagccgtagtaacatttataagtaaaaaaagaagttctcattctgttgtacgtatagtatttcttaataagccaaaacaatttattaataaataataattaatttataggtaaggtttttatatatatgtttgtgacttaaaaaccaatactgaaaaataaactacgttgaaaatatcttacaatcaacttcaaaatcaagtttgacaaaaataaatttcagcttttgctttggtttgttagggtaaccaatgggactcatagtgtttttttcctttttgaagtttgtagcttctcccgaaaagactacgcgtcaggctcgggagccctttgtctctccccaccccatctattaagggcattcacagtgcactgaggtggcattctgccccaaccatccacgtcagatattccttcccatatatgtgcgtggcgttcccaaccgaagtccgcggagccaaactaagttacccgttcttcgtcataacttgcagcgagggtggagcggcgcgttgggagaggccgtagccccatgcgatgcccccacatcccgtgcgaagtggcgacggtcgccggcgaggccgccgccccgaccagctgcgtcatcccctaagcggtgcagcttgctagatccggcgaacccgaggctggatctggtgagctcgacggggtggcggtggcggctaagcgaggagaaggaagatggcggcggcgacagccaagcgaggagaagaaagatggtggtggcagcggcctagggaggaaagggatatggtggtggcggcggcaacttaacctcgctgttgtcgccattccgcgccaccaaggaccacagcagcggcagctcgacggagagggccacaccgccagatccactccaccaagctcccgccgtgcccccgtcagcgccgtctcccgctcgcgcccgccgatgggaggagagacgtagccctgccgtccacctatttgatggtattttggctattatatgtgtacacaagacttactcatgatggacaaagcaaacaagcagtttgtaagttggctagcttatcatttctacgcaatgctcggccatgtatatacacgcaaatacatgcatgcacaggcagctgggaatatatatacttggattagtatatgtgcatgtataattaaccaataactagccgtgtgaagattggctggtgaggcaatcacgtgcatgcatgcatgtactacagtagacggtcgtatgtgtgtgcatgcctgggtgattaagcaacctatgcatatccgagtgattaatcataggctcggcccatggccgaagacggtagctgcctacgcgccaagatttcagaagttaatatgcggaagagataaaaccagatgaattaagagataaccaacaaaccaattgattttatctctataacaaacttgatctagttagttacttcgcgcgagcgctggcgaggcgcttatcaccggactgtggcccagcagcagagaaacaaagcgaattacaaattagatatttgacgccaggagaagctaagagataaaatcaaagaaggatatgaacaaataacaaactgatcgatcaagccttatctgcaacgaacttgacgcggaggaaacggcgcgcggacgcggcgagcaccgacctcagacccctatataaggcgtcgacccctcggtagccaggggcattcacgaactcatccacacattcattcaccaacgcatctagcatccacaagccacccatcatcaacgcatctacccatccagcatcaacacatccatccatcaactctcatcggcgatccatccatcgacgacacgcaccggcggcggcgagcgacttcggccggagtcccggcgtccggcaggagagggcgcgcgcggtgatccgatcattagcaagcgcaggagaggagcttgatggctagtccaggtaaaagctagcaagattgtttcgttttctttcatctacagcacgcacacatccatgcatagggatccatctacacgtatcgtcgtcgccggggaagtcgcggtggccgattcatctacgcgtcacagaagcctcatcgatgccggtgtctgttcaagccgacgcagtgctacttgtccctggactcgacgctgctaattcaagccgctggtgatgcatctacccgaagctgcgacctcgccgagataccagacatccttgatttgcaagcttcaccgcactggagcgggctaaccatggaggaggtcgtcgggaagccgccctgccggagcgcgccgaggatcggcggagctgccgccgactgccaagacttctatcagttctcatgccggaggtcaagcatcatgcatggcgtcgaaaccagcggatgacgatggaggcaagtatggctgcagtacagaggaaggacgacgggaggacggcgagccagtgctgttggatggcaacaagctagctaatgcatgttgattaagttaattattgtggcaacgtggccaaccaatcggaggacgacatgtcatcgctgctacagtgccatgcacaaaccaatgcgtgggctgaagaagtcctgttggtttttcttatttgtcccaaatgagatgccgagctttgattaaatccggccaccgtctacatcaaccatcttcaataattcctccctgattcttctctaatctaatctcgacgcaactgctgtgacgtcaagtcgttcaagctacgcaactccatgcatgtcttcaccaacaatctacatcgacacgttgttcaagaccgacaaggctagacgacggagggtgggcgaccaacactggcgcacggaccgacgaggccatggatcgctgccggcgctcacacacacacacacacatctacatcatcatcacaaccatgcatggagaatgcgaagtgaagacgacgagacgaccacaagcagcttaatcggaggttctcttgcaggcctagacctgcggaggtaattaactgggagcttctcgaggccccaggaaccaggagaccacatcgcacaagtcagatctgtccaatgacagattatggagcgcgcatacatatatattacattgggaatttgtatttatgatcttttaagattaataaagagcatgtttcctatgttttgtttacattgtgtattcaggtacactggcacgcccacacatatatgtatctctaaacaaacgagatctcagatgttattttccaccctaaacaccaccgtagctccgcttggatccgagtccatcgccgggaacgctccgtgccgacgcctcatttcctacgcgatagaaaaggcgatgtgatgaaaagcagagtgaaaagtaaagggggatagagagagaaatagagagagtggggggacccaccatgagtgacctccactgtagagcatgtagctaataccgttcctggccttggtggcaagcgaggttcggcgaaaatgtgtggcacactgttactgccctaaatgcagtagactagtactactactcgatacaaaaagtatgcatctttcctgtctacgtgtctatctctttgtttctcttatgaataaatggtctactccatgcatgcaagaaggaggacatgcaacataaataaattttaaattgatttttctactaaactatttattatatatactatctaattactcctacattgttatactccttacaagtaaattttcaaaacaaaatctcaaatgattatttttatcaaatatatgattatattcctaattgaaacatttttataccatacaagaaaaatagttgtaactactaacatcgtaagatactgagtgaaacacaccaagaacaccacgtgcaacatttacacattaactagtggaacattagaacatatttattgaaacatcctaataatacatcgtgcaacgaattaaaaaatacatactgaaaaaaaagttgaatgtgcaacatagtcaaatacaaattgaaacatttgtttctcacgcatgaaacatctatttttaatggtgtgaaacatgtatattgtttttatcggaatgcaaccatacgaaatattgttatcaaaatttaattgcaacgaataaatggtgcaattaaatcgtagatttgataaatatattagtaaaaaatattgttttacaacttaatagatactactagtcgattttgtgcattcatgtgtagagggtgtatatagagagaggggcacatggggagagagggagggacgcacggtgagagtgagaggctaagagcgcagtccttgcatgcaatggcgttgcgtccgatacttccatgcgtgtgtcgggcacccgatgctaagcattgttcaacttcccaattatatattctatattcgagtgtaacatttgccatttgatctatatctaacaggattactataacccaatgcaacattaaggcaaaagctttgtcttgttgagaacacatacaactctgacgttgtggcaggttcctgagcaaggttacaacaacatggacctagcctatagctaaggcttggggcgacctgtggtgctctaacagtaagataacctatatacgatgaaaatttgttgtggcccatgggcttttgacaccagccccaggccatgacctagggtgttaggggcctgggtccgcctctagtggcagttttgcttcgttccaaatgttttcttcatttgaagctgtatgaatgtgttgttcacttgttcagcttccctcatgtaagtatgcaactgcacattctttgagagaattcagaatagtgtatcatggaacaaacaattgtattccaaacatttctcaacacttaaagatccgagtaaaaagtttggagtaggttgcccctaacatcataagccctttttgggctgaatattgatgcattaggacactttttctagacatacgttgcaaatttgtactctggtagcactatgatactacatccgtttctttaatatatgacactattagttttttatcaaatattgtaccatttgtcttattcaattttttcacacaaatatatatatatatatatatatatatatatatatatatatatatatatatatatatatatatatatatatatatatatatataaataaatcatgcttaaagaacatttaaagataaatcaagtcataataaaataaataataattactatattttttaataagacgaatgatcaaatgtattttaaaaagtcaacgatgatatatattaaaaaaacgaaggagtactatctctagcagtatacagtaagtactttggcagtttcagcttgcaagaatgactaggacgtatgatggatcaaggtaccacctgcagtgcttcggtattcagagacagcgattttcaatacatatatgcttagatgtttgtagattaattacatgtgttctattattattttcatcagaaaaacaacacatatttgtgaccgagctattgataaacagaatggcacgtattcttactttgcaatacccacccacacaatcctgcctcttcattgcaaatcgaacaacaagaaagatggcagcgttgatatgtgaaagatggcagcgttgatatgtcgaacaagatcaatcaaggatgctatctttcctggacacttaaaagctcccaagaaaagtactgagtaaagcatctgtctccagcattacaagcacttcttttggctgtatgttcatgtccaaggaagcttttctggacatctgccggaaatctgtgctctagtactagcctgcagtatgcgggaagcactttggcagcatcagcttgcaagaataaccaagatgcaattacagtgcttcagtctcagtacatgcttagacgttcgtagattcaagtattcaacacatacatgctcttcccattctttctatcagaagcaaaaaaatttatgactgaagctacagagccttaagtacttccaacaccgacctcacataatcctgtctcttcgtgcaaataactttatgcatttttttttcgaacgaaaggaaataacttgatgtaaaagaagatataacaataatgctatctttcaaggtaaatatgagcatctcggataaaatattcccaagcaacacacaagcaaacatttgactccacaaaacaagattacaccgagacaacttcttatctgcttccacaagatacaattgcaatgacctttgtaagggggaacaatagaaagttgaaacaactggaataaggttacaagggaatgaaactaaatttgataaactgaggagtaagatccagtcggagctcactattgccgatttatgacttgccggtttgttcatacctccctaagccacccagagattctggaatccagggaattatgccatgaaaggcatggacaaactgaagagttcttgagaaggaggaggagaaggaacagcacagccattcttctccatcctcatactgcttatgctgctcccgatctcaagaaccatgaagatgctcctgccatgcacccaccatgatctgtggaggcagagaattcaagagtcttcatgagaaaaaaaaaagacaggccaagaagccatgaggtgtctttccgtacctgattgaagttgcaaatgctcagctgttgatgaggcaaaagctaggggactagtgagagagccaagaacttgcacggtggcattttaaagaggctagtgtggtgcgctttatgggaaagaatgacaatgaaaggtagaaaacaaagtttactgtgttcagtacgtttattttactgaacatgcctcaaacatcaatctactaaacttaaatctgttgacaattctactacacttcatctgttgacgattcttcgttcctatcctacttctggggctcccaaacaaacttactaaatgtaggtataattgtagagctgtcactcctacctatttaagtgggacattcgaacaccttctgtcctccaattagagtaccaaaggcatcgatgttagtaaaagtttagacaacctctatacctcaattgatctgtcaatttttaccattttggtagcagctgctgaccaacagtcatgcttgccggcaaaagttcagaagcaaacattcatgtaggcatgtagctaaccaattacttagaagttaagcatctcacgactaacctgggacaataaacccaaccagatgtttaccaacaaacagagtctaatcagctttcactgagcaaccaaatccacagatccgcgataaaaagagaagagggcatcctttatataaagctaaagaagcaatcttccttttcgagatgcgcatttttcataatatatggagtttggagcaatgcagcctgcctgttcagccactaactcatgctgacaaagttttgcagcacttcatctgactcatgacgatgtaattctatgagggcaacaaggttgtaaattgacttagtaatccagatttggtacaaacaaactaagcttaagggcaggggaatatactatctatgcagcatgcgttactgctcccaccacaaaagagaggaaatcagcaccaccaattgtgggcaccaggtccagcactccagctacattagagctgtgtttagttcacgtcaaaattgaaagtttgtttgaaattggaatgatgtgacggaaaagttgaaagtttgtgtataggaaagttttgatgtaatagaaaagttgaaagtttgaagaaaaactttgaaactaatcacggcctagaccctcccaaacaatctcccttttcctctctttttttgtacaggtgggtgagcaagaggggaagtgaaaattcctcttgcgagtgcacccaatcattgccatcatgcacactaccctcactccctgatgagaagcactaacgtcttacagggtcctttcgaccttacgcgtcatccatgagaccatgaccaacagagaaagcatcaatatgtgcacgcatcactagtctttggactgatagtctccacctctagctgtgtgtccgtgtgtactgaatgattttttgtttgtacaaaccaaaacatgttgctatgaaaaaaattaaatcctgtccagccttgacctatggatgaactataaccttcagaaacgatggcctgaaaaggaggtaaagtagtactaaaacatcatgcttctaaagaataagtgcaaagttcatggcaaaggattctaggggtgtgtttgaggagaaggggattgagtagattgggaagatacgcaaaacgaggtgagctattagctcatgattaattgagtatcaactattttaaatttcaaaaatggattaatatgattttttaaagcaactttcctatataaattttttacaaaaaacacaccgtttagtagtttgagaaacgtgcgcgcggaaaacgaaacaaacaaactcactctcccaccctctggaacgctgcctaggtctacccatcagggagtaacaaaaagtagagatgctttactcaacaaaagaagaaacgaagaagaaaagacatatattaaattatatatttttactaagagagtccaattcattacatattctgttgtcaatcagcgctgcgaatatgtgatccatgttcagtttacccaagactcctctagggttgatatcagaaagcattgctgttataccccactactccactaaatccactcaatgaagaacaaatgtctcactctcaataatctacaaagcaattgccaacttccattcgctttcaacaatttatattgctgtcaatctgtagagtgaagactagtctaaagctaacatcactgaagggacatgattaccccacaagaaataaatgatttgttttcttcctagcatgctcagggtgagtaatgagtagtactaatagcctaaacttaaaatttatccctttttgagaggcttgatcccagcaaaaacaaatgaccaaattcaaactgcaggggacacaattcaaagagaacacaataaacccatgagctaaatatgacaaaaaaaatcaagaatgacaaaataaatggtaggatgactcttttacaggactggacaaatttatccaacatgacaaacccattgatctcctgaattaggagtattgagagattcaagaaattagtaaagttatgaacatctttttctacaccatcttctagcatatatcattttttctctaccagtatataggatagccaattctccgactcacagcaacaaccattctcatcatcgttacatgctgcggtactatcaagccacagaataatagaatatttaatccctttggttttgctttggacccaaatgatcggtgaactagtatttgtaccaaaaaatgaagtggccagtgtttcagataagtggattttcctcatatactaattttgactgtgaattggtgcttcatataatactttgaattacgtattgcaaattatacaagttcctctagaacagatattaaaaaaaaaatcagggatgagaacaattgaatgctgaaaagtacctatgatcaagtaggcaactggaaacaaaacctcgaagtcaccacattagcaacttttgcagtagaggagtagatacgtagctatgcaaattaactgggtactacaaatttcagacttggcattatcagaaagcccaagtagaaacaacaattcagactgcaatttgattaccacaaagtctgagtaactacctgacaaatttataagtcttcttggttgactatattccctaataagccacttattaggaaataaaaattaatttatagataaaaattttatatatttattcttagcgacttaaaaaccaatgctgaaaaagaaactaagttaagtatatcttaaatcaacttcaaaattaagtttaaaaattcaaattttggcttttgctctagcttattagcccaacagatgggcctattgtctatgcagtgaacagttccatactacggcacagtaagataaaagtttacaaaggttaccattgtgatttattaaggcttgctgccaagatattattatcaagattcctgtttataatttgcttatttgcacacgctactttatcctggcaaatccattttattctgactgtgatttagtgatgcctatattttgttggcgcctacaatacaatgtagatactactagcatatctgcttatgaactacagatctgcaaatgcaatggatctcaaataattatgcccacggttcccacattagatgcgcacgagtaattaaactctctgcaaaatggttccagaaatgccaacaggacaatgaacaaagcctagtcagtttagcttcaaattcaaacacaaccaatttgcaaggaatagttaatttcggagcaaatactatcgaacaacagaactgcgcagaacattcttcagaggtagtacatggctgatcacaaaggacaatgatgtgaccatgactactatagatacaaccgtcgttcacatcaagatcaagctgtccaagttctgcaatccagttcggtcacctgctacagtgtcgacttcaaacggccgccaaatatgcatgcgagctccattttaggtccatgagtacttgatggaaagctctcggagtcatctttccaatggatccagcttcatcgccaaattccatcccagtcgggcgaaatcacaaagagaaggtgttgcgtcacctataatgggcctatgggcttgtaacttcgtctgggaccccggcccaagtggggcccatgtggggtgcgccccaaccaggtggagcacgaccctagggtccccttaggtcgtcctcccacctccttaaatagttaggtacccctttacagtttattgggttttgatagattaaagtttagccattgctacttgcttgcagcgcgcgtgtcggctagaccgtccgtctgcttgttcttcggaaccccaacttatcattcgtatttaattcttatttgcaattcagattacttttatcttgttattgcttgtgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagcagtgctcacctaacagcatttattgcagtctggtcaagcgtgtcacgctgcatgcaacgcagtacagcacgctcttttatccggtctgtgaccagtcacagaccggtcagatcaagggttaggtggcgactggcggtctgacgcacgccttgccccatcccatcaagacgaaagcctctaggcactcgtctcaagccggagcaagcgtgttatttcttagagatggcacgttagccctggttagatttataccaggcttcatcctaaccattacaggcaaggtgttacacgaaaaagggcaaacgtgcacgttgttaaactgacgcgtggtggacaagaatgaccggtctgacactggtcgcatcagcaacgggcagccacgatctcacgttgcgcccgtctccgccgggagtggaggtaggtgtgagttgtcccatcgaagtgtcatttggacgacaaccataccaatctccgcccattaaagaaaaaaagaacagtccagtttggaaagggaagggtgcatgtggtatccccttgaagtataaaaggaggaccttgcccatagagaaggggttgattctggccagatttagagcttagagcgggggagaagtgggctcacactttgtagctcattcatacacaaatccacaaaaacacaggagtagggtattacgcttcgcagcggcccgaacctgtatacatcgccgtgtctcgtgtgtcttgccggggagtaatctttccacatacagttaaatttttgagagagagcttgagattgcaccctaagcccccggccgaaccggcaaaggggggcctgcgcggtctcccggtgaggagcctcgagctccgtcatctggcgcgccaggtagggggctcagcgtgtgttttctgagctctcatactcttccgtgtgcgccaagtttcccttgttcagcccaatggccgagcaagcaaaggcgcacgatctctctccgagtgtgagcggcgatgacggggagccaaatccgcgccgccgagctcgcactcccccacctcctccacgccaaagtcccaagcagggggaggcgctcgatagagtcgagaaatccgcagcatcaccagtcgcgggtggtgcaggagaacggcgagatggggagcgtcgcctcctcgtctacggcgacggcagcacgcctcaaggcgcgcttcaggctgttggcgcgctcttacgtcacccgcctgtcgtccctgacccggagtctccagcccagcgatggctggatgacgtggccaacttggtcatgacggcacagcagcgcctgggtgctggtggacggtccgccaccaccaagacctccggcgccgctaccaccggctccgtgtcatcaaggcggagggcgcggcgagcggcggcggctgcacgccattcggctgccactccctcgtctacaccgtcgactcgggaggatcagcatggggagccggatgcccgcctcaacaccgggcgccggcgtaatggccggcgtactccccatgcaacggagggcgcctcctcgtccagagtgtcacctcgacacggacgtgaagatcagccctccgtgcccccggccggtggtgttggctgtagagcctttgtggcgagtcttcggaatgtccgttggcccccaaggttccggcccaccatcaccgagaagtacgatgggagcgtcaaccccaccgagtttctccaggtctatacgaccgggatcgaggccgctgggggtgacgacagggtcatggcgaacttctttcccatggccctaaaaggacaggcgcggggttggctaatgaacctgccacccgcgtcggtccactcctgggaagatttgtgccaacagttcaccatgaacttccaaggcacatatccgcgcccaggcgaagaagcggacttgcatgcagtacagcgaggcgatgatgagtcgcttcgctcgtacattcagcggttttgccaagtccgcaatactataccatgcatccctgcacacgcggtgatctacgcgttcagggggggtgtgcggcacaaccgcatgctcgaaaagattgcctccaaagagccccagactaccgcagagctttttcagctcgcggaccgagtggctcgtaaagaggaagcgtggacatggaactcctccggttccggagtggcagcttcggccgcccccgaatccgccgctcagacagggcggcgggacaggaggaggaagaagaggtcggcccattccgacgacgagggtcatgtcctcgcagtcgagggcgtttcgctggccacccgaaaggggaggtctgcgagcgacagaaagaaggccggcgctccttgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggactgagcaaactctcaccaatgtgggagggtccgtatcgagtgatcggcgtcccccggccgggctccgttcggctggccacgggcgacggcacagagctgcctaacccgtggaacatcaaacaccttcgtcgcttctacccctagtgggggtcgggtgtcaggtttcgggctcgggccaaccccgcacccccccgggcgtgcagggttggccgggggcttatcttttttctcttccgtatttcaacaaaagcattttcgatttcctaaaggctgtgtctgtgcttttgtttcctttttgaagaatcttgacttgaaataggtcactcgtgctcaaccttgccctcgggggctcggttcggtcagctaaaatcgccaaacggggcccagaaccgagccgtgccccggggcgtggtgaactccgggggggaatcggcaaaaacccacaatcgggtcacccataaccctcggtcaccacgttcccggcctggccagtctcgacatgtggatctccccaggcactagccccgacccgagccatttgaggactaggacctgggcacgagcccttgatcaagccaagacacagaaggaccgcggcacagaccatcctcgtctcatacacacaacaaatagaattgacatagaaatttcctctttatttggttgcagattaaattagtctatacaagaagggggcccgaaggcctcggaagaagaaagaaaaagctattcaagattggcaggggcctgggggctcactccgacgcgcccgggtcaccagccttgtcgtcgttatcgtccgcaccaccgtcgccgccctcctcgtcggagtcgagggcgaacgcgagccgaggggccgtaccctcgaagctgtgaacgatgtggtcggcggcgtcccggacctgcgcgcgtgcgccgtcctcggttccgaaagggaactcttccagcgctgcccacggggagaagtcagggtccgagaggcccccaagccgaacggcggcccaaggcccccgacggccggagttggccctccgcctgcttgtccgacggtgtcaggcgcccccgaccctcaggatagcctcggggccactgcgggaaggccgcgcctgtcgccctcttaccccgaggatatcggcgcagaagccgagggcgccccgcgctgcctctcggatgaagagcgccctggagatgcggcccctagcgaagaggatcggccccgccgaaaggtgcagcggcccgtctactttgttagtgaggccctccgggacgccaaaacccgataccctcgggcccagaagatgctatacgctattctgatggctccgagaaaagcaccatcaccatatctccaggcgaagcaaatcggctcgcccagattcgtgcgctgctcaggtaatgtggcagtcttgaagagaccgcccattatggacagccaactcaccattaccaatgtgcatggattgagaccgttgggtattttgcccaactacggagaccggtcccacctgtcaccaggctttaggggtggcgtcacacctgaccgcttcccttgggaagggaaattgctctggcataacgccgggggctactgtcggtgatatgggaccgggagtatcatgactagaggcttgaggcagacacaatcgcccacgtggcctggcaccttcggggacgtcgggcccgagggtgaggtgtccgccctcctcctgatttcccccgagggggggtcgggttgcgcttgccccggccccgagggccgaggcaccccgacccccttaaggaagtctgcgccacatatatgggataagtgagcacagcagtgctcacctaacagcatttattgcagtctggtcaagcgtgtcacgctgcatgcaacgcagtacagcacgctcttttatccggtctgtgaccagtcacagaccggtcagatcaagggttaggtggcgactggcggtctgacgcacgccttgccccatcccatcaagacgaaagcctctaggcactcgtctcaagccggagcaagcgtgttatttcttagagatggcacgttagccctggttagatttataccaggcttcatcctaaccattacaggcaaggtgttacacgaaaaagggcaaacgtgcacgttgttaaactgacgcgtggtggacaagaatgaccggtctgacactggtcgcatcagcaacgggcagccacgatctcacgttgcgcccgtctccgccgggagtggaggtaggtgtgagttgtcccatcgaagtgtcatttggacgacaaccataccaatctccgcccattaaagaaaaaaagaacagtccagtttggaaagggaagggtgcatgtggtatccccttgaagtataaaaggaggaccttgcccatagagaaggggttgattctggccagatttagagcttagagcgggggagaagtgggctcacactttgtagctcattcatacacaaatccacaaaaacacaggagtagggtattacgcttcgcagcggcccgaacctgtatacatcgccgtgtctcgtgtgtcttgccggggagtaatctttccacatacagttaaatttttgagagagagcttgagattgcaccctaagcccccggccgaaccggcaaaggggggcctgcgcggtctcccggtgaggagcctcgagctccgtcagcttgtttcttcgatttgcttgcaggaataaggttgatttgcaccggcaagatcaacaacccacggagaggtgtatcgatcgctaaggcgcaacacaacgtctcgtacggttgtagtcggatcgttaacgtttctcccaaatcgtagttatcacaactcaccgaaagatcgagccaacaacagccttgagtgtcgaaaagaactcagggttcatcaagtggtatcagagctttcgttgctcggtgagtttttatcttcctataactagaaaatagccatacaaaaaaatttgtatcatttacctagccatattgtgccattgcattgttcttttcagtttttactttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttgagttcttgagttgcatctagagtttgccgatccttgtgtgtgtttgtttttgccgtgcatgtgcgcgtgaagaagaaggaagcagaagatgcgcatgaggaagatagaaggagaatattagactagattagattgctttcgtttctatttgggggccacgcagaaaaggaatcggtttccttcttttagatttctcaccgagtcccaccaccttccatgcggcattccccccttgagtccgactccctctcctttccttttggttcaatctacaccgtgccatcccatacaccttggtgaattttttgtttggtgtcggtttcgagatctgtttggaaaaacggaaccggcataaattcagagcattccatttttgtataattttaattttgggtttagacttttacatttgagtccctgtaaattttatatttacgtttgagtccctgtaaccttacattaaggtccttgagtcagtttttgttaaaaaaatcaagaaaaaagtgagaaaaaaaggcagaaaggtgcataaaaaaaagaaaaaaagccgcacaaaaaaaaagaaaaagaaaaggaaagaaaaaaaagaaaaagaagaaagaagaaagaaagaaaagagaaaatactgttatgagttagctgaacttcatatatcagagttgtgcatgagttgttcctagtgctattttgtggtatcgtttgtgtctaggctcgcgtctctagtacgttctagcctaggaccagcacggtacttgactttgaaccattattcaactttgcattctctcatttgagcatttgctatccctttgctacatatttaagcctacccagagctccacagatctgattgcagccgtacagcaagtgtttgccaaggcatcgatacatccaacctccattggggtgcttggttaagtcggtgtacatcaccattccgcttgctttagtaagaacttgtaagagcttggttaaaagcttgagtgtgtgtgatatttgagctgccactacctagtagttgataggagcgtgcatatttttgtgtgtttcttgtttgctactaaccatggtaggattgtgtaagggaatacgagaacatcgacttctacaccttcgacgagatatgacgacttctccatgtgatgcatatgaggtacatgactataattttgaacaagttgcatctaagttaccattctatgatgggaagtatgattctgttgcatacattgattgggagctagtagtagacaatgaatttgatatatatgatttttctgatgctcaaatgattaaggctgctagtaataagtttacctcttctgcattattttggtggacttatgttagtaataaacctgaaacttgggatggattgaaaaccatgatgagaaaacgctttgtgacatcttattacaaatgtactcttcgggagaaattagaacatctgaaacaaggtgacagaactgttagggagtacattcatgaatttaaggtttgtatcatctacagtgatcacaaagagtgcaatgaaaatacaatgcgtagatttttcaatgggcttaattctgaaattcaggttttgcttgataatgtgacatataatcatattggacacctattcatgcttgctcgtagcattgagagtcagatcatatcaaaggcgaggatgcatgaccaatgtgatttatctcctatttctgaatccccaatatacttatgtaatgatgatgtgcaaacattggaggagcaatcttttgtctcccctgttactaacgttttgcaggaagattagcacatccaagaaaaggagaatggtatacttgagaagaaagaggatgaagcacctgcgaagtctgaagaaagttcgcaaggtaaattaaatggtgctgagagaaatgaaggtgagtattctcaaggtgagctacacttgtccacttttcatgctatagtagagcaaccattagtggaatcaattgctgagttgcctttgtcacaagttgatttacttgctgttccttgtgataaagaagagttgtgcgataatgcttcacttatatccatgccacaactagtgaatggacatgctattcctgttgttaatactaactgcgctgattttaagcatgttgttcacattgctaatagagtagaggaacgttaattgacatcttctttaaatactttgggctatgttcagtttgctgattttcatgagctcgataatttgaaggagaaattatttgctaagtttgattttccatgtccaagtaacgctatttttcatctctttggtgaatataatgatagaggaatatatttggtgcatagagtttacatctgttcagatttagaacctcctgtacatgtggataaaacatgcaatctagagagaaatgttattgctaacaaaattatctcgagtttgtcttgttgtgattggaagaaacaggtagttttaaatggactacacgaagagcaccatatggaaaaaccgaggacggttttccgtgaagaaggggaggatgatgtgaccatggctactatagatacaaccgtcgttcacatcaagatcaagctgtccaagttctgcaatccagttcggccacctgctacagtgtcgacttcaaacggccgccaaatatgcatgcgagctccattttgggtccatgagtacttgatggaaagctctcggagtcatctttccaatggatccagcttcatcgccaaattccatcccagtcgggcgaaatcaaaaaagaaggtgctgcgtcacctataatgggcctatgggcttgtaacttcgtctgggaccccggcccaagtggggcccatgtggggtgcgccccaaccaggtggagcacgaccctagggtccccttaggtcgtcctcccacctccttaaatagtcaggtacccctttacagtttattgggttttgatagattaaagtttagccattgctacttgcttgcagcgcgcgtgtcggctagaccgtccgtctgcttgttcttcggaaccccaacttatcattcgtatttaactcctatttacaattcagattgcttttatcttgttcttgcttgtttcttcgatttgcttgcaggaataaggttgatttgcaccggcaagatcaacaaaccacggagaggtgtattgatcgctaaggcgcaacacaacgtctcgtacggttgtagtcgaatcgtcaacgtttctcccaaatcgtagttatcacaactcaccgaaagatcgggccaacaacagccttaagtgtcgaaaggaactcatggttcatcagacaatctgttctgtccacacaccgccgagttatgactgagcgcttgatccaaataactttttaactgccttagcaggcaatcttagcgcaaaaactgaattcaattcaagaactcgtctggaaggcgatccattacgaactctcaaaaaagaaaagcgttcatcaccaaccttgggccacggcccacggcgaccgcctgggtcatgagaaggagctcaccgccgccggggcccgggaggcgtcgcctcgccctctactgcgccgaagcggcggtgggttctgcgttttgacacgccatgaccattcccagccgtcgatcattccatgtacggtccagatcgcggggaggtggcgcgctggagaagatgtggccgattctcccgctgatacgtgggcccatagatacggtgtgaaaaaaccaaggcccagccgtttcgccttcgcctcgcttaaaccctaaaccaaaacccctctcctcctcctcccctccaccggcgcgcggccaccatgtcgatggcggtggcctccctccgcctcctcgcgcgcggcggccgccgccgcgcccgcttccccgcgccgctctccgtcccgggaggccgcgcggcgttcctctccggcgcggccgaggaggtcgcgcaggcggacgcgccgccgccgccgccgccgggacggaaggtgctggagagcttccgcgaggagttcgagatcggtgggcgcgtcatctccttcgagaccgggaagatggcccgcttcgccaacggctccgtcgtgatctccatggacgacacccatgtcctctccaccgtcgccgccgccaagtcctccgaacccgtccgggacttcctcccactgactgtacggatccccattttccaacctggttaccgtgttatggagttttagagagcgttgaatttgattgggaaactttcactagcaggttttgatttgcagtattatatagttaatttggctaatgatcgctctgtctagaatcaattttgtatcactaagagactgcggaagtcaaaatctgatgctaaatgccatttgtaatcctcgccgttggtttgaagggtgtttagtttgaggtgggatgcaaaagagaagctttggttgttcttgggcctttcttacagctgctgatacccatcgacaacttccatttatttaacttatttgaggaaatgacgaattcaatattgaaaacaaatattgacgtgctcacattttaaagacatcacttgtcttgtattttgtgcatctttttagctccattttgttctctgccctaatagatattttgtttattattcatgatgcaggttgattatcaagagaaacaatatgcccaaggtgttattccgacaacatatatgcggagggaaggtgcccctaaggaaagggagcttctatgtgggcgtataatcgatcgaccaatacgaccattgtttcctcctggattttaccatgaagtccaggtaatgaatgctactattatttggttcttaacatgtgtaaagtttttgtaaaatccttaacttatttacctagcaacatcctgcttttctagatcatggtaaatgttatatcgtcggatggaaaacaagacccagatgtgatggctgcaaatgcctcttcagctgcattaatgctatcggatataccttggaatggaccaattggagtaattcgtgtaggaagaattgatggaaattttgtgctgaacccaacggtggatgaggtatatactgatcgattagtaccacatggaattgcactgatctgtcctccataaattgttcccatggtgttgtgaaatgtactgtctgtggatgcgatgtatctcaggagtattgatattggtcattgcactggtccagttacggagatgcatacaattatttgattctctttggtctttttgtgtagcacgaccaactccatcagcatatatgattcaaatgtggtctacattgctagaattttttttcagctgtctcatgttgtatttactttactttaactgtgttttgcagttaggtttgagtgacctcaaccttgtttatgcgtgttctcgtgataaaacattaatgatagatgtgcaagctcgtgagattactgaaagggatcttcaagcaggaatgaaacttgcacacgctgaggtattattttatcttcatattcttgctctattgtaagtatatcctcatgaattgattcacattctcaggcagttaaatgcatcaacccacaacttagattagctaagagagctggcaaaaagaagaaagagtacaagatctcattgatttcagataaatcctatgagaaaattagaacattatcagaagcacccattgaagaagtcttcactgattcaacatacggcaaggtgattatatgttatctgtactcttccttaaaaaatatgtggaggggaaataaaatgctcgattgtgaccattttgtatgaattcaagccaccactatttgttttctatgccctgtcttttgtttgagaagcaaaatgtaacatgtttcaaactttactttttctttacaacatgaactcactgagtatttttctttctgcagtttgagcgaggagaagccttggaaaatattacacaatctgtgaaagcaaagcttgaagaagaatgcgatgaggacagcttgaagtttcttcacaaggcagttgatacagtgagaaaacaggtagtgcacactaattgctttggttaaagccttgcaaatggagggaaaaacctatttttggcaactgatggacatcaaatgcatgcatgtcggtcaacttattattgtacatatacagctaacatatatcctgattttgcaatgcgcgatggctgatgtcattattcgaccttttgcccttctgcatgaatgattttatcacatctagttttcctgcttgaatgattttatcacatccaatttaaatgcatcgaaacttacaagtttggaatgacctggtcatgctaacagaaatagcagagcacttttatttctttatgatttaacagaaattataaactttggcaagtctgtaacttatgtatccaacacattagtgtataacaaatctcattgtttagcactttaaacttagcatgccggttttgcattgagacaagcaaacttctagtcctgatgcatccttttgagccttcgtttgcttcatatgcctagatttacacaacctacataatttattggtgttgtagatcccagatgtactagctatccttgacaaaaatctgatattactttattcagtgttatgttcttatgtagagtcacttctgttatttcagttgacatggatttgtgcccatcttttgtgcaggttatacgcaaaagaataatcgagaaaggacttagagttgatggcaggcaacttgatgaagttaggccactctactgtgaatccagcacatatccaatattgcatggatctgccctgttttcacgtggggatacacaggttctctcgcacacactttaaattgaaggaacattgcaacatttgttttccagtaaagtgaccacccacatggactactttatttgtaggttttatgtacagttacccttggtgctcctggtgatgctcagcgattggattcaattgttggtcctccaacaaagcgtttcatgcttcactacagctttccaccattttcaataaatgaagttgcgaaacgtgggggcttgaatcgacgtgaagttggacatggtacattgtctagtttatgtttgtgtgcagattataggaactagtgagttaattaccctgaagtattagacaaacaactaaggtcatgtttggattgtggcctattggtacgatgagattagtctcacatgggtacgtgtactcagtaagagagtgtgttgaaaaatggagaaaggaccagtgaacaatagatagttgagtccttggcaatgggtacgtgtactcagtaagagagtgtgttgaaaaatggagaaatgaccagtgaacaatagatagttgagtccttggcaagtaacagacttcacagttaggtggcaaaaaccagtagttctcttaataaattagaaatttagcaaaagtgagggtcatcccccttgacctcagtgagtttgcagtggttgtaatggtgttatgttagtttaactagtaacacgcctacccattgcatgggcccatacagatgggttgcatgggcccatacgactgggagatgagctgagggtgtggatcgagcataaagcactagatccaactggttttttgttaaccaaccgcctggttttttgggagaggcagtggttatcagctggtgagttaaccaaccgcctggtttttttgggagaggcagtggttatcagctggtggggaggactggtttttttgggagaggcagtggttatctgctggtggggaggactggtttaaagcttaagcatttggtctgtattgggatactttggctgttgcaatttgctgaatgccatctagtgacaaggttttatatctagactagtcattgatagctcttcctttacatgctgcttcttatattccaatcttattttgcattgtaattttgcaaagcaaaatggttgtcagctgcacagctatttattttgtaacactttgcaggcacacttgcggagaaagcattgctcgctgtgcttcccccagaaggtgaatttccatatacagttcgggtaaattcagaagtcatggcttctgatggttcaacatcaatggcatcagtatgtggaggtacatttcatttgtctcttttattgtcctagtatacttcaaagttaaaatgaactaatataatttccattttggtgttaagaggcatcatgtggtaactagatcctgttatttccttttttattttttttaaaacgttatgtatcttttatctggtagcaattggccctaattctctcattctctcattcgcagaagcctttgtttgaaaggctatacactgcaaccatttgtaatagaatgcggatccatgtttttcatctatagaaaatccaagctagccattctccattgccttcataatatctactgtccagaagataaagttttagatcagtagtcagagactcttagcagagacctgaaaaatatttttgaatttttttaggttatgttaacttctttgtgttcctaggatctacttctgagtattgatatgaatctccttttagtgtcaaagtgcttaaatattgatttgtttcttaatatttctttttttttatcttcattcatctgaatggcaacaggaagtatggctttaatggatgctggaatacctgtaagggaacatgtggctggtgtttctgttggtcttgtcagtgaagtggaccagacaactggagatatttctagttatcgcatattaacggatattttagtaagtatagttgcataccatttctaccatcaatccttataaataactattcctttttcatccaactgtatattttggttggtgctgaactgaacatggccattgatgtttcccagggtcttgagnnnnnnnnnnnnnnnnnnnnnnnnnnnatttgaggaacaaggagaggtattactgctattcaactggatataaaacctgctggaataccgttggacataatatgtgaaagtttggaacctgcacgaaaggctcgaaatcaaatccttgaccgtatggaccaggaaataagttctgcacgtgcttttaatgatgggagctctcctcgattaggtttgttagtgcacttatagtttagttcttttaaggagttcttttttggtgcaaacattgcttgatcaacaccagaattgccctccatttgcagctacactgagcttcagcagtgattctcttaggaaactgcttttccacaggaaaaaaattgagcaagaaacaggtatcaagcccctgtgcaacttctttcaagaaataactagcatcatgtctgcacgttgcaacgaatccttaacatactatagtccaaaatatattatgcaaaaaagaaataattatactaaatccagatgttgcatgcatgatacatgatgctaatcaaacatctacatattgtcatatacttgtgcaaatatgccatttttttctgtaaacatcttacaaaaaatgcacacatgcctatatgtttgtagccacaaacgatgtagagtagcccaactccctcttctttaaaagtaaagatgcatgccatttcactagagtgatagatcaacgtagtggaaatcctggctattgtcgtaccataaagtcataaatttatgcggattggtgatgacttggtgtttcagtgtttgaaaaaagtgttttgcagagcttaacggcacctttttttttagaaaaaaaaacattgatttgatgaaagaatatcatatggatatatttaaggatcagaacttcataaagaatagcccatggacatatgtaagggtcaaaatgtcacttaatttagtatcgaatggttgcaagtttgtatctttcaaaacttcaggagtttgttttttttgcacgacaatatgaatataaaatattggtagagtttcattttgctaccaagcattcatattttatttctctattcttgacctcgcttatgtaggttctaaatttacagtctgtgtgagaatggagtttctcttgaggttaaaaatgatgtttcatcactaatttgtatttgataacctgcatatttgaatgcatgaacatacaatgcactctgttttattcacatttttctcaatcagctgagttttaactcttatcttccatattctcaaggtgcacgggtatctgttagtgatggtacagtcactattgtagcaaaaacccaaccaattatggataaggctatcgagaaggtatgtatcaacaatacaacaatatgctatttattcattgtgcttatgaaagggtctgtgatctttgcttgcactttattcatgatcttctgttctataaaatttgaaatatgagtacaacacaaagtgcctgggaggaagaaccccagaccattctaaatttctaacttttctacctcattacaggtagaatttcttgtgggtcgtgaaattgaagttggcagaacgtacaaaggtgttgtttcctcaataaaggagtacggtgcttttgtggaattcaatggtggacagcaaggtctacttcatatttctgagttgtcacatgataaggtatttttctcttaaaaactctgtaatattaatatatggaacatactgtctattatcatgtgttttatttactatgctaatcttgttcaaatttgtgccagtacatgattgcagttccaactgaacatgataccaatgttattgatgataaaagttcctatacactttttttttgtttgttaaagggttgttgggtttgaggaatcgatgttctagggtcatttgattcttagctccaaacttatcattcttgatttattgtatggtttgaagaatgagaatcatgaatgatcattatcatcatcttccccctccacattgttgtagtcatgatagaggatgtgaggaatagttccatggatgagtgttgatccatcatccaccttacagtagatgatggccaatgagattaagccataggaaacatagagcaatctcatgaagtcacccatgtgatatgagactattgttctaaccaaacacacttgagcaacaagaagaggttcaatcacgtttcacagtataagtgatccattagttcattgcattcatactggctaaaatgctgattaaccagcttttaatcagttgtatttattatatatgtatttagtgctcattttatttcccttctacctgcaggtgtctaaggtctcggatgttgtatctgttggccaagtgctctcattgacatgcattggacaggacttgaggggtaacattaaactttctcttaaagctaccctgccccatgcccatgaaaagaaggatttagcaagtaatcatactgatcctttgccaagtcaagaagttgttggctggacggctgtagagaacatgcctagcaaggatgctaatgctgaaccatccatcagcaaagacgaagacaacatgattgaggagacacctgggtgttctactcctgcagttataattcgaagtgctgctgaatgtgatgcgcaagatgttacaaatgatcctaagaagaaacgcccaaaggttgcaaagtcatctcctaagctatctaaaccagccagcgaaaggcaggaagttaagagaactagtgctaagaaaacttcaggtgcatcaacaacggccaagaaaaataagaaagaaaaagctgactcttcaaatgatgtgctggatgccattccagaacaaaataaaagtaacatcatgaactattctagtccctcaaacttcaggtctgggtctatgaagctgggtgacgtagttacagcaaaggtctaccagatacgagcctatggattagtacttgagttgagtgatggagttcgtggaatgcataaatttgcggtaatttcatacctaaactctctagtgagcaagttaatttgcttcgggatttgcaatattaatatcacattgcttgtcctttttgtccttctattatatgaaaaagaactgctatatgactatcgcatacatataacatctttgatagttaggaaagaaattatgtttccatatttgcagtattgaacatgacaatgcaatatcagatcggatggatccattgccctcaataacaaaaacttagctaaacataacaatgtagtatcattatttatgtattttaatttcattgcactgacattgaaacctttgcaggaaaatggacacaaggattttgaggtcggagaagaactacttgtgaaatgctcaagtttcaatgcaaagggaattccggtcttctcattgctagattagtagccattttgatggggctaatgtcttctctataggcctacagaaatagacgcttgtaaatgtgtagcagctaattcatcgacttgaggaacatgagaaataatactgcggctccctcgacttttgtcagagtgctaccaaaattgtgtggctgtcgttagtagttttgccctgcaactcacaaacgcccaaacattacgcatcacttggtatctgaatctcttttgcagcagttgtacacttgtatttttgccacgctgtttcttattcatcgttgaaactaaccgtaacagtagcattcatatttctctccactcgtaatcccatataattcatttcattctttaatacagttacttctaccatgagaatctctgagcagcagcttcttgggagttgggatatcttcatttcattcattgttgtgtggtgcgaagtgtgaattgtacatacagaagtacagaactggacgcaaaattgtggccttttctgccaccaggtcccacaacgacgaggcctgtggctccgaggccgcctctgataatcgccaagaaatgaaccaaaaaaacgaaccaaagatgaggtgatagactgactagcactgagcttgcccggccagcgccgaatagcgcgacgcgccgacgcccacacatgatacgttgcgacgaaggagctcctcgcgggtcgcggcgatgagcaacgccggcaggaggaggaggagcctgacctccatagctccctcccccgtttcctcctcttctttcccttccggcgcccgggaagctcaggcgccgccgtcccagcttcccagctggaagttctcccaggtgctcggcgaactgccgctcgccgccgccggcgaaggccacgacaacggcacgctccaagatgacggtacgtgtaactctcacgctatgtcgaaagccatcagggattttggcctctcgtctgagcgaggataataatccggttctttttcaggtgatacgatctcggcaatcgagttcgacggccggggcgagcacctggccgccggcgaccacgccgggcgcgtcatcctcttccgaagaaccgacgacgagagccacgtaaattacagcaatatatctcaaagctagctattccagtatggttccctgcagcacgagccgggctgttgaccagcgattcttgtgccccgcagccgccgccgccgccgtctcgcgccgacctggagcgcacggactacgccgcggcggcgccgccggcgtacgcctacatggcggagttccagagccacgagcaggaggtgagcgagtcacccatcgatcgagacggcttacgacatttgcaaatcgtagtacactcttactgatcagtaggcagtacacagttcgacgttctgcacagcttggagatcggcgagaaggtgaagaagctgagatggtgcgcgcggccgaacagctcgtcgctgtccatgctcgccaccaacgaccgcaccgtcaagctctggaaggtatatgtatcgatcgaacacggcattgagatcaccttgttgatagttcaagctcttcttttctgtaggattagtagctagaatgtaatgattttatagcttcaaggcaggtctccgaacacaggtcgaggaaagggaacggccagccgcggcggcggcggagcactccgacttcggcgtcgctgtccgagatcgcgctgctcggggagggtgattcgagcgtaagaaatgggtattattacgagtgggcgagcaagaaagctaggaactatttgtcccctgattcggctgaacattccgaaaaggtaatgttctatctgcagcattggaatcttcggttgaactcgtttgaattgtgccttttgtgtaaccatgtgtgatcaggcaagtgaggttggagaaggatataccgcgaagtgccggagagtgttcgcccgtgctcatgtgtacaacatcaactccatttcgaacaactggtaggttggttgatccagctattacagtacaagtttacaacctgtgtcatgccattctgtctcaactctgagaattaacgaggtcataatgtagatttgttctctttttcatgtgtgcagtgacggggagacgttcgtgtcggccgacgacctcaggatcaacctgtggcacctggaggtgacggaccagtgcttcaacgtcgtggacatgaagcccgcggacatggaggatctcgtaggtgatttagtttcatttgtttgctcaaaaacagtttgcatatacatagagatggattctaataatttgagtggacgtccacccgtttattgcatgtcagctagatggttacggaaaattttcaaaaaaattgacaagagagatcaatatgtaatatatcactccacaaacatgtaagttcaaattcaacttctataagttgtaacaaaaataacaaatttaattgtaaatatacatacagtaatttgagttttgtttgttatttttgttataatttgtagaagttgaattttaacttacatgtttgtgaattgatatattacatattgatctatcttgttcatattttttttaattttttttataatcatttaaataacatgcaataagtgggtggacgtccactcaagcttcccgcatataactgcataataaaagaagtcatgaatgaacggcgaaaccgaagggttgaacactaactgttgcctttttttttttcgatcagaggtgatcacttcggcagagttccacccgtcgtcgtgcagcctcctcgccttcggcagctcgaggggcttcgtccggctggtcgacctgcggcagtcggcgctgtgcgaccgcaacgtcagaatgtaagaggctggctaattaattagctgatgttgtacctttctttttttttctctgaaaaatgcaaaatggttcgttactgtttttcagattccaggatcgtgggaacagcgtgcagcctaggacgctcttcaccgagatcatctcttgcatctccgatgtgaagttcaccggagatgggaagtatctgctaactcgagactacatgaacctgaaggtattctgaattccacttgacatggcttctaaaaaggtccaagtgtacaggcagcgtgtcatatggatggttggatactgaaaccttcagtgttcctgaataacttcagttaacttcgccatttgcagctctgggacttgcgcgtggagagctcccctgttgcaacttacaaggtgcatgagttccttcgtcctaaggtacatcatttatccagcacagaagcatttcactgtcttacatcgcccggtcagctgtgtcagtcagaacacaacaacacaagaagttaagaattcttttgcagctgtcggagctgtacaacaacgactgcattttcgacaggttcagctgctgctccagcaagggcggggactacttcgccactggatcttacaggtttctactgctgcaacacatcaacctcatatctggagtataaggctatactgttagtgcccatccttatccatctcgtggttctttgtgttcagcaatacattcaaaattttctctcgtgctgctgcaaatcccaacggaactacgttggaagctagcacgaacccttacaggtacttagctttgttcttttactgtcgctttgacgctgccaaatgacttaaatttagcaaggctgatctaatacggtgaagaattcaggatacaatcattcccctctgcaaagagtcaagggttgctcagcaattttgctcgcggaatccagagaaaaggttcgaataattcatcaagttattcttttaatgtgtctttgtgcattctttcagtgacgcctctactttagaactgaagcttttagcgtgtgctctgcaaattctcttcccctgcaggtcaagatggaccaagatctgacggccgggaggacactaaatgtaacatgacatcaaaggtgacacatttagcttggcacccgatggaaaacttcatagtttgtgcagctaataacagcttgtacatgtaccacacataggcatatgcacttattttttctccattacccattttgttccgtgggagtactggatactggaggaaaatatagagggcaagatttactaaacacatcgagtgaaagcactatgcattacatatagaaaggcatttgaagcgctgaacatatttatgcgaagctgaaaccttagtcctcgggaagatttttcgctaagcatctggcatattacaatacatattcgggcatttcaaggtatgctgcacaagatcgccactgtgggtcagagaaatgagaagacactcttaacgtcaagaaaagatgcgccagtcccactgctctttgcactcgccaaaatatccttgcaataatcctgaatcgtgagaggttggactgaggctgcaacttgctttgtacattgcataggctggaaatctgcaagaggactgctgaagcagaatttgctcttctcagatgagctgtccattttacctaaaaactgaagagaattctcatctggagtcttgcttagagccttgcttttctcagacgagctgtcccttttacctacaaagtgaagtgaattctcatctggggtcttgctcttttcaaatgcttttttacccgcaagttgagtagagtttttgccttgagttctgttcaggatctcgctcttctgagatatactgtccattttgcccgtaaactgaaaggatctagtttctgcagttctggtcaggatgttgcggcacctctcatctgtattgtttggagagactctagcctcagtacgatcaaagaccataggcgtgacttcatatgcatgcagactgctctgatctagtccaaactgatcgcccgatgtcttcattttcttcagtatcaaaggttcataagaactatccatggatttcgacaacattagattggggaaatctctggatttcttgcgtatgtgatcaaaaattgtgttgttggtggcacttttgcattctgcctctactggttcagaagccaatacatctggaacatctgaacatgataacacaaattttcatgcaagagcacaaatgaaacacaatagatgtgcatagtgtcatatagaattgtgttaccttcataatcttcttcatgcagtagagtaaagcttggggcctccctgtagtcatcaaaatatcaccttagaagttagaacgctatattctatattcagatagtagagaactttcggaaaaaatggttataaataaagaaataattacaaggatgacgaatacatgttagaaatttcactaatagctgtgatctattgcaattctgtggtgacatattgcaatccttgcagaaaattaaataaaaaaaaaagtctgtgtgtagaatgatagccaccggataggtgttctattttctctgcactgattatggaatccttggcaatgtagagaaggttaagcacttacagtgaagctaagttgttgtactctcttgttcccagaatttccagatcattatcatctttgtctggagctttggccctaaaatcatcttctataacacatacctctttagaaagtgggttctgtccattatgatacttagattgatttgtccgagttgttttagagctaaccaaacagctctctgcaggcagattgtacaagggttctgcctttttaatcccaaacactttggtcacatgaaaatcttccctgctgaccacatgcttcttgtggatatcaagaccaacttgaacataaaattaaagatataaactatgtcagcataaaatcgtacacattatagatgaaaatttcattttttgatctatagttccccaatggtaatattaccatattcttcaaaaatgacgtcaaccttcagagtagccctggcatttggggggcatgggacatacagtttgacagagtatggactgcaattttcaaattagccagttaagagtatttgtgaacagctgagctacaacttagacgtccgagctgagaatgcagctaaatactccctctgtcccataatataagggattttggagggatgtgacacttcctagtactacgaatctgatgacaaatctgtttctttttctcattatttttaacggctcaatcaaagatcatttacttttaactttctatagaaggattgaagcattaactgaaataacaacagaaatattacctggaaaattcttgagtccttcacagaagaattagaaatggtgcagcaaccaccacaagaaaaacagataagcaaatatcaggagaggaaatagacagcaaaggacaggtaatatactgtaaaggatatcaactgagagaacaaaaccactgactttattttctcatgaaagaggatcgcattatcttcctctgatcccacaacctgacaaaaaatcatgtaaaaatttaggtttcaagagtgtcaattgatccaaaataaagttaaagagggtaccatatcagcgtaattttgtttactggatcctactgcctgtgataggcgagtcagtgttacaataattgttgattttccctgtctgtttccagcatcctctatgtttatatcaattttggggcctaatgatggcaaataactttttatgctatctccaaatggataatttcgtcctgttacggattctatcttcctagcatcagcagttgccaaactctcaaaagaatcaattccagcagtcttcagtgcctgggatgacagtgataacctcaagcattaattatgcagactgcagatacataaacataattacatacccaataaagataataaagttaataacctttgctgtgacaattccaattccaggcaattgcttcagcaaaaatggactactctcccaaagtttttggtgtaagcatttcgcaaggagcatagaacttatggcagacttgtaattctttttgtatataaaatattctctcatgcatttggcaaccctgcatccatttgagcatattgaattcatttcctgcatcaaatcgcaaaaattaaaatatgtcaaaagaataggtgacaaaatcaaatggtattttgaactggacaaacaaattacctggttgagagatagatcatggactagagggtccccagttaaacaatcatttgccagaataaatattttttcttctcttgtttgaatacgcttcttccttttcccatttgcaccaacaacatggaaccaaagccttccctctttgtcagcatttatctcattaaggagcttcttctcatttcgtcgtagttggatcccttgatattacagaaaaaaaatcaaatcgctaatttattatatttaattattaattagaataaactggagttacctacaagtaatctctgcagagtggcagatgatatgcaacagatcttccaaagtgcaacaggcagaagctttgacaataagcttcatagtatcaaatttcagatagaattttgtcatcagcctcccaggttctgagtagaaaatatatatctcagaagagtcatctttaatatgcaaatgaactgagtaactggaatgctgaggagacatctaagtagcaagggagttgaacagatgggcaaacagaacgagaaacactagaagaatagtaacaaaactattgaagttatgggacagaagtaggcttcaagttgaatacccagccgtcaaaggacctgccatgtttgccagcagaacttcttacaaaaacgaaccccattaaatttggagaagacggtgtacattttagtgtcagctgttaaggtcatgatcagaaaacgtacacagatatttcatgttatctacttgaactataagactgaacgatcgcaccccagatattcaagcatgtattggagctagctgaatagctgtcaatgttacagctcagatattgaagcactggtctatgttagttgttaaggttgctgaggtcggaactcggaaaacctcaacaccacaccaatcataagctcaaactccgtacttgaaacaggttgaagaaatgcatgttgtccatagtgtaatgctcattttccatccccagtcaaatctaggcctattacctaaatgtattttagatacaatgatgtggttcggaattgaatcctttggacactttgacatgcactatacaacgaatccagttcaaaggaacaactgtaatgtatttagcccaaattaatagaaagatttgctatggatcaggttggtggatactatagatggtagtgcttctattctctcctcaaaaactgaattgcacaaaagccacagatattaagcaatgctagtgggcacaccatcaaaagcctactttccacaatgtaggtaggtgtgcagatgggaaacacacaaggcgtaccacaaagtgaggacacaccgttttccaactaaagccaaactattttgcagaagcgtggaattggcaaaagactaaacttcaatttgtatagcgtaagcttgtaccaatagacctgtattaatttgtatcatcatttttttaataaaaaaaatagaaaatttacctaatggttttagaaggaaaccatcttcatctgtccaaattagaccatactcccccagctcatggatcttctcaacacatatatctgtaaattgagttcataacgatcaaaatcccatagaaccatgaattctacaaaatccaagaaagatatacctttcatttgcttttcaagaagttcacgtggaatttctttcttaattccgtaatgctgaggattctggtaattcaattcgtcaaagtcagtttatgcatttaagcgaaatggatttaaagatttaataatactaatttgcccatgccttctttatcctgatgtacaaatacgagcacttgagccactcaatagccaaagttatatcagacaccgtcagctgaacaatctctgcatttagatgctcaaccgcacatggaagtaacctggtcatagcatctatactcagcgagaagtttgaaatggtatgcagtccatgtcaaagtcaactaggtgaaattattagttttcagttgaacataaaacacttactgagactccaccatctcacatccatttagaaggttctcatatagatgcacctacaagatataacaggttagcacaaaagacctatagagccaattttgcccaataatggtatcaaaatatctcagagttaacaagagtggaaaatatagatcctttactgtctctcttcttgtcatgattataattgttccagtatcatcaaatggtggacgcccagcccttccacacatctgtagatcacccaaataaggggaggggcattgttagaagcaagaggaaaccatatagtataattttataattgaatcacaaaatgctctgaactacaatgctttaaatgcatgttagttttaattaaaaaaatatgatcttacacattacactataaataattgaactagtatgtggcatgaaatttgcacgtccaatttcaagtgttttgcagatataagatcaaatgatgtgttttcgtcaaagaaaaggatcaaacgatatgatgttgtggcaataagtatgtcagaatcaactttgctttatgataaacaattgaacttatatgcagcatgaaatttagaacatctgatatacctcttttttcataaataactattccaataataaacttttggcaataagtatgtcataaccaacttaacataacacccgcccaagcaaaaagttattgtataagtatagagtgaaaggtcatgatagattatgttctcatgcactttacagcgtatatgttggttccgataaacttaaccaagtttatagaaaaatatttaacatctacaataccaaataaatacattatcaagacataatttatggtgaatttaattcaactattttgatattatagatgtgggtgcatttttctataaatttggtctaagttagagaagtttagcttagggcaaactgaaacaccttacaatatggaacagagggagtagcattaagactacacatcaaagataacaaaatcacatatactttcatgaagcaaaactgaataatattattgcatatcaacaatgatgtatttactggtggaaatgagacatgatagtatgtatacctgaagaaccatggatctctcatattctacatacagacccttctctttgttgctgaaaaatagaatgaatatcagagaaaaatcattaagatgatagaggctaactcaatcactgaatatttaaaatgaactcacaaaaattgtgttgactttatcaccactgtgtgagcaggtaagttgatcccatgtgccaaagtattcgtcgtgcaaagaatttgaatatcacccttcaggaaaagtccctcaacgacactcctatcctttaggcaaagaccaccgttgtgataaccaactgaaaagttgaaataagatatgcatcaccaatcagtgtaatgttaggcaacacatcaaaacatgggaaaccattgtaggttgtgaaggtatcgtgggtcgagaacaagattcaacatgacctccatgtacgagacaagcctgcaactgcttgtcgctacaggttagtgcagcctcctttagatgttcatactgctgcatcgatttcataaatggatttgaatagcctagagaactcgcagtttgtgaaaggcactgtgctgcttcttgtgcgccttttctagtagaacagaaaacaagtgcagactttcctcttgaatgttgcatcagtatatctgtatcaatattatcctttattttgaatcctgaaattctgctaacttaacttaaagtacaattgacagataggtagatgtaacttaccgaaaatgaaactttggagtctctacaagtagaaagaaataaagaaaataaatatatcagattcgattcagtgattatgcacaaattatcagtacagtagtacagctcaaggagatgaagaagacatctgacttagcacacgccctaattgtcccttctcattttaaagaaggaacattctcagatagtaagaaaatgcataccctctcaaacaggaagtcatttcttgctggagcataacctaaatagcacagtgaaacagatatagattaggtcaaacatataaattgctggtttaagtgttgtaaggctgtcaggacatgctaagtaatcaaagtggcattttcaagagttcatgattttgtggagtaaaacaaaaataatgatctattcgaacatcatttcatgactgattctgtgaggaagttgcaggtgtaggatggaggtattcatgacacagtttcttctcactttgacataataagtaaatcaaatgtcctaattcttacgctttggccaaatatttgcaatatgatgagaaacaagaaccataccaaaaaccttggttgtcaacttcactggcctcatctcttctccaaatctgcaaaaggaatatatagataaggaagttctagtggtggtatccttgatgaagttgcttctcatcacctttttattccttcagacggtactgcaagccactccgctgagatccaagcaaagccaaaacgtaagtaatctttaacagaacataatctggtaatgtaaataaaatagagacatgttgggaccatactgcttggagtttaccaacctatatcctcaatattagggatagtggcagaaactgctatgaatcgaacatttgccaaaggagcaatcttcattgtgccaagtcgagaaagcatttttattctactgacaattgcttctagggcagctccacgaggatcgttgaggagatgaacttcatcaataaggaccagagcaatgtcactgaagaaacccagtccaccatctcttattccatgacgactcacagaatcaaacttctgcaaacataaagatgttggttaaaaaacaaggaagtggctagcagttgtgccaatcctctttttacaccgtgtaaagcaaagcaagcagtcacatatacctcaggagttgtgagaattaagtcagcatcatgtatggatttggtgttatagaattcattgtcaccagtcatctccaagcaactgatccccaacgagcccagcttcatgttccagtcacgcaacttctcctgcaccaacgccttcattggagcaatatagatctaccaggcagttcaaattaagcacatggtaaaaattagacattcgtatcctcaacatacaaagtgaatccctaaagtgtatagaaaagctaagaaggtacttgacacatactgttttcagggttcctttgatcaaattaaacctccactctgatgagaggaaccttgagagaagccttagaatgcagagctcgaacagcacggttttgccactcccagtaggcgcagagataaccatgtttacatccgagaggaagcatgcagggaagcactcgctctgcaacgaattgaaatacctgcacggaacgcaggatgccactgtaaaaccccatcccagctactccacgtttcataccgtaatccacattccacagaagtgttttgttagcctgatgcactacgactacaaggctactcaaaatctcaatctactgaatgtgtgagcgcgatcatacaactacacagaaatgcaccgtgcaaacaccgtaaccgcggcccacggagtttgatattggcaaatgcgatgatgcatcgcgcgcacctgaacccgaaaacggagcggaatggcgggggaaggtccgcgacggagcgcagcgcgtacgggtcgccgagatgtcccatcgccgccatcgcgtgcggtccctgcagaaaaatcgagcgatcgcgggtgagtagccccgccgccgaggaatttcgtcgaacacgttgcgcgcggcggccggcgatcggagccgaaccggctcgatcacgatcaggaactcgcggacgaaccgagcgggcggaggcgcgcagcgtaggaagacgagaggcggagagggagaggcttgcttactgctggttggtggaaccggatttggaggggggggggggggatttggaccggaggagtcggagagatggcgagagagaggagcggctgcttcgcgagggaacgaaggtgggagaaggaatggcaggagaagccgcgcgcggataatgcctctggtgtctcgaggtgagaaggagaaggcggaggagatgagccgtggatgat

SEQ ID NO: 60157 - DNA, 1214 bp, Oryza sativa
tgtggcctccgcctccgcctccgcgcggcacctcgatccgggcggcgccgcggcccccttccgcgcggggtggccgaggagcctcgccgtggcgggggcgacgcggaggggagggcgggagttaccaccaccaccgggaggaacggagctcctccccgccccgtggccgggatcgggggcccgggcgtaggggctccacctcgtggggccgccggggccgaggcgggaggcgagggactaggagatcgtcatggcgatcggatctcgcggcggcggcggcggcggcggcgagagtgagtcggcgcgacggttttgcgggggaggcggtggcgatcgtcagcgtgaggtgagggaggcggtaacgggtgctctctctctcgcataatatttgtgggcttgtggcggggaaccgacgagacgcggtcggggtcggactaggtgtagtaatttttcctttcttttttcttacagccgcggccagttagttttgagggagttttagactgagttcttattatcttcactttctcaactcacctttctcgtttttcacgcgtatattttttaaactaataaatgatgtattttttacaaaagtttttttataggaatattactctaaaaaatcacattaatttatttttaaaatttgttttagctagagtacttgattaagcatgcgctaaacactgcttgttttgcgtgctagggacacagccagcctagttacctactccctccgttcatattaattaacgttttgaataaggttgaggtcaaacttttataacttagactatcaataacttttaaaaatatttagtttaaaggaactagaacaacatatatagatttgtcttttaaaatactataataaaagtaaacatgcatttatttattatatatattataatagaaaaataaggtcaaaaatgtatcttgtagaccgtgtcattgtccaaaacgtcaattaaaatgaaaccagagggaatactcatcttcctcgttttctgcgcgcacgcttttcaaacagttaaatagtgcgttttttcaaaatgtttccatatgaaagttgcttaaaaaattatattaatctatttttgaaaaaaaaaatagctaatacttaattaatcacgcgttaatagaccgttccgttttctgtgtgcactgttctggttgggaataggctctagcgaacacagccttaggaggga

SEQ ID NO: 60158 - DNA, 1092 bp, Oryza sativa
gagttttaaggtcccatacctgatgaatagagttttatggtcaaatactagtactaacataatactccttagtagccaacacagaagcacaagtttgcacaagttttgcagcattaccatactttgatggtcttgtcaagtgagccagagtaaagccttgttactgagacaccgagcgaaatcacttggcgctcatggccactgaggattgccactggtccagagtcacccttcttgtcaggaattttccaagccatgatgcgaccatctccggtaccagcaaacaacatctcatccttgatagtcatggaacaaaccagaccagaaggttcacggagactggacttcatccctgtttgtgtgttccatgcctacaattcattgtagggatcaatatcaacagttcaatgcacaatagtaacatcgcaatatgtaacacaaaatggactactcccacaaaaaaaaatcaacgaaattaaaatattacctccacggacttcgtgattccaacaaatatccatgggccatgggtaatcatgcaaccaatcttgcctcccatcttgatggcatcaacgcactatgacagaaacattaagaaaacaatgcaatgtaataaatattagaatttttttatcagccagacacctatcttttcctccttgttcagtcttctctttccaagaaaatataatcatcaatcatctcacatctttttttttcttttttttttactttctctttctttttttcactactttttttttgacaaaaccatgtatggaccatcagccagagagaactgtaatgtaattccagagagccccttgcttatcagccaaaccagcctcattgccttgctcgcaaactgaccctgatatactgatcaacagtacacaagcaggcgaaaagattcccgtaacaattcggtccggcatgccgataaccccaatcttgcaaagaaaaaactgatttggtaccaatatgtctgaccacaggaagcaatcagatagtactccccaattgatctcatggaagcacttcaaagaccgccacaatcaacggaggaatcgacgcagatgcaacccccaactt

SEQ ID NO: 60159 - DNA, 1062 bp, Oryza sativa
ttaattattacatgcatgaaacatgaaataaaaaaaaatacatcgctccgttttataatagataatgacattaacttttagatacacgtttaaccattcgtcttattaatattttacaaataaataaaatgtaaataatgcttaaataaagtactttaataataaaacaacactcatcacaaaataaataatacatatttcaataagacaaatgatcaaacatgtatccaaaatcaacgatgtcatttgctagtattgttttagtatggtgtgaggtttgtgagaccctgctcatagtacagtcatatatataggaaaaggtacgaattgttgccctgaactattacggccattcgaattgccctcctaaactcctaaatccgaacgaatcacccctccccctcacccctcccccgcgctaactcaatccagagcggtttttagcctacgtggcatacacatggcagcctagtcagcaaaaaaaaatcagtgaggcagggcttcggtgatgtgggccatacagcggggtgagaggaagcgacacggcggggcacctgccgaggccagtggtatggaggcagaggcgagggtggcgtgaccggcggtgagggcgacacagacaaaggcgaaggtgcggctgaagaggcggccatggccggtatcgatctaggactaggagccgacggggatgtagaggttggggaaggtggcggcgatccgtgggcaatgcagaggaggcgtcgtcgatctgcggggaacgcaaacaaggcggctaggacgagctgtgcgacggggcccggcgtgccggcggcgtcaaatcccggcatgccggagccatgacccagcatatcctcgtccggccgacgagagggggggtcagagcgggattggatcaaattgcatggaggaacaagagattttggtgtcgccgctattgtgtataccgccgctcgccatcttttcgtgcaagtctggcgtcggctatcgctcccccaatcacaggaggacaaggccctgctgatgagcttgacgggccagccactgccggcgcacgccttatct

SEQ ID NO: 60160 - DNA, 3257 bp, Oryza sativa
ctatgcaagtacgaagctttgcccgatcctcgtcgtcgcatcgtctcacaagacgacgccttcgatggatagctctcacatcgtttccactgcaaatggccaatccaaaagcgagaatagtacagaatgacctaatctatatatatgtctatactattataaaaattgaagatgttttgtcgatattttgatacgtcatctgtgtatgagtcggtttttaagtttgtttgcttttgaaaatacatatttgtatttgagtcggtttttaagatcgttcacttttagtaatacagaaggaatcatataagaaatttgtttaaaaaaactcgcatgctaacttgagacgatcggactcctagctgcagctcatgattttctatatatatatatatatatatatatatatatatatatatatatatatatatatatatatatatatatataagcgaactcccacagtgaatttcatcttaactaaaccatataacaataataaaattaaaataaccttcacacgttgtaacgcacgggcattttttctatctctactattataaaaattgaagatgtttttgccgatactttggtatgtcaatcgtgtatgagtcggtttttaaatttgttcacttttgaaaatacaaatccatatttgagtcggttttaagttcgtctgcttttgaaaatacagaaggaatcgtataagaaatctcttttaaaaactcgcatattaacttgagacaattagacttctaattgtaactcatgattttctaacaaagtatatatccaagagaatttaacacaataaatttcacgttaactaaaccacataacagtaataagattaaaatagccttcacccattgtaacgcacgggcattttttctatattataaaaattcaagatgtttttgcctggaaattttgtacgtcatcctaataacacatgcttttattttcctactccgttccatatagtataccaacgcaacacgcgtccgactatccgtatttgagtcggttgttaatatcgttcacttttactaatacagaaggaattatataagaaatcatgatcagactcataactgcaactcatgattttttaaaaatatatatatccaagcgaactctcatagtgaatttcatcttaactaaaccatataacaataataagattaaaatagactttacccgttgtaacgcacgtgtattttttatagtactaaataaatagaaggagtaaaacttcgaacagagtccggctagccccatgtcgtgtcgtccacttgccatgcatgcatgatgatttcacccatggatttgatcgatcgatcgaccatcgccttgagttcgttgtgcatgcgtgccgcatgccccttgtctgtctcgatctccgtccttttttctaaaataaacattccatgtacacctctacagtacatatatatcctacttatataaacacttctaaaaactagacaacagattaatcttagtattgacgaaattatgaccagtgacgattttatatcgacgagcgtatcgtctactattaaaaaatagttagctataaatacgagtatccatgtaaaattttaaaaaaactcgaatgaataagttctactatcagtagcctaattagttcagctacgttcaggtaactttttttccctgtgatttggacttgactgcacgcttgcttgcatgcacacggagggaccaaacggtgaggcatgggagatgcgtagatgcgttccatggatctcgcgacagtgatgaccatcctggattgtccccggccatgcatggacactatatatgtctctctgttttttttgaaaaaataatttcgagggagaatactttgtctctttttcgtttgcttaattaattttctagctactagatatatagctagagtattaaactacatgcatctagctagcatattagagggagaggccttaaattggcctattgttgtagaagaagctagtagatgaatccgtactatgatcatgtatatataggtagattggttggtacaacagtggaatgaatgtgtagggatgtttcatacgtggactggttgacgtcctatatttgttcacatgtcaattaatgtgcatatgtcatactatgccttgttttttgtggagagattttgtactcccaaccctctttgaggaaacttggctcttcatagaatgctaaaacttttgcagaatcagctggctgaaggtaaaatgtcatatcatgatatcaatatataatagaaaaaaaagggaactatttgcacatatttatatctacacggttttgaaatgtatctgtgcattaggatgtgaaaggttggttgatgagtccttagcttgtttttggggctgtctagttttcactcccctaaaaaaaccaataaattctattcacttttgaatgccccaacatgggcgtatctacaagccggacaacccaaaaatttcctagcctaagacccttgtagaaaaatatagtaaaaactaataaaaaactcctgccatgtgaagagtgaagtcgatgcgtggttgtcttggtcccatatcgtgtttttttagttttctcgccacattggcagcaatcatcatgccagacggcaactacgagtctgaggcagagacaacaaactggtatggcaaggatgcaacgcactgtcatagcagcagttaccacgccaaacaaaaattaggaatccgagacagagacagtaaaatagcacggcaagggtgtatcttgctgtcatagcagcagtcatcataccagacgacaactaggagtccaagatggaggcagcaaactaacacggcaaggatgaaaggtcatcaagtagtcaagccgacatgttagcaagcaggaaagggcaaacgtcgtgtcacgatgttcgcgcctttgtggcagctagctaacaacaaggtggtaagggcggcgcacggtggtaagttggaccacccaaacctcaaatcctagatacgccactatgccccaggtcatgccaagattcatacaacaatggtccatgggtagtcctccagccatatctttttcatccttacgtcgcttcacagcgctgcccctgttcacgccatgcgctgcatctacgggcttaggctaccccctctacctcgccaactctgcctctagcaccggtgagccctaccatccccctcctttgagtagccccacaccccgccttcttccccatctagcaatttcac

SEQ ID NO: 60161 - DNA, 3007 bp, Oryza sativa
aatcacaaataaaataaataataattctaattttttttaaataaaatgaatggctaaacagaacaagcaaaaagtcaaaataacttatatattatgggacggatggagtataacgacaaaggagacacactttgccgcagctaccagttggctggctgatgagaagaggtcggtttggctttggtaaagtaaacaatcgcagtagattagacactcctgcctgaccaatcgtcgtgtgacagagcaccataccgtactccttactactgatgccggtcgaaagaatagcttttcactggcccagctggtcgatacatcgatcagaggccacatgttctcgtcgattggtgattaaaaaggtgataaatgtgcagcaattagcgatgacgacgagaagatgaagtgatcatccaactaaactcgatcctttcgttctcccgtgtgcagtgcatatgcacgcacgcttgcgcgggggtggccggcgcacggcaaaagctggtcagatcactgtcgccgcgccggccagcagcgtgtgtacagcgttaggagaggacgatggcgacggaacagcgtgtcacacggcgcggtgtctctttggcccagccgctgtgtaagttaaatttgttagaacataagtataaagaatgtgtgtttagattaggggggtaaagttttggtatgtcacatcagatattatatagggtgttgcatgaggtgttcgggcaataataaaaaaaactaattacagaatccgtcagtaaaccgcgagacaaatttattatgtctaattaatccgttattagtacattgtcaaatcatgaagcaattatactaaaagatttgtctcgcaaattagtcgtaatatgtgcaattgattattttttttagcctatatttaacactttatataggtgttcaaacatttaatgtgacagagtgtaaaattctgagatgcgatctaaacacccccccccccccctcttaagctggtatgtcacgtaaattgttaagggagtagctatatttatagtgccatatttttgatcaaaaatagtcgccatgtatttacattgtaagtccctaaattacatatgtaattttagtgtatttatcatgtaagtttcaaaattacatatgtaagttcaatgtaattataatgtaagtacaatgtaattatgcaacgtctatattttgcattgtagattacatatatttatatactatacagatacatatgagtaaaaccatcaaaatcttaaactaatgaagcatgttaagttttaattaatcgtgtaatgacagccgagagatgctaaggacctgagtggactgaacaacatctgacggtcagaaattcgactgtaatcagccataaaatatggcgacatcattttagcaaatccgattgttaattggctgtggtagaggatagagaaggcgagggaagagaagagtagactattctattaacatagacataatatatattattctttaaggataattgatataaacacggcatttacttcaataaaggtacatccacttattacatagttgttgttttgaaattaatatgatataattaaacaaaggtagatgtaaaaacgacacaccagcatgacaacaccaaacaaagaaaattagcaacttatttaaagtttaagtatgttactaaacctctatccaaagttaatggaaatctacacagcaatatacattatcggtatggtaaaatcaagtaaagtgagaggaagtcgaggaatacaaattttgacataaagcaatggccagagcccctccaagggctaaagtgctcaactattatacagcatatttgcataatagccttttgtaaattgatgcggatgaattagcctattaagttttagaggagggcaagagataataaagataagatacgcaaaaaaatatgagcaattagcgtatgattaattaaatattaactattttaaactcgaaaagtagattaatatgatattttaaagcaacttttctatagatttgctaaaataaacgtttagcggttcgagaagtatgcacttagaaaaggactttctcctccttatgcatggatgcgacagtcccgatgctcagcttggcgaagtgcctatgtgcatcacacagctactcacatctttgtgtgaggaacgcgaagagctgcgttgctcaggagccatggtctgggaaatcatcacaccgagcggtcatttgcggcgatgttcagaaatcaactgggagatggatgggaattagggtttgattcatttattaacaactagagtatttgggccggcctgctaatgatggcctttgttcatgtgttttgatggaccatttggggcccccacgtttgacccacggattaattccatgtcccactcccatcctaacaaaattgcagggttccgccccagttcaccgacgagtagaaatttcgacccgccctagcccccgtagcggtgggtccccgctagatccccgcaccatgcggggaaattaccaccctagcggcagtggtggtggtggtggtggtggcggcggcaagaggtggaaggggaaaggggtgaccggcatacagttgcggtggccattggggacatctttggaggattcatcagcggcattgctttgccatctcaagaagattgggtggtgcccccgaccacctccccgtcgttgctctccacgtccttcttcttcggcttctgatgctccaatctgcatcatctcgtcattgctgtcgacgcgacacattttccccttcatgtgccgccaccgttagagcgacaaagctgctcccggtcctgccaccaccgcagaagctttaccacacgcgacaccttcaacaccgccgaggacgctgccatggcgtacgaccgtgagaccttcaagctccatagcaagaacgtgcggctcaacttttcagaccggttccttaggaagggttgtgtagtgcgcctcaccactggagacatctgacgag

SEQ ID NO: 60162 - DNA, 9032 bp, Oryza sativa
  unsure (1)..(9032): unsure at all n locations
gggggttttgttgatggtcgttatcgatcagtttcgaccgtcaatattaccaaaatagaggagaactagtgatgcttgcaatgcataaatatgttagaataataatattccactagtattaggtatactaaccttttgcagagattgacaataaagtgaaggagaatcgacatcaacagaaacgataaatcaatcggacgatgtcgagaaccagacttatgtatgaataggccaagaactaaaaattgatacgatgaattgggccaaaattcacaagtctgcggagaagaacaacagaggaggccaccagccaaaattgggctggattgggccagccccaggttcggcaccttccctagcgccgttggatccaggttttggctggacggcgtggatcactcgccaatgacggttggagggcaattccgaccattccaaccgccacaaccgtcattggcagcctatttaaggacttcaccttctcacttcactcacacacctcaagcaatagctctctcatttctctcaagtttagtttagtagtatctagctggtggaataggaataaagtagaaatcaggagtccggaagccttcggaagagttcgggtatggctctagcagcttttctcttctcttttgtaagctttgtacttttattagaatactcttctaaatacatttatgaatgcctattttacattatgttcatgttatactgaatatacggctagcttatctgggagatgctttggtgcgggtataatgtttgcttatgcaattactctatgtcatgacgatgatattagagtagtatctggtagtttaggcgtggtgtctagattacgggatatcattatttggggttatatattgcggatgagaggtgggccgctgatggtgacagctcagtacgggtattcctccacgccggtatataattctaagttaatttcctgaggagggtattcctccgtatttagccccggttgtatggtcatgacgggctgccgtaaggaactcggcagttaggggtggcttttcgaagtaccaggagggcattggatagagggtattagctagtatatcgagtaactagatactatgtatattagaagtataggaatagattatctttctcttttctttccacttagcttagataatatattatgagaatgagtagtttatgcttgtgtgtcactctacccttggattatcttaacccctacttagaatatgattatcacaagcaatatataaattattagtccagttctctttatatgatcttcccatgggataaaataaatacgatacccttggaatactctcgggtgaaatgctacaatggtatatccgtgcgcttgcggatgaactctataaccataatataccagaagtatttctgcgccattgctgggaattatatttctagtagtatcgttaagaaataccaacacccggagacaaccccgcctgcgcctcagcctcctccgccgacactgcgcccgccactgccggccccgccacggtctcctggctgatctggctgcgggggtgccagatccgcccacgacggcgccggatctgccccctccggccgccggcgtcgacggcgagtaagagaggcggcggcgagagggagagagagagcagcgcggcaagagggagacgcgaggggcggcggcgagagggagagagagcggtctggcggcgagagggagacgcgaaggacggcggagagagggagagagagcggcgcgacggtgagagggagaagcgcgcggtggcggagagagaggcgaagaaaaagagaagagggagtggcggcaaaaaaaatcgagagagggataggtaagtaaaaatatgagtggggcttcgtgggctaagacacccattgtgtataggagtatctctaccgggttgctttagatcttgaggagcccatccagggatatcctcaattacgagcttaagtttctctatgagtgtcctcggttagtgagaacactttaggagtggctcacgttatgatgcgctcaggatgttctccaagagtcctttaccctgcgccacctcctggctcaccggggaatccgtagttcgatctcaacttcgctgttgtgcttgtcgggtttgtgttcgaagccttcaccagcccatccgtaggcccctgcttctctggcatgtgaaaaaaaaaactgcatttttgttttcaggttctacgagcatgcaaaatctgcaggtctggagtagcagcaaatttatttatttgctcaatgttgagttggcttgacatgtattgtgctttagaaaatgtgtgtttttgacagaggccgtgtttagttaccttcaaacttctaaaaattctgtcacatcaaatatttcaacacatgcatagaacattaaatgatttgataatatggtgctaaagtaaatatttggtaatgatagattaattaggcttaatagattcgtctacgtttaatactttaaatgtgtgatttgttttgttattagtctacgtttaatactttaaatgtgtgtccgtatacttaaaaaaaatttgaccaaagaactaaacacggccagagttgttagttatactagaagtttaagcgcggtgccacgctgcgcacgctaacatatgcataagattaataagagcatctccaacagcctctccatcacactctccaaaccaaaatttagccattttaaacaaaaatcatactcgaacagcctctccatcccagaatagccaaactccttccctcgctagccaaatttggccagcctactccacgtgccattcacttgccatccgtggatcccatcacctcccattcacttttcgcgcaacgtggcgagggcatcggtggcgagggcgcggcaacggcgtggtgaccgagggcgcggcgacggcgccggtggccgccggcgagccccatgaccccttccctcctcgccttctcctcctcctccgccgcgagaagaccggcgcctcccccttcggcgcaacgacgaggagcagccgcgcctccgcgagccccccgtcgcctccccctccggcgcaacgacgaggagcaaccgcgcctccacgagccccacctcgcctccccctcctgcgcaacgacgaggagcagccacgccgccgcgagctcgcccccgccgcgcggtcgttttaccgcttccggaccgacgacgacgacgtggtggacgtggccgtctccggggaggatggggacggcggcggcggaggcggaggcgggagggtacgcggtgtccgtcgaggtccctggcgctcgcgggcgggagggcgggctagtgcttcgcgcctcggggtttggagagggcgtcccgctggcaccggccgccggcggtggctccctcgcggccgagctctccttcgacgcgccccgcgtgcccgtcggcgtcgggccgggaagcccagcgccgctcggcatgtccatctcaggcgatggcgccgtcaattttgcggcatggaaaggggaaaaagaaggaaagagaagagagagagaggggaagaagagtagaggctgacatgtgggtccattgttattttggagagaactaatagagagtttgttggtttgactagccaaattaaatagagagttagctatatcggtgtttaaagagcgtaatttggagaagctgttggatatgctctaagaatcatataacgaaggtatattggggtgtacggtgcagcaaaatggttgtataataaattaatagaacatgatgcggctcattttgctcacaaatgggaacagcataattttaaatttactcgttcccaagctccaccggcggtatgactttagtaagtttgctcaagataagaaaacaatctcagcgaaaaagcaagtctatccgatgatactaacagtttggcaatgtaggatagatcgcccaggatcgaaggaataggacctaccagttcgttctcactcaggtctctgagaatcaaaatttgaatataagaattcattatctaatcatacagaaactactgaacctatggattgaaatgttgtggtctactcatagaacagcaagagcccgcataaggccaatcacatctggaattttcccggtcagtctattttcttgaagtgacctatgtaacacgaatagaaagcgcacaacatagaggctataagtaagcatctataagcatgagaagatacgaacgaaaaatcacataacaagctagaagatttgcaataactaaggaatatttatagtgtggctacttgaagaaagactattttgtaaggtatttctctagcgttttggttatatgaaatgtccctacaatacatataagaagttcgcgtcatggtgtctgacactcatgaacaatgaaatatcactgaaatattagcaagaacatacaaaatctcaaagctagtgcagctccctatgctcactggaatggtccctgtgagattgtttcctcttacatcactgcagatttggaacaataaccacaaccaataaggataagttgcacaaaactgcttgtctaccatattgcctattcaattatctaccatattgcgaggataagtataacaatcataaaacaaaaatactgatttgcatttcagcaaaccagtagaaaataatcatatatgaaaaattaacaggagatgtggttgcacaccgggaggggaggagacgtcgcgccatgcttacgacttgagataaaggtaataggacaaaacagaagcatgttcaagatataattaatgtgtccaatacattgcattcgatatatgaaacggaatatttgtacatgtaagcttaataaatattgaatgggtacaggaagaaagtaccatcgacatgagctatcaaactgaatatttgccttcaatttgtcgctaacaggatgttcacatcccttcatgtatataaaacatggtcaagcacatccatataccatcttggctatgtctacgtgcaataatccgaccgtagttcgggattatatttatatagcttggaggaaaagttgctactttgaaccattacatttctccaatgaacacaatcacatttaccaggattcatccattctctttcatttgtcagctccattaggaaacattcaacatagcctataactttttgtagcttcttgataaaaaatctgcatgaccacatggtaaagtaagtaaaaaagattttctactttcagctttgatatttagttgtgcatacagctccaaattaagaaccgagatgcattgattcattctgaaggactgcaaaatagaagaaaagaaaatgaaggagaaggaagagaactcataccatttggatctgttcagtctcgccagcggctgtgtcgatccaaattcagacatccaaacatatgagtttgatcattcaaagaatgagaaacatgtcgtaaagggagaaaatgagagaaagcagctacctcaagacttgatattaaattcgtggcatgaatttcagtttggtttaatacttgtgtttaatcttgcgatgtatgtccctgctaacactgtaacacaacacaataaaaagtaaggcaccaaccatcagagtagtgccaacttaacattgtaaaaacacaaaaatacctccatcatcagtgcaacaccgatgcatccatgcaacatgttcagaaaaatcttgcatttagcgatgcatgtattcctgcaatagtcacggttttatgttccaaaactgcatgtatagctactctgtcctggtcattcatcttatcaaactcatcaatgcagacagcacaacgatcagcaagaactatggcaccagccaccaggccaccagactgtcttctttcccctgtccacaggattttgttcaggacttctataggaaccaaaagaatgtacgaaagaaagtttcaacaattaccagtctctcgatcagaagtgacagcagcaggcaaaccaacaccagacgaaacccttccagtagttgaaagggcaatggtcatgactgctctacggagctgggaattggcaattgaaggatatcactgtgacctgctcccttcgctgcccacgtcgccacgggactgcaccaagccgcctcctctcgccgcccaactcgccgttgggatggggagacccggaaccgcgaggcccacgtacggtcccgccaccagcacgttgaccacaccagcaccaccggctcactcagatttgcagcccgcgggggcggggggggaccgacgcggctcggaggcgcgtaaacgcgccagctctaacgggcggcgcgcacggccggatccgccgccgccgaaggccggtcgtgcggcgacggatccgccgggggacccccgttgccgtcactggtggtagggggccacgggccaccgaatgccgcccgcacggcgggagctccgccgaccttgctcgtctccgccgccgccaacaaagtctgcaccgtccccttgccgactcgagggcagagagctcctccgcgccgctgacctccttaacgcctccccgcggaggtccaccccccagatcagcccagcgccgcctcgttgtcggagaggtcccacgcctcgtactacctctcggcnccatcctcaccggcaacccgnccaccatcaccatcaccggaaactcctccttctcggccttcatacgaacctgcagcggtgacggcgcacaggaagggggcggcggcgcagcacaacgnaaagaaggtggaagncggcgcgcgggggnacggcgacagcacgcgagggagggggcggcagcgcagcacancgggnaggaggtggaagncggccgggaggcgacgggcgagnagatgncggcggcgcgcggggagggggccgcggcgcagcacagcgaggaggagttgggaggcggccgggcggcgacgagcgagaagggggtgncggcgcgcggggaggggccggcgaagctccacgtccttcgatctgcgtgaggtggggaagggcggcgaactcgcggtcgaacccggcgccgccgccaagctccccgctgtggtcgccgctgtcgagttccgcaagctcctccacgctgacgatttcttgctccccggctccccaccgcctgccctgttcgccttaaggattttagccttctaaaatttaccagtgagactgcgaatttctttattttgtgccactttcttctcttttcctcgttttttttcttttcctcgcgttttcttttctcccgagagttgtaggacggcattgtccctggcttctgcgtacagatcgattggatcaaaccgattcatccttctgctcgctgttctatttcgcatcgcccaggggagaggcggaagctacggcggcgcacggcaccgcccatcaccgcgtgccctcgttcccttgttgcgccaccaccattgctcctctctctccccctcctccgaagaaagggaaaaaattgagtgtttttggataacacttcatacttagtactctctccatattttaatatatgacgccgttaactttttaacaaatgtttgacatttcgtcttactcaaaaaaattatatgattataatttttttattgtgacttgatttatcagcaaatgttctttaagcatgacataagtatttttatatttgcataaaaattttgaataagacgagtgatcaaacgttggttaaaaaatcaacggcgtcatatattaaaatatggagggagtaccttgtatgaacagctactggatgcttttgtaatctgaactagaggatgctgcaattggttgcttttaatttgtaatctgaaattgattgcctaggatatgtaatctggatggtattctcagatttggcaatttaaacttgttagacttgttcatctatggtcaaccattatgagtatatgttgtcgaaaattctggtcacatgctgtcaaattttcggggtacatatgctgtcaattttttttttctgtactatcttttcgtgttttggttacatgctgtcaaaaaaaatacagtagcattgctgtcaaaatttccagcaattagctgtgaaaatttccaacaaaattacagcatattggattcgagaaacgcccagggctcttccggctagctccataaggtggtgggctagacgatctgggttcgaagtctcaccccttctaattatttgatattaggtcattccttaatattcgcgttttttacagcatattggattcaccaatttctcaacttgaacacacatgacatttctcggaaacatatccttcaaaaaaaaatatgtacaacgtacaacacaattgatcatttttttggttgtaacttataattacaactatgtatactctttcctcacaacactagttcaaaacagaatggagcgaaaatacataggactagcacaaattgattcctttacaacaagtgttctccaaaacttgttttttcccctgtaacaagtcttttcccagaatccaattaggagatgggactgggtgctgggtgcttctcttttgcagtgctgctgccagcggtgggcgatgggactgggtgcttcttttttgcagtgctgctgccagcgatgggcaccggcatcagcggcgggatggtggtggtgtggaggcgctcggggttgtctattggcggcggcggaaggggatgtgtggcggtggcgtcgcttgttcgtcggtgtctgctcccgaatcccaatcgatctgtacgcagaagccagggacaatgccgtcctacaactctcgagagaacagaaaacggaggaaaagaaaacgaaacgaggaaaagaggagaaagtgttacaaaatagagaaattcgcagtctcggtggtaaattttaaaaggctaacggattaaatatcaaatcctagcgaattggatggtaaatccttaaatttctcgggtggcaaatccttaaggtagtgtttggttgctgggatgagatgggatgggatgggacgaacccacttttaggggtgtttggttgaggggtgggtgggatg

SEQ ID NO: 60163 - DNA, 830 bp, Oryza sativa
aacattatgcttcttcatcctctgtttatgggatcatcaagagcatgttgagttaggaagtcactgctccccatcttagctctagcagagaagtgctcaacattgtggtgcgctatcataacgattgtagtttattatatagggacaacagaggcacgccctaagtggaaaaataagtgaaactagcggataagatcacttgattatttgtgtgatcgattagggataaaagttacaaaaccagaaggttaatttggtgcaattttcgtatcttaacaacttaatttgcttgatggcccgcttaagcgggccaccagtgataatggaacttcgcaggtggacgcccatcggaccatcggacccccaaccataactatgcagctgggtcatcgcggccaaaaataatacgatttgcctgtgaaatttatggtctcgtagtgaaaaatcgtttttaagtacatagcgaatgccatgaaccattacatctactgttcaattttcatttacacccttggaaatggcctaagccctaaggtgagtcaaccaaggtttagttgggcacgtgcgtattgttcttcgtgatgataagctcgtaggcatacagctaggcatggtgacgtgcgtccatgctgtcacatatgtaggcagatcggacgagcgtcttgtagctgtaccccaccgagattaagcgagatgcacgctaaaactatcgatcataaatgatactcatccgtccctcattgactttttttaaatagtttgaccgtacatcttattcaaaaaatttaaataattattaatttttttctattatttgattcattattaaa

SEQ ID NO: 60164 - DNA, 657 bp, Oryza sativa
accacgcgctacacacacaagcgaggaaacacacgacttatgactctaccctagagggtggcttaggttctgcgacgggttctccaagatcttcactcctgcttcacagctggcttcactgcttcctccacttcactagcagatcctgcagtcttctggagcttcggcaaacaactgacgatgtcttcttcttcactgacctgaccatctagtactagttgaaatccgaacaaggaagaagggagtaaaccttttgcaaatagcattaggggaaggagaaaggaactttcgcaaatagttttatttataaaatatgtccttaggttttatccacttggcttatcctacagtcgagatggctctgataccagcttgtcgcgaccgggaaaatttccttttcccgaacgctagtgtattaatccccggcccaggaaaagccggggtacaccacacaaacatgatacgaaaggcacatctttattatatcgataatatttacattattacaaaggcacttaaggcctgacaatcaaaaataacagcagcggactagcgggcctacggctccatctttacaggcgctcaactggtgtataagccaggactccacctaagacatctttttcaaagcttctcttacttgagaggggaaggatt

SEQ ID NO: 60165 - DNA, 2770 bp, Oryza sativa
ccttaggaagggttgtgtagtgcgcctcaccactggagacatctgacgaggcaatcgcgcaacaacagtgagaacagcggggcacgacaggagtgtccatggaaaaacaaccacagcctccagctccattctctcattaagaacgctgacacaaccacaccatactcgaacaaaatgcttcacatgccggtgtggcatctagcagcgtgtggattgactctgacgtgtgggccctggatagatggggagatgtggaagtccacttacatttgtgccccacgttttaaattttaatttttttttcttttttactaactaagatgctacatcagcaaaaaccaatcgatactgccatgagacttgacttggatgattttgttaaggtgggggtataaatttctggtattacagtttagggatatcgattaagctcgacgtaaagattaggaataggaatggaaaatgtacttattccttcctcatactcttccagcaggttctctcccggcccatgatgtcgatcgttcacaggccagcaagcaagtcgagcggtgccggcacttgcactggacggcggcccagcccatgaacggacggctgcatgagcctgataatcacggtaaccgaacgattgccggcaacaaactacgggcaatacgacttgagaactgcaaatataggtgaagagaagagatgtgttacaaagctctgtactggtattagaaccaatataagacagtttaattttttctaatccaactgtaggagtagtacaattttataaattaatggttaagatcacttttgacgcataaaggttaaggctcccatcggatagcctaatcagctaaagaaaaagccaaaatttaaattttgaagcttaattttgagattgattttgagatattttcaacgtagtttctttttcaacattggcttttaagtcaccaagaacacatttataaaagttttacctacaaattcatttttattttctaataagctgttttggcttattaggaaataagccaaacgatggagatctaacaagtagcaccgctgttttctctgctcatttcagtttcggatgatcaccgctggcgtcatcacgtcacagcttcacaggtgaagctagaatattaatgtcttgtacatatatgtctcgcgtacgggttaattccacagattcatcctattccgtattgagagttttcgacaactcatccaccaccacacacatgtacagtaccgtgacggggacgtacgtacaacctggctacacaagcaaacgcacacataatatgtatcgcgattgatcaccaccccggatgcccggatcgaagcccggccggacagtagagttttccacttttcatccaggaattctgcccaactacgtactatgccatacaagcacaagaagggtcgcatgagtagtagtagtaggcatcatctacatcgtcagtagtggtaggccaaagtggaagtgaatgaaggatttgttggtcaccatccaactactccgttcttgatcatcactctcctttctctttgtcaccatcctagaaatatatactcctgcttcctctttgtcaccatattgcttcattgcatgtctgtcttatctttagactatgggcatgtttcagattatagccaaaataaaccttaccattaccaaaactttgacaagatgctatattgccaaaattttgacaagatttcttatgtattgaccaaatttgacaacaaactaaacgtagacaattttttgataactttacaaaaaaatagtatagttgaaaataacatcaaattgaaccgtccctatatatggttcgtattttaaaaattaagtaataggtgagaagctaacttttgacttttactttattttctaaatcctatgactatcgtaacgatgagaatcttaattatctcgagagttagtgattctaaaatagttaactggctctattagggcctagtgtatagattactccgtattttaaatttcgaatttagttttaggaataactagtattaagggttttcaccactatttttatttccaaggatatatgtggtaattccggatttcttttaatcagtacttagcagacggtacctttgaggtgactaaaggtgttggtttaaagaccagcagctttgacgtttcagaaaggataaaaaagccagctcaatgcattggcttgaattgagccgaagcatcaagcaactcctcatcccacatatcaccatattaccattcatccatcctacatccatccacaacacaaatcaaagcatttgaatcacaaattttggcacaaataaagaattctatcactccaattataataacaagatgaacgaagaaaaaacaaagtttgtcccacctcaccttgtggggaggggccacgccagatccggccgcccctgagagctggttgcaagggcgtggggcggagaggaggaggggcggcgcttgatccaaccgttcctgagcgcctatggggaggggcggaggtagacctagctgcccccgagcgccggtgggaaggggcggcgttggatccagccgccctcgagcgcgggtggccaatgtgaagaggtgagaggagtaggggtggcccacatctcattgctgccaccgccgtgaccccccggcgtgaaggaagaacaggaaggcatggactaggggaggaggaggaaaagcaggtgggacggtggtttcagagagagtggcgagatgaaggggctgcaggaa

SEQ ID NO: 60166 - DNA, 5850 bp, Oryza sativa
tcagtttgtgacggatgcgaggctgtggttggtgttaaggtctactcttcggaagtcggagaatggaattacagtgagtggaattacggaaccagatcctctgacgtgaactgctccctgacatggtcactaacaggtggcctgagagcggtggggcccacatatcagtcgtcacgtccctctgacttcacctcagaggatcccaatcctgaaattacagggaaagcgaatggccccacagtaatatagtatatgataatcaaagtgtctttctcaatggcattgctgcatttagtcattcgtcagcctcttgtggagttgtggtagtggcagtggatgtgaagggggagatatggaggatcttgcctgtgccggagatggactatgcggaagaaacatatggttgtgttgtaatcagttctatcggtcaatccaaagggaaattgtaccacctcagtaaacacaataacaatgtcgttttaaacttgtcaatataggttcttgaggactattctaaggatgaatggacactgaagcataaggtgactattgaactgctgtctgggaagataagttgcaagtaccaaaccatgttctaccgtggggttgcagttcatctagactgcaacttagtttactacattgctgattacatactgatgtcgtatgacatggatcgtaaggaaccacgtgttattcaagatcttgggtcagattgtatgatggagtatcttccctatgttccactctacgcaaaaacattgtctagcggccgctaggtctatttctttgtcatgttgcttggcatttgatcccatgaaatgatagttagaccttctaagtatctaggccttttgtgaggatcagcatgagtgcttttctagttgtcatttgtaacatgttggtctgccacttattatatcgaatgattaatgtttatgtttattagcttatgactgtaggaatgtaacaattcaggatgtaaaaacattgttattctttcttagtgtttgagttgtgtcagttctggaaaagaattagttcgcttgtgctgttgtacaatatcaggtctagggatggcaattgtgcccgtttacccgcgggtaaaaaccctattagggttgggtttgttctctattttatacccatgggtatcttattgagtcaaaagctatgcccgatgggtaaatgggcatgggtataggtaatcactacccatgcccgctttgcccgtttacccgcgaaatctaacttacatgtagactaggagcaaaatccactagaatacataagccacgttctttgttttctacggtttcccttttatttcccttattatttctctcctcttactctatcgccgccagaggagagacacgacaccgaggcggagaatatttgatgttttaagttcgattcgaacttagtagcttgtagactttttgttccactgcttttgttgtggcgggtaaacgagcacgcccgcgggcataaggcgcctgcgggcaatgggcatgggcaaccatccttacccgtcatgtagtaatgggtatacccacgggcacaaataatctcatgggcatgggtattggtaggcactacccgtgcccgtcgcgcccgattgccatccctaatcaggtctgatgcttgccaaaatcaggtcaatatcggagaaaaataggtgagttctcatatcaaagaattcagtaagtggcagtatgcttaggtgatcatctgatgaaaatgcttgagttcttatattgaagaagtttaagaaaattccatgtgaatacctttaggttatctcctggttgtccaggaagcataaacgtggtgggctggtagctctatcatcttgtgaggccagagtaagtatatcgcatcagcagctgtactttgagaaatgccaatgtctctcctgtcttcttgttgagctgaagaatgcgatggcaaggattgcatctcgttgatagtaggtggtcaactgacatttgtctaaaaattgaatctatttcttggcttaaatttgtggttaggttgtctaatgaataaccgaacagagtagtttgatgctaaaccctgttttcaccaaatacgttattactagttttcattacatatacccgtccctgagtacaacaaacttcaactttctcatttacaaaattttctatatagaagttatttaaagaattaaaataaatctatttttaagttttataattattaatactaaattaatcatgtgctaatgagttttctcgttttgcattcactaaaaatccctcttccaaagaggagatctaatgcagccttagagcatccccaggagctcatccatatttaatcctccatatacccatatgaatggccatccaaaaacgattcatcattcatatccctcctcactataatagatcatccatatcccaccctcccatattttactaatatcttccaactaacatagctgtgcatggatttacctagcaagaaaaatcacatcaacataaataaaatggacataaaagctcatttctactccattcctcattttctacagcaaaaatatagcaacataaatctactaagtttctactctactcctcattttctacattcttttctctgctcttctctacttttctccactcttttgctataggggctggggtggcaggcagcgcacggatctgcctaggcagccagcgggtgcggaggctcggcgacggccggtgggcgaggagcagcggcgggcgggcggatgaggggcggcgatgggcgggcaaggggcgtggataggcggagttgccatacggcgggcaagcgcagggcgacggtggtgggcgcagacgtgcggaggtcgcatggctatcgctgccggcgctctccttctatatctggtatgcctctccccctccaggctcactccacagctacaccctctctctctccaccctccgtttcaaaaaaataaaaaataaaaaagggcatggcgtactctccttcgccagccgacgacgacgacgatggaggggaggtcgtggaacttcagatggaggtgggagctcgatccacatgatccttgtgacatggcttaaggagagagacatactatatttgtctttcctctctccgtgtgtggcacatccgctactttaggatgaccggatggggcatccgttgaaggtgggtttttgtgctgttaaattccggatggagtatcggtagcatatttcctgaagatgatcttagtagaaatggactttatagatatatataaattagaaaatattgaataatgaacttttttttaaggatatagcaatagcatagcattgttcagtcgattccgtatcaatcttctcccaatcctctaaaccctcttccaaaaaaaaaaagaaaagaaaaaagaaatctctaaaccctactacctcgtggaagaacgaatcccccacgctcgccgcgatgcgaacgccgccgcctcttcccccgtcgccggcgccgcctcccttcctccaagccctagatccgcggcagcaggtacaccccattcactcctctcgccgccgccgccgctagtgtggaggaagaagtgcatgcggcggagaacatttacggttctctgccttctctccctgcaagatccgccgccacttccttctccgtccggccacctcgtgtcttccggatccaggtacatatacttttcgactgagatttcttgtctagtttcatggatgtacatggatatatcttttcacctcctgctgttacaacttacttgtgtggttaagtttgctgcattttgattttcttgattctttcgtttttcagagcgtagcgttttttagttcatctgttgctaagttaagacctttcaagtctggtcaaaggaaaaagctcagaaaatggtagatatcatagaactccaagttgttagttcgttgtttcactttcaatgagaatgtcattgttcatgtaaaattattcatatcttttgaatatggcttcctgatggcaagcagtgcatgtaattcagaaggtgaaatttcgtccccagtgttgctgtttggatcgtagaatagttctctccttccaaagctttgctccagtttgttcggaattatcgtactttgcaagagactgttcttttactcaatgtccacatcactctgctcagaccatgtttcaggctatggctgcagatgtagaatgaaacattttgtactagtaggtatattagctgtccaaaaattcctcgaaatttgcacatagttttgcagaaaatctaacgagttaaagctctgaatcctaaaatatcccccaaaaaacatcctctgaattctgaagagtgaaatatctgaatctgtagatgtaaagtcatatatgtagcagttatgcacgcagactagcagtctaccagttttaggtttagttgccaataaaacaaattttttgatgtactgattggtgcacttatctcctgatattttaagttttaccttttttcggcatctttgcaaggatcactcttttcctcactatatattgatgttatcattccattaatcatgttgcctttcataaatatcaatataactcttcatgtacaatctggtttttaatgtttggaggcatttactctgtgaaacagattccctgtttagattactcttttcccattatatattgatgttgccttctatctgaatgatccctgttatgcactacctagtttttttttttttttttagtttggttgatcaatcaatgcaataatattctgtagtgtaaagcacatgttcaagggaaaagggatactcgaatcaagaagcgggaagaagatgatgacaatattatgatattatgattcgtttcctttttcccgctttgcatcttttgggtactggtggtgggggacagaggaaacatgaatctatagctcaagttagaaggctatgtgacaaatttagtgcctctgttcaaaattgtgttattggtataatttggatttcactagtttattttgaagattgtgctttacttaatgttctttctactgtgagttatttctacttttgaaaattatctggaaacctgacctttcttgtttgttgttttgattagatctgaggactgaagactactgccagtttcagggaggatttctactcagtggaagcttgtgttgtagctggtcttttgatgaatctattggtctcaaatacattgtagaatagtatttgttggttcgttgaactcaatgggttctttgccgtccaaagccactggtgaggatgccctagttctatgcaaggagcgaatgcgccatatcaagcgagctattgattcaagagatgcactgtcggcatcccacctatcatatactcagtccctccgtagtgtgggtactgcattgcggcgttatgcggagtctgagatctcaacagaatcatcactgtccatttcagaagcagataagtcaccatcacattcctctatggcttctccatcgccttctcaagcattagagagcactggttccccagtacatcgaggtagtcagctgactcctccctcaacaaagatccattacatgaaagcagcaggaacaaaacctttaacaatcactattgatccatctgctgctgactttgtggggcaagaatccccagtctctacctttgtgccgccaccaccaccattgccccctgaattatgtacctcatgggatttcttcgattccaattatgcttctggtagtgccacctcaaataatgagaatggagtgacattaaattttagtagattgaagggtctgagagattcaagggaatctgaagcagt

SEQ ID NO: 60167 - DNA, 1128 bp, Oryza sativa
agaagcaggccaagttcgcctacaccacgcagcaggtcaagtcctgcatcctcctcggcctcacctccaaggccgccgccatcgagcaggccgccttgttcaagaaggccaacctcgcctgccactacacctagctacccatacctcgccgccggccggccatctctccggccatctctctctcttagctagttggtagctagtgtcgtcatggtgttgatgatgaataagtccttgcatggatgcgtcgtggcaaaccatgcgtatattattcaagaattgtgtgagtgttcagatctgacctcagctgtggcttgtgtgcgtttgcagttaaattgatgaggtgcacggcgccacgacgacgtctcgtcgtcggtgcttagttgcatgctttgtttgcttttcttagtttcttggcgatgtacttattaagagaataagatgagtttgatttggttagtgatgaactggtctctgcttttacctaagctaacttgcacttgtttcttccctggttgcttggtttctttatgacgagatggatgcaattaattctgtgtacatcttatttcaatttgatattttactcttctgtgaatttacagttggtttttgcattcaacggaaaaaaaacaacagagtttcaaagatcttgtagacatacaagtttatatgttgaattgatttacttaattgatggcagaaaagggttgctgtagattatctttaagaaaaaggtacagtaattattactactgtaatttacagtagtcaacacggcgagctgtgttgtcttgcggccgtatatgagctaggcacattattaccttactgctaatactccctccgccactaaatatttgacaccgttaacttttttaaacatgtttgattgtttattttattaaaaaaatttaaataattattaattattttcctatcatttaattcattgttaaatatacttttatgtatatatatagttttatatatttcataaaagtgtttcaataagatgaaccatcaaacatattaaaaaaagtcaacaacgttaaatattcgagggagtacattattagtcgtcgcctaagaacatgagagcagagactataagcacgtcaaattaat

SEQ ID NO: 60168 - DNA, 9378 bp, Oryza sativa
gttatagaaataaagagatcgatcgatgcaaagggatgaagaggaggagtagtaggatggacgtgataaagcggtaaaggtaaaggggatcagattcagagagggtttagtgatccaagaaaggctctggatttgagcccggataaaagcagtatatccccagctacatatgggcatgatacgtacattccctttgggcatttgcgtttgcatgtatatgcgccccatgcgaatgatgcgagatgcgtttctcgacgcatcttgcgcgtaggatgagatgaaacaagcgcagcgcggcgctctgtcgcttcagtagctagcttaggtgcagtaccacgtttccttcagataaaacacacgtcgcgtgcaattcagggtttacagtctcgtcgagccttcgaaatgcgagccctagaaagataattcctctttttttaattcattttggtattgacttcgaaaaagctataaccaattattatagagtttgcagaactaataattgcgaattacagaattatagctttgattaaataatcataaagaagagatcataaacaaaacaagaaaaattactaagaaaatcctagaagaataacatctttcgtacgcgaatctggatatttgtgtagtcttttttaagagatcatttcaatccggttcgggaggctcgaatttaaaaaattatagtgaaattcgtcgaagctgtgagccttggtgatattcagagtggtgttttggtatccctttcttctttacagagcatgtaccatcgtgggctttagtctcgtgcaagagataagggcttgcgctcttgggccggaaaacattgggccggttgatgacgccgtccatgttccccgtaagacatttcttgatttctgatggctctctgcatctctgatcactgtaattgagcattagtgcacgatgttatctgaatttggttcaagtctctggacaatgtacttgagcatgatgttttctgaatttcatgcaagtttttcggataaaaaaactccaaatcctagcatatgtaatccacacgtactacatattgtaacatcctgtttgttcttgcttcgacaactttctgaattctgatacaacgaaactgaccactctagcttgcatatgaaacatctctaagaacaattagttaagaacctagaagagttaaaacacgtagtagtacatgtaatcgatcacctctcacactacaggagggatcgatcacagaatctgaccaattaaacacgacatctacaaaaacaatcacctagaattgtactccgtactacacaacaaaaattaattaacaatcataattaattcctaaaaataattaagcttcgaaaccctactactaccaatcgagcgattaactgacggcgattacagcgaagcgctcgatcggatcggagtccggtcagtacccgccggcgccgccgctccatccgcctcggccggcggcgcccatctggttgccgccgatcgccaccgacggccgctggttggcgttggtcaaatactgccggacggggtcatccgtcggcggcccggcgagcgccaccggcggcggcagcggcgccgtgatgacgtactgctgcatgaccagcacggacgccatcttggagaactcggaggagacgaggaggtcgccgatggggccgagctccggcgactccatccactcggcgagcgccgacgtcagcggcgagctcgcctcgccggggtggcggccgacgatgtacagctcgtgcgcgttgtccagctggctgcggatggcggcgaccgtctcctcgctgttggccaccacctgctcgacgtagaggatggcgtcgttgccgaggttgcgcgaccggaactcgttgaggtactcctcgtccatctgccgctcgctcttggcgacctcggggacgacgttgatggcgcgggagtgggcggcgggcatcggcggctgcggcggcgagatcgccggcgccgtgtaccccggcgggattaagcggacgatggtgaggcacacgcccgggttttcgaccatccgccacgcgtacgcgagcccctcccggtcgtcgggcccgccgaagaagaggagcgcgacgtggtgcacggccgccatcctcgccgcggcggcgctgaggccgcggtcgacgaggatgccgacggagcacggcgccgacgcgaggatgctctcgttgaagccccggagcgacgcgttgatgggctccatgccgccgtccaccgtctgctgcttgtggaacgggagcacgatgagcgagacgtgcttgtcctccgccagcacgcacacgtcctcgtgcatcgtctggtacggcgacaccgccgtgagcgcctgcaccgacacgccgccgaccatctcctcgtagctctcgaacgcgttgaagatgtggtcgctggcgccgcccgggttcgacgccgagtggtgcgcggcgagcatgttggaggcgcggccggtgagctcgacgaggtggagcgcgtagatgaagatcggcgagcgcttcgtcgggttggagagctcgagcagcgagatgatcgacggcacgttgcgggtggtgtgcacgcacgccagcatccggagctccgcgtcgtgcttcgaccgctgcaggttccgccgcttgtacccgaccagccgccgcgccggccggtacaccgtcgtcaccaccggcgtgaccagcgccgtcatggccaccgacaccagcaccatcacggcgaacgactcgtcgtcgagcacctccttgtccctcccgatgttgaggacgatcatctcgacgaggcccctggtgttcatgaggaaccccagggcgacgccgtcgcggaacgtcatggtgtaggagacggcgatgaggatggtgcccatgatcttggcgaagctggccatgacgaacacgagcacgaggaggcccacggtgatggggtcccggaccttggtcacgttcgtgcggaggccactgatggcgaagaagagcggcaggaggaggccggtgacgaagtcctcgagcttctcgattagcacgacgccgagcgggccgctcggcatgacgaggccgtacacgaacgcgccgaacacggagtggatgccgatggcgtcggtgcagacgccggcgaccatgacgccggtgaggatgagcgtgatgtgcacgtcgccgatggcctccccctcggggacgcggcggacgatccaccacatgagcgggcggacgacgtagaagcaggcgagcacgaaggccaccccggcgatgagcacccagagggaggagaaggccgaactgttgacctctgagatggcgatggcgagcgcgaggaggatccaggcgcacatgtcgttgacgatggcggcggacatggcgatccggccgaggtcggagttgagcagcttgacctcggcgaggatgcgcgccagcaccgggaacgcggtgacggagagcgcgacgccgaggaagagcaggaaggaggcctggtgcacgttcttggacacctggtgccggaagatgaacgacgtcgccgtgccgatgcagaacggcagcgccatgccggcgacggcgatgatgagcgccttcttccccgacctcctgatggtgttcacgtccatctcgaggccgaccaggaagaggaagtagaggagccccaggtgcgccaccgtctccagcgtcagcaagctccgctccgggaacactttcaccgcccacgtcgaaacctgccccatcaccgacggccccagtatcacgccagcctgcatcaccaccacgacgacgacggcggcgacacagttaaccaatcgaccaatgagaatagaacaatggcggcggcgaaggtggcgggcgacgtacgaggatctccgcgatgacgcgaggctggcggaagggcttgaggaggatgacgaggaggcgggtggtggcgacgatgatggcgacctggaggaggaagagggggagggagaagtcaagaggggaggcgccctgccagatgccgtaggcggtgaccatcatcggggagtagcagacgaccgcgccggcgccggtgccggccttgccacgcgacatctgggacgcggaggtggcgttcttgatgagcgggaccgcgccgcccgtgccccccgccgccgccgccgccccactcatgatcggggccatctcggcgcatcggcgcgtcgacgagagagagagagagagagagagtataagctggtggcgcgcggcggtggctgtgagcttctcgttttcgtccggctccccgtggcgcgtgcgatccgatccccacactgcctaattttgacgtgccctggccgtcgcagctaaaccagttgaagtgaaagctgcatgttcactatcacaaaagtgtataggccggcccacccgtattttgcggcccaaattttcgtgggctggtttgggtctcgatccaaatacaggtgggtgggcctaaatgggccgagttcactgtactgtttacccatgatagggaaaatatgtagtactccctctgttttatatatttcgctagtaataacaggcacgacagatgtgtgtttctttatatatatatatatatatatatatatatatatatatatatatatatatatatatatatatatatatatattaatatttgtaatattgtaccaaccaaatttatacatctcgtcgagacacaaccaaaacaaacaataggaaacattaatgataatgtggagaggtggtgccatcgtaccaactcactctcagttccatcatacgtgcatgtgcggccatgccaactgcctacattcctccacatataacttgcttctttatgcccatatccatcactacaactagttaacaacttataataataatgctgatatagtctcatctctgcatatcaaccaacatacaacagaagttgcacaaatttaggggaaagaaaaaatgttaaccaattttttatcggaaaggctatatggctatcgcatgtttttgttaggctgtatcattcgttttttggtcccttggattttgtttgagattcgtgctatctagacttttgttttcttttgtatgtgggcttttgattattgtaagttcgggcttccatacgtgggctaaatgggcttctttttttttttacatttttgtgggacccactttgtgttgccgacagagagagatttttttgtgagagtgtgttaatggtgggacccacatacactattcaaattttgaaatccgcaccggagagagagattgtctgaatcagactagagagagagagtgtgtgagagattcattttgctttttgcctttttcctcatcgtctcgtccggcgatttcggcggagatttcgtcggcgacttcgggaggcgacgacgggcgtaagctacgccgcggcgtggattcgtgcaggctacgtcgctgtcacgcccgaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccagctccactcccacaggcagctcagctggggtataagccaaacgtcttctcctcctagatcctttttcttcaactgaggttgattgattattgcaagaatgagcatatgacatactcaacaagccacacagcaaatatgcaagtgcacaaggataccaaaggatggcataatataggctcatttgcaaaagcagcatttagcaaaacatttaagagaaataaaacagtggagtaattaatcagaaattttaatcaacactgaacaacacacccatgctgcacaggcccaaccatcctgaacaaccatacccggctgtacagatctaactccaaaccaggagctaagcaaattattaccaggtataacatccataattattgtgagaggtgtgagactaatcacgaaaaacattgctcaacccgcccataaccgcgggcacggctattcgaatagttttactctggccagaggtgtaccactgtacccacaagacacagccccacaacatgtcaccatgtgcctcaataccaccacggtacctcggaaaggagttgtgacaataccccttgcacaacacaatccaccacagcgcacctttcctggatcataatcacccccttataaacaaggcatggactccccagcgacccccgtgggcttatctccgccacttctcagtctggtgctccgcaatgaatcatgctatacaaaaggtaaagccgttgcccacgctggcttgtggttggcacggttaatgtttcacaacagtagctcgcgaaccggtccttaattgtcatgagcacgactctcaaaaccatgtgctcacaacccaccattatcaagttttagttggcaagtaattaattaaccaatcacgattgaccatcgtgaactatcattaagccatcattaaataataatgagtcataagtaatcccaatagtgtgctaatgtttctaagcatggctaagcaatcatatctaatatctagctgaaccaatatatatagctcaactagtcaagttataataacccaaggtatcaaggaataaagtaatcaatgcaaacaggccataacaaaggaatagattcacaccacccagtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcacgaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcatatgaatttattatgaattttacaagattaaatctaattaaagcccatttaaaaagaattaaataaatttaattcaatttatggataattttaatatgtagatctttattttatacaacttttgcaacttgaaccacattaaactgagttacaatgaattagttatgaattttcaaagattaaatcggattaaaacacttatatggattttaattgaattatgacgcaataatgaattatttttgaaaaggaaaagggaattattgcgtcatcaaaggcggtccgggtgcacgggacggtctaaggaaacgaacggccgagatcgattctatccaaaacgggcggccgagatcaacttgatctaccgcggttcacgggacaaggcgacgatgacatcagcggtgacgtcagcgatgatgtcatcaccggcgacggctcggccttgcgcgctcgtcggcgaacgacggcgcaacgacgcaaacggaggacaccaacgggtagaggacaacacggcgaactcaccggtgaccaaaaccacggtggaagagcaacggacggcgccggcgacaaggaagaagcggcgacggtcttcgggtcgacggtgacggcggtgctccggcggtcttctgcggcggcgaagaggtggacggggacggcgacgacctcgcgatcccgatggtggcgacagcgaccaacgacggcggctgcaacggcggcgcggcgcggctgaaccgacgacaacgacagcgacggctagggctacgcggaggcggcgctagacgcgacggcgggctaaggcaaaggtggcggcggatagaggagagctcgagggtgcttataaaggggctagcgagcggcgacggaggcccacggcgaccggcggcgagatggaaagctagggttggagggagaaaagtcgatccgaatcgagctcaaatccgtcgatttccaaacgtaattgaccgaagtttctataagagaaaaggaagaggagatcgaggagattatttcccctcaaacgatttcaccggaaacggaaaggatcgaccggattggaaagcggcggcggctagggtttcggccggcagcggcgcgaggaggaagacgggcccgacaggtggggcccacctgtcagcgggagagagagagagaggagagcggtggcttggttgcgggccgacttgggccagggagggagagagaaagagagaggttttgggccggctttcggcccaaagccaaaaggaggatttaaaaacatttttctatttaaattattcatgaaatgatattccattgattaaaaatacttccttggctcaaataaatcccagaaaaatctaggaactatagaatcaagtaaagtatttaacaaaattttatctaacccaattttatattgagatttagcaaattagatcttctcttttaagatcatttctaattattccttttaaacaacaatttataatttaaggatttttaaacaagaaaagctcttaacaattataattagatcattattgatcaaataattactgaactgttctttgtatcatttaggaattgagctctgaaaaatccgagaaaatttcagagagttgacttaatcatggagaatttaataaaaattaaatccatccatgctttatatttaggaaattttatttcccacatttaacttcacttgtaaattaatgaacatttaatataaattctaataataatttattaaataatttataaatcctgaaacaaaaatcaggatgtgacagtcgcggcagtgattccactagagtttgcggtgtgggcttctccatcttgtcctcgagctcctcctcctccttttctccggtgagtatgttttgattcttctccagcttcatttgttagcttgctgctcgattcgttgttgttttgctccgctagttgtgctccttttgccgacggagagagagagagagttatagaaggagaggttgacgatttcgtcgtctcgttctcatcgtctccggcgacgcggcggcgatttagcgaggcgacaaggctgctcttcggcgagccgactcggtgtctgctgctgttgtggaggtgtcgcaccgtcgattgcgcaagattattccagtggctttcctttttgttttttttccttttttgttcatttccatctcctatttagcatgctacatgctgttgtggagctgagaagtaatgatctgacccgggaggtcggtacatttccaattgagctgttgaaaagcatctcttaagtcgatttgagacgcaagtctctttttgacccaaacttaaaaagaaataaatcacttagtgatttcaaaatgatttcaaacaaaag

SEQ ID NO: 60169 - DNA, 4462 bp, Oryza sativa
ctgatgtctttttaaaaaattaaattatactcgatgatcaatctagcgtctaaaattaatccacaaaggctcgataatttcaatgtgaagatatcgcgtatcacaggaagatgccaagtgatcaggacactgatggatatggagtacttcctgtgtaaaaaaaaacgaatttaggactgtatgtgatatatttttttattgtaataggatatatcaaatctactactatattgatttttattgttattgggacagaaggtgtatatatcctaggctggcctagaaaatataagtgtcgtacaaggtgtaattgttgagatctgaaagcatataggagtatatagcatgtagcttaagcccaactgttcggtctgaacacacattatattagatctctagctagatatcatggaaagtctaaaggcgtagcaattatgctccatcaagtcaaaacaagtgtcaatcgactgcatataaattattgtgattataactgctagctacactgcaacagtgatagtacttgatacacatatagccagtacaagcttgctagttggtagtggctatttactctgatttagttttattatgacatcgtcaaactaagcagggccaaacatatattatggcaacattcaaacagtgcaaggtactgttttatctattttttctattaactttttttgacaaccacagctacagaaatacaaatagatgctgactgggaacctagtgctggtttttctaaccgacacataggcgtcaattatgggagaaataaaaagtgccggttttggaactggcatctttaaggttatgttaacgccaaaatttagtaagattgtttagtggattcggttaaggaatcgtgaagacgtggcatgacggcgtaattctatatattaattaggcatgatttagtagtttccttttatctttagaaaagtgtgtttagtgtccgataagaactttatatttttccctttaatctttaggaaaatttatttcttgtttaagaatgactcgtatctacccatgggtataagtttgtgcacccggggtcattgtaaactatctccgatcaataaaaatactctcggcgtatcgccaccatctttttcgaggtttttacttatcatccggtgaaacttggcacctgacacggggctgcatcagctttcgatcttcggtgaaggggtaagtcctactgtttgccggcccagacagttgtatcggctacattggtgttgttcaaggcttcatcgcttcgatctcttgcatcgctctggtttggttagtatatttgcctatctatttatcatatatcttagttaatctagtttgatagctcgattaactgtataggctgggatgtgctttagggtttttgccggtatcggctaaattgctttgccagattaggttagctaagactttatacttcttagcatactttgcaatgcatcattactagtcgtgcttagaatcaaaaggctaacatatctttgattataataagggtttcatcagggtttcagctgatgagttatctggatgttgcatcggcttacaaggattgcatacaagttggttttagctgatcaaaacaaaggtttcattgtttatctgacatcgaaccttcagtcgatgtatgctttaatcatcggatcatttattctatcatattattataagctggttggtttctgttgaattatgttatattacattatcatcagctgattgtctttatattattatttactcaagtgtcaaaatatacattggatatatagccgattgctcaaaaccctaccgacatcggctggaactactccatcggcttgtcaacggatcggctatttgatctgttgtttacatatcttctcagttgcaggattaaatagattggcacgcctgcatctcatcaaattttggacttgcaatggagctaagaaaatctcccaggccgttgtgttcgttgacttagtttgcgccaacgcgccaacacagttccaacaccatcgtctgagcatggaatttttgtcaacaggttccaagaataaaaaaagtggtccgatgcttcaagcaactcttaatcacccatgagatcccatccaagtacacaaacatccatgaacaaaatcaacgagaagtcgccgccactgccagatccgctcgccggagaagtgccatcgcctgatccgcatacgggagcctctgccactgacggatctgcccgccgttgccattgccattgttgtagccacccgcaccgtcagagaggggaggaggggctgcagctctgaagaggggagaggagggaggtactggagccggagggatggcgtcggagaggaggcaggaggggcgggcgagagagagggatgcgatggaggtgggcgagagagcgggaggtgaaggggtgggcgagtggataaggatgaccatgggctctctccctttgcactacaaaggagagacaaaaaaaatcctggctaggatttgatttttacttaattggtacttaggtgtcaattcttttttaaaaaaccggtaccaatattattggtgccggtttttctctataactgacacatatagttgcttaaaggtgtcggttttaaatgaatcgatacctatgagccattccctatttgggattatgtagtagtgaacctacatttttttaaacccggccttatttttataacccgattacactgttgtattcgctgcaattaaatatttataaaaatatctcacatgattatattctgattaaagaaatatatgttgtaaattacttttatcatatatatttagattctatttaattacttcttaaaaggtaattaaattcaataaagcctagctataactaatttacactatgataaaagtaacttggcacaataaaaataagttatcacaacattaaaaataaatctgttgatacaagaatcgagaatgctcgggtggcggccaattatttttttgtggggccaaaatgatactgtcctgggtggtctgtgcccttaagaaaattatggattgtagttgttggggtaaaaacatgcgtatatataaaaaataaatcaaatcaacacaattataactaactaaaaactagaactatattcacaactttatgaatgtataaaaagtaatttaatcaaatctaaatataatatacatatatatgataaagtaatttacatgataaaattaattcgcaaaacacatatttatttcattagaatataattatataagatctttaaggatttagttgcaacaaacattatggtataatcaaaatgtggtgtgtatatatatatatatataggataaataaattttatttgaagactaagtatagtgttaagaatatttttttttattaatgccttcatactcccacgtggaaaagggatgcgtattattttcgttatttattgaaatagtagctgtttaaaactaattattggatatgctctgtgtagttatgtccttgactccttgtacgttctacatatgtccaaccaaaccatgcaaagaaaacttaagtgttgtcaatttggtacgctcgatcaagacaaaattagctatcgaacaccgtagttttataagacattctgatgacttaattaacatatgacacactttgtggcaatttgctaaaacaccaccgctgaaaaacccttcttcactcccgattcgtaaccccctttaatctatgtacgtatccgggaccccaaatctgagactccatctctagtcctttttttcttttttaattgtttgttgctgtttgcatattgatttctaaccaaactccacgataaaatcatcagcattcacataaacattacaaaatcatccacagtcacaaaaatcatccacatccacagtcacaattcacatcacaaatttccagatccaaagacatcacaaatcaacaaattcacataaaactaatctaacacttaaatcacaaatcaaccgccaccctcaaccaccgcgttgtcaccgtcgccgtgtggggccaccgctgcccgctcccgcgcggggccgccgccgcttgctctctgcaaaacagccgctcactctctgcaaaatagaggttaatagagaaaaagaaaaggataagagggaggaaaaagagagtggagagaggaggaaagggaggaggaagtgtttgcgcgcgaggaggagaaaatacgagcaagggattatataatatgcgttgaattttagttccagttggtaataacaactgggactaaagatagtaaggggccggacgatttctaaaccgagactaaaaatgatctttagtccataaaagtgcgtgcggctctttaaccggaaaaaaatgatttttaatcccgaatcctattgaaattgggactaatgtggttttaggctgacccagcaaagatctgttctccagtaa

SEQ ID NO: 60170 - DNA, 40380 bp, Oryza sativa
atgcacatgttctttgaactgtactctgcaataacaaaacttattttcagatttgatgatgacaaagacatcggtgcattgtatggagaactttgggaggatattcctagtagcgaaagagtaaccctacagttatacttaccagaaattatctctcttttgtgtgattccatgtcctcgtcatcatgggctgggaagagaaaggtgaagcctctatttcattattttactgtctatacacataaaagtatcatagcttggaatacacttacgatactgtgtgctacttgcagtcagccaaggctataaaaaaactatgtgatgctctaagagaatccctgtctgtgcaccacaataatattcttgaatcacttttgaaagaactacctggtcgattttgggaggtaagtagtactatgatttttctatctgtggcatatcagtgaatctttccttttattcatggaataaaataggatggaatgcttagagattttcaagaaacattatccatgactaggttcataattcatttttttcgccatgaattaccacagggaaaagatgctattctggatgcactcgctgcactttgttcgagctgccatactgctatgagtgcagaagactctggcatgcctagtgttattctaaatgctgtttgtgctgcatgcagtaggaagtcaaaattgtaccgtgaagcagctttctcgtgtttgcagcaagtaagtatctctcttctctaccctgatctctatgtgaaactgaaatttgtggctagtggatactctaaagcattttactgtttgtggaccagacttttctttgataaaaggatttttagctgttagatagctgtgttcttaacctagtgctcaaaaggtttatgatcttagatgcaacaaaattgatgagaaaattactttcatgcttaatactccctccgtttcatattataagtcgttttgacttttttcctagtcaaatttatttaagttagaccaagtttatagaaaaacaatattagcattttcaccacaaaacaaacatatgaccaaaatatattcaatgttagatttaatgaaactgatttggtgttttagatgttgctaaatttttctataaatttgggcaaacttaataaagtttgaataggaaaaaagtcaaaacaacttataatatgaaacggagggagtgggtatttagtttgaagatctttccggaaatattgcaaacagctctcttctcaaaatattatggggagcaatctagattgtcagtgttatattttcacaaaagacattcatcgggtttaggtgttgtgttgggatggcattttgacattttctatatattagaatttacttagttttctttttctttctttaccacttttcaggtgattacagcattcaaagatccaggattcttcaatattgtttttcctatgctgtatgaggtttctaatcgatctgtcatttgtaaaacaaggaactcatcttcactcactgcatcctctagtgctggtcagtcattaattccagcccctcactgcattcaactaatgtcaatgctggatgaaacatcttgtaaatgaatactagaacttctattttattatctcattctttatcacataaatatgatatagtactgatagttgccatcacaacacaatgtttgaaaaccttgatgggatcggcttaacaagacaactttagaactatacattgttgcccttaatgcagcatacgtgcatgacttcaaaagccacttatcctcctttattttttatgtattactgtcttctgcagagcaagatgaaactgaaggtgtttctgtttctcttgataaggtgctcaactgtgtagcatcttcaatcactgttgctttcctgcaagatattatcaaccaaaggaagaatatcctggaaattattttaaattctctatcccccgaggagagttggcagagtatgtatcttgtatgcaagatctattataattctatgcaactgtttttgaatctcacttatttgatacatcaccactatcattgatgctttttttatggatttctatgtgcagttaagttgtcatcgttcttgtgtatcaaagagttgtgctataaattccagaattcagatggtaataacacttggcctgaggaaacaacttacttggttgaggaggtacatcacatagttgtttagtcctacacaactgtactctttagttcagtatttggtttcttcattttcctgacaaatttcttttaatttgaccgttcagttatttcattcaacagcaccaaaagttgtggatgtcatacgcttagttaagattgctcaggtaatcatcagtatatctagccctcaccaattcatattatattgtgtttgctcatatttattacaatctcatatagcacttttaaagtttcaccataagataatttgttgtcttccttctaatgaataaacatattgtagtttactacttgtatgttttatggcaatgggagcatgtgaactgaaattgcactggacggagctgttgtgggtgttatactaaatttgatgattgcataacaccatttggcaccagtttttttatagattatttagagatgatacaaaattattcatcaaatattcagggaaaaataagaacttgtctttagaaaaaaaaaaggtggctagtctggtggtttgatgaaccctggtgcacatggtttacagattactgctttgcttctttatgtaacagttcatatgcttgtttttggcttcactgattttagaacaaacagttacaaggtttcttgcactgactgtaacatataatttatatcttgaaaggacgagctatccaagatttatgtaaaatataattgttacatactatgctagagtatattagactactgtatattgcacaaaccagcagtttctggatatgcaatctgagtttgaattgccccctcatgactaacttcttctcaggttcacaccgctgcttccgagtgtctccttgagttgagcaaattgtatagagactttccattggttgacagaaaagggcccaagttctcaggcgaacttgctgaactttgtgagtcggaaaaaagcgagcaagcaaaggcatttttgaagcaatgcatggatattctcaaagacttcgaagatcccactggattagccatggagatggactaagtgaagctctcgaggttaaatcggcatagtaaatatcaaaaacaaggctgcgcatgtataaagggcgcgagcaccagggaaggtgggttattctcgcaaattggaatcaccatgtaataggatgagcgtttcattactggttgcatccgaaggaaattctgaagctttgcatccgcaacccacttgtgcaacatgccctgccgctgttacgatttaatgtttttctcccagaatgtagtggtgagctaccagagattggtttcatgattctttcaagtctcaacttctcctagaccaggcccgcttacatctggcagctttcataggtcataaactgccctcacagaccaacacatgcccacacatgcttgcgcaactgcgacacacgcgcccgtgaaaactcgggaagaatttcccgatcggtcacccatccctaaattgctccaggccaagcacacactttgtccacactcgtgcacactcgggaagaaattctcggccaagcacacactttgtcctcactcgtgcacacttgggaagaatttcccgatcggtcacccatccctaaattgcttcaggccaagcacacactttgtcctcactcgtgcacactcgggaagaaattcccggccaagcacacactttgtcctcactcgtgcacacttgggaagaatttcccgatcggttacccatccctaaattgcttcaggccaagcacgcttaaccttagactctcatagttctttgaagattggcttccggaaaaaagttgcaacttgttgatatgagtattctattaattatattaagccttagaccaggatgtcaaaaaaggaaccaagaccttattatacccgagagtgatacttatgctaggaaacatatactcatcctaaagaacgatttttgtatgaagggcattgattattcaatccaagaacttaaacacaaatgtgtctatacatatatggtttctgtttactttcacccatattgggactaaattgagacggtttacaggttacaatcacatatgacttgtgtaaaaacattaaactgacgccaaccgatgtatcttcggacttcttttctgaatccctattatgatcatcagggacttaagtggttagcttgcggagagcagtggtggtcttggagcctgactgccttcccagatgcttggagatgtaatctccagcatccatgagcttgttgaggtcaacattggtctctatccccagtccatggagcatgtacacaacgtcctccgtcgcgacattgccggtggcgccctttgcatatgggcagcctcccagtcctgacactgatgagtccactatgttgatccccagctggtaatacaaaaggaaatgttagaccaacagagcatttctggttgttctgtgtctgtttttcagtaagatggtttgttcattggcattggcaggatgtgaagtgtggttgcttacttggagagagaccagtatgttggcaagggcttggccgtatgtgtcatggaaatggacggcgatcttgtccactggaacaaaagacattacagcttcaagcatagcaagtacgctacctgaaacaaataagataacaaggagcaggaaattcccaatgagaagtggctcatactatcatgtagaaaagttcgaacaattgaaatcacatgattagcaagtaatgtgtcggcatgttttatggattaggactgcaatgctttcaaaaaaacgtatcatcgcttttgaaagtagttttaaatgcgcaaaaatatataaaccaggaaatgacatgctgaaagcagtaaaggcaacaaaatcaatacctggtgtaccaacaccaatcgtgtctccgagtgagatctccgagcaacccatgtcataaagctccttagctacatatgctacctttgatggatgaattgtgccttcaacagggcaaccaaccacacatgaaacatacctatgacaatcaaattttgcaaattctcagatcagattgctgtctgttcattttaactttcaggctcgatagatcatcaagcttatgtgacttacccacggattcgtattccatgtttcttggcagaagttacaacatcatggtaccgaacaaggctttccttgatggtacaattaaggtttgacttagaaaaggattcagaggcagatgcgaaaactgcaacttcttttgcaccagctgcaacagcagcctcaaatccctggataagtggagataaggttgattcatcacaatagatcaaaagtcttcaaaaaacgatacgtatagatagtctattggtgctatggtgctagtatattgtagagtctcccaataatagaacagaaccagacatactctgaggttaggagttaacactggaaaccgcacatctggcacatgcttaatcccttcaaccacatcctttgcatctgctagctgcaactccaaattgagtgataaaggttagctatttgaacttgaactgctaccaattttatcgtgtttttgttctgcaatgaattttgcaatacaagttttacaagctaatgtcccaattttaacattttttgttatgtaataaattttgcggtacaagttttacaaactaatgtcatacaaaaaattgatagtgaaagaagttagatggaattatcagtaacaacttctgatgagaaattaagtgctaccagatatgcatgagtttctcatgcagcatgacatgctaaattcttagaaaaggcggttcgtttcttcacctaatctgagtaaatactgacaaaaaacaaatcaagagctatcgtgacaatctctcaaatgtctgtgatttaaattaatgtatgatactagtacacgccttcacctaatctaagtaattacctgtggcacccattttggggacacaaaacttgtggcttcaactactgatagaccagaagccaccaatttgtgtatcagttcaatctttacagatgtgggtacagtattcttctcattttgcagaccgtcccgtggtccaacttcaactatcttcacaaaccttggaaggtcccataaaacctgaaaaccagttaatcatcaattgagaaaaggagtaacttgtggtaatacattacgatcactatacttcatcagcggccattttcacttatttagttataaaggtaaatagagaagactgacatgttgcattgccacagtcataatgctacatgtgagttcattccttctatttgaggtggtctgatgaaacctataacaaggaaatgaaattgaatacacccaatcacccatgagccatttcagttacacatgatcaaactaccttccgtggaagagctctgaactccatatccaccccattgcaggatgaatcagtatattggccttgcatatgccatgaatgagcactgctgtgaaagatcgtctgattgttgccaccattgcgatgcttgtaactgaaagtaagttcacatggtcatatcatacgagtttcagggcatacttcagtaataaaattctactgtcactaaagtaaactaacaagttcctgaagaaaaatagaagtgttgcaaaggtggaaatgtacatgatttgcttaaacctctggaaatactggaaaaacattccgcgtcaaagtaaaaataccgacaaagcaacaactaggaaaggaagaaatgtagcacggtaaagtttgcaacagtagaacactagaacttacttgttggtgttgctgtcatcaacacttgctctgcaggcacttggagagaacctttcaagtctgttaatactcaactttggcaggtccccaagaccaagtggctcctcgaggcttgacattctgtgaagcaggaggcgttacaattttaacaactatgttgagatgaatcttgatatgttaatatataaaggacacgcccggggtgggggagttgaggaacatagtcagaaatggtgcactagtccgcatggaaaggaacgtttgaaatccaatccaatgggactcgcaaaccatgtccattctcccggcatggtcaatgtgcagtgtgcaatgcttgcttgcacaccggaactcgaacttggccagacttcttctttagatattgaattgcacatgagatactcaccctaattaattatccatcaagcaggtctctttaaccattcaatcatgaaatgccatgcttgatgaactaatatatgatgatgcccagtaactagcagcaaaaatggaacagcgccaactgctctgtattaattcattttttttccttgtaaatactcaaagcaaaccaagatactacaaacccacactgcaacctctccatgaaaccaaatcaagcaggccaatcggcaacatacttgctacgaagaacagggaacagaaaggggaaagaaccaagaagaaacaagaaatcacatacctcaatcgaacgacgaattcgaagcaaacccgatcgaatcgcacccgagattgagggatatggggcaccgaactcaacaagccttacttgaatccgacgcaaaggagagagcagagcgccgaaaatggaggccgcggcttgcgcctccgcgtctccgccaagggaaaggaactggtcggcgaggtcgcgcgtggacccggttcacggtgagatccgtggtgcagcgccctgggccccaggtgtcagtgggagttggctcacgggacccggtccagggagttgagtctggcgggctgtgcggacgcagtggcgttggtggtaggtctcgttcccgttttctagttcggtgagcggccagccgaccacctaaaaaccccggactccttatcggattcggtttttggataattgtgcattacccgttaacacttagcagagcctggcattgcatttgcatggtcatgaacccatggtcttcatatgtagtagtagtagatttgtagcgaagaataatgatgatggtgattatgaaaaatattcatggttgtctatatgttcagatcagaatgaatcaatcagctgatacgatctggatttgtggtcttgtctcatgacagcaacgagacccgattcgcaaatttgtatttaatgatctctgttagtgcagacgtggtcagctgagttccagaagaaaaatcggattggaaggagtggtggccatgattttgttgatgtatttcctcctcgtgttttataagagtaaccatcatccgtcctattcaattcaatttatggttgaaatagcaatcgtcattatagcactagataaattatacatacgtgttttgcaacaaatataaaaaaaggacaaataatatcaacgtatatataaaaaaaaggaaaaaaatcaaattgaggccgaaaactttacacacctcaactattattctaaataacgcccctcaactttaaaaccaggatacccaatacccgtcaactattaaaattgtctggctgatttaccctctcaaggttgttttcactagattaaaggggccttcatgcatgaccagtcagccaaatcaaaattaaaaaaataatatggatcccacattcatgcgttggaggagcaattagttatctacatgatttgaaagagctcaagcaataaatctcattgtgcaaattacaattgctgtggaggaagattttcagcgattcgagcattgtcgccagggagaagataagaggacactaccagggaagaaaattacacaggacttctttgcgtgacagctgtataatacgaatctcaaagcaacatgttttcttccctgatttccccagagacttgacgagtaaacgtgttctcctgctgtcgccgcacgccggtcccaagtggtctcactgcgtcccctgcaatccttggcggtgccccctcactctggcccttccttgtgtccttgtgggctgtggccctccgtgcctctcgtcgcgtggccaacggtgctagctgcagctcagtggcttgcacgtgtcgaccagctgactctttgttagactgactatgcaggtggtggggattatcacttagttctcgccaacacttacgttgtctcagatgaggcggaccaggaggttttttcggagctgtcaattggaaagaagttcgacacctaaaagataatagagtaggcatacctataagacttcaccatggtcttggtgatgtgctaagcaatggtggttgcagggctagagattggctcatggcggagccaagagcatctcactaacactagtatcgacaattacgagtttgcgacgatgccaagattgtgcacaccttatcgacaaaatcatcacttgggtgcttgatagagctctcgacactttaatttcctcatccttgtggcatcatttttgcagtttcgtccatgtccgacgtggaggataaggcaaaaataccaaaatgaccttgtagccacctataaggtggtagcgctcttgttgttgctagtccagtctaacttccatgttgctagaggcccaaagggcacctccgcataaacaaagctagagcacagctctgcatggcatcctccctatggctctagttgcctagagtttggtaggtaatctttcctgcacgcccccctgactttgcattgcatccttcggtgagctccgtcccctgcttttgacgtggcatccacctttgagctctccaccgttgtttgcatactcccactgtcccacatctcatcgtcctcgacgtatccaagaataattacatcatgccaaaaatatctacacaaattagatgagttagcaagcttgtcctctaatttgatatgcataagttgatataaatgaaattggatggatgccaaacttttgagctaatctaattacatagtagtagaagggaaaaaaaaagaaataacaccataaagaaatcatcatacttgtttctggtttcaatacaaacttttttcctctaaacttatacttcctccgtctaaaaatgttgctaactaggatgagattctgaacggttaaattcgaggacctatattttcaattttctgcgcttgagaaaataaaagggaaaatgtcatgtctcctcccgttaaaccctagcttaagcccccttcctcttctccgcgcctccgcctccgcctccgcctccggtctcccctctcctcacacgctccggctccgacggacgattcccacccagtaatggcgatggatttggacgagccgctcgacgcggagaagggcgaggcggcgctgcggcggctgcgcgacgccgacccggccctctacctctccccctccgccgacctcgccgccgccgcccgtgaggcctccaagcacctctacgcctcgctcgtccccttctcccccgcgcagccgcccccgctctccaacctcctcgcaggccccgccttcgacgccgagcagatttggtcccagattgagctgctctcccgccccctcatcccccacctgcgccgccagctccgccgcctcgagaagcaacccccgtctcagccgccgcctcgtacggaatcgaagtccgctgatgccgaagagaagtcagaggaggaggacgaggaggatggtgaaggtgacgaagaattggaggagttggacgatgtagatgatgaagaggagtcagaggaggaggaagaggaagaggaagaagacaaagaaggattggaggataaagcagggaatcaagtggaggacgagttcttcaagataaaggatctcgataagttcatggtaaagggggaggaggcggaatatggtgggggtgccaagcaagggaagaagaagaagaaaacagagaactggatggaagaagatagtgatgaggaggaagaggaggaccttgatgaggatgaggacaatgaggatgaagaagatgacgatgaacacttggacgtaagcatttcgtaatcacatcccttgttaaattcttagagaccagtattagctctcataaagaagattgatatatagaaccactgatctagaagtatctcaggagtagacaccggaatttctgtagtcgcaaaagatagtatctgtattacctcaggaaattgagcatatggattaagttttaaaacagtttcccgcttgagctaataggcttatattgggagctagcattgggtatggtttaatgcaagatgcatgcttgctaaatgtgattcttaagtatcgttttttattaatatagttggaagactttgacgatgaagaagaagaagaagagggtgcagttggagatataatgtaagcctttatgctattttctgaaaatgctcatatcatgattgatagaatcacagaatgcgaaacagttcgggtttccgcacagtgtttttttatctttaagtgattatatactgggatatcaaatggttttaactacatttgaattgcttttttgaagatcggtatgatattcgtagaaatggaaatggtagtcatttataaatttgaattgtagaatcacttgaataattcttcacaaccttttcctattttatcattttcatgctcgacacataatttgatctgtttaagttaactgtcatacaatatgacctgtttagctcagagaagggcatacaaaggcaaatggagtaggaaaacaattggctccaaataatggcatggaatggactcaattaaattagaaaacattaagtatgtaagacaaacatattacattttcatgtaaattgttaaaaaaatgatgatagcacaagaaaatggatttatgaaaaaacaattagattaagcataaggcaaagaagaagtttgttgaacactaaaatataggtataaccacgtgtggcaatgtgggaatagaatgctgtgaaaaaaactgccacattcgcataactcataggataatagcaaaggatacctacaagtttatatgtcatgtacaaaaaggttgagacacaatatcaccctaaaaaacacagctttttagcatataacctaggcaaaactgagctgtaagttctgtctacttcttagccactgcaaatgtccctggaaggataagagatctgattagacaattccaagatctcaccatgcacataaatgcattacatcattctttcctgccttgtatttgtccagtggagcctttacagaagtttccatatgttgtattgactcagcaaagcttaatcgttatgcccagacttcggttgtatttaatatttgttcatttatagtattatgctttgaccagcaaagatgatttttccaggtataaggatttttttgaggaagctgatgaccaaaaagtaaggaagaaaggtggctccaagaaagttcaattcaaggatgaaccagatgaaccagaagttgatgacaaaaatgatgatggaaatgttagtcaagtactacacttactcacttcaatataaacaagttaggcacatgtatattatcagcatattcttccaattctgcaggatgaacagggtttgtcaactcacgagaaggcgcgcctgaagatgcatgctaaaatagaggaaatggagaaagctaatcttgaacctagtatgtggaccatgcagggagaggtaatatataatatgtttatccattcattagtttctagaacaaaacagatttttaactttgaaactgttctggtattaaatcatcagctcatggtaaagaaaccacttgaaattttcttgtaggttaatgcttccagcagacccaaaaacagtgctctagaagtggaccttgattttgagcacaatgtaagacctgccccagtaatcactgaggaagtcactgcttctcttgaagagatgataaagaaaagaataatagaggtatgtgtgttgtttcctttttggacatggcataatgggcagttttgcaacttggttaactttgttacagtgctggagaataaatttattctggacatatatttttgtatttgtggccttgtgctacttatactgagggagctttacttgttgattccatgtagggtcattttgacgatgttgaaaagccttctcccttgcaatttaaatccccaaaggaacaaaaggatctggtatacttttagtcttgtccaagaacataactcattgatgataacaataactaatcatgtaattgttgtcttgccgttatcaatattatttcaacaggacgaaagtaagagcaagaagggtcttgctgaactatatgaggtttgcactatcagaatacagcttttattttttatattcaaagaagttgctacttaagatcagtttaatgatgatttattgagggctggtgtttgtgtttgtacaggacgattatgcgcaaaaggctggccttgcacctgcaccactttctatttcagatgaacttaagaacgaggtgagtttagtcgctttctattataatatgactattggctttcatgggactaaggctgtactgtttctattgttaaggactttttttttcttttgtttaattgctgtgtgattgcatgtcatttgtttttagttaaaagcaagctgcaaaaagaagaaatcctacatgtcaaagaggaaatcttgagttcttctcattgaatacatgtcattctattatgacctccccccaccacacacacacactcacatgtaaaaaaaaaaaaaagaaatcttgtatcaatgcttgtcttgattgctagtgttgctactttattcaatattttcttctgtgtgtggtgatggtggcaaaggtacttgcaatgtctttgagaaagatcttttgaaaggaattgataatgctgtacctcatgagcatgcaattgattaaagtttgttttttttatggtagaagcagacatcgatttcttttgaaaaatagagaagtgattacttgtgatcacattgttgttaacttagtactaactatgtagcaataagcatgcaaatgggtcataccgtcatactcggtgatttttaaaactgtaattttttgaggtaccattatcaacttggtggtctttataaatttgttcccaccatttcattggtgctttatgcatattttttcccctgtaatgatattggaggcttgctgcattgacctaacttttgtttccacttaggcaaataccttatttaagagaatatgcttgaagttggatgcactatctcatttccactttgctccaaagccggtatggaatagtgacaagatattttacttacatttgtaatttctttcagcgaagttaactaacaaggtaaatattcacttttcaggtcattgaagatatgtctatacaagcaaatgtaccagctctagcaatggaggaggtaaataaaatccttcatttctccatgatgtttatacggttgagcatttcatgtcatgatttctctctctttttgcagattgcacctgtagctgtttcagatgctgcaatgcttgctcctgaagaaatttttgaaggaaaaggtgatgttaaagaagaagcagaacttacacaagctgagcgcagaagaagaagagctaacaagaaaaggagatatgcaggtaaatgtccttatgttttttaagatacattccttctagcttttagtataaatattctgacctgacatggataatgctcctacttcctcattcaaaacatttcattgttcattcaaacatggaagtagtttgagcaacacaaattcaattatagctagcaatatttccaattgcaaagttgggtacgagaatagattgaggcctgctagtttttcatacttttgtaccatacaggatcgcataaggagaggccagccaagatgcagaaagattaactcaatactggggaaacgcttacattatgaacaagtagtcagccatttttactgttcagcattacctcctgacccaaggatccattcatgatgagtattgtgcaaatggcaacgcagcattgacagacatggaggcagagagcaggctaggaaaggtagggtgaagggttgggctccaatgcttttgatcacaggatctgtactctggtggcacaacagacagacagctgttccaggtcaaagaccctgacgtaacccatctcccgtcccacaagaaaaggcgagcgaacgtattggaatgtgggatgggtaaaagaaatcttttgtttcttgttacactagtcgtagtagtagtgtagtaatgcaattttacaatatcattttttacactatagagtatcaatggagtgcatgtattcagaggcatatgttctgtttttgatacgttagggcattggtttgcagatgtctgaaatttgcgtgcggtgtattagtatcattttgatcctttgctttttttgccacattgagggattagattgatctaataaaggtgatgcagctatagactatagcatggcaagaaagcaaaataaacatgggttatgggggattgtactatcagctacagtagcaggtagagatgcctgtacgcaggtcaagcttggacccgagaatgaggacgtagagttgggaatcaaaaatcatgttgtagatactctgccatgcgtcgtcatcttcatgcacgttacaacgttatcatcttccagtggagtacagtacacgtacatgtagagggagtagtatacgttttctgttcgttccgggttcgcaagactggagaggtagctgaacgagagtgacgcaatgagctgcaatgcaccacagcagcagcacaaactctgcacatgtgctgctgcgaatgcagagttggccgtagagcaatgttgtgctgtactactactggagactggactggccgtcgccattctagcaaatgtcatttgtaacaacgatacactggagtatgcacagtggtgtaccgtgaaccagcaaggacgtgcgaatgcacagtgtgtaacagcaaatgtgccccaggcagaggtagcaagccagaaagtccaacactacactgcataaagttttggatctttataggattctcccaacacatgatgagtcgcacgcagctactactcctacagtagcagctagggacaatttcttcttcagctcaggctcagctgctgagccggtcgcgcctcccaacgcataggcatgctcccgccggccccgtctttcttgtccgccattacgccaaccagccgcagtaactcagcgtactactctactcctactccttttctttcgtttaatagtatagtcaactactaactttaaatcaccattaacttaatagctacttcataccatacttagagcagtcccaacccttcacttaggatagtgtttatggcattaactacattgcaatgtaggacttttagcttatgtgacactatattaattaaaagagagagtgaagagaggaagaaactgggtctcatataggacacagcttcaacacgagaatatatgcactatacactatcaagttttacattgagagataatagtgtctttataatagatgaagaataaatatgattggtagagaagagagatgatgtatttattaatggcccattttaagaaaccatgggttgtagagtgtagtttctattgtaatgtcttattaacatggcaccatagacacggtttatgtatactatgggttgtgactgcctttatatactacactattaatacttgatcctatttatcatacacacattgcgtcttgaaattcgtgctacagctggctataaatttatagccctctgctcatctctcttctctattatcttcttaaaatatatttatagctggcttatagcctgctattatacctgctcttactcgctgcagcattgctcactactgtactctcttcgttaaaaaaaaaattaaattctggccgtaaacctgaaccagcgtaagccacctatacgtataccaggtttactaaggcctgcttagttccaaaaactttttttaaaaaatatcacctcaaatctttagatatatgtatgaattattaaatatagataaattaaaaaactaattgcacagttggaggagaaatcactagacgaatcttttaaggctaattagtccatgattagccataagtgctacagtaacccacatgtactaatgacggattaattaggctcaaaagattcgtctcgcggtttccaggcgagttataaaattagttttttaattcgtgtccaaaaaccccttccgacatccggtcaaacgtccggtgtgacacccaaaaattttcttttcatgaactaaacaggccctaaaccttgaggtgaggtcattgccacctacggagtatgaggtatgatttaacggttaccacgaaatatatcggttttaaaaactaagaagattatcgcacgtgatgtcgtgataattgtacggttttataaaccttgtatatgactctgtagtacaacttatgtacaattaaagacatgtaattatagattaattaaaaaataacatgttcatatgtctgtatagttgtttataatcgttaatcaaatttagtgataacgtgagtcaaacagttagaccgtatgcataatattttttttttgaccgaggatgtactcccaacccagacgagccaccaccatgctagctgctgctgctgctagcgttgcccagtgaccttgcagctcgccatgctagctccgctgctgcttttgcccaaagctgcaccccctgcattgcccctcccctgaccaccttgcctcatctgtatctccgcccccccccccccctctcctcaacctctcttgtgcttgcttctccattgcagctcacctccatctcctattctcctcctccttgttgaaggagttcgtgtgcctctaccaagaacaataagaagccttgcattggtagccatgatcacggtggtggacctgtaccacgtcctgacggcggtggtgccgttgtacgtggcgatgacgctggcgtacgcctccgtccggtggtggcgcatcttctccccggaccagtgctccggcatcaaccgcttcgtcgcgctcttcgccgtcccgctcctctccttccacttcatctccaccaacaaccccttcgccatgaacctccgcttcctcgccgccgacacgctccagaagctcatcgtcctcgccctcctcgcgctctggtgccgcctctccgcgcgcgggtccctcgactggctcatcaccctcttctccctctccaccctccccaacaccctcgtcatgggcatcccgctgctcaaggggatgtacgccgccgccggcgccgcagccggcgccgactccggcagcctcatggtgcagatcgtcgtgctccagtgcatcatctggtacacgctcatgctgttcctcttcgagtaccgtggcgcgcggcttcttgtcatggagcagttcccggacaccgccgcctccatcgtctccttccgggtggattccgacgtcgtctcgctcgccggcggcggtggtggagccgcggagctgcaggcggaggcggaggtcggggacgatggcaagatgcgagtcaccgtgcgcaagtcgacgagctcgcgctccgaggcggcgtgctcgcacgggacgcagtcacactcgcagtccatgcagccgcgcgtctccaacctctccggcgtcgagatttactcgctgcagtcgtcgcggaacccgacgccgcggggctccagcttcaaccacgccgagttcttcaacatcgtcggcaacggcaagcacggcgacgaggagaagggcgccgccggtggcgggggccactcgccgcagccggtggtggggaagaggaaggacctgcacatgttcgtgtggagctcaagcgcctcgccggtgtcggagcgcgccgccgccgccgccgctgccggcgcggtgcacgtcttcggcggtggtggcgccgaccacggcgacgccaaaggtgacgacaccttttttatcatcttttcgtgcactttgacttccctttttgttttgcccgcgtgtattacactgttgtttgcttctgcacaattaatcactcttgtcttgtgctcttgaccatccgatcagtataatcaacggtccagatcacactggtctgctgattgtttggagaactcaactgcgtatactgatttaataccacattcttgaagtgattctttttcacaaacttaccttcttgaattgttaattcatgtaagcttttctgatcttaacagtgacattgactgttaagtagagttgaattgtacagttaagacaaaatcttaacagtaaactactgatttgacaaaagaaaatgttctttgatggatgcacaggtgctcaggcctatgatgagtacagcttcgggaacaagaatgagaaggacgggccgacactgtcgaagctggggtccaactcgacggcgcagctccggccaaaggacgacggcgaggggagggcggcagcgatgccgccggcgagcgtgatgacgaggctcatactgatcatggtctggaggaagctgatcaggaacccaaacacttactccagcctcctcggtgtcatctggtccctcgtctcctacaggtcaattaagcaaacattttactcacacttttcacattgccatgttcatcatcagtcatctctgtttgttgcatgtgttgttaatcttgtgaacaatgtgatgtaattcaggtggggaattgagatgccggctatcatcgcccggtcgatttcgatcctttcagatgcagggctcggaatggccatgttcagcctaggtttgtttgtgcatctctgatacatgctgcattgctgtaatcttacatggttccatgtctgattgcaatgactgaactatgttctggtttgcaggattgttcatggcattgcagccacggatcattgcctgtgggaactcccttgcttcgtatgccatggccgtcaggttcctcgttggtcctgccgtcatggctgcggcctccatcgccgtcggacttcgcggggtgcttctgcacattgccattgttcaggtaagctgcaagttcaggcttctgcaccaaaatgcatccttaactgcaaaagaatctatcgtaactcaacaattgtcattgaactctcaggccgctcttcctcaaggaatcgtgcccttcgtgtttgccaaggagtacaatgttcatcctaacattctgagcacagcgtatgatctctttaccaccatttttttcagtattggagaaatgtccccattttgaggtttcttttcttttatgccctgaaatctctcgccctgtttcccggttcccttttccattgtatcacaaacgccatgcactgaattttctgaaaaggggcgcatcttgcagcttttgatgattcctaatcatattgttttagactaagaaatccatttttactcatgatttatcatccacaaaggcagagtccataacaataccattaaccatgattctataacactatcattgtatctgacatgaccatgaactcttgttctgcagcgtgatattcgggatgctgatagctctccccatcacattggtctactacatactgctggggctctgaagagctctccaagtctcaactcaactgtgcaagaacttgatgttactgacagtttgattaggatttatggtctgttttagttgctcagattttgtttggatgataggtcagcttagtgatgctaggtggacaattatccgagaacttttgggttcaagtgacggccagccacggtttctgattgaagattaggaacatagacatcacattagtgataacaggcatccaatttgtaagacattgagaaggtctgtttcaaattactgacaatgtagtaagacattgaacagtgcttatttagcattccaataactgatggtaatgcgcttacttaaggagctactctgaaggaatttatttttaatctcttgagagattagctccggattttccttttcaaatgtttctgagtttgagggctccttcggaagacaagattctgaaaacacgggaataatcgtaggaataggatgtcatgctataacaaatattataggaaataaatttataaatttataggattctataaaaagtattgttttgtagtaccataggaaaatcaagaaactttaagttacaaggatgagaaaacatgaggtctagtctcatgttagttttctgtcaaaattcctacaaaatgagcaataggaattttaaaggattttggggaagccatttctatgtttcaaaagatcatatggggaaatttttcaatggattttaggggttgaacgctttatcatcacttgccaacaaaagttattacactttgtttaaggtgaggtgaataaattcttagacataacttactaagggcaacaacaatgtatatagcaaaaatagtccatataaataggacctatatatgtgggttttaactattataacattcacaatgtatataaatagcaaatagtattaggaggagagaaagtagagacaaaaaatatattttatcctatatgagaagcccatatgcttatgaattttttttccttactatggactagttccacaatgttgttaggtgactggataaaatattgtattagttatgaactagttttacactatagttatgaactatattgtattagactgaataaaataagtctaagggaatcttgccacattttttaagttattaacacatgagactgactccctctatttcaggttataaaacgttttgactttggtcaaagtcaaactactgtaagtttaactaattctgtagaaaaaaaagtaatatttacaacaccagcatagtttcattaaatctataattaaataaaatttcataatatatttgtcttggtttaaaaatattactacttttttctaaagaatttatcaaacttatagtagtttgactttgatcaaattgaaaacatattataacctgaaacggagggagtagttagaagggaatcttattaacggtggttacaatcaaacacttaccaaattgattaaatttgtctaaccttaggtttgcagactatggtaaaatgtagcttacaaccaaacattctctaatcctttaaaattttctctatgtttctttttatctacttttcctttgttccaaagaatcggaaagatggaatctttttgccacttttttcaagtttcaaatgaagaaaaacatgcgtagcattttgagcatcttttctagtactactcccaagtataacaaaaagtttgggcccaaaattaaaaggctaatggctggcctgtttgctcgaaacagcaggacagaaaaatgattgtgttgggagtcagacaaaagtgttggctttaggcatgcgcacttgaaggttgaagcagcaaccgacgattatactccactcttctcgtcctgtgacagacttgacacggttggatgtctctgaagcttataaccaacggtaattttatcatttttgccgagacatatttcttattataaaatttggtatattagcatatcatgatataaaaaaatttagtataaaatttatatacttataaggaccgtaaaaattctttagtaccaatgcatggatcttgtgaagaagattttttttactcttcatcacactcttttagatcatctgatatagtacacggttaccatgggttcttttagatcatctggcatagtacacggttaccaagggttattagacatatccacggacctaatttacaaaatcgtggaataaattggtcaagtttaagagaaggtaaactcaaaatatagataaaatttatacaatttgtcaacgaaattgcaacggtttttagagcaagtagtttttattattttttcggtttagatcccaacctatgtattttgaatttgttttatatctcttctatagagctgggtattctttttacattaatatactcccttagtcttgtagtatagcaacctatgattggatgagatattttagacctattcaaatttattataccgtgaaatgttccatctggtcctaacttggataaagggagtaggggtgaaaacgggatggatatttatatttctgtccagtcgcccgctcgtattattttggagcaatttcgggtaaaaaatccgggtactcgggtgtttgtacagatatcgaagccgaattcggatacattttggttgatacgtgatcgggtttgagagggtggtatccgatggatacggattatccgataaataatacagatattacacggtgtctgaattgatacctattcgttccgtatttatgaccgatattatccatgtttgtatctgtattcgatactatctatgtctgacccgattccaattattaaatatgggttaggatatgggaaggatgcgatccgacgaaaacaaccccatttcacccgtaggagggagtagttggtttgattgttttttcgattgtgtagaatttgatttttgtaaaagattgttgtcagggtctcgggtgggccacacatgggctgtcagcccatcaccaagaagtccaagcaagccccaacctgaagtaatacatagcagcaacagcttacaggagaggacatcgatcgatcaattggccaaggcggcaaacggcggcggcggcgacctggaggcgggcttgcctccttgtcgatctctaccttccctcttcctctgcttgtctagaagttactagacctttctagcccttgtattcctccatcttccaccccaaaaccttccaatattgtaacagattcactagctccttgtgttggatttgataccactacttctgaaattgcattgttgaagtgggtcgctaacaattgtaaaaacgaaaaaaccccttgtcgtcttctccattgcggcactgaaactcaggcggcgccaccagccagcgtaccacgacgttgctctgctagggtttgctccaccctcctcccacctcgcgccatcggattccaccttcccaggtctccctcccctcccgtcgccatgccgcacctcgtccgcgagcgcctcttcttcggcgacatcaacgacgccatcgccgcgctcaccaccaccaccgcggaagccggcggcttcacccacctcctctccgtcgtcagctccgccttcatctccttcatcaccgactgccgcccgggcctctccatccccaccgaggaggtccgccgcgtggtcgccggggaggagggcgcgccgccggtctccgccgtggcccccgggcggctgatgcgagtggtggagcgcgctggggtcgggctgcgggtcacgcggatggccgtgccgctgcgggacaccgaggaggagaacctgctcgatcacctcgagccgtgtcttgatttcatcgatgagggcaggaaggaggggaacgtccttgtccattgctttgctggggtctccaggaggtacgattaatatttaccaacactaatattccgagtaatctgtgcttttttgtaatctttagtgtcgtgtgctaatcaaagtgaagttcattagatatttttagttctggaatgttacatatatctgttaggcatacttccgttttagccaaatggacattgtgaattttgttccaagaatttatcaattaatcataagcatatgatggaatgtgaatccctgtatcatgctctgttttgacaagttggatatttttgcctgtcctgatgcattggttataacaaatatattggttaacagcgatgtatctcctgttcactgttgttcatttgtaagaaaattaaatacttgtaaatttatctgtatcttgttgcagtgctaccatcatcgttgcttatcttatgagaacagaacaaaaatctctggaaggttcgattatttcaacaaaatgggtgatttttcagtcgttgctttggttattactccagatgaatacctgagctgtctttttgatacactctggtgacatgccatgcttactgtcttgtttcagaagcactagagtctcttaaggaagtcaatgagtcagcctgcccaaatgacggttttcttgagcaggtaaccctttgtgatctgtttgcaccctattgctcttagctttcttttatttatttgttgaatgtgttgtaaattgcagttgaaactgtttgaagaaatgggcttcaaagttgatacttcaagtcctctatacaagcgtttccgtttaaaattgctaggttagtcataattcatcttggattctttgttactgttggacaggttgtgtggttattatgtcagggaaactgtgaagattctggccactggttagcatttatttaaaaaatggagatgtaaattctttgttttagtaaatttcaacattgcatgtctgtgaatcatgatatatttgatgttttcctgctttttttttaattatccatgactaagagtgctattcatgcagtcctgttgaaaataaagcagtcatacacttctcaatattgcttacttttgtttcttacttatgaaaaatctttgacaaatggacagatttgggtactttactgtttcacctttgtcctttctcttatgcatagtctcttactttgccacttttcactaaacttgtcaattttttttacttctcacaggccaatcctacaaaattggagagaaaataggaagctatgtatttgaagatgatcctggtctttctggacagcctaattcttctactcagaatttaccaaacaagcaaacccaacaaccagcataccgctgcaaaaaatgcaggagaattattgctgtgcagggcaatgttgtgagccacactcctggtgagggtgaatcttgctttcagtggcaaaacaagagaaaaggagagcgatcatatagcaaagaacaagattgctcatcgttgtttgttgagcctctgaagtggatgactccaggtaattcaccctcgtaattcagccctttgcagttacctacggtcacaaatgacttctcagattgatctcctattgatgtggctcatagcaaatctgtgtttactgctgagtgttcgtccaatctgttatgtaattctatttgttttatcatttctaattggtgcttttgttattgatggaacagtggaagatggtgctttggaggggaagctatcgtgtatccactgcggagcacggctaggatatttcaactggtcaggaatccagtgcaactgtggcagttggatcaccccagccttccaaatttccaagagcaaagttgatattagtaccacttagatagttgtcagaggctagtagattatttcaggaccatgtgagctggtgtaaataccgttttatcagaaggatttacgaactcgaaggatctcgaccgaagattttcagatccattgtgcactagatagataccatgaagaaatatagtctcagaaaccaccacttgtattgctacttgctgttagactatgccatcaattgtaattgttggttctgatgatctgaaatgctatcagcacgaatttcattttttttcttctcttttttcgagtacgcaatgcatcgtagtacgtatataaatccgtaatgcagttttgttgtacatgagtgcatccattgaaaacaatactgtgtttctcatgttccgttttatgccgctgaggtggcgggttcggagtttttgcttccggcccagccaataatgctctaagatgggcttgctcaccaagggtgtgggctcgacgtctaattgtgggccttgtattcggcctcagccacgtacgtgggctttatattgggccgcatgttccttgaggcccatgtacaccatcaagtcaggaggagaaatccccttccacgccgcacactctgtcacacgccggcgcgccggccagcggcggaactcgcgacacccgccggcgaaggagcagcagcacaggaggtggacggcgcgccagcgaggtcgcccatccagcctctgcgtttagttgtttgaccaatcgggaaagaaggcgaggaagggaggagaggagcggagaggaaaggaggaggggaggatgccgcaccacgcgcggccgatgacggggctgctgctgttcacgggagtcaacctggtgctcctcaacaccatcacccccgtctatgacttcgtctgcttccacccctactgggaacgcagggtacgccgcctccctctttcttcttcacccaccttatccccccattccgatctcccaaggctacgctttgatcctgtcgccctactacaccctggccaagccttttccccacagttcgatccgtgcatctgttgattgtttcttgtctcgagcatgcgcgccagctgtttgtggaaatgcctcgcgtctgtgctgcaactttcttcaattttatgatttcgggaacgaactatccctaacacttcctttcgacagacaatttggtgaagaaattccatattcgctagccagaaatttttacaattgaagagtgctcttataggagcatctttgtgctattatgatgtttttcctttctatactatgatcttgatatattgcatacaatttgaagttttgttgatgtgtaatcttgtgaccaatttagagagaacgtcgtcaaaaggagcgtaaagcactacaagccaatggttctctacaaactgctaaatgattttattcctaggtatgtgcgtgacactccttgagaaaaatctgtttgatggaagtgttcatttttataaccacttcaggagtagcttcacaatttggtggatgtgaaaggaaggtgagaatccccaatttatctggtaaaaaacttgagatatatttttgttcatcctagtgatagtgaacttgcttttggtatgctttatttatgcatgcatttgtttaactttgaattgacatggtatattttaaattttcagttgttttactacttggttagttggatgaaaccctggattcttcattgatatggagtgaagaaaattttataggcaggtaatattgtgatgctcttcagatatgagtagatctccgcactccaggtcttgctttcataatgctactcaactgcatcatcacatccttgtaaaattaccgaggaaactagatctgatgaatattgtttcttgaaactacctttatgtatctcttatcttctcatactcatctggctataacatagtaaatgaaaaccactgtttggctcaagccatttattctgatcaggatcctattaacttagttatttcctggggtggaaggaacatatgtttaacaactgatcctgcagagtgcttcattacgtgtttgaaagttctgaaaacctccaaccattttactgttcttccctcaacggtttatctgtcaacaagcagtagaggaatgctttctctgttcttgttgaatgtaccagtaatcttttgggctttctaatcaggtaggattcaatcatgtagtgtacaagatgactgaacagaaagaaggaacaaatccatcttcccaacaactagccaggacaatgtgcaagaccaaacatgaacctgagcccaacctgaaatgtaaatatgcaattggaaagaaaattccattgtatacattacactcgtggtaaatgcacatcatgtttgaaattgtgcacaaaccagccactatacacactaccctgtttcgctatagaactagatctcgcctcttcttctttgggtttgttgcttctgcacagcctgatcctttcctcatcatggccacaaactctgaataatctatcctcccatcctacatgtgcaaaatgcattcagcgtctcttgataggacaaatattttcagctttatcgatttcatctgttttgcatgaacacaatttaaagagcatttcttccttacattattagagtctgcatctgtgatgacatccttgatctcgttggcgtcgtataacccttgttccttcaaggcttgctcgagctcttcctttgtgatgtacctgcaagagggatggaataaatgtgtacaaatccctgaagttcagaattcagttatatcagtttttgctatccttaacttacccactattatccttgtcaaagtactggaatgccgtgtaaaggtgctcttctcgatccattttgttcatgtgcaccgtcgcggtgacgaactcctcatagtcgataattccattgccatcagcatcagcctgaaagttgaaaggaatttccaggagtcctgtcagttttagcatttcatctcgaactgaactgaagtttgtagcttcactatgaggactcactgcttccataagttgctcaatttcgttgtctgaaaacttggtgccctgctttgctaacccatttttgagctcctcaagcgtaatggtcccactattgtccttgtcgatgttcttgaacatctccttcagccccttgatctcctcctctgacaggcatccggctataatctacagaagattcaaaacaacaattaagatgcatatatctaccctgatgatgtgattaagagtaatatttaccctcagtgcagctttcttgaactggttcatggccctgaactgcttgagcctgttgagaacaacattgtcaagtggtacatcaggagcatccccatcttctttgatccacgggtgatctgcaaatccaaattgatccaaatgaatccaaatttaattctgacaccaattaagggaaaattaatccaaactgtacctctatatgaaaaaaaggagcagatttgagtaattaatctgtaacaaataaacttactgagcacttggaatgctgtaagcctctccttggggttgatgttgagcatcttcctgacgaggtccttggctccagaggagatcttcggccatggctcactggcgaggtcgatctgtccgcgaaggatggcggcgaagatggcgttctccgactcggcccagaagggcggcacgccggcgaggaagatgtagagcatgacgccgatgctccagatgtcggcctcggggccgtacttcctcttgagcacctccggcgcgatgtagtaggcgctgccgacgatgtcgcggaacacctcgccttccttgaagaagacggagaggccgaagtcggtggccttgagcggcgcgtcgtcccctttgctcagcagcaggaagttctccggcttgaggtcccggtggatcacccccatggagtggcaggtgtgcacgatcccgacgatggcgcggaggagcgccgccgcggcgcgctccgtgtagtggccacgcgcgatgatgcggtcgaagagctcgccgccggcgcagagctccatcacgaggtggacgttgtgcttgtcctcgtaggcgccgcggaggtcgacgatgttgggctggccagagaggtggtgcatgatctgcacctcgcggcggacgtcgtcgacgtcctccttgttcgccagcttccgcttcgcgatcgtcttgcacgccagcttctcgccggtggccttgtgggtgcacaggtgggtcacgccgaactgcccgcgcccgagctccttgccgatggagtacgtcgtgcgaacctcctccatcggccgctccagcacctcgccgatggggcctgccggcttcttggacgacgacgccgccgccgccgcttccgtcgccgccgccttggccgccggcgagcacggctgctgcttggcggacccatttttggaggaggtgccgcggctcggcggcgccgccttggaggtccctggctctgcctcgtcgccggcgacggccttcccgccacccgtgcagcactggcccatggcgtcgggggatgcgcgcgtgcctgctccggcgacggagaggcacggatcggagagagaatttttggtagaaggaagaaatggatgtgtgagtttgatgggttgagaggaaatggcgggaagaagtgagcggtagttgtttcggtttggattttcagcgtctcgtaggtttggtcgctggctattcttggctgctaataattgtttctggttagattttcctgtgaccaatcatcaatcgattagctgctaatagttttttctgattagatttttccagtgaccaatcaacaatctgcctttacaattgcctaaaaaaatgcgcctttgcaaacactaccaaactagtcaaagcttacaatatcaagcgtctcctctgttatgaaagaaaaaacaggccctaacatcttaagctctcatttctgcagaagcaccgagagcaaatacaaggatacttttcctaattttggtgtgctatgtatgtattttaactttcaggatacactcacaatttgttgattttagtcctgcattagtatgtcaccgcaaaattcaagaagaccatttaatcatgtaactgtataaggtgttccactgtcaatagagtgaaagcttcttctggaatttctattgccgtatgcaattctccctcctgaataaccacatcagataatgttctcctgaagctgtcaatagcatcctctggatgccctttcgcaatggatgcctgcagtggtgttgataaccgtaagcaaataacctatcacaagaccaaaactagaagtacaagagccaaagtttaggcactgtagatgatgcgaaaaattcagacataccaaatgcatttcatcaatcttgaaaagccaaaacatccatttcctagcctcttctccatcaatacagagagaaatattagtccaattcatatggtggaattccaaacgttgcagcccgaatccaacgccagcacctgtagctttgacaaatgcttctttaagacaccaatacctacagaaacagacaattgttaactccacaaattttggcttgtaaacatgatcagcaccctgcacttgttctgaaaagaaaaaaatgaacaagaacaaatgcatacctgtagaactcagttagcataccatcatgactgtctgcagtaacaatgcagttccactcatgatctgtgagataggaagtgaaattgttgatgaactccagggcagtttctcgttggggcttggagatgcacacaatgtccaggccaacgaggcagagaggctcagatgctatgccaacgtactccccctgatgcgacgtgttgaagttgaagccaggaaggttgacatttttattctgctgcaacaacaagacgtgatcgattccaatttgggcttcagaaactgacagaatgtaaacgtgaaactgaagatatggatttgggatgaattaattgatgagaatatctactagactactactactaccagatagggcttcccttcaagcgtgcggttgatgcgaatttggtggaatggcattccaagggcatggtgcacgagcgagtacttgagcaggcggctgacgagcgctcgtttcctgtcttcttctctgacgaacctgcaccggtgaggtcgtgaggacgaggagaaaaatctagaggctgaattcaattgcagtagtgagtgggtggaatcaatggggagaaagaggagttggttggaaaaacctgtggatggcggggcggtcgtgcggcgggaggacggcggcggcggcttggaactcggcgggggaggggcgccaccggccgacgtcgacgagccacctacaccgccaccgccccccgctgctctgcttctctccttcctccatcatcaacaactcgatcaacggacaacggtcaactcaagagttaaggcagagaaagccgtagaccatggcctggccggccggcaaggaaaggaaaggaaaggaagagggacgacgacaacagagaggggaggttaggatgggcctttctcacgaggcctgtaaacttttgaagctaaactaggcccaaattgcatatgtgcatcttgccatggtgccatggcagagacatcagcaaattaaacagcaacagagacataaccatagccatcagtccatcaccatctgccaatctctcacattcaataacagtcgccattgatacgctgagtgttgtgcactacattgattttttcgtcagactcggaggagatggagattaattgagctcgagtgtgagactaacagcaatgctacgcaggctaaagatcgcaatagtaattaatggcgaatcgagccaacgtcagttcgctatcgaccgacataataaatcaggttggttgtgaaccgagacatctcatcatctcaccctggagtcaggagctcaggaacagcaaagcaagaggaggaagaagcggagatggctgcaggcgacgctgcgacgccattgctggagatggcgtaccaataccatgagggctgccccgcctgcgccgtggagcgcagcaaggcgctcaaccccggcatcccctacatgcgcttcttccacatctggatcatcatcctcgtctcatgtacgtacgcgcctcctatatatcgatcactgcttcatttatacgtgttcatgcatgcttcgcttcctgctctgcttgactgcctctccagtctccttattatctattattaacttatgaagtctcatgttcgctctcatggcctaaaaattctcacattaatcggagaaaaaaaacagtctatataggaatctacctatattattttactacttaaagttcaaaatatttccatcgtcataaaaaagaaaaaaaataagtcggactcaacatgcgagaaaaaagattctctcgtcagtaaaaataggaaaaaaatatttcgtagtaaaaacaacgtccgactcattataacagaaaaaaagaatctcccccataaaatacatccgattccttaaaaaaaagaaaaaaatatcgccagtaaagaaaacgaaaaaaaaagtccaactcccatagaaaggaaaaaataacttctgacatcctactcccataaataaaggaaaaaaacatgtcctactcaaaatcgagaaaaaacacatattataaaaaatcccgtttataaaagaaatcgattcgaaaaaaccacccgactagataaaaaaccgaaaaaacacagattataaaaaatcccgtttataaaagaaaccgattcgaaaaaaccacccgactagataaaaaaccgctccgaaataaaccatcagaaaaaacattgctgaaaaaggatcgaaaaaaccatccgaattcacacgagaaagaaccgccatatataaaaaatactaccccgaaaaaactgtctgacccaacacgagaaaaatcccgcgtttataaaataattccgattcagtactgtgcaatgcgaaaaaaaactgtctaatttcataaaaaaaatccgatttcatgaaataagatccgtattgtttgtattgtccatcgtctaccatgtcgttttggtttttccatagcgtcgtcgaatgttcagacgtgtggatctaaaacaagtcttgcttaggcttgtttttctcggaacaagatcaaattgatcgaggctttgggtcagataggattctcgatttttccatcatctaaaaacttggtttgtgttccacgattatattctcctctattggagactctacatgtctctgtatgcaattattatactactggtaagtatagctaatattcttgatagcttatcatataaaaataataataataaataaacatatttttaattgttattaagagaagagtgcactgaggctctatttatttagacttgacaatacaagacaatgcaggatttgattgatcctattattattgcaagaatgagattgaaagattattttagattatatgtgtacaaccacataaataatccaatttgtttgggtaaaacatgcattgttaaggttgtcatagtcaagattgggtcattatattacagatgtttcaattttccttataatatgtcttagcaacaacgatcgatacgattattatcatgggaaaattgaaaccatgccattataattttgcaaaatttgagatatgacatcctgacccacatgtcattgactcatgtgggtcctacatgtcattgagataccgatggcatatcttaaactttgcaaaattataatggcatggttccaatttaccctatcatcattgacataattatagaatatagctgaaattcggaatttaaaataaggaacacaggaagaaaagactagagtccatactggcataccatagaactaatggaaatccggaactagaaaaataagaaaactaaaagtagaggttagagtccatatagaaatacaatttagctggaatttggaattagaaaaataacaaaactgaaagtagaggttagagtccatatagaaatacaatttagctgaaattcgaaattaaagataaggaatataggaagataagactatagtccataccggtatacaatataactaatggaaatttgggattagaaaaataagaaaatttaaagtagaggttagagtccatatagaaatacaatttagaaataacgaaaattcaaaattttaaaaaataaggaatatggaatgaagtatatagagtccatataaaaatacaattttaaaataattaaattcgcaattagaaaaaataaatactaaaagataagtttagagtccaaatacaatttagacataatagaaactaggaattaaaattaagaatattggaagaagagtatagagtcatataggaatttataattaactaaaatttgaaataaaaataataaaactaaaagtagagtttagagcacatgtagaaacacattttacaaataaataaataaattataatgaaaaaaagaatattggaacaatagtccataaagaaataatattgaaacatgagtccataaagaaataaaattagaaataataaaaatttagaattaaaataataagcaatagtagaaaaagagtctagagtccatataaaaatacaatttataaagaaaagaaattcggaattaaaaataagaaatattggaagatgagtataggaatataatttagaaataactaaaattttgaattttgaattagaaatataggaataaaattataaataatagaaattcatgattaacaaaatgaagaatgttggaagaggattctagagtccatatagaaatacaatttagaaataactaaaattcgctattaaaaataattaataattgtcatttatatacaatacattacgaatattacacattggttagtttgatcaagttagtacaaaatttaaaattatgttgtccttttaatatatttgataataaaatatgaaatatgctattatatgagagaaaatataagaatgctagctgcgcaatttacgcgggccaccatgctagttcatgttatgttcgaaaaagctaatggacgagcgctcgcgttcacctgcccccacgcgatcaatttactctgaccaatcccatgccacacgaagtatagatggccaatggattgcccggctccgcatggcccaagcacggctgtgcctgggctgaggtcagtcaggcaagcacggcccaacctacatgtcaggctgtgtcgtgccagctcacgggctgcacacacattccaggcacggccctatatgactcgggtcatgccgtttcggctgtaaggcacgataacccatcgtgcttcttcatagaataagtctatttttcatcctcaactctttgggctgtcttatatgactataaataagtctattttgtattcctcctctcttttggcattgccttatatggttgattaagtctattttggatccctataatattttcttcgatcgtgccgtgccgggccagcccaccgtgccaaggcattggcctaagcacagcccaactgtcgggccatgccgtgcttaggcccggccaaatggtcgtgtcttcggccgggtcgttgggccccgggccatatggccatctataacatgaagcgtcatattctttttggctctaatacgaatatagccacttcttccattttcggctagtcctttttcttttcggctttactctttcccatttaattttatttgaccaagttgaattttaggtgagaccaaccagttaggcctcacaacccgcatgcatgatttttctttttttattctatgaattcattttaatttgtatatatgatacaaactttatacgtatgaagtttctatacataaagtttatatgtataaaatttattgcatattttttttgggacagattaacatgtcgttgaattcatttgaaatttatgtttataaaaatttacatgcacaaatttctatataaaaaatttctctttctatatatgtatatatattttagatatgtaaagtctatatataaatatattttctttactgggccatgttgcttttgttgggctgaattctagaaaagagagaaaaagatgcacgtggaagcctacgagcgtggaaacatgaccgagaaatctgagtcgtcgcgctcgcgccttagcaattccttcttaggtgtgtaaacgtaatcgtgcacaccgtggacccatggttgctaagtattagacggaccctattatgtttgcatatccattttttttccatttccaccagcattgcaagatgtgaatgctttatcagtcatttctagttcacctgaatttatcttatagaggattattttgtactacctccattttttctttttatatagatgactcatttgacttttggcataatgtttaatcattcgtcttatttaagaatttagtataaatatgaaaaaaatatgagtcatataaattttattaataagagaaatggtcaaatgtcacgttaaaagttaaaaaaataaagagagtattagtgtctaaaattaaggggctaaaaggaaagttcaagcttgtaatcgttggtcgaactattgaagcaaaattctaaattgttgtttcttgcatctcttttgcatctttatttatcttgtcattggcttagcttgttccattgatgcgggcctgtgagcttttcatggtagatttttaacctttcatccttacaatattttttttactgaattccatccttataattgaatttcaggtttgccaatatcatcgttatttcccttcttatacttcatggtatgtatttatgattgtaaaatttacaatagcaccaaaagtatactctacattgtataagttttagtgtaaattagctgtttctatttctcattagcggaatttgtaccttgcataattttatcatttggttccgtgaaatgttgttcatcattcatgtagcaattcaaatttctctagtttccatttatattaactagttttttagtcttggaaacggaaataacagtaaagttaccacctaattcctaattcttcaagctatgtatagtcatatatatgttgctatgtatactcatactcatatgttttggctaatcattgtttgaataaaaggtaagctcatagtttaattctcttcttcacaatatgtaagagattatagcatttatttttattgtatatttctcttgtccactacagataagagacttgcatgttgcaaaaagagtagaggacattggattctatgcaggttttgtaggtaagcaattataatgtctgtaataccaaaggtcatgcttttacttagtagtgacaaatgttttttacacctatttatctatcgcaaacatggcatattataattctcaacctattaggtgcgtcatatatgtttggtagagctttaacttccactgcttgggggatggtagcagatcgtattgggaggaagcctgttatcatttttggaattttttcagcctaagtactttttagttcagttccgattgaaccaagtaagtaatgatttgtattaccttctttatatccacctatgattactttaccttgtgttgtgaaatcagatttgtattcaatactctctttggactaagtacacactattggatggcgataactacacgatttcttttaggttcattgaatggcttacttggaccaataagagtacggtgattaaattatctaaattcatattttctatccactattgaaatactataactagctagcatactgcaaccgggctttacaggcttatgccgttgaagtttgttgaccagagcatcaatccattgggttgtcattggtatactacaaagttctataatattttttactatagttatattgcactttagattatgacactctttttatatgattaggttagcacatcatgggcaataggtctcattgttgggccagctatcagtggatatcttgcacaggtatcctactaaattttaataccatatgagttgggtgcatgcttaaacaatgcattgacgctattatgatgcttttgtttcatttgacagccatcagaaaaatatccaattctatttttagcaaactcattatttggaaggtatcgttgttataggaaatataattgttctagatggtataactccttaaatgactgattcttgaaaatctttccttaggttcccatattttctaccttgtttatgtatatcgatcttctgcttcgttattcttataagttgcatttggctcccggtaagtgcacaactagccaattttattcttattgatattaatttgggcacacataattcttgtttttatgcttcccttagctaaaatttatcttacctactaaaatacaaaagttaattaatattttgctaatactttcaggaaaataatgtgttttcatttcaaaataatgtgtttcataaaatttcaggaaacactacataaatattcaatagaaagaactgagattgtaaaattggatctttgagtacacatttggttgacttcgaagagtttgtcaagcaacacactggtccagctaaagataagagcttatttaagaattggccattaatgtcatctattgttctcttctgcattgtctccttcgatgacatggcttacacagaggtatgtaccaagtatgtctaaactaatggtgtagtatttcttagctaaatgagtctagatgtttgaacccaataatgggacaattgaaccatgccacacaaattttgcgaataattgaggaaaagttgccctgttttgggaaatatcgattaaacacttcacccaattacaaaactagggtatagtgttatcactataaataatgcttctatgtttatgta

SEQ ID NO: 60171 - DNA, 3152 bp, Oryza sativa
ttttatcttactaaaaaattatatagctatttttattatgatttgttttattggtaatttaattttgtcttatattcatatatatttacactaattattttaacaacacaaatcatcaaacgtatattaaaaattaaccatgtcatacattcaaaaggggaataatatgggtcaacattcaacaaaacacgatcgatcagactgcaacgtaaggcataactaaaaataacttgattagatacgacgtgttgcaacttgcagcgtgtggatgttgatctaattaaacccttgtcgtgtactttggcatgcatgtgttctaattagctgatcgatggggacttgcatatacatctgtcgacccaagggagcaatgtctttaaaaagtgtcaaattagtgcaaattaaaccaaattttcacatgcatggttcagaagtttccaatattatgaaaacgtcacgcacgcgtgtgtatcgtgtaacctggtcatgtcacttcacacatcatctagaagatatattttcacactaaacatatttttccttttatctttaacgcttgatcagtacaaaccaacagttatataaacttaatttgtgctagttatatttgtaaaaattacccaagttggacatattaaaactacaccactctagatttgacgattttgtttatgtttatgatattgcgaaattttgtgaggataatataataaattctataaaagatagtgatgtaaagtcataaaaatgctagatatatatagaattacagaagggatctgggacctatatattattttgtccttttcagatcagtaacacttaatagttaagtcatcgagtgctcaccaaaattccaagtaggaaattcttccgaagaaccgatgttctttttacgattacatgttgttatgtagtgttgatcaattaaattgacatccatgtcgtctctgctaaagtaatatgtgttttctttacatctaccgtaggttaagtatttactaggagaaaacagcagaagagtcaaacagctagcaatttaattccacacctagtcatcaacatgttcttttcttaattttactgaaatggacaaaaaagagtgtgtcatgcacacgcagtcatacatcttagtacatttgcaaaaccagaggcaagtatatgaactaaacgttaatagcaatggctatatataattaatgtttactcagatttgcttgttaacaccccagatcattagtctctgaaaaaaaatgtcatccaacaggcggcccaactgactgcaattctggaatattttgagcacattttcttgcctcaggtaattaaatctaataaatgatcacttgttgactaggatatgtcacaatcaggtatggaattgttgttaattttgtgtccttttctgtagcgttgcttatgaatgttaagatgacttaaagtgacatgaaagcttaaaaaaagtcagtgcaattaaattttagtaccatattattctatctccttgctttttcaaagaaaaattatttgtgcagtatatatggcaccttcaattaatacaaggactttgatgtatctggtctacaaataattaattaatgttcagtcatatatacctattaatacaagaccacaaaattaaattaatgtgatcatcgatcatattcagtgcattattgcacatatttactacattaactacacgtacatatactgccaaatccacatctagctaaatattaattgtgtacacctaaaaatatgtacatgtaacgtaaaaatacgtggtatatataccagtattctacggcaatcaacacgtatacatattactttttttttctctggtcaacagtagaaatagaaactgaagatcacctatacgtcaaagaatcccattgtgatttaatgctttaattttggcaacaatctcctggatataaatgtacacgcataattagatagatcatctatctatatatataggtgtgcaagttcaagtgcaagagcacaacacccttattaatccctaattaccaaacactctcatcgatcgatctcgcggattaattaaagtggtattagcgagcttaaacgcgccgctaatggcggcgatttacctgctgatcgccgcgctgatcgcctcctcccatgcactcgccgcgcatggcgccggcggcggcgttccgttggcggcggcggcgcctctcccgttccccggcgacctcgccgcgtccggcaagctccggaccgacccgaacgccaccgtgccggcgtcgatggacttcggcaacatcacggcggcgctgccggcggccgtgctgttcccgggctcccccggcgacgtggcggagctcctgcgcgccgcctacgccgccccggggcggccgttcaccgtctcgttccgcggccgcggccactccaccatgggccaggccctcgccgccggcggcgtcgtcgtccacatgcagtccatgggcggcggcggcgcgccgcggatcaacgtgtcggcggacggcgcgtacgtggacgccggcggcgagcagctgtgggtcgacgtgctccgcgccgcgctggcgcgcggcgtggcgccgcggtcgtggacggactacctccacctcaccgtcggcggcaccctctccaacgccggcgtcagcgggcagacttaccggcacgggccacagatctccaacgtgctcgagctcgacgtcatcaccggtaatcacagcaagcaaccgcctgcctctagctagctaattacgtacacctcactgcaactccttttgctagctaattaatcctcacacatacaaacctcgtgatcaagaactaaccgtgcaatcaacatttataaaatttaaatatactatactacatcagagtgaaatgtgatattcctatagaattattctacgtgttttctattcggtatttaaggtaggatgctgtgatcaaaagggatacatgcatttgtctcataacctcgagttttatgtttatctaatttattacctacacatctattaatagaggtaggagatgtaaattattttcattatttttaaaaaatctgttcaaaaataatgtgtccacatgcataattagaattttttttacatattgttaactaactaattttaatcttgttaccc

SEQ ID NO: 60172 - DNA, 1420 bp, Oryza sativa
gactgggtgaggcattttggcgccaaatgggatcgcttcgtgcagaggaaggacaagtacgaccccaagaagctgctctcccctggacaggacatcttcaactgattgattaattaattaattaattgttgcctaattaattaattaattaattaattagttacagcggttaactttagtcaaaaaatgaaataaacataatgttgtcgagaacttactgttgataagtagttactgtgacttgaaaacaaaagtgtgtagctcctcctcgcatcttgtatgatggaaggatgagatgggggttacaagcaataaaaaagaagatgatgaaactagtaatacaacttaacgcatgttcctttgtttgtaaaaatgtacaactgccacttatagtagacgtatcgctgtaacatgttaatgtactttttcccgcacttcgggtctccttttccctaattcatagtacaaagactaaattgattggtgattaaaaaaatattacattttagaaacaacacacttgatagtggtaaatttgtgggtgcattattgcggtagaatactttttaaaatataatgagaaatccatcctttactttaaagagctaataaattattacaaagtatgtagttttaaagtattcactctgttttttaatgtgtgacgtcgttgattttttaaatacattatatttgactattcgtcttattcaaaaaatgtaattattatttattttattgtgacttaatttattatcaaatatttttatatttgcaaaaaaaataaataagatgaatggtcaattaaaaatcaacggtgttatatattaaaaaatagatatgagaaaataaaaccagacaccaatagatagagacacattgtttcgccacatatcctattgttaaactttaatcatagtcgataaaaatttgcatgaccgttgttttcaaactcatgacatgcatgttgcatcctatctttgtgttcaaacctttgcacggggcttattgtcaaatccaataagtggccacgtatttagtgaggatcacatatttaatgagagcagcgcatatgtttcttataagcaggactgtgcatgttagaaaaaacaattctacatttttatgtttgaaactttcaccttccaaacaaagacctttgtttcacacgggttgaaaaatgcatctctatctatgtgagcatggacgagattcttgtagatgttactgggaatctcattaaactacatggctgttacgtaactaaatcggcaatgatcatttgcaagtcggctgctaaccataatagttgaccccaaggggaagcataagtggtgtggcggcgctggagtcgtggatatatgactccatacaccagggtttaaatcttaatgtccgcaaatattacgcacatgcaagt

SEQ ID NO: 60173 - DNA, 1292 bp, Oryza sativa
agggagtcaaattgcactggttttaatagttaggagagttgtcttatctggttttccggttgatggatacgaattagattcaggctatttttaagagagtcaaagcggacttttccgccccaaattgcatctgtttttaggtgggctagctactcgtctgaatcatggatgctaaagattagcagagggatcaagcacactaatcacgttcatttgtgtcggaagacacgacaaatcaatttttgttgattgttattatccatcgccacgtgcagagtgacgtaacgtgaatgcacaggagactggtgtttggcgtagcagcatgtgattagttagttagccgtcgggattgtctacactactgctgatataatagcaaacacgaatatgtaaattcgaattcatatgtcaaccactgttgtcgcgtcagcaatattgcataggatttgcatccaaagttggtgatgaacaagcctcaggtacaccctggatcctagagtatttggtactacaagcagatgcagttttcgtttcttacttttgcaaagtcggaaaaaggaggagagtacttttggggttacaagtcaacatgagtcaacactactagagactgcgcacatgacaaaggtgacagataagagagaacaaagaacaaagaaagttcccctgcccatccatagttgatcagattcggacgtgacactaaaattcacaagaagaaaagaaatctataaagttcttaataagtactgctagtattctctctattttataatatacatatattataaatcgtttgtctttttcctattaaaaatttgttaagtttaataatacctttttaaaatatattttgataatatgtttgttttgtattgaaaatactatttatttttcgataacttgatcaaacttaaaaaatatttgattagcaaaaagaaataaaataatttataatataaaacagagggattaataaagaaaaagaaaaacacaaatatcaatgaaataaccaaaaagaaaatccagaaaggggaggaatttttattggcccaaacaccctgaccgtcggaggccaccaagaaagaaagagagagatccctttttgctttgcgcttttgcaaacccttttccaattcttcttctttgcgcctctccaaccttcctccgtatatatcaatcatcgcccaactccagctcccaactcccttccctctcctctcctctcctctcctcatccggagacgccacgccgacacgcagctgcgtgtgcgaggaggaagaaacccaga

SEQ ID NO: 60174 - DNA, 674 bp, Oryza sativa
aactgtgaatatgacgtagtactatttgcaatcaaaattattattattatttgtggggaaaaatattatttttgtttttacatgtgcatgacaaatggactacattgatgcaaagcataggaccagtacattgattagtacaatgtggccgcagctgtgactggcagtgccatccaaccagaaaaacgttgtgcctacttcttcctacgatcccaacttaagtcaatatttctgaaccagctgtcataaaaacacagaagaaactcgtgccattcatgtcaagcaaaatatttcctcatcgtcatcatgagcgattcggtctgatctgaaatctcgcgtattaatccagatgataatcgagttcgttatataatagtatgtcagacagtcccagcatgagagatcgtcaacggtacacgattagatcttcgattatcttcgtagatctggagaagttaaaattggccgtgtcaaacaagctagaaggcttcttctgatggttcatcgatcggtgtcactaatgatccttgtacctaatgagatcttgagttttgtgtttaatcctcggatcatatattgatgatcatgaccttcgatatgatatcgatcggtctggctttgcatgcatcagttcattaacatcatatctgcttgattaatctctaacacttaga

SEQ ID NO: 60175 - DNA, 4612 bp, Oryza sativa
ccgccgtcccgctcagctgccggccaccgctctccccctctatcgcctcgcctgctcgagagaacccgaagagagaagataaaagaaaataaacagagagaaatgtgggacccacaccattttctcacttacacgtggacctcacataataattttaattacttttgccaactaggatgctacgtcagcgaaacccggcctatatactgtcttgggaccttttatgcacggttttacatagttcagaaatacacatttctgattttgtggttaacggaccttaaaaaaatctcggtgtaaagttgagggacagccgctgaacttattcctcctatttatagcccacaaagcattggcccagacagccaccaaatagtgaggcccagaagagagcggcccattcgacacggtcaggcccacgttgaagcccaacataaagtgggagtgtaaagctcacacaagagcggcccaatgggttcctcacgatgaggacacatgtaaatctcgtccaagaagagaaagttcccagtaaaagccggcaactagccgacacctaatggcagcagaaaagtccatttttacacccatgaacttttagatcaagtttcagtctcatcccttaaccacgaaaccggagatgtaacattctccaactatgaaaaccagagtgtgcacggtctctaacagcagcccaatttgaaaccgaaccaacaaacagcctggttaacacgtctagccatgaaaagctaggccccatacactagcttgattgttctgaatggattaatagatggtagattatatttgattttgtgatgataatcgatgtaaaagcgaaagagagttaactattacccgtataagttatattggcattattccatcttcaagtttaactttatatatacaaatacaaaacataataacagttataacacaaaacatatatcatatacaaatatactactccctctgttttagattataagtcgttttgactttggtaaaagtcaaattacttttagtttgaccaagtttatagaaaaacagtaacattttcaacccaacacaaatatattataaaagtatattcaattataaatttaatgaaactaatttagtgttataagtattatactatatttatccacaaacttgtttaaacttaaagtagattgactttaactaaagtcaaaacgacttataataatatgaaacggaaagagtattttatagtggatgaaactaatttagtcgtctagatcttagtacgtttcatcataaactaaaataacttacaatataaggaggatgaagtacacagttgagaagctatttaaatctaaacaaagtattacaagcaatttaatttaggtatagactacagttttgcgaaaattgaatcaaggccttcgagcaatataatcggtgaaaccgacgacgaggtgctgggccaacaaatatacaaaatattattgtgcatgtgtttgtctttaaaaaaaagttgagtactaaaaaccagtgcaatttgaaggagtggaaacagctataacagccagcgagagaaatgtatatcaacagaaaaaaaatattataatgtaaaaaggaaagacaatatcaaagtaaaaaatatagagtaattaaattgtatttatggtataacaactcgtggctgtgatttagtacaataatttgagaagtgaatattcaagtccaataacttgacaagtaggcacgtacattttagtataggaagttgacaatttatagtattttggtgtaataaataggtatatgttgttttggttaacaagtaccgggtgagttttatcacaatgtcaatatgtcatcatatagcaatcatgtggatatatataatcttgaatttaatccataagaattacactgctcattctatttacaccttagatttaatctataagatttacattgctcgattaatttgcatcattagtttggattttttttcaccttcctatatctcaaccaaaatataaaattttcaacgtagttaaatttatttgactttcaattactagaatgacaaaaattatgtatacttatacaaatctatgttatattgataaaataagttctaaaaactaaatgtgtcgacgtttgatgtcgcaattccggtatttgcatagtatggggatcgttggtaccaggatatatgcgagacatatgtaaaagagacggagacgaggatttttatacaggttcggacccctgaattgtcaggtaataaccctactcctgttggccgaagccggtcgttgctcttattcatcataatcacaccggtacaatatttggggtagcctatctaactgttgtcgacttggcggccataaaaccatcccgtaatcgacaacagagtagttttcctccttgaatccatgttcggcgagatcagagacatcgctagatccctcctaacggttgtcgtaggaactgtatggggactaactaggcttatctccgatgtcgatatccggcggcttgtcttggcgtatgttggcttatatgttgatcttgtgtcttgatctattgttctatgtcccctctcctctttgggggtcttgtatgtatacccataggtgtccccttgtccaagtagaactagggaaaccaatatggatacaatccgagtagtacttatcgcttccatatagaactctattcatcattccttatgcggaagtcctcctatatccgacagttgtttccatataagacatggtatgtggtgggtcttgccgagatttagtcaactactattaggtatgtggtatctataaccctgacaaaatgaatacagaaaaaaatgcttgaaataattaagttgttacaacgcttcaagttattgtagcaaaatcatacccaccttgtaagttgttgtaactatatgctcacttcttaagtccttgtactagcaaataacttggaatgcccctttgatccatcggttcaacaaggtttttctcaatgttgtgtgtgcttggaacattgatcacacctcagtctttgcatgcttttctcccatatttggcatacgaaggtgcggtccttgaacagatgatgtgttatttcgaggttgctagcaaaagtaattattgggccattgctagatttgcagccggtctgccgtctatatcttattttgtagttggagctattcaaaattttgcattataaaagtacccatgctttccatattagttttgtggccactggatctatcctcccattgaattgtgctatgtatgctgactttgcactatactttgcattgttcttccatcaccatctaatggtgtcatcaaccctttctgctaggattgttgacgaggacatcactagctcaaatatgaccatgtctaccttttgtattcatcaacaaaaggtgcttgcttgttatgtaggatttagtgttatatatttgaacaaagttactgcaccatgagttatgtgtcttcttgtttgtagaaatacttgcatgggtgaagaaaagtggagcaggcatacatagcacttggatgatcaatgaagtttattggggaccaaccggttgcctttcccaagtctattcacatgttaccgcgtcacttttgatccatagaagacaagaggtgaagttccccatgttttagattcaaattcgggccttttgacaagatccatttcaaacgaacatagcccttgatctagaaggattctcgggacccatgagtacttgctagaaagcttatggagtctaatttcatatggttttggtcccacgtcaaaatttctcaattgtcaggaatatgtaaaacaagccacgtacctcattcagtaattttattgtcgggtacgtgtaatgccccgattttcgttcgggattaaaaatcaataaataaatcatttctagaatttatattaaatggtaaagcaatttaatcaagtgaaatattgaggaaataaaaaatttcctttaaaaaatcatggccggaaatatttttgtaatactctttgtgtcctaatattctctctagattttttccgtgaattttcggagctcgagaagtaattttaacatcacaaagttcatttaatcaattaaattaattgaaaaaaaaattaaattctcctcctttcccttgggccaactccggcccaagtttccttccgctcgggccggcctccctcctctctcctcccttgcctctctcggccccggcctctatccgggccgcccgtgtgtccgcacacgtggccgcctcgtgcgcactacatggtgcacccactcatgcctccgtggacttggtccacggtgggccgaacccccttagtcaccgacaggtggggcccgcttgttggcgccaccctttttcccctcggtgacgtcataaatcaatattaattgcgcaataattcgagtttaattccggaaattcatttaaatggctcaaaagttctaaaattcatatctaattcatacgaacttcgaattgggccattcaacttgccaaattcatccaaaattgagctctacatgcttgtttactttttatgtacttttacttggtttttattagtgttttccggg

SEQ ID NO: 60176 - DNA, 2094 bp, Oryza sativa
tttgcgtgccaatgtgtagattccgtcgtttcggaagatcgcgatcgcgaggaaaagtgttcagaagattgattgaggaagcaaggcaagtcacacattccccttgggcatattgagcctactttataatttttttaccgtttgcagataaatatgcatgttttgcttattacatgggaatagggtttacctatctactcgcttgtgccatgtttacttgacatccgttctttgttaaacttgggtgataattcgactagcttatgttacttatgttgacctagctagaactgtatgcttagccatgcttaattaattaccactagctcacataatgggataattacattattagacatctagtatcttgacgagctgcgtgcttgagacatccgaccatgtttcattagtcgtaactacccaactaaatacgacttaatggtgggctgtgggtgcatggttttgctagtcgcacccatggcaattaaggaccggttcacaggaaaccctcgaagacatacatcgcttaccacatgtgggagtgggtaactgcttgagctgtagtatagctcgaccctttcctaggcacccgtggcgagggtgggcgtgatggagttgggtcggctggggtgtccggttgtccaacttccggattcaccagtggcgcacgaggggactgcccactcctggttaggggtaggggtgaaaccttagcatggtgtggatggttaggggagggttatgcgaagggtcttgcattgtcacaatcactcgacatggtgatgtgtcaggcctggcacaatgacatgccggtggattgtgtcttgtggacacagttgtgcacctcttgccagagtaaaactattcgaatagccatgcccgcggttatgggcgatcgaccagattcagcgtgattagtctcacctttaataaattggcttaatgaactggttagttcaggtgggatggttaggcctattcaacgtggtgtagcgttgatcagtggagatttaatattaccttaattatcaactattttaccattttcaacaataaatgctttacaaccacctttttgcaaatagccacaaaccctccttgtctcccattgcacgtttgcatcattggtgtggcttgctgagtacggtggttgtactcagtattgctattatcccctcttttcagaagtgtagtgcttcttagctgaagatgaagttagacgacaagggcttagagcccagttgagttttgcctgtggagtgaagatgtagccccgctaggatcgcctttttccgttgctactgctttcttttctgtgtgaggactaagtgtctcttctgtaagtatttacgctttatttacgtttggatgtgtatattatttgtcgttttgtgtaccctggctgattcctggacagggatttaatacacaaaatagtctagaaatttgggcaaaatttctgggcgtgacagtatgcatcctagggctaaccctaggacatccctaatcatatttattcagtagccgtcatagtttcgagtcgggtttcacttagattaattctgtcgttacatttttgccgatggttcggtttgtggaaccccaacttcgagtctttaatcattcatctgcaaattgagttgcaatctacattgttcttgcttgtgtttttcgattcgcatgcagggattaaccttcttagtgaggtcaactggatagcacacgattgataaccaaaggagacttggatcctattgatcggaagccggatcatgtgtgtcaagtttccaccaaatctagagttatcagcatatcgaaagatctaagaccttagttcctaaacatctgtgttgttactccatatctaaagtagcatgtcaaagaattccttcaatagctagatcgatggtgagcctgtgccacttgtatccaccaatcatttgttagtgtttcatataccgatcgactcttctgctttgagtggttgtagagtcaattgctttgcttccatctcctatttgtgtctctgttgctgatgttgcacattcggtacaagataaaatttcgattgttactcattgggctgcaggaatt

SEQ ID NO: 60177 - DNA, 1286 bp, Oryza sativa
tagcttagctcccccgcaccgccatgggagggtggcggtggcgggagttgttgttgttcttcttgttgtcattcgggcttgttccttccaccacctcagccggagcaatcctggacgctactgcgatctgcgtctctgcagcttcctccgtttctgtctgctttggctttcttttgagatgtgcactctctatttttgcttcgattcgagctggtttgatgtcgaatcagctaaagatggcgtgtgcggcttagtgttcagcaatgggggaatgcaatgcggtgatatattgtctctttttggcttcaaattaaggattgatcctagatgcgctaaatttgatctatttgctttgagctttcttgtctcttgcgagatgtttgatttgtgttgccgagtcagggtagggagttgatttaataatggcgaatgcatattttggctacctggattagcaaactccataattatgtatatctaagaaaaaaaaaagatgtgaatacggaagattgaaacgattgtgggcatttcagctgaaggggaagactgttttttttttgaggatgaccggcattgtgtgccatagaatcttttcaccaaaatttgcagtacagttttaatggtttcttgcatggttcaatttacaaaactatacccttatgtactgtagtagtacatttgtatgggaaatcaccaagttgccttgcttgctgggagtggcaagaaggtatttaaagctgctgggttcagttgatgatgcatgttttaatggtgaggtcatagacaaatatgaacataacagagtgccacttacctgcatccaggtaaaaagatataatagagggattcacgattcacatcataaaacacaaagaaggtttctcaacacacacagagaggagtgctaaatggcgctcttgcgatgatcttcgtgttgtgctcatgatgccattgctttcagtgatcaaaaacataatttttaactgcgcttttgcgcttgctgcagaatagattagtagtacaggacaagtgttttgtctataggcacacccacagagggcacaacaaccatacttttctgtggattgatttgtatttagtctaaaaagagtagcagtttcttttacaagattgctaataacgcaccacttgagattttgagtaattgcctatttggaaatataattcattaaatctgaggtatattttcactttgaagtctgcagataaattggcatgtttcttttcaatttttcttttggggatagacatgcttaaattctgga

SEQ ID NO: 60178 - DNA, 17110 bp, Oryza sativa
ttctctaccattgctaatggtattacagatattaatgtgttttgaagttcactttcagtctatcacagtaacttgaaatgcacatgttctttgaactgtacattgcaataacaaaacttattttcagatttgatgatgacaaagacatcggtgcattgtatggagaactttgggaggatattcctagtagcgaaagagtaaccctacagttatacttaccagaaattatctctcttttgtgtgattccatgtcctcgtcgtcatgggctgggaagagaaaggtgaagcctttatttcattatcttactgtccatacacataaaagtatcatagcttggaatacacttacagtactgtgtgctacttgcagtcagccaaggctataaaaaaactatgtgatgctctaggagaatccctgtctgtgcaccacaataatattcttgaatcacttttgaaagaactacctggtcgattttgggaggtaattagtactatgatttttctatctgtggcttatcagtgaatctttccttttattcatggaataaaacaggatggattgcttagagattttcaagaaacattatccatgactaggttcataattcattttttcgccatgaataaccacagggaaaagatgctattctggatgcactcgctgcactttgttcgagctgccatactgctatgagtgcagaagactctggcatgcctagtgttattctaaatgctgtttgtgctgcatgcagtaggaagtcaaaattgtaccgtgaagcagctttctcgtgtttgcagcaagtaagtatctctcttctctaccctgatctctatgtgaaactgaaatttgtggctagtggataatctaaagcattttactgtttgtggaccagacttttctttgataaaaggatttttagctgttagatagctgtgctcttaacctagtgctcaaaaggtttatgatcttagatgcaacaaaattgatgagaaaattactttcatgcttaatactccctccgtttcatattataagtcgttttgacttttttcctagtcaaatttatttgagttagaccaagtttatagaaaaacaatattagcattttcaccacaaaacaaacatattaccaaaatatattcaatgttagatttaatgaaactgatttggtattttagatgttgctaaatttttctataaatttgggcaaacttaataaagtttgaataggaaaaaagtcaaaacaacttataatatgaaacggagggagtgggtatttagtttgaagatctttccgaaaatattgcaaacagctctcttctcaaaatattatggggagcaatctaggttgtcagtgttatattttcacaaaagacattcatcgggtttaggtgttgcgttgggatggcattttgacattttctatatattagaatttacttagttttctttttctttctttaccacttttcaggtgattacagcattcaaagatccaggattcttcaatattgtttttcctatgctgtatgaggtttctaatcgatctgtcatttgtaaaacaaggaactcatcttcactcactgcatcctctagtgctggtcagtcattaattccagcccctcactgcattcaactaatgtcaatgctggatgaaacatcttgtaaatgaatactagaacttctattttattatctcattctttatcacataaatatgatatagtactgatagttgccatcacaacacaatgtttgaaaaccttgatgggatcggcttaacaagagtacaagacaactttagaactatacattgttgcccttaatgcagcatacgtgcatgacttcaaagccacttatcctcctttattttttatgtattactgccttctgcagagcaagatgaaactgaaggtgtttctgtttctcttgataaggtgctcaactgtgtagcatctttaatcactgttgctttcctgcaagatattatcaaccaaaggaagaatatcctggaaattattttaaattctctatcccccgaggagagttggcagagtatgtatcttgtatgcaagatctattataattctatgcaactgtttttgaatctcacttatttgatacatcaccactatcattgatgctttttttatggatttctatgtgcagttaagttgtcatcgttcttgtgtatcaaagagttgtgctataaattccagaatccagatggtaataacacttggcctgaggaaacaacttacttggttgaggaggtacatcacatagttgtttagtcctacacaactgtactccttagttcagtatttggtttcttcattttcctgacaaatttcttttaatttgactgttcagttatttcattcaacagcaccaaaagttgtggatgtcatacgcttagttaagattgctcaggtaatcatcagtatatctagccctcaccaattcatattatattgtgtttgctcatatttattacaatctcatatagcacttttaaagtttcaccataagataatttgttgtcttccttctaatgaataaacatattgtagtttactacttgtatgttttatggcaatgggagcatgtgaactgaaattgcactggacggagctgttgtgggtgttatactaaatttgatgattgcataacaccatttggcaccaattttccatttggcaccagtttttttatagattatttagagatgatacaaaattattcatcaaatattcagggaaaaataagaacttgtctttagaaaaaaaaaaggtggctggtctggtggtttgatgaaccctggtgcacatggtttacagattactgctttgcttctttatgtaacagttcatatgcttgtttttggcttcactgattttagaacaaacagttacaaggtttcttgcactgattgtaacatataatttatatcttgaaaggacgagctatccaagatttatgtaaaatataattgttacatactgtgctagagtatattagattactgtatattgcacaaaccagcagtttctggatatgcaatctgggtttgaattgccccctcatgactaacttcttctcaggttcacaccgctgcttccgagtgtctccttgagttgagcaaattgtatagagactttccattggttgacagaaaagggcccaagttctcaggcgaacttgctgaactttgtgagtcggaaaaaagcgagcaagcaaaggcatttttgaagcaatgcatggatattctcaaagacttcgaagatgccactggattagccatggagatggattaagtgaagctctcaaggttaaatcgtcttagtaaatgtcaaaaacaagcccgcacatgtataaagggcgcgagcaccagggaaggtgggttattctcgcaaactggaatcaccgtgtaataggatgagcgtttcattactgattgcatccgaaggaaattctgaagctttgcatccgcaacccacttgtgcaacatgtcctgccgctgttacgatttattgttattctccagaatggagtagcggtgagctaccagagattggtttcatgattctttcgagtctcaactttgagtgcaaaaggaaccaagacctaattagacccgagagtgatacttatgctaggaaacatatactcaaatccaagaacgatttttgtatgaagggcattgattattcaatccaagaaattaaacacaaatgtgtgtatacatatatggtttctgtttactttcacccatattgggactaaattgagacggtttacaagttacaatcacatatgatttgtgtaaaaacattaaactgacgccaaccgatgtatcttcggtcttcttttctgaatccctattatgatcatcagggacttaagtggttagcttgcggagagcagtggtggtcttggagcctgactgccttcccagatgcttggagatgtaatctccagcatccatgagcttgttgaggtcaacattggtctctatccccagtccatggagcatgtacacaacgtcctccgtcgcgacattgccggtggcgccctttgcatatgggcagcctcccagtcctgacactgatgagtccactatgttgatccccagctggtaatacaaaaggaaatgttaggccaagcagagcatttctgattgttttgtgtctgtttttcagtaagatggtttgttcattggcattggcaggatgtgaagtgtggttgcttacttggagagagaccagtatgttggcaagggcttggccgtatgtgtcatgaaaatggacggcgagcttgtccactggaacaaaagacattacagcttcaagcatagcaagtatgctacctgaaacaaacaatacaagagagcggaaaattgccaatgagatatgtggctcatactgtcatatagaaaaattcgaacaattgaaattatatgattagcaagtaatgtgtcagaatgtttgtagattaggactgcaatgcttttaaaaaatcggtatcatcactttaaaagtagttttaaacgggcaaaaatgtatgaaccaggaaatggcatgctgaaagcaataaaggcaacaaaatcagtacctggtgtaccaacaccaatcgtgtctccaagtgaaatctccgagcaacccatgtcataaagctccttagctacgtatgctacctttgatggatgaattgtgccttcaacagggcaaccaaccacacatgaaacatacctatgacgatcaaattatgcaaattctcagatcagattgctgtctgttctttttaactttcaggctcgatagatcatcaagcttatgtgacttacccacggattcgcattccatgtttcttggcagaagttacaacatcacggtaccgaacaaggctttccttgatggtacaattaaggtttgacttagaaaaggattcagaggcagatgcgaagactgcaacttcttttgcaccagctgcaagagcagcctcaaatccctagagaagtggaaacaaagttgattcatcacaaagatcatagcccttcataaaacaataatgtatagtctattgctgatatagtgctatgtgatagagttcccaaaaaaaataaaacagaactggacatactctgaggttaggagttaacacaggaaaccgcacatctggcacatgcctaatcccttgaaggacatcctttgcatcagctagctgaactccgaaatgagtgataagattagttatttgaaatttaactgataccaaatttgtcaaattaacagtacaaattttacaaattaaggtcatacaaaaaaataatagtaaaaggagttcaatataattatcagagaagtagtgacaacttccgatgaggatttccacataaaaaaatccggttttgaagtaagtgcaatcacatatgctagaaaaggtggattttaaatcaagaggtatcttgacattgttccttaaatatctgttaatttaaattaatatatgatactacatttattcacttaatctaagtaattacctgcggcacccattttggggaaacaaaacttgtggcttcaactactgatagaccagaagccaccaatttgtgtatcagttcaatctttacagaagctggtacagtactcttctcattttgcagaccatcccgtggtccgacttcaactatcttcacaaaccttggaagctcccacaaaacctgaaaaccagttattcatcaattgagaaaaaagagtaatttgtagtaatattttacaatcactacactttttcagccaccattttcacttattcagttatgaaggtaaatagaaaagactatgacatgttgaattgccgcagacataatgctacatgtcagttcattcctcgtatttgaggtggtctgatgaagagatctaaaaaaaggaaatgaaattgaatacactcataagccattccataacacaggatcaaaataccttccgtggaagagctctgaactccatatccactccattgcaggaggaatcagtatattggccttgcatatgccatgaatgagaactgctgtgaaagatcgtctgattgttgccaccattgtgatgcttgtaactgaaagtaggtccagatggtcagatcttacttttttttttcagggcatcctttggcagtaaaaattctactgatgataaaagaaggtgagaaaggaaaatcttcggtgtaaaacaaaataggaaaggaagaatctagcatctgtatggtttgcaagagtaaaacttacttgctggtgctacggtcatcagcacttgctctgcaagcatttggagagaacctttcaagtctgttaatactcaactttggaaggtccccaagaccgagcggctcctcgaggctcgacattctggaatcagatgttacaatgtgaagaagactgttgatatgaacacttgatatatgtcactgaattgagttataatctcaaaacacatgaagaacaggaggaaaaaacaatgtatcgggtcgtattatctcattgatcatatgccaactgaacaaacattagtttccgtttaccagttgggatatatcgctgcaacaagccactagaacagtcagaaacggtacactaatccgcatggaaaggaaagtttgaaatctaatccaatggaactccagaaacaatgtccattctcccggcatggtcaatgtgcaatgcctgcacaccggacctcgatcttgaccaaacttcttctttacgcattgaacagaacagcatatatacaaaatactcaccctaattatccataaagtggtttatttaaacattgaatcatgaaatggtatgcttaagcttcaatgaactaatgatgcccattgcacagtaattagtaatactagcagaaatggaacgacaccaacgccgctgttaattccgctcttttccctgtaagcactcatagcaattcaatctagctacaaaacctcacttgaaactctccaagaaaccaaatcaagcagccaaattgtcaccagctaagaagtagtacaaggaacagaagagatcagaaaggggaaaagtgcaagaagaaacaagaaaccatcgcacctcgatcgatcgacaaattggaagccaacccgatcaaatcgcacccaggattgagtgagtgatatagggcaccgaactcaacaagccttacttgaatccgacgcaaaggaggagagagcaccggagtccgaaaatggaggtcgcggctgcgcctccgcgtctccgccaagggaaaggaacgggtcggcgaggcagcgcgtggaccaggtctcccgtggaacgtctccgtggggcccaccgtgtcagtggctgttggtccacaagacccggtgtagggagaagtgcatgccggtttggcgggctgtgtggaagccgtggtgtttggttggttggtactccttttcaggtctggtgagcgaccacccaaccccgcgagttcttatcggattcgggctgtgaaacgttgttgtgttcacccgttaataacagtgcctgataaatatattacttccggtgattatgcgaatgccctgcttataatctgctcaatgtagattaatgtggaaatggatcttctggattttagtgatggtgattatgaatatattcattaccacctctttaaatatgagatcatgaatcaactgataatatacggattgatgatcttttgtgtcttgacagtaaggatacccgatccgcataatttgtatttaatgatctttgaaagtgtaaacgtggtcagcttaactccagagaaaagaataaatcagatccggagttgtggtggtgcccaaaattctattgatgtatacatgccgtcctcgtgttttattaggtggctaggaaccatcttatttaatttagagaaaattgcaaaaaccaccccaaatgtcactctgagtttgagatgtctccccataagaagatttgttgcaaatccccacatcctaattcatcttgctttgatttaggcaccttctcttcacacgtgcgtgattcttgaagaatctcgtggcgaaatcaaccgagtcccactcggcgagagcaagagattacgttgtttgttctgtataaggcggtcattttgttgcgttatcatggtcatttcactgtgtttttcatggtatactagctatatattctaaactgatatcatgtgtattgaacaacatatccttttttttcatggacataatgagcatatagaaacatttgaacatgaagcaataatcatatagccagattaaacctgcatgacttcatctattgcaattggtcagatgacccaaaatagcatgtgttagtataggttaatcagaaattaaggccacacaatctaatgcaaaacggacatgttgacaaatcatcacgatgggcaggacttggctaatttcgccatgagatgctccaggaatcacgcatgtgtagagagaaggtgcctaaatcaaaccaaggtaaattaggaggtgaggatttgcaacaaatcttcttatagagttatagggggcatctcaaacttagagtgatgtttaggatggtttttcatttttccctttaatttatagtataaatattttctatatgtattaatgttaccttcatttttaatagatagcaccgacaatttttttaataacatttaattattcatcttattcaaacatgtactctaaatatgctaaagtataagtcataatcaaaataataaattttgatgataaaataagtcacaacaaaaggcctgttcactttgatgccattttcaaccttaccaaattttgataatgttgctaaaaaagtggctatatttagtttgctaccaaattttggtaactatataagaaatcctacaaaaattttggcaagtatgctaaaattttggtaatgctaaaatttggtaaggttttttttagcatcaaagtgaacaggcccaaaataaacactatttatataatattttaaataagatgaatgataaagaaagtagaaaagttaacaacgttatttattaaagaaatggagagagcaatatttatcgttcattaatgaaacgtactcctacaactctcgtatttccaattttccaaacaactatcaagtcgtttcatcttgtactttagcaaatttaacctatcaacttgtgcaagagtcaaactacattttatatgccttagaaaaaaaaatattctctcgtatcaaaatataataacttttagtagctaaaatttatttgaaaatataacttcaattgaactgcaataattataattacgatggttcgaatcaaaatttcaagataatcatgaatttaaaagagaaacacaaatcatatacctcctgatttcctcctttcagtgaagtgttaaaccctagctagcccctcttctccgctctgcctcctctcctcccccatcccctctccgccgtctcaacctccgccgattcttcccacccagcaatggcgatggatttggacgagccgctcgacgcggagaagggcgaggcggcgctgcggcggctgcgcgacgccgacccggccctctacctctccccctccgccgacctcgccgccgccgcccgtgaggcctccaagcacctctacgcctcgctcgtccccttctcccccgcgcagccgcccccgctctccaacctcctcgcaggccccgccttcgacgccgagcagatttggtcccagattgagctgctctcccgccctctcatcccccacctgcgccgccagctccgccgcctcgagcagcaacccccgtctcagccgccgcctcgtacggaatcgaagtccgctgatgccgaagagaagtcagaggaggaggaggatggtgaaggtgacgaagaattggaggagttggacgatgtagatgatgaagaggaatcagaggaggaggaaaaggaagaattaggattggagggtgaagcagggaatgaagtggaggacgagttcttcaagataaaggatctcgataagttcatggtaaagggggaggaggcggaatatggtgggggtgccaagcaagggaagaagaagaagaaaacagagaactggatggaagaagatagtgattcggaggacgaggagtatcttgatgaggatgaagaagatgacgatgagcacttggatgtaagcatttcgtaatcacatctcttgttaaattctgagaccagtattagctatcgtaaagaagattgatatatagaaccactgatctagtagtatttcaggagtagacaccagaatttctgtagtcgcaaaagagaaagtatttgcattacctcaggaaattgagcatatggagtaagttctaaaacagtttcctgcttgagctaataggcttatattgggagctagcattgggtatggtttaatgcaagatgcatgcttgctaaatgtgattcttaagtatcgtattttgtaatgtagttggaagacttcgacgatgaagaagaagaagaagagggtgcagttggagatataatgtaagcctttatgctattttctgaaaatgctcatatcatgattgacagaatcacagaatgctttcgcacactatttttatctttaagtgattaaatactgggatatcagatggttttaactacattttaattgcttttgtgaagatcggtatgatattcgtagaaatggaaatggttgtcatttataaatttgaattgtagaatcacttgaataattcttcacaaccttttcctattttatcattttcatgctcggcacataatttgacctgtttaagttaattgtcaaacttacttattagatgatggctagcttttcatgagaccaacagctcagaaaagggcatacagaggcaaatggagtaggaaaacaattggctccaaataatggcatggagtggactcaattaaattagcaaacattaagtatgtaagacaaacatattacattttcacgtaaattgttaaaaaaatgatgatagcacaagaaattggatttatgaataacaattagattaggcataagtcaaagaagaagtctgttgaatattaaaatataggtataaccacatgtgtggccatgtgggaatagaatgctgtgaaaaaaaactgccatgttcacataactcatagaataatagcaaaggatacctacaagtttatatgtcatgtacaaaaaggttaagacacacaatatcaccctaaaaacacagctttttagcatatatataacctaggcaaaactgagccaagttctgtctacttcttagccactgcaaatgcccctggaaggataagtgatctgattagacaattccaagatctcaccatgcacataaatgcattacatcattctttcctgccttgtatttgtccagtggagcctttacagaagtttccatatgttgtattgactcagcaaagcttaatcgttatgcccagacttcggttgtatttaatatttgtgcatttatagtattatgctttgaccaggaaagatgatttttccaggtataaggatttttttcaggaagcggatgaccaaaaagtaaggaagaaaggtggctccaagaaagttcaattcaaggatgaaccagataaaccagaagttgatgacaaaaatgatgatggaaatgttagtcaagtactagacttaattacttcaatataaacaagtgaggcacatgtatattatcaacatattcttccaattctgcaggatgaacagggtttgtcaactcacgagaaggcgcgcctgaagatgcatgctaaaatagaggaaatggagaaagctaatcttgaacctagtacgtggaccatgcagggagaggtaatatataatatgtttatccattcattagtttctagaacaaaacaaagttttaactttgaactgttctgctattaaatcatcagttcatggtaaagaaaccacttgaaattttcttgtaggttaatgcttccagcagacccaaaaatagtgctctagaagtggaccttgattttgagcacaatgtaagacctgccccagtaatcactgaggaagtcactgcttctcttgaagagatgataaagaaaagaataatagaggtatgtgtgttgtttcctttttcgacatggcataatgggcagttttgcaacttggttaactttgtggccttgtgctacttatactgagggagctttacttgttgattccctgtagggtcattttgacgatgttgaaaagccttctcccttgcaatttaaatccccaaaggaacaaaaggatctggtatacttttaatcttgtccaataacataactcattgatgataacaataactaatcatgtatttgttgtcttaccgttatcaatattatttcaacaggatgaaagtaagagcaagaagggtcttgctgaactatatgaggtttgcactatcagaatacagcttttatttttttatattcaaagaagttgctacttaagatcagtttaatgatgatttattgagggctggtgtttgtgtttgtacaggatgattatgcgcaaaaagctggccttgcacctgcaccactttctatttcagatgaacttaagaacgaggtgagtttaatcgctttctattataatatgacaattggctttcatgggactaaggttgtacagtttctattgttaaggacattttttttcttttgtttaattgctgtgtgattgcatgtcatttgttttttagttaaaagcaagctgcaaaaagaagaaatcctacatgtcaaagaggaaatcttgagttcttctcattgaatacatgtcattctattatgaccttcccccaccccacacacacacacacacgcaaaaaaaaaaaaatcttgtatcaatgcatgtcttgattgctagtgttgctactttattcaatattttcctctctgtgtggtgatggtggcaaagatacttgcaatgtctttgagaaagatcttttgaaaggaattgataatgctgtacctcatgatcatgcaattgattaaagtttgttttttttatggtagaagcagacatcattttcttttgaaaaatagataagtgattacttgtgatcacaatgttgttaacttagtactaactatgtagcaataagcatgcaaatgggtcatagcgtcatactcagagatttttaaaactgtaattttttgaggtaccattatcaacttggtggtctttataaatttgttcccaccatttcattggtgctttatgcatatttttttcccctgtgatgatattagaggcttgctgcattgacctaacttctgtttccacttaggcaaagaccttatttaagagaatatgcttgaagttggatgcactatctcatttccactttgctccaaagccggtatggaatagtgaccagatattttacttaaatttgtaatttctttcagcgaagttaactaacaaggtaaatattcacttttcaggtcattgaagatatgtctatacaagcaaatgtaccagctctagcaatggaggaggtaaataaaatccttcatttctccatgatgtttatacggttgagcatttcatgtcatgatttctctctctttttgcagattgcacctgtagctgtttcagatgctgcaatgcttgctcctgaagaaatttttgaaggaaaaggtgatgttaaagaagaagcagaacttacacaagctgagcgcaaaagaagaagagctaacaagaaaaggagatatgcaggtaaattcccttatgttttttaagatgcattccttctagcttttagtataaatcttctgacctgacatggataatgctcctacttcctcattcaaaacatttcgttgttcattcaaacatggaagtagtttgagcaacacaaattcgattagctagcaatatttccaattgcaaagttgggtacgatagtagattgaggcctgctcgtttttcctacttttgtaccatacaggatcgcataaggagaggccagccaagatgcagaaagattaagtcaatactggggaaacgcttacattatgaacaagtagtcagccatttttactgttcagcattacctcttgacccaaggatccattcatgatgagtattggtgcaaatggcaacgcagcattgacagacatggagggagagagcaggctaggaaaggtagtgaagggttgggttggaaaggaagtgtgaagggttgggctccaatgcgtttgatcacaggatctgtactctggtggcacaacagacagatagctgttccaggtcaaagaccctgacgtaacccatctcccgtctcacaagaaaacgcgagcgaacgtattggaatgtgggatgggtaaaagaaatcttttatttctcgttacactagtcgtagcagtacttcatttttacagtaattttttttacactatagaaggaatatcaatggtttgcatgtattagagaggcatatgttttgtttttgatacgttatggaattggtttgcagatgtctgaaatttgcgtgcggtgtattagtatcattttgatcctttgcttttttgccgcattgagggattagattgatctaataaaggtgatttgcaagaaagcaaaataaaaatgggttatgggggattgtactctcagctacagtggcaggtagagatgcctgtacgcaggtcaagcttggacccgagaatgaggacgtagagttgggaatcaaatcatgttgtagatactctgccatgcgtcgtcatcgtcatgcacgttacaacgttgcacacgatcatcatcttccagtggagtacggtacacgtacatgtagggggagtatacgttttctgctcgttccgccgaccgcgtaccgtacgagacagggaggaaggcagcacgcaacgcgatgctgcaagactggagaggtagctgaacgagagtgacgcaatgagttgcaatgcaccacagcagcagcacaaactctgcacatgtgctgctgcgcaatgcagagttggccgtagagcaatgttgtgctgtactactagtctactggagtactactgcagactggactggccgtcgccattctactagcaaatatcacatttgtaacaacgatacactggagtatgcacagtggtgtaccgtgaaccagcatggacgtgcgaatgcacagtgtaacagcaagtgtgccccaggcagaggtagcaagcccgaaagtccaacactacactgcataaagttataggattctcccacacatgatgagtcgcacgcagctactactcctacagtagcagctagggacaatttcttcttcagctcaggctcagctgctgagccggtcgcgcctcccaacgcataggcatgctcccgccggccccgtctttcttgtccgccattacgccaaccggccgcagtaactcagcgtactactcgtactctactctactccctccattccaaaataaataaataaataaatagataaatctagggtgtgtttagttcacatcaaaattaaaagtttagcccttgtttagttccaaactttttcttcaaactttcaacttttctatcacatcaaaacttttctacacacacaaactttcaaattttctgtcacgtcgttccaatttcaaccaaacttctaattttgacgtgagctaaacatagcctagccctgtttagttctaaagtttttttttccaaactttcaactttccatgacatcagacctttcatacacacacaacttttcagtcacatcgttccaatttcaaccaaacttccaaacttcagcgtgaactaaacatagcccaaggcaaagttggaagtttgtatgtgtacggaagttttgatgtgatgaaaaagtggatgtttgaagaaaaattttgaaactaaactcgggcctagcactgaatgtgacagattctaatacaataaatctggacagagctatatctaaatatatcacatctagtactaaattgattttttatgagaaggagagagtactccttttctttccctgcttttacgcgctgcagcattgctccctactgcatgctccctaccctcttcgttaaaaaaaaaaaaatcaaattctggccgtaaacctgaaccacgctatacgtatttaccatgttttggctccctatgagttaacggttagcatgtaatatatattggttttaaaaagtaagaaagttatcttacgtgatgttgcgataaacgcacggttttataaatcttgtatatgattttgtagtataactcatgtataactagatatatataattatagataatcgaaaaataacatgttcatatgtttataatcgttaaaagtcataacgtgagtcagactcaaacagttagtagaccgtatgcataatatttttctttttggaccgagggttactcccaaccggaaaacagatccctgactttgcagtttgtagttgtaccatgtgggggccacatatcagtgacacaactatatgtcggtggtctaactacaaactgcacaaaggctaagtttagatccaaacttcagtctttttccatcacatcaaattgtcatacacatataacttttcagtcacatcatctctaatttcaaccaaaatttaagctttacgctgagctgaacaaagccaaagtcaggaccatcattctcccaacccagacgagccaccatgctagctgctgctgctgctagtgttgcccagtgaccttgcagctcgccatgctagctccgctgctcgctgctgctgcttttgcccaaagctgcacaacctgcattgcctctcgcctgaccctcttgccttatctgagtctccccccttcttttttcttcaacccctctttatgctcgtttctccattgcagctcacctccatcttctattctccccctccttggagaaagagttcgtgtgcctctaccaagaacaagaagaagccttttgcattggcagccatgatcaccgtggtggacctgtaccacgttatgacggcggtggatgccctgtacgtggcaatgacgctggcgtacgccatcgtgcggg

SEQ ID NO: 60179 - DNA, 1319 bp, Oryza sativa
tcctcattttcttttccgtgcataagtatccaggaactaaaaaatgaagtccccatggtttggcttatttcctaataatccaaaacggtttattaggaaataaaaatgaatttgtaggtgaaatttttataaatgtgttcttggtgacttaaaagacaatgttaaaaaagaaactacgttgaaaatatctcaaaattaagcttgaaaatccaaaatttagctttttctttggctgattaggctatccaataggagcctgaacatggtaaatcttcattcaactcttacatggcacataagtacaaaccttcaactggacagtacagccttgaacatactctacttgcaacatatgatttgcttatacttgtactctcaatagccttagaagcacatgtcgaggaggcaacagcagcaaagggcagcacagctgcaaaacaacagaacggttaagtatttcagttcttcagtctactttcgcatatcactactattataaaaattgaagatgtttttgccggtactttgtacgtcgtccgtatatgagtcggtttttaatttcatttgcttttagaaatacatatatgtatttgagtctgtttttaagttcgttcgtttttaaaaatacagaaagctcctaattgtagcttatgattttgtaaaataaatatccaaacgaatttccagagtgaatttcaccttagctaaactgtacaacagtgataagattaaaatagcttttacccgttgcaacgcatggatattttttttctagttatgaaaaagagtaattgtctcattacgaaaaataggggtaaaaaagtctacttcataccccaattctagcaacctctttttaatcataaataaaccctataacttaggtgttgagttaggttttctataaacgtaggaagatactatgggcttgttcattttataatcgcttttaaccttattaaattttagtaagataacaaactaaatatgatgtcaccaatattatcatactactaaaatttagtagttctagaactttcctatcataaaaacgctagtactaaattttgaaaagacatcaaacgctactaaaattcgataacaccaaagcttgtcaaaagttgatattgccacagtttaataaggttaattttggtaacaaagtgcacagcttatgttgtccctgctattaggttatgatcgattggagtaaacagaaaatggtaggcggtaggctcagccactgcctcacacaagacattattatcagtgacaccgagcttaattaccatccttccaggaaggccttgtcaccgcgg

SEQ ID NO: 60180 - DNA, 1891 bp, Oryza sativa
ccgccgcccatcaccggcggtagcaagggcgccgtctctctcagggtacgtacgtatatacgtttgtgcgtgacagtctcgcttggagtcttggactgattgatctgatcaagttgattagtgtctcagctggatgactgggtgctgtgccgcatatacaagaagacgaacaaggccggtgcggggcagaggagcatggagtgcgaggactccgtggaggacgcggtggccgcgtacgcgccgtcgtcgcagcagcatgccacggctgctgctggcatggccggttcggacggcgccggaggagttgctgcagcgcacggcggcgactacagttcactgctccatcacgacagccacgaggacaccttcctcgtaaacggcctgctcaccgcggaggacgccgccggcctctcgaccggcgccagctctctcagccagctcgccgcggcggcgagggcggcggcgacaccgtgcgacgccaccaagcagcttcttgctccgtctccaaccccattcaactggttcgaggcattccttccacgggccaaggagtttcctagtgggctaagcaggagtagcagagacatcggcgacatgtcgctgtcatcgacggtggacaggagcctgtctgaggctggcgccgtggccattgacaccggcgacgccgccaatggcgcaaacactatgcctgcatttatcaatcctctcggcgtgcagggtgcaacctaccaacaacaccaagccatcatgggtgcctcgttgccatcggagtcagcagcagcagcagccgcctgcaatttccagcatccgttccaactctccagggtgaattgggattcctgaataaaaggtgccggcattatgcatacacatatatgcacatgcatacatgcatggcttttcaagtagtagcacaacattactagtaattaatcacactaatgtgtgtggcagtcgcattcagtgagcactgatcgagtagttgcatggacacaacactaatgcatgcactacatatatatggccgcattgctcatagggcaagtacctgtaccaactaggtaagtgacctacccagctaaaccatgttcagaataaggagaagaagccgcatgcaaacacgtaggtcatatggctttgccttcacatgcgtttgcatcatatatatcgcattcagaaagtagtgctgcagctaacacatagatatggtgttagcttcatgcgtttgtaccatattagcggatgcagaaagtagctagttgcactgttcatcattatcccatgagatatgaactttatatacctttggggccagcgctctacagactagtacagactacagagatcggcaaggctgcatgctggaaccagagacgctgacgccccactccaccaccgatcgatcgctggtatccgagggggaggttttgtccgtcccctcgtcccccgcactgttcgcgctcgctcgcccgctgctctgctcgtctcttccaccatcaaatgatcacatgctgtccatcaactcacccccgtcgtctcgtgtgcgtgcagctttcccccacggcctcctgctgctgccgacccgacccgacctagcgtccctcgccatcgcgcgatcgtgagaaaaatcgggtgttattgtgtagtagaaaaaaaaaccggtcccgtcctttgattccctctgcctgggcgccgcccgctacgggacgcgagagcagctaccagcaacccgacaaaccgcacaggcggcctccccctcccgcgcgcgccagcgtccaacgctaacggcgacccgcgctctctcacagtgtctctcccgctagcgttatcatcatcagctgcgggcttgctatgctatgcttgcttgttgcagtggttttgccacgcagaa

SEQ ID NO: 60181 - DNA, 2092 bp, Oryza sativa
cgataatgtatgtctcgttttacctttgcgaggagaagaccatcaggcagccggttggtgaagacaaggtcgccaccagcaatgggggcagagtacaccagccatgtacgcaaagaagccagccagcggcgacgacagcagccgacatacatgcataaccattaccgatcaaaccattattagtaatctgtgaaataatctaatttgcgaaagaatttaaaacgataaacctggcttgtaatccaagatttttaatgcatgtatgtcatcagcggtgtatggcttgcttgatgaatcagagactccagcaaaaaggtcgctgcgtgcatgtatctgtctaggtagatcatgcacctgcatgtatggcttggacagaagtggcttgatcgatgcccttgtgcgacaattgctccaatcagctgggttggagtccatatcgattccgaaattgaatctcgccaacaaattttgatgtcgacgaggaaagacgccgatgcttcagagctttgcatgcatgttttctgctgatgcttgatctgttgcttgacagcacatggcgacagatttgatctcattgcataaaatagaattgacaggaacaactacttatggaggctcataatagctgttggcttcaaatcttttgctgatcaagaacaaaactcggtgactgacgtccggtcttgccgatcaaagaaaagactcggcggcgacggtgattggatcaatcgccgagattattttcccggctagatggaatctgagtggaagaagaaaagtttaggaaattggtcgcgggcgaggaagttgcagctcccgaagtgaagacaaagccggcgactcgtaaagttgattccatcgcgctttttgatagataactcgacgcaacccctacttggcgcgccaactgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattgatcggacgatcaggttgtctcatgccccctaaagggcctcctgcccaccttatatagggtggagggcaggattacaagatagaaaccttaacaacacgggatcggtttcctaaatctactttacaatcttatcaaaccaggactttaggccgttccataatatacagggaaacgtaatacccaagtcatgatctgttacatattccatagatataagctatcccctaagactagtcggataaccatgtcgtgtgggtatggggtacccataatctccacagtagcccctgagaccttcacagccgaaaagataaccttctctcgaactagattactccaaagccgagtgcttcaattatcttcgccatggtctcccgagtacttttaccaaatctgaagactgtggagggctgaaaaatatagtcaggtgcatcgaatagatgcacctaataggtgttgcccccgactatgtggttaattgaaccaaccaaacatatagtcaaggaataaataatctaaccaaccgagtggttttgataattgtaatcaaccaagtgacttgatatcaatgtatagcatatgcggtgtgaatccccgaataatatgatccaagtgatataccgactgcttggcaaaatatgatgcgtacaacctaaagttgacaacatctttgaaagttcacatagcaaaacaactataaagaagcttgaatgctgtgaataaagaaattttcaaagtattgggcatacgccatgcgcacactgctttaacagatgtgcttaagtccataaaagacacattgtttcaccacacctggaaatatatggcacatgtggtataacatccgagtaagtaaactcataaaggatttaccaaccgcctgaaaaatgaccataatatataatcagcctaagccataatattggtcaataaaaatgcacacttacgtggcaaaaagcaatgatattgtatccaatcaattgcttgataaacccaaacagcaccttgactatataaaaaagtcag

SEQ ID NO: 60182 - DNA, 24236 bp, Oryza sativa
  unsure (1)..(24236): unsure at all n locations
tgccttctttatgcgcaagcctgaaaaaaaggggagagttgtttaatcaccggaaatgggggcaccactcccggccggggcattctcctcctcgttgtaggcggaagcggccaccgcgtcgcctcgccgtggggaatgcccgccgcgccgccagccgggtatgtgccaccccctccaccccgtgaagaaggccattgcgtctccttgctgtgcggggatgaccgcccgcttgccgccgccccgctagtcgctaggggtgaaaacggtaacggtaattaccggtcgaccggcgttcgttttcaactttctaccggccgagccatatagaaatggtaatcgcccgaaacaaaaatggaaatggtaaaaaatatggaaatgaaaatggaaatagttttgctgttatacctatcatttccgtatttaccgtattcttgcggaaattaccgtttcttataatatggtaattaccgtattctaaatatgtcgatattataggacatgtctatacttgacccacagcttatagattgaataactcttcaataaatctctaacttttgtacatggctaaaatgaagttaatttataatttatatagtataagcttgaatttatgtatatatataacatacttatgtaaagttaaatatatgtttttatagtttaatgtttccgtatttattaccggtttccgatctgtaccgacatgtttccgtccgtattgtttcgtttccggttttccgatatttccgatatcgttttcgtttccgactttaccgtttccgatttcgtttccgagaaaaatatggttacggaaatggttgaggctgttttccgatcgtttccgaccgttttcatccctactcgtcgccacccgctcgctgctcgccgcctcgccgcgcatgtggaaggggccgccgcggacgcctggtgatggaggaggggaagaggaggtagagaatagagataaggtggtgacggaggaggggaggaggaggtagagtatagagacaaggtaggagagatgagtggttaaggtagaataaaggggaaaaaaaggaagagagaggatatgtcaaaaatttgaggtgggtggaagggaaagaaatagtnaatttttctgtgcgggccagataaaaggcccgcgcgtgaaaattgatttttccgtgcgatcctcttaagtcgaccgtacgggataatgaggattatcccgtacagtcggattaagacgcacgcacgggaaaatgcattttcccgtgcgggcattttcccgtgcgggcgataacccggcgcacggggaaaatctatcatgtagtagtggtcacatgaggatattaattagcctaaaagttttgtcacgtggtggccgtcggcacgcaaaacgaagcatgcattattgcacgattaattaagtattagctatttttttcaaaaatggattaatttgatttttaaagcaactttcatatagaaactttttgcaaaaatcgcaccgtttagtagtttaaaaagcgtgcacgcggaaaacgagggagaggggttacactgaccaaataccagaatcctgagtatagctgtagttgcttatgcaagaatctagtcagaacttatttcaatttttgtgtttcagtttgtacatagccttctagtaaggaggctccacctaatttcttggggagtagggagttccatgaaacgtacaatatgtatacggccgctcttagaggcacttgtttggaacaaaccttattgcaaaacaatctcagtgatggcgatcaaacacatatgtaagtacaatttgccataactgggaagtccagataacatcatatagtattgctgtgttaaaactggtcagcaaatcatcattacagtctcacgtcatcatccatcaacttgcacgagcatcctacaattactatgtgcaagcaacaaagaacgcgaccatacttttcgttactggatgcagacatgcagtaatgttacctttacaaatttgagcattttacgaatgtaagttcttttatagacacataaggcgaaaacgcagaaatggctttgtctcgaaaaaaaaaagaaaggcagaaagggcaaaattcgtatttacatgatttacatatctatatcatcaccatctataaagtcttcatcaccatctgatcacgcttgggtctcaaaattctagtctgcttgttcgcatatatagcacatctctcaagcttgttccctgtattagtttaaatatgttagatccatgcccaacacatttatgatacatcagtcaaaggcaacatgttaagaacataagatatacccccatctattaaatttcagttacaaacgttctataactcatcatggaattcatacagatcagatcatttcagtggctaactgaactgcaagtaaatatggtgggaatatcatttacaagacaggaaaagtaccagaccatgtttctttttctattatactaagacaaaaggacatgcaattagataactaggagtttagaaacatcaagaaagaaggagactacagctacaacgttaaatgtggaagtagatttaatttgtatggtgtatttattaatggactcatctccagacacaggtcggaacaaagcttttggctgaactcaagtatttaagctcagttgaaatacttgtaagtgctacactaggtcactctcatcaaagcatacatgcatcattatcatcccgtttccacttggcaccaaattgccgctcatgctgtgcttgagaagtaaatggttggtcagagaaacatgcctgaattaattctagccttgaaatgaagaatgcttaatggaaactagtggagagtaaaaatggaaaaacagaccttgagatgttggtatggaaagttcactcaattaggggagactgacattgattaattctagcctaactggtgtcatcatttgtgctatccttttaacaaactgtgctatctttttaacatgcattacctgtatttgtcatagctgctcttccttatcttccgtatggttgatatctttcctaatgacaaatgaaggtatcggtcttgcatcttgcacacgaaattcaaaaatctcttcatcggcatcaatgcatgatgcactgcctttttgatgttcatgtgactgtttgtcaaatatacacgcattattcaaaatttaatatagaaattaatgtcattcaaaaaatagtaagaatagaaatattagtgcaaatataataaatagtgcaaaaattagtcttatttgaaaatataaaaatattttgcaatgtttaaccattcgtcttatttgaaaaattaatacaaatataaaaatgataagtcatacttaacttttgataataaagcaagtcacaaacaaaataaataataatttcacaatcttttgaataagacgaatgatcaaacgttacaaacaaaaactcaaagcaactagtattgtaggatggaggtagtaatgtaattaaactttactcgataacaggcttaccattacctctccaaggaagagcattggtctgctgacatcatcaccacctgcaggttctctcatattgcgctcccatgtttccaaagccagaaactctggaaaatctagatcttttaccttgttcaattgtgatattaggcgctccatctgatgctgcatcagtacagattcaaataatattaaagaatagaaatatgtaatacaaatgaagtgcaaaacacaagatgatcaagattggaacaagtataaacttggacatccaagagtaagaatagaacttcctttcagtctgcaccttcaggcaaaaataataccgagccaatatcttcaaaatttcttaataggtatagagatgccccactagtgttgtcctttctcatatattcatgtattaaaaacatttattgaaagtttatgcacaatttcctgcataacagaatgattattgctgaatgcagacataataatttagtcactctctgaaaagagaaggccctttcattacaaggaaacaaaccattgaaaaacaagttcatttgctattcaagtaattacaatttatattttttactacaagttgaacaattttggcattacatcattaacatttgatgtgcagaaaatcaaatgtttgtttcttgcaaaaaagggagcaacctccattctttgcagaaaatctttcagttttgcatgcctgtctcttctggcattatcaccatcacccccccttcctccccaagcaagatctccaaagtcttgactcaattcttcattgcaatgcttgcagtgaaaattgttatcaatatggcttacaagatccagtgcattgagggatgaatacctacagctcaacacagaaatgacagctgtgctaaaatcttttaggtggtactatatgtccatataacaatcaaaattaagctttactacctcctctcacagttagggcacacatagttctgaatcatgtagtttccatctaattcatcctttaatttcttcttcatctcgtggatcctatacagtgtgacatcatacacctgcattcaagaaaaacatacacaatgaaaacaatctttaccagattagattaaaggggtttggaaaattggataggactttgcttataggttatagcctacattaaacatgagccagtagctgaaaatgaaactaccagcacattactcaacctgtttagcattatgctaagagcagaaaaagaaaaaaaaagcaatattcaagaaacatgtagaaagaagtcaaccagcttcttcatttttgtgaagttttaaaagaacttcaggttcttcataactactgcctgacctcatttaggcaaatggttatatcatgaaattgactattctgtgttgccatcacatggtaacagaaaaggatattctggtatccagttgtctaattacagttcgatagtatccctaagatgcaattactgattgcctaaactttgatacactgcatgagtccaactgcttacagtgtcaaacaagtttatgttttcagaggtatataaagctcattgtgttatcccatatataaggacatgataaatactatgtgaaggtcatcattagttgcaaacacaaaagttttgtactcttgtaatgaaggtcagcatgcaaaagaccttgtatatgcaaaacacataaattttgtttttctctagacgagcaatatctttgaaaaaagatgcgtgtttgataaataacctgcccatagtgtaagcaacagtagggctgcatgatcatcttcaatttcccagctacattggtaggaacaagatgggcatcatgcgaaacatgggagggtgaggcagttgaaatgcttgcatcatgtattgcctgcgccgaaaacaacacaaggtcagaaggaaagcaagggactagtcgatcaaaacttatacaattatacatatggattgcatctaccagacccaccaacgaaacaaaagaagcaagttcagctctcctgaattctgatgctaccattaatgattctgtaaatatattaaaccctttggatgcttacctacataaatttaacctaaagttgctcctacttatttcaatagtgctgcatgcacaatgtgctgttgataaatgatcgattactgtaagaaaaccagtttaaacagatgacatttttttagtacacagtaaacagagcatgcctccatatatgaataaaaaagactacataggacgaaagaatggactaacttccttccgatagtatcttctcactaatttctgctgttcgagaaaatgggtaatctgacgcaatcggttgaatggaatcatcagacttcttgctaaatcttcctcccggacccactgttgcctgaggcaaaaaagaaaagaagataaaagttgcactaaatcagtacctaaaggctcatagaactgctcatgcacctttcacttagagaagttgtgagtacaagataatggaatcacattaattatcaatgctacaaaaacaccaccctgataaataccctgcaacagcatcccataaatccaacaatacatagaggtctgcactgattattccttatcactgttaaccttttacagtaaatctgagcagtgaattaaccaactcggccacccattgttctactagtgggactcccaaaaaacgtagcctaaaaaaccacaaaagccaatcccccattggcactcgcatcatcattcatcaattaggtaatcgcatccccaccaacaccgaagggcggacacactcacaacaacacaagcagcacggcacaccaccaaggtcagggctccgggtctggctcaggattaagcgatctcacctggtgagggcatcgaggacgacgacgacaatcccacagctgccgctgccgttgggtttggactggtcttcctcaagcgagacgtcctcatagaatcctcgcgccaccatcctcaccaacctaccaaaccaagttgccaaaccgaaacccagtaaacctcctaaacccctagaagccgaagtacgaagcaggggaggggcatatggagaggaaggcgaaggggaagggacctcaccgatttaactgctccatggtgtccatggcggcggaggcggaggacgacggcgagcggcgagcggcggaggattttagccggccgcgcagcgtggcgcggaggcttgagttgaggagaggagaaaccgaggagaaaaatggctaccccgaaatccgaatcacccaactcgacctgccctctttggacttcggagttcggaccgttggactcgacccaaacttcctctcctctccccctccttgcgccggaaggaacaggagaactcggtgagctgaaaggctacgtgaaccggcgcacgctcagcccacgcgggccttttccttttttttcttttttttttcctctcccacgccggtttgttcgaggctcctgcaaattggacgcctgatttttttaaaaaaaaaatcgagcgttattccattatagaccggaattgtttcactaagtaaatcaaaaatgtttcaatatggtaaaaagctgaaacacaaccaaatcacctcatgaaacattttgctacaacgtatgaaacaacggttttcaaaaaatgggcgatgtttcaccctcaatgtttcagcaataacgaaagaacatttcaattcttaaaaaaagtgaaacatgctcagatggctacatgaaacaatttggttcaatgtatacaacaaacgatttaaagccattgcaacacttaaatcccgtgtacatcaacaaaccacgtgtccatcaagatggaaaatattaaacggtacaaaaatccactgcaacatttcatccatacatagtaaaacatcacgagtatacttgctgaaacattgttggtgaaataaaaaatgaaacgaattcccttaatagggcgttttcgttatatcgggacgacggttgcaatggggacacgcgtggtgggggacacatggagcgtggtggagatgcatggagcgcgtgtgggcggcgggaggcgcggcgcccgatttttctcccacccattgggcgtccaatgtgcggcattttcgcagtttttttctcttccactccaggccgaataaggacattttcttttcaactccatttcctttttttatattgtgtgctttcaaataaatttaaatttgaaaatttcgagtaaagtttctactaaaatttgaaacctccaattcaaatttttaaaactttcaactcaaagtttggaagctcacaaatcaaaatttgaaattttatttcatatttcaaaattgtcaacttaactatttatttgttatttttattatagaaattatgcttatcgcggcatagttctagcgaattgagttggtaaggcctcttgtttcgtaacctgcctacctgagttcaaattgtaaacttggcatgtgtatttagatttacggctaattattctttcaataataggcaatgtacccgtcaacagcgagaccactattgtgacttcgtcaattttatgatatgcctgcctaatcttcaaatgtacttatatgagtaaggtgtgcgtgcgtgtttatagggggtgagtgtgcgcgtgtgtatatgagcgcctgcatctctacggtgggttttttaaaaattttttgtaagagtaaccaattactgaatcttttgcacataattgcaaagattattctattaaatgccaatgtgtaatttaaatggttttggcatacaaaagatataacccccatttcatatctcttgcttgcatttttttttcagtcttagttttagataaaccaataacttctgatacgtggtacagtggtaagcttagataggtcatagatggtcatagatttattcggtctttgtgtatccatcctcttatttgatcaatcttcgttgctaggcaacgatgtagtgctagaaggcatgacggaggcaagatagggacgataggtagacagggagccggtgagcggccggcataattgttatgctgttttttaaaaaaaaaaatttggttaattgcatcgtgtatagtataaactaactgaaattatcctttggacgatatacaattacagaggaaaaaatagtctcgtgcctatgatatgttaggtatgatccacaatgatctcaatatgagttgcacatgcgtgattactagttgcgaataaaggcacggcctccacggggcgacaatgagtataaacatgctatctatgtcaagtgccatatctctgaaactacagcttgtcaattgctatgtcccagatcacatcatatattgtgttaaaactggtaaatgacatcatcatatatttctggtgtcccttttctaatggctacttatacacaagcgaagaccagtgtatcattcgctactgatcctcagaaattgtagcatttgactactcagcaggaggtatacagttcttctccacaagcttgaaaagcaaagtgcggaaggcagaattcatttttagttgatttaagtcaaactagtttcatatactcacggtatgaatactgtgattaaatgtccaaccattggtaatgtatcaaacttgagccatcagtcctactgtcccagtgtttcaaacttggaccacttagcacattctgacattaaggaagtaagcaattcttcagccctcttcccattcataatcattacaacttacttcttgggtctccacattcagatcagcaaacttatatacctcttctatatttcctacagacacattagatccaaagtcaacacactaaaagataagatgaaagtcgacatgttaaaaaacatcgcaccagtgagctttcagttcaaaacattgtatgactaacatttttgacatatataaatcgggccatataattagctaactcaaccacaagtctgtgaaacaaaaaaaatggtggtaatatcatataaattcaaaaaatgataacaaacaattaccttttcattatagaaatacaaggggtatgtaattagattactagaaaatgctagactacagctagaatagttgttgattaatattttaaagaaatttttttggctcttatgtgaaattatagataggaacacaagttttgatcaagaaatacctgttgattgcctcactttcaattcaatgccatcatcaccagattcaccaccatcatcacgttttgatttggcacccaaccgcctctcaaactgtgcatcagaagcaaatggctggtcagaaatacatgctaggctttcttcttgtatcgcccttttgccctcatcttcctgccttttctggatagcctcataataagcttttgcgtatgcctcctacagcattaaataaaaggtgaatttatatttaacattcactctactagatagttcttgattgtgaaacttataattgatattgaaatgcaaattttatcagatcacctgtatgctcttcatctcatcttcctctgagagctgtttcttgtcactcttggcttctgaactttgatccagatttgcagtgttgttgttttcttctttatgttcccccgcgaggactgtgcgcttacgattcatccatgagtgctgtggctttatactttccataccagattcaacaccttcctgtgcaccagtacttcctaagaaattaacttcaacctggaaaggagaattggattaatcaggcagtgcaatatctagtttaaatgaagtaaatttcacgattagtacttacaggggcaaatcctaataatcaaaccattttattccaatctagaaagctagtagatgtttcaggaagcatagaaattctagcagtattcccagcataacaccatggtcatgctatatgcctcaatcaatgttgcctttattggctccacatttatctaaatttgcacctttagttctaatgaatacagctcaatgcatataccaggcttacctctgtttccccaaggaagggcattggtttactgctgtatcgcccttctgaattctgagatgaaccaactgcaccatttgcagatgcccctatagttgctctttcccaatcttgcaaactcataaaagatggaaaaggaagatcctttaccctgtcaagtactgctattagtggtttcaattgctcctgcattcatgcatgttcaaatgttagagcagaaatctataaaacgcagcatcacaatccacactatcatcaagattctagaacatgcactttgccatccatgtttaagctaaaaacttccttgcagtcagcatcttgagggacacgcttagccaatatgggagaacatacaccgttgtatttattttatatacgagaaaaatgcattagctgaatcataaacatatacaagtgatcagcgaagtgatgcttcatagatgacataaccaatatatatagaaatattttcatctttgctatagatgttgaaactatatatatggttcatatcaaagaaagtccttctcacaacaatgaaatgctatattgttatcgtgctattatcacaaatgcgataatggttagagagatgctaaactatgtattgtctatgtgcaatgtaaaaatttatagaaagtttatgcacaatttactggatagcaatctgattattggccaaaatgcagattcactaatttagtttttctgaccaatgtaaaacaaatttaattattttccgatagttatagtatgtaagctgtactaaaaactgaacaattctaacatcatttatgtttgatctatgctcccaaatttggtaacaaatttctaactgaataaaaagtaataacctccattctttgctgcatatccttcagtttatcgtgcgtatgctttattgcattgccaccaccacacacaatttcatccaaagtaagcttttcactttctggacgaagttctcctttgcaatgctcgcagtgaaaatagtcatccatatcgctgacaagttgcagtgcatcaaatgctgaatacctatggttcaacagagacaataatgtaagcttcatttttttatgtggtactatagatccagaataatcagaagtatacttagtaccttcttttacaattaggacacacataatgctgaactgtatctctgtcatctaagccatctttcaattttttcctcatgcggtgtatcctatatcttacaacatcatacacctgtatttcagaaaaatatgcacattacaatctatatcagattatgaccagatcaaaagatgtttttggatcatgggatgggtaaggtacaagcagattttattctaagactgaagatggataatgttatctctaacgctgtggtgagagacagattttatctcactttctgttcaacaaattttcagtaggattctgtcctaataattctaataaagccaaatgacttagattttgccaacctatggaagagaaaccaatttaatcaaaacacccaccatgcatgctgaaaaactgcaatgttcaattgaagtaatttatatgagaaggtccgcttgtgtgatttttggcccatgcggttttctaattatagttcagttatacccctaagatgtgattaatgatttctttattattcggtacaaaacattgcattaagtccaagtgttcacatcttataatgttaaacaagtttccatgcacagagtctatatcaaatctcagtgagctctaccacacgtaaaaacataagaaatagatatagtgctacaatgctacatgtcccacacatgtgctttgtggatcaatgtgaaaagtcaaatatcttgtttatgcgaaagatttcagcaaacaagtttctctttcattagagaagtattttttccctcaaacacgcaagagaattacgcgtcatttcgttaagagaggtgggggggggggcgatcccaccccaagagtcagaaaaaaacgtcattagagaagcaattgtattgaagattatatgttcaatcgataagtaacctgagcatagtccaaacaacagtaggaatgtgtgtgcatctttgctttctctcctcccttagtaaaaggatgcacatcaccagcggtggcagagacatcgttatatatgtttactccttttggttactgctatgacataaaacaacacaaggtgagaaggggcaaaaaaaaaactgagaatcagattaacaaacaaagatgactcctggatgttcatattgattgcacctccgaccacacaacccagaaaacaaaagagttcaagcaatgttcaggtcacctcatgctgtcattaatgatcctgtgaatgttgattgtcttaagctctttggatgcttatgttcataaagtgaacctaaagttactccttatttagcaatactgcacacacgaagtgattcagtgtgccaagcaaaacagtgtaaatagaaggctaaattttttagtacataggaaaacagagcggccttcatatctgtaagaaaatgactatacaagagtgtgtggcgcaaatggtatctaaagagccctatacaacaaccatcacaaaaaacaacaaaaaatccatggcacacatagatagtcagatttaacgaaatatgcatattccggaaaatgggaaaatgtttaatatggactataaaaaagagcatagcacacacatgtttatgcctctgcagtatcaaaacacagatgaaatatacatgacataaaatttcatttattgaagtcccacctaagttctgctgaacttttctgatttgtccatgtaagattatacaagtcattaatgcaccaaatatagttatgcaactaattcatttcccatgtatttccactaatcacgtacaagcttatgtgaagtaggtgctcaaaaacatatttctggcactcattctatagtctaaagaaataaaataataacaccactgcatataaatgtggataatttgtagaatatcttgacatcttgactcggttggaaagtggtcggcagtttttactttttaggataagtggaaaatggctgagggcaaaacaggtagagagaaaatagaaatgtaaacattttgcaaaaagaccccaacatgacaaatgctagagatgcgcaatctttaatagtggcgattcactactcacattgggagtgggtggcatatcctacagtgccaaactgagaggccgcaatcgttgtctcactcttctatcaggtcttgctttcagaaactactaataaattaacaacttctgttttaagtggagtagatggcgattccatgctagaataaaaaaaaaaggctatgcaaaaatgagaacaactttctctcagaaatttctaacctccttccgatgacatcttctcaccagcttctcttcttcaaaaaactggagaatgcggcgcagttgcttagaggaaatctttaatgctttagccaaatcttcctctcggacccactggcgccgcctgtggtaaaaaaaagtatcacaattgtgcattggcactacatataaatatataattagttacacacgaaagaagataataaatattgaaatgagagaaaaaatgtttcagagagagagacagaagaaagataatagatttactaagaagactaaactctttgtgatcagagttggacaattgaagcagcttctccaattgctgatttccatctctagtaaccaaaattttcttatttgcgaaagggcaggggcactgcctcatgcattgaataaaggaagaagagttatagtaagagagagtgaggagtggaagccgcctcctcacacaagcccgaaaacattacacatacactataggaaaattttattaggcttgacagaggatgtacactccggggtgcgaaagataggattaaggaggagaaaaaaaatgaatacagacgtaagggcatagtagtcaaaactgagcaagcagcattataaaaagaaaatgtgggacatcaacgagtaccatgtagcactacttatatggattaggagggaaaatgttctctcagcagttccacatggataatgagtcataagaaattatttgtttcataatgttgtatacaaactggatctagttggtgatagtggtgattaaccattatttcaagttgcatatttggaatgaagctatcaattctagatgccatagatttgataaacgacaaaccatgagcagcagttacaccaaaacagtacctaagggatcataacaaaatcgttcatcattcactctgaaaaaaatcttcaaaaactggatctacattaccaatgcttgtttgagcactgaacaggacgttgtggccaacctgctttaagaaacgaaataatcaatttaaccttgaaaaataaatcctggaccatatgccataaatttgacaatgcacaggcacaaaaagtctgcattaattatctgttactgtaaattctccttgcctaaaatcgcaagaggccaagagtgaagagcagtattcaacatgaaggtttcctcattggcgctagcaactagcatcatcaatcaatcaggtaaatgaaaccaacagaacatgtaaggaacagaaacacacgcaacagggcacattgataagcgacagcaccgaggtcaaagctttggttcaggatttaggtttgatctcactctcacctgccgagggcttcgaggacaacgacggcaagcccacagttgtcgccgcgagcggacttggggtctctggccagcgagacgtcgtcgtagaatgcgcgcgccaccatcctcaccatcctgccatgccagccaaaaatccccaaaccaaaaccaataaaattacacctcccgcagatgccaactatcatcaatgcagcatggatacacggaggggagcacagtgggaggatccgcaccggttcaagggctccatggaggccatggcggcgacggcggcgacggcgagcggcggttggggtttcgcgggttttcgccgcgatcaaggaggttttagccgctgcagcgcagggcgcaaggcttgaggacgaagaatgcagcgaccgcgccgagttggttgggttgggtttcgtttcgtttcgttctcgagtgtaccgactcgtgtgggtcggacccgagcccgacacgactcccctctcgttttaagcggtttggactcgaacccgactcgaccatttttcttcttctcaccttcttgcggtggaaggaaacacgggcgactgagcagctgagtccaacatcgccgggagagagatggcggagacatcgtcggcggcggcggcggcgcagaccgacgcggagagggaggaggcgctggaccggatgctgacgcggctggccctcgccgaagacgcgcggctcgcgccgctgctcgcccgcgtcctcccctacgccatcacctcgctcgcctccgccaccgcatccgtccgcaagctcgtaagcataccactcctctggtcctgggtcgattgaaatttgtatgtgagacatatgtgtaggtgtgtcattattctccttcggttggtttagttggtctcttggttggtgatgtttacaatgttcctgcttcaatttgatgaaattcgagcaacagtgcgtattatagtgttttagtgatttgttcatgtacacataatcttctaaacgacataattagagagactattgtgctttatgttgcaagaattacttgcatttgttactgtaacctgaacctattcagaggtagcagagtgccagtcctgttttccttcagttctttgcatgattctatagcataatttccatgtcaattagacaatggcatgtaatggaaaataataccatttttggactccattaggttatggaaattctcagccacattaacaaacgggtgaagcacaggcctgagatttcactgcccatgctggatttatggaggatttatactgaatctacttcctccacaatagtccggaatttttgcattgtttatattgagatggcatttgaacgtctgctaagtgaggtatcctattctgcttcgtttgtttctcattttctctaggctgttttaccttttctgcaaagccaacaacatgaagttaacattctgtaacaggacaagggaagcatagcacctgatcttttaatcaacatatcaaatgttacagagcagcatcagggaatcatcttgagacttgtggtgaaggtttgtcacaatttaattaagactgttgtccaccacagagtttacacaatttagtcaagtctataatgatttttgataagttactcatagcttccttttcttcctttggtgtatctgcatcctaaaaagcttgctagtttttctctgtttttttaaatcttgttgtcaggctattggtgaatgtaacacacataaggtgggtgacaatgttgcttcaaaatatcaatccataagtggatctaatgatggtctagtcttcgctgacttctgttttcacacagtactgtatcaaacaccacctcaagggtaggtttccttgctaaattaggtacaagtatgaaacttttttttatttatggagagttgactgctagtattcttcagtgttggatgcccggcaggactttcggttgctcaatcagatcgtgttactggaaagcagccactaaaaggtgacacacttacatcaagaaaggtaatacagaaatgcatgtatcatttattcatgttatgcctgtgtatgcaatcatgtcagcatatacattcgcacattttaagtccttgagtatagtaactgcaccttcttacagttgaatttcacttgtgatatcttcagctaggaatcttgaacgtcattgaagctatgcagttggcaccagagattgtttaccctctttatttagctgctgcttcagataggtacttttttggaattatgtttacaatccgctgaaatgtttgtacggatcattaatcatgaggatcactgtttcaatgaagtcaagagtcagttactaagagaggagaggagttattaaagcgcaaagcttcagctgtgaacctagaagattccaaccttatgaagaaactgttcacactattcaatggtatgcattaaggattttgtagcatgctaactcaagcaaatttatatttcaatataatactgtcactttgttcttatgtattgtcatttttgttgggtggcatatgttattctgtccttgaggtgactaaaatgcattgttgaaatccagttccttacataaagggcaaagctaaaattaaaatcatctagtataactttgcctccacttcaaattatatatagaaggctttatagttttctcgagctttattgttgcatggtcaaaagatgggtgcggatacctttgttgcccctcatcttcataaccctagcaaggtccttttggtacagcacgtgtctattccatgaacatatttcctccagcctagtcccgaagcagtaggtcattgggggtacccctccaacaagtttcatttaaaatatatcactcatgaggatttactgatcctttttacaccatcttctctcaccttgtaattataactaatgttctcactaactgttctcttccgtatttttaactgagataacaaggtcatgtcctctccttctcttgttttcatacccttcttaatacttgttcccatccaaagtaagccttacattttgtaaaggtttgtgtatgttagcaggccagcatttgcacatggcactctcctgtaccaacatgtacacaatgcttctctttattttgttttgtaaaaatctcttgcttgtttttatcagtgcaaatctgaatatttgtggtttctcatggtatatgatagatactgttctcttttgcctcaggtactgcaagtccagaaaatatagctgcagagctgaaagtcgccccagcacatagttcactgcgagtccgccttatgggtgttttctgccgatcgattgctgcagcaaacgcattcccgtacacacttcagtgcatctttggctgcatctatggtattctgtttatatatatttttactttgtgtatttattttagttttcttatttgttgtcatgaccaataaaatgaaattttaataagctgtgtattaacaaatgcactcttttactagttttgattatttacatcaccaaaccacatctttaagtagtacatagaaactgatttggtatgtttgtccttttgtacaataatctttcttttaagcatcttttagagttttatggaatggtaggagcagcagaggatgatcttctgaaaaactattaatatcaaattaacaataatgtacagcatacattacaatagaatgataaaagataaaggtgggcctagaaatttatatctggaacaagtgaaagagttaaaagatatgggctagggttcatggaggataaacaccattaggaggatagcaaggtggcagcggctccctgggatgagaagtaggcatagactgggatgcagaacattgaggacaatggattgatattttttcttgctaacagtgacatccttatatagaggtgctagagcccaaatgatagaaactaaataaaatcataccttggatatagccatctacttccatgaaatatctaacatagaaactaataatccttatccccaaatcaattgcgcagcccataacacatatatgcatgacttcctttaaagagggaaatgcaagatgaggacttcatttgctttttaagtgtctatttctatgatatggaacacattctatgatatttcttgttatgttgcattcaattcattgctaaaactactcaattgacatttcagcaaggcaataactcaacttcagcatgccatgtatcgttactaaactcatatttgtttctgctgtgtttctatgcctgaaggaaacgggactacttcaaggctgaagcagttagggatggagttcactgtctgggttttcaaacatgtaggtgcactttgtatgttttcagttcaccaacattgattagcttctagcattctttacttgtgctcttccaattttagttttttcacttggagcagttctgttcctttctgtcaaccttgtttcatggtctcaaacttttatcaattatcattgtttccttattgatttaggcagcaaatgaccagctaaagttaattggtccagtcattctcagtggaatattacgttcacttgatggttcttccactactgaagcaggttttgcacttgtcatcgactctacttgtttaggcatgcatgtgatttatcttcacatccctttgctttgaattacttgggttttaacacttctttgacttcctattttgccatgtcaaataagttgagaaacagtgaatgatttattgatttcctttatgtccagattcttccagtagggatattaaaatatttgcctaccaggcaattggtttgcttgccactcgcatgcctaatttattcaggtatgcccttttcttactcttctgctttcttgcctcgtgattcatttctgttatggagactgattttttctactttttatgaacattgcagcaacaaaactgacatggctatacgactctttactgctttaagattagaggagcaatctcttcgtttgacaattcaggaggcagctactgcccttgctacagcatacaaggtacttacttgtaggatatgctaatttcctccaaaatggtgctgtactgctgtcctgacctgttaaaaatgttggcaaagatggttgtgaaatgtgtttcgagggtgtagtgatttccctagggtgctgtacttctgtccttgacatttctcattattttgaatggtcagatatttttacgctgtagttgattaatgacttgatgcggaacaaacttactagttttgttgatgaagcacatgaatggattgtgacgccccatggtccaaacatggtacaatctatccactttgctggattaaaccacatacattgcaattctttgaagcttttgatctcgtttgctgcagttgggttaacctggaattgccttcatacaccaagttttgtatgctgcattgtcacactcacacctttcacatccaacatagactgactaacccacccccatccattcacgcacacatgcatatggacctccaagttctggcttggttagatgctaaaagatgtcttgcaaattgcaattttatattcttgctattattttactgaaagaaaatcttaacatgtgacttgaaatagttattcgttgaatgtgttcttcgttctaattataacagcatgtatctaactcatttcctgacatcaaagcgaaaagggtaatgagcgaacgttcgctataagttgatcccgcgaatcagaagggggaaattggaggacacgtattttcttcctttttcagtttcctttttccttcttttacgtgatttttctaatccgttgcaaagtctcaaccatctccttttattttctcacttcggtttattttcagatttcttttttttcgttatagtatttttatagcctttttaatggaaatttttatataaacaatttctgtgaaaactttctatatatagaatttttatatatagagactttatatatgtaaaatttatatacatatatatagactttgtatatgtaaaatttatgtagaaattacgtgtgtagttagaaagtttagtgcatataaattttactagaaataataaaatgctgacggaatttttttaaatgtataatatccgtggaaaatttctatgtacagactttctatatagagagactttatatatgtaaactttatatatatatagattttgtatatgtagatttatatatatatagattttgtatatgtaaactttatatagaaattatatctataactagaaagtttagtgcataaattttattagaaataaaaaaaaatgctgatcatcatcacatatttctcaaaaaaaatccaatccgaacaaacctcctaacagaaaaaaggataaaacgaaacattgatttttttccccatcgcgtgaaatggaaacgggaaacgttttcctccttttttgctgttttctattcgccgctagcgaatgttcgtgcattagacttacccacatcaaagttagtaccgcctggagtgtaacagatacgtgctgaggaagacccttggcaagaagtagaaatatagtgctcaccagttccatgaactgagggagggagggtgggctttgcatggtatggggtagtggtaagtaggtacatgccatgattgtctagcagttgagggaggactggaggagattaccagttcagcttgcaacagagatcaacagataagtccttgggtttggttaagagataagtttaatcaggagataatcattagttgaggtattcttcttaaattgtttgggattcttgctgtctgatctatacatgcagccactagagaatgtattcggcacagagggaagatacaagaaggcaaatgttctgttgagtgttgacatttttgggttttacatacttgtgacttgtaatatttattgctttgtcctgttactgcatcatgtcttcagtcagtgtcgttcatatgctgttatgttactccactttttctggaaatatatttgtgatttccttttttcttaccagggtgcttcggttgtaatattgaaggatattgaggcacttcttttggaaaattctcaaatggtaagttcccattcttgtcattgtagattcttaaatactcgagagcccacagctgcatcaaaattttcctatctacagttgaatttgtgggtgttacttctattattttttctcagactcatctagatatatgtgaaagcaatagtttgaaaagatggaatatttaattgtttatatgttgttgattggcctgatgagaagttctattggaatacaactatatcttcttacttttgtgatagttgaaagttgaaccctactgttcgaggaatgcaagtacttttagtcatttagattttgcatacttttgtgattttacattttttatcttattttttcttcaaggagcaaagtgaggtccgattttctgctgtaagatgggcaacaacactatacgatatgaagcactgcccaagccgatacatttgcatgcttggtgcttcagatgtaaaactggacataaggtttgttagaaaagatcttgccgagttgttgacatcttgtttcctttggtttctatttattatttttaaaaaaaatataattatatgattatgtttgtcatcagggaaatggctttaactggtctgaatctgttaaatgatgaaagggagtcatttgcaatagcaactgattccaactatcctgatattgcagacatggtaaattatgtatacagccaacagcctcagttgctacactgtgatgagcagaggaacggaaaattgcttttcccaacaaaaacatttcttgcaatgataaagtttctaatgaagtgctttcagaaaagtgatggctcggattttcttcaagaagatctatctaattgtccagtatcaaaattgtgtatcattttagaacatgccatgtcatatgaaggatctagtgaacttcatgcattggccttgaagtcattggtcgatatttcctctcgtcaaccaaaggtttctgtcctatattatctgttaaagcaaactatgctttcttcacatgtttaaacttttccttttttaattttagttggtgtcatcgcgctatgtgaaccgtttactttggctaagaactttactgggccatgttgatgctgatgctcgtgaagcaacttcacgtctgcttggtattacttcttcagccctttcaagcactgctgcactggatcttctctctgagctcacttcaacatttgatcaaaatcgcccatcaaggtatggaagagaaatttaaaacacaaatccattttctctgtactgttatgctacttctaattcacgtggatatttgatgaattgcaccagattcgaaaattaccatggattgttatgtgcaattgggtatataactgctggttgtttaaaggaatcttatgtaagtttatgcttctttcatgatactattttttttgcagtttgtttatgtcatttctttgctacatgtgctttacatgaaagtttagtgcattcgctgttcgcttgacaccattaaacctatcttgaatataatttaatggtgttatatcagaacgacttgatgggcatcccattagtaataccatccatgagaatcctttttgttattctctagtactaagaatatgaaatggactagtgtaagacggttcttgtttggagtgtcatgtgagggacagaattgcaggcagggaaagaatgagagtagtacttctctttccataagttaaatgtgttttgagattggggattctaagaaagaaagggatgaattacattataatttacctatgccatacaatgttcagttgttcacaaaactataggacaacacaagaaactatgttgatttttatttttattctttctctctgtttttttcctaatataaatctttagttaattttagggtattcccgtgctggtttcttgggcggttaatgtgccaaagtggctggggtgccccagggaagaaggcacaagggacagtctgtagctaggcagttaa

SEQ ID NO: 60183 - DNA, 2428 bp, Oryza sativa
agatcatatgactatgagactgttaagaagtaattttcaaaaagagagagagagagagagagactgttaagatgtgttgatacttgatgggcttttgaagtcggtccatacaaacaaggaataagtctattttgccaccctcaacacatgctcttggttaaatctcatccctcaaccgcaaaaccgggtataacccgtcctctaacttctaaaaccgctacaaatcagactcttaggatggttttggaggcggtttcgtcctacgtggtagttgacttgctgaatcatcaagcgggacccacttgtcagcggtctccacctcatctctcctcctctttctctttcatctttctcttctctcaccttctatcgacacagaggcatcgcgcagcaacaacgcattggggaggagtcgtcggctggccgcgttgcgccgcacgcgggggagcagcctggctcgagcacgcaaaggaggcgggagggcgtcggggcatcgtctgagaggggggaagaggggggtcgtggaggatgaggcagccaactacgcatggggaggtggtcatcagccggccgtgcgcaaggaagagctcgtccaccggccgcccgcagggaggatctcgtcggcctaccaagcgcggggaggggcacttcagcatggtggccacacagggaaattcgtcgatcttccacgtcggcccggctcgagcgcgcagaggaggtgggtgggcgccggggcattgtccaagagggggaaggagatggtcgtggaggacgaggcagaggccgcacaggcaaacccctccacgtcgacagcagcgacggtcggcgaggaggggaggcgtgaccctcgtgctccatcccgccgccgcctccgtcaacgccggtcggcgttatgcacctgagaggagagaaaagttatagagagaggagaaagggtaactaacgtgtgggccctgaacgtgcagagatgtagcatagagggggggtgaataggctttcctgaaattttctcaacaacgcaagcggttaaattgacagggccggaaacctcctggtgatgaacaccggaacttcctggcagtgatgagtagcctgaaacttccggagttcttgagccaggaactttcgggcaacagacaaaaacgaaatatgagaagtataacaggtcctaactagtgaaaatcaggcacagggttgcacaagatgaaaatcacaagataccagcagattcaaacactgatcaagcacaagagagacataggcgatttttttttccaaagttcagatcacacggatcctactctccgttgaggtgctccaaagagccaggtctcgattaaccccttgcctcacttatgcaaagatcctagaagaggtccacagccttcaactcaacacttctaggtcgtttctagaattgagtgaccaccaagatccaactcataattccttctagaaaaggccacaagtgcaagttgctctacctaggacaacctctgaaaactcagcacaagaaacttcactcacttacctcgtttccttgcggaggtgaggaaaaccttcacaaactttctcgggacatccacaagatctttggaagctcatgggcgacgcctaaccgtctaggagaagatctccaagagtaataagcccaagtgacagcccacaaggtatccaaagtgctcaatcaaacctaatcttcaagccatctccaaaacactcctacactctcgtctaatctctcaatctcacaagataggctctagatttgagtggaggaagcaaaggaagcttgggagtggctagaaaaccctagaacatgaatgaacagaagtggaatggccaaaaggtgacctggggacgaaattcatatatataacggctaggtgatatcatctagccgttactcacaagtttgaactagaaacctgccaggaggttccggacaaaagtgccaggaacttccgggcagcacttaggaaattttttgcaaataaacggtgcccaaaagttccggccagaacctccgggtagccctctctgtcccggggagaaaatcatttttcaaaaatgattccaaaaaatcttttgactcataaatatgactaagagcacttggtataccctagaaccacacttgaaaccccttttaatagtacggtttttcttaaactcaatttcgaaagtgaaaaacctagtctaaccaccttcgatgatttttgcacttaggaacatttgaattggggggggggtctccttgcattcttagccatcccaactcgctttgggactaaactcctgtgaataaacttgataaacacgttagtcccctttaaccaccttgtcattaatcaccaaaacccactagggggtttaagtgcatgttcaatctccccctttttggtgattgatgacaacatggttaaag

SEQ ID NO: 60184 - DNA, 3005 bp, Oryza sativa
gtcgttacgtgctgccgcatctcggaatggttttgttttttttttttgtttttttttctttttgggttgggttgggttgggtagttcaccaacgcaggcgccgtgtccgctgcgaaccagaattcgggatcagatttgtttcggttcaagcgtgtgcccgaacgggatttgtgttttttttttgggggttagtggaatcacggaactgggggtggtggatcgctggatcagtagatggaactcactgctcgggacttcgacaattgcagcgggggatccaaaatagatagtgacatatttgtcggttcttggtgaaatcgatccgtcaaactagcttcctcttcttgggtattgtatatctgatatccagagtggttttgttcacctttcagatctctgcatattactatactactagtactagttagtgtggaaagccctgagttgactgaagatcacttcatcttagccctgttacacttggttgcagtaataacctgacagttgaaggtgcacactagcaacttaccaaccgaatgttggacgtcctttgtttttggcttctgattattatatgtattggtttagaagtcgcttacactgaaatttccatgtcatatgtgctctttacttactctattgttgcttcaagaaaggggaattgtgaggtgcatttaatattcatgctgacctcaagtgtggtcttagcaaccaatttctgttactacctttattttttcccatttcactgtgtcgaagtgtacaatgtatctgggatattgtgttttagttttgctaggccttgtttgtgctgttagactttctttcgcccattttgaaggcatgccagagatttttttttcccttctaaaattgaatatttcgttctctcattcgtgccaaaggcaaagagcatgttcttttctacaaactgctagtaaatagtaattgcttctatgctctcactagacctttagatccaatggttgttacttcagattatagaggtactagtctcatgatattcttaagtggagactaatctgtgaccaatcccttcttcctgattgaaacgcctgaaccctggcaattagaacttgacctgttctactagtcattgttacctcccattatctgaaagacttaactctttgtatcaaatgcaagtctttctctagtttgtaacaacatggatggaaaccactctctgaaatgctaacatgttattcattcctactttagatcagcgtttgtaatgcttctgttcatatcagaaagcaatccccagatgctgtgtgccatgcatgaatttgttgaaatatagagctctgtgttgtcagaacagtctaggagatgtggtgagccctgtgggcagtgtagtactaagactgagagttggttatttacttatttgtattcagtatggtccctcttgagacagtttgattgggtttattagcgactatgagcacatagctatagtcccagttatattttggttgtagtcgcagcatgtaattggtagtcttgacaaggataggtgttttatccacgagcatctcctgttctctatctttgcatcagtacataattcccctcaaagtagctttcaaaattccagaggtgtagcatggaagcacttctggttgacactatactatccaactactaattatttgtaccatatgtaagggtttactaattgactatatattgtctattatactgatataatagaattgaacagctcataacctgcaattgtcttttgccttttttagctgccgtaaacatgcttcatcattcgaatagccggcaccaaaggaacagaggatcaagagtcaaaacattactccaggctaccttacttctaggtgttgttgtctggcttatgtaccaggtgaaacattcctatgataagaaaaatgagtacttggaagatgctgagaaccagcttgcccatgatgatagaagcatgttccaggggaggaaagaaaggggaggtagttatggtgatggcattctggaaaagggtggggagaaccctgatgtagtaagcaaaccagacgaagagaacattggagaaactgtgtttgagaaagacaatactgactctcatgatgatgatataagaaacactgacagatcaaaagctggtgaagggcatggcagtagtgcagatgggaatacagaagctaatagtaatgatgaggatggaacgaccaatcactcagaaggagagaagagtgacgctgagtccaattcatctgacgctgagagtaaaggtgaagaccattcaactggagatgatatgccccaaagcaatactgtcctagaggaaagcagtgcagagacgaacagaatgccccatgaagaagttgcacatggtgatgaatctactaatgaagatcagtccaatgtgaaaagtgacggatctaatgaaaaggaagctgagaaaaaagaggcagtggattctcaacatgcttctgaatctctgtccgatgatgcgaagggtggaacagatgatgagcattccagtggaactcttcctgatgaaacaggtaatctaccatcagggcagaatgagaactcacaaagtgatgcgacttccaccacatctgatgcttctagcgaggctgttcacattgagactggatctgagaatgaagatgcagcaaaatcatctgggactgcatctggtgatgatgacaagggctcagccaatgaggcatctgattcaaacgaaacaaaatctgatgaaggcaatgtggcagcagaagtttctaatgaccaggctgcaaacacggaggcagggaactcccaagaagcgtctgctgcaaagctgcaaatggctcttcagaagagaccaagcctgtggagaaccagaatgatgggaatacagagtcgtctaacaatggtgagcaggtggatatcaagatggaaaccagtgcttccaccaatgccgagcagaaggaatctcaagtcggcgatggcagctctgggtc

SEQ ID NO: 60185 - DNA, 783 bp, Oryza sativa
tccccccctctctctctcctctttttcttcatcgcctctccttttcttcgcctcggcgccgtcgccgtcctccactctcccgccgctcgcctgactccctctccctctctctcccgccgccgccgcgagcctcactctccctccctccctccctccctcccgttggcggcggctgtgaagacaatgagaagggctgccgccaccgccggagctttgtcagcggatttgttcgtcgccgtcgcgtcatcgagcggtgaacggcgagcgatgcacggatccgtcgtcggtgccgctcgctgcgccgttgccgtcctccccgcctcacgccatcgccgatctccccacatcgtgtcgtcgccgtcgcgacctcctccgcctcgcaccgtcactggccggaggcggtactctctctctctctctctctctctcgtcgctgcctctctctccttccggcagccggcgagggtagaaggggaaaaacggggggagagagccgtgtccacaggctcctccctagccacagccaacccagtgcggctcctcgcccggtccccagtagaggagctcgtagagccgcgtcccttgcacaggggtcgcggctctctgctaggagacggctccggccggaaaagtggacgccgtgagtagggatacgccccaggggcatccattgctgatgttttaagctgcaaagaagctctgcaacacagtcaaagagagaatgatgaccgctgcgacgagtgatgtggccagccacgggttgctgaagtagttgcgcaccag

SEQ ID NO: 60186 - DNA, 1495 bp, Oryza sativa
gcggcatttatcctccatggaagtcgtttccgatgggtgcagtagtgcttattggtgacacgcgtgcgagcggcgatggtgcactgaataaagatgtgcttagctatgtaatggaacttgttttgctgtagtaggctgggatatgatgtggcaatggcctctaactattgctgttgtgtacataagcatatgaatgcatgatttgtaatggtcgggtgagcccttaatttcatgtaagcaacttacattgcagtgttaaagagtttggtaatggaatgacatgattagaacttgaactggaagtataagttgtcaagaatttggaaatgtcatttggaaatggaatgacatgattagaagttgatctggaagtataagttgttaccccgtgcgaacaataattttgcacgttatatatgtatgatttagaaaatatatgtttggtaaaagaattttttctgtcaggtactgaatgggtaacgatcaaaattaaaattttatgtagtacagaatgtccaacgaaattttatctagtatagaatgcgtaataccagcaaactgagatggaaaaggtgagggaagcaaagcaattttctgggtatcgaacttggtcagtcatcaaccactcaaagagctatagcacctggccttaacaaccgatcaaagcgaaagagtcgatcgatatatgaagcagtaacaaacgatcagcggatacaggatatcacgtacaacctcactgtcgacctgatgaaggaattcttcgacatgtttcttcagatacgaagcaacaacataatccaatcagaagggttgatgacatcattagatggcgatggacgaacaatggaataccagtgcaaagtcggcatacaacacaattcaatgggagattagattcagtagctgcaaagctgatatggaaggcatgagcactttgaaaatgctaaaaaaaatatatggctcctactataaaataagataaagatggtaaaccagctgcaaatccgtcagtggctgaacaattaattctgccagctctatgacaaaaaacctcgaaactatgcagcatgcacatttgtacgccaaatataggagaaaattatgcaaaaattgagaagtgatgttctaagcgcacacaatggcgacgaaaccttgttgaactagtggatcaaaggacatcccaaggtaaaaaaacacaagacaaatacaatgaaattgatcataaaaaaaagttgtggcatcggagatatggtgtgaaccgaaaaaaagagtgttccacagtaaagagactaaaatgccataactagtgtatgacatatttttgttgaaactgttgttatgtttttctataaagtcaacttgaagatgggataaccccaatatgacttatacgagtagtagttaactcttctgcttgtacctcgattatcatcacataataaaaaaatctactatctattcatccatctagaacaatctcaaattgtgactatat

SEQ ID NO: 60187 - DNA, 725 bp, Oryza sativa
ctacaatagccactgcatccttctgttcagaggaagccaggatgagaatcccagcatcacgaaatggaaacacccctattaccacgttgtccggtatttccatcttcgtttccttcctaccatagcaagcaatttgtctaaaactacctgtcctttcatccttggattctcaccaccaatggtttgtgttcagtgaatgatctaaccatgcgtcattcacagttcttcgttcttgtctttactctcatgattttctctttgttccagacttgccaatccaaccatgagcatgtcgtttgctctgaatgctgagccaaacactgtgtggtataataaccgctccctcctccagaatacattttcagatgacaatttcttgatgcgcatcttcctccctcatgacattgcagttccaagtataaatgatagcatcgttccttcatttgcttgcgggttgttctgtgcaggatctgcaaccagctgtgatgcctacattttttccatcttctttggctatgttagcaccgatttcagtcagcggctgcggtggcccgagatagtctggtttgccaaccgtgatcatccagttggagagaatgctactgttcaatttactgaacttggggatttagtgctctatgatgcagatggaacacttgtttggtccaccctacagcgaacaagtctgttgtcagcatgaaccttacagggtcaggaaatctggt

SEQ ID NO: 60188 - DNA, 7556 bp, Oryza sativa
aaattttatgcagcagaaggaatttggactactcgcagcctgaagaaagctgccatctcatcagcatgttgcaggagaaggccaaaaataaccagttgatggaccttatcgatccatgtttctttgatatggaattacatatggatgatgttttatgaatgatgaatttagcaatgtggtgcttgcaagtcgataacaatagaaggccttccatgtccatggtggtcaaaatcctggaaggtaccatggatgttgaaactgaacttgattttgacctggtaaacatagacccgatggtagtagcacatcgagcagctcaaaggaacagtattactttgcaggtagactctgtcctttcagggccaagatgaaatacaaggagctcaaatatattcttcaaagatatcaagctcaagattgaaaacacgtactcctgttttcctatactatggcatttagataaacaaagatgtagacatgtagtgatgtactatagtgataatgattttttttctgttctccaatgcagcagctttatatacttgtgatgacaaacatttgcagttgcaaactgtatggtatctgttgctaggaactggaagatcccagagttctctctttagataatgttcccagacatatatagtcatagataacttccaatgtctgataatttatattaagtgtgactctggaaccatctctttataccttcttgccttcttggttcactgaggtattcgagctgatctcctcataattgtgaatactgaaaagtaacttgttgcggcgctgcaaggatgctatacagcaaatttcttgagtaactccacctgtaggaatttaccaatatatctatttcttgattgtttgtttaagtcatgaaactcttataatctactggtaaaagccatgagtggactggttgtcgtcttgccaactagtcagcatgcatatgctccagcctccaggagtccaggttgtcacattattgaatgaaatacaagtcattttcagctgattgaataatatatatagtgttaaaatcgagagatccctagaaaatgatcaatagaagtatacgttattatagctctacatgcatttgaaatggctagttcgacctgtctgaaattcctgtgctaccggtgccccctgatataggggatcgctaatgggcgggcgatcgttgtgggcgatcacccccgttccctccctgtcgggtcccagaactaacaacttggatccgacataaattaatatatcaatccctggatcagtaaatatcgatacatacaatataactggttcttcattgcatacgttaaagttttacaatactaagggttttacaataatatgtactcatctaattgatcagctaaaattaatatacagcggaagtttttatacattctgactagggaggtataacctttagggattctctaaattatcggggtcatcgtagtaatagtcataagggtcctcctcttgacctagatctgaaaaaggggttataagagtaaggatgagtattcataatactcagcaagttatcatgaaaatatattatgcattggcatatagtagggttctttgcaaaaagcagaaataaacaatctggaagagttatagcaagaatttataaacgtatagactttatatttctaaccagggtaccatatgagtcccggtactcaattccatgagtacggctattcgaatagtttcaaagatattccactgcagcagatgtacgttttacccgcagttcacgacttgttgataatcatcggctttagtcatggcctagtattaattcattaacaattgtggcacctgttccatgaacttatatcctcatatgccctgaacatattgttaacagcagcaagaggagttctggcgttcccgaggtatttaaggggaaatgatcgtatgacaccacgtcatctcgatcaaggcttataaatataccatatagtttatactcgagtatcacaaaccatttacctgtacatggtaatggttaaggttgcccttcgcggctatagttgcctcctgcgcgaggacttaaaaataagaaccactatacataggtgccatattgctaattaacataataactatgtctgtccccattctagaaactgcggtcaaactcgttcgttcgacataagttcctggtaaaacttatatcgatcgagacactactagccacccggaaatcaaccaaatcttacgtactgtcctaatctaagtataaggtattttaaccatattgtaggcaaagtaagcaatactaaattatctgggtttctatggttgatttatgcatataaaatagaatattgaatagaaggctataaatgaataatttgtaaaatataggcttaaatgaccaaaaggtatatggtaacttgccttgctcgatgtcctgagattgattgatattatctattgagtcagatgaatcctcaagacctagggttagacatataaaattcaatttcaaaaggaattcaaattaaattcaaaaataagaaaaataaagaaaataaaataaaatgtaaaaatagcaaaaaggattcaaaagatagagaatgattttagaagaatattggtccaagtttcactggaattggatttatattttaaaagatatgggcttctaaagtttgaaaatcaattaaatgttaaatgttactgtgtgtgggtcccacctgtcagtctctctctctctcttctcttcttcaacctccggccgatccccaaatgcagccggcggcgctagggtttgggattgtggcggtgctaaagggggaaaggggttgtggccgaggaggggagggagctaggattctccggcgacgacgagcggcggcggaggggttaatttggtatgtggacggcctagcggctagggcggcggtgacatggttaggccgtgaaggcgattgggatgatgtgagttagacatgctaggggaggggttctagagcatctatggagtgcttagatggattccaacagcttgccgacctttggcaaggcgcggagaatacttgctgacgagcgcctccattggcggcggccgtgctcacgtcggtagcccagagggtggcatgctagtgcaaaccgattgcaaaaatggactctaggtagtatgtctatggttgaaacggaagaactcaccgagatcggttgaaacgacggattgcggccggaaaaacttcgcggtggcgaagaacagagcaacgcgggggcggcggtgctcggcttggtgcggcgaggtaaaactcggcggtactagaacatggttgatataaggtgttctaagggatatttagggcggaggatggatggaggggtgtggtgtcgatcgcgcataaggtgttcgatcgacgggagaaagtgattgatgagatggattggtgaagcagagcttcggggttgtggggctatggttgttgatgatcgataatggacaaggaagggattgaggtcctatttatagggctagaaggagtagatgagctcgagcaccgtcatcgccatggatgagctcaaggattggatatggctggggcgacaaaggctgtgagacggcgggcaagatcaatttgagtgatgggaggccacgtttgaatacttaccagcgaaggattggcttgactgcgtgtgaaatcggctagcggcgtgttggcgccaatccgggcgcgacgcgcggtggcggcgagggtgaaaacggccgactcgggggtggatggtttgaattgtgagaggggaaaccaccatctaactttaatctaaccgtgcggcaagaattggcgcgattcaccacgggtagaagcgaaatcgcactcggcggcggcttggacgggagcgcacggcgtcgagcggcgattccttgcggcggaggtcgtcccggctttgttgtcgtcaagattggtgcggtggcggcggtctgagggcgtcggacgggcgacggcgtgccaaggcgatcgggcacgcgcaagcggccccgaggctgacgcgcggcgactcggtgcgcggcgaagtcggacgccagggcggcgcgtgcaaggggaggagaaggccaactaaaccacggtttttgagtgggatgtggtccccaaggatccagcatagactttgcaaaggattggatagggattgggctgagttagtcgagctaggcattctgccgaataccttgagggcaatgaacagtgttttcaggaatttttgaatatgtccctaggaaagaatgaatttaatatatgaatttggaagggttttactagggtttggagtgtagcaaatactcactaatattaaggtaaactaaggaaataatctaaagtttaaaatttgagagaatttgctgaaattcactaaggtttggaataaaaggaataattacggtaaattagtagggttctaaggaagtaatacttgaaccaattaagaatcaaatagatttttaaagcacactaatttaatcaaaagccagcatgatgcagtcaaattttagtttaaaatttgaggatgttacactcccctaaggccctaacacgttcctcttcccttcttctcttcctactacaccataaattaaaaaaaagtaaaaaaaacacaagttagaaaaaaaataaaaatagaaaaaaaaaatctaatactcttatttatgtgcatagactctatacttatgtatagactttgttgtcgagtgacaaccacgtcacgtcgaagaacgtgggattgggtctggtgttttgaacagtaaatggtattgacttaataaaatgtttgggatccccctatcacatggcactaggggctatttatagccctagtacaagctgttactctctagggtttattgtttacaggagattttacatgaataccctcatgacggtgacatctacaggggtaaccaatgtctattgagttatgggcctgctaacagcttcctcggcctgccccaagcaagtggcgaacaaccttctcggaccgatcccgagcgaagctgcatcccgctctaccgaaaggggatgccttcatacttcgccatgagcttcgccatgtactttgtcttcatgcatcgccatgggcttcgccttcatccagacttggcttccggtcattttatagatccctgatggtttcggcgggttcgggcgaaggccctcatgacatgcctccaacaaactttatatcgtaaactttgcacgtataaactttatgtgtgtgtgtgtgtgtgtatatatatatatatatatatatatatatatatatatattatttgaatcgggtatataaacttttgacttataaactttagctgtataaatttactaaaataggaaagtaatgcggtgccaaaaaagtaaaccacgtgaagaggggcctgatcgcgtggggcgaacaatcgcccattaggattttcgcctgatatagggataggcaaaccacaaatttcgaaccttgcactgcacccgaatgctggctgaaaaaggaaagaagatggagaagaaagggaggccgtgtgggcctgagggagaaaaaggaagggaggtggcccgagtgaaacagtgtctctttttattttccatggatttgtttgaggggtatttggaagatttgatatttgaactcacaaagttctcaggatttgaaacagtaacttcataggctagtattttgatggttttgaattggatttgaaaggaatttgagatgggttggggggggaggaaatatgggaaaggacgatgcaaaacggatttgaattaattcacaaggtagggattcataaaatggattttgggttgatgagatagaacccgaatggtagggtgtcgattttgaattcttagaagaagggcttccggggaagaggttgaattccaaaattcaaatttcaagagttgattttgaattgggatttttgaaaaaaaaattataattaaggtttttattaaaatagttttcaacggtccgaaaaattggggcgttgcatgcatggagctagacgcgtttccgattgtttcaaacgaccgcaccggacggtacatgatttggttgggttcgcacattgtagatcatttcagatgacgcactagactttacaatgcagcaccggacttagtgcacgatgtacataatttgaaatcagggtgcacgcgctcactctaatttggacgtaaaaacggcaaacaaatgcacacagtccatgaaaacactaaacactggacaaaatgtctcctctttttatcgtgcttacatgtaggggcaagataactatggctgcgccggtgcatgcatggcctccttgaaggccctggagccgcgaatcctggcgtcctacccactacgggagagaggacgaatggtgagctacacgcctttggcatggtgcccttcttcatcccggaacgtgagcaggagatacatctgtgtttccgtctgcttcgtcctccgtcggctactcaagtatgcacgcatttccaggaggaattagaagcttctacttctactcgcagcaacgatgacgatgacgaggactcgactcagggtgtgtttagttccacgctaaaattgaagtttgaagaaagtgacggaaaagttggaagtttttgtgtgtaggaaagttcgatgtgacagaaaaattgaaagtttgaagaaaaaagttggaatctaaacagtgcctcagatatttgggaggtgttgggtctggggatttgtcacgaccgacctgctgctgatggagaaccagatccctttctttgtcatccagaagctgttcgagtagcttcggatgaatagtgataataaggccattcacagtgtgtcctaaaattttaccagatttcacatgccacatggaccaagaaccatactagctacatactccacaatgcatattacttatagtgggtcttacctatctctctcctctcacttttctcccttcccctctctcctctcacttttcccaccaccaccagtccctcatgggcggaggaagcgaagtggcaccgatggtgagcgtcgcggcggcagcggcgccgggcagggctccacgcctccaactctcctcgtcgcaccgcactcacccccgcccctgcagttccagcagcccgagcagcatcggcggtggtcgccgccacggctgcaacggaggcggcgggagaggagaggtggcggcgctgcccaagtggagacggcgccaggcgggcggaagatacggacgatggcggcgccgagcggaacccgtagacgacggcgccgccacacagagccgcggatgacggcgccgccgatctgcggaactcgggaggctcttctccctctccgtcgccgacagtccgagcggcgacgacgacatcgggcggtcttagcggcaacaacggcggctatggatcgagctcgccggctccgaatcgacgtcggtcgtccccttctcttctcctctgccgcatctcccctcctcctcctccacttgtgcaggagcaagggacagcggggcagctgcgtgaagctgg

SEQ ID NO: 60189 - DNA, 1572 bp, Oryza sativa
ccagcttagtcaatgctttgaattatttttttaaaaaaggaggtagtaagaaataaacctgacaaaagagtttgaacccccactaatactactaagtgatgtggactagggttcacgatcttccgaaagattctgataagcagtcgatttggacggagtcatgacacaactcgatccggcttctgaacgaacacgctcttaagccccgcaatcgcagccccacgtctcctccggttattaaccatgtcgaaacgtgattgacgtcgctgataaggctaatccctgtttgcgatacgaagaacacaaacaagaacaaggaagaatacaaccaaaattacagatgaatgattaagcttacaagttgggatcttacaaaccaatctagcggcgagactgttcttgatagaataatctaagcaaaacctgaaccctaaaggtgacggcgggtactgatatatagagtttagggtcatgcaaacaacccttgacgcaaccctaatgggttccaacacaatatacggtccaaaggcccaaatacggtgacgcaacaccgggacaaattctaaacatcaatttgtttggttgattcctattgacttgaaaagaatttggacgtgggactagaaccattggaaatgttatcttcttagctttccatccatataaagaacaccctaatccgagcatgtatgcgatctgggcgtccgttttagtgcagactagtcttggactccgaataatactcgaagtcgacttggttgagcctccatattgatttgggtgcccttgatgatttccacgcctctaagtctttctctaagcgtcgctttgtcctctccatgattcttaatcataatataatcattagataggaatctattctcaaaatcatgtaaaaaaacgtaggaacaagctcacctctaaattcaattatcgtgcgcgagctcttgtaattggttttttaatgaccggtggaggattgttgtgtatatccaatggagtgatgtcctcatcactaaagaaacttcttttataagcaacagagagacgaaataaacaagactggtatcaaagattgttatgaacttttgtaaacaattgttttctcccaagtgttgcaacggttctttccgaaatttatccgttgcatccatggtagtcgctctctcttcttgacccggtaaacacaaataaacatattcactcactccgtcactcggagaagaacaaattaattaataaacaatggagaatttgaggtaaatcagattcagatagatatatagatagatggatggatacagatgtagtgagattgggcgaggatggagcgttgctgacgacgacaaggacgtcgatggcgagagaggagagaagagcgcgcgcgcgtccggtgagacgtcgccgtcaccgcgcgctcccaccaaccactactaaaacccccccacgtatctcctcctctcgacacggtctctcgtgctctccattcgagctcacgtagtggctaagtgtttgtgtgtacagttgtttgatcagctcgccattgccaatgccaatgccggaatacgagct

SEQ ID NO: 60190 - DNA, 23747 bp, Oryza sativa
attcctgcagcccctgtttgttagttagaccctgtttagttcccatgcaaaaacttttcaccctgccatatcgaatattgggacatatacatgaagtattaaatatagacaaaaaaaactaattacacaaatgcgtgtaaattgcgagacgaatcttttaagcctaattgctccatgatttgacaatgtggtgctacagtaaacatttgataataatggattaattaagcttaataaatttgtctcgcagtttacaagcggaatctataatttgttttgttattagactacgtttaatacttcaaatgtgtgttcgtatatccgatgttacacggcaaaaattttcacccctagatctaaacacagccttagttagattagatttcctcattaataatagtaagctactagtatagtaactagtatagtgttttactgtttgatgatcacttatttctagcagtagtgggctgagactaggggtgaaaacggtaacggtaattcctggccgaccgacattcgtttccgactttctagtggctgagccatatggaaatggcaatcgactggaaaaaaaatgaaaatggtaaaaaaatatggaaatggaaatggttttgctgttataccgattgtttccgtatttaccatattcctgtggcaattaccatttcctataatatggtgattactgtatttctaaatatatcgatatttatagggtatgtctgtacttgacccacagtttagagattgactgactcttcaatcaaattcctaacctcaatatacttatgtaaagttaaatatatgtattctatagtttaatgtttccgtatttgttatcagtttccaatatgtactgacatgtttccgtccgtattattttgtttctggctttccaatatttccgatattattttcgtttccgactttaccatttttgatttcgtttctgagaaaaatatgattatggaaatggttgaggctgtttttcgatcgtttccgatcgttttcatccctagctgagacgtactctaaacacacacagtttcggttgaaatttatggaactgctgggtttaggctgcagctggttgactttagttaacagcacacaatttgcctaaaatttaaggaattactgggttctggcagattaattagttctcttacaattgcagcagcaatggtgcctccattaagtttttttttaatttgtatgtacgtaatctgtcaatgggatgtacgatagatgaataatcttgaactacttctactttttttaaaaataaacttcaactaaatatttttaattattattattattattattattattattattattattattattattattattattattattattattactactactactactactactaccatatatatactccagtttggagtagtacatagagtaccgttgaagaagattggcaacaacggcaggtgacaattccgacttggaatggtgcagatatatacatgatgtatacatgatgaagaaatcaagtcagtgaaacctgcatgtcataatcttgagtcaatagttatgcacctgttcactaactttggatggagattcacaaatagaattcaataatttttatgatctttttatgctgtgagttcttattagttcgtgtatgcttttgtttattctagtgtgagtttttgttgaattggtgtaataattggttgtagctctttgagcaaagcccgggattatattccattatctaaaaaaaaggtggaaaagtctattcgtctcgagggaacaccctttatttttatatatcgtttacaaatcataaaaaaaataacaagatgtagatcaatatacaatatattaataaataaaatacaagctcaaatttaactagaaatagaaataataaattgattccgaataaaacatgtcattcatattgaaatttattttttaactatatatatctaattgaatttacatatttgttgagtgacatatcacatatttaataaatcttattatatttttattaaatttattaatgatattttaagatgacatacaccgacatgcacaagtaaagaaacatagcaccgatatatatatagggtttagggttagagttagaatccccttatctctaagaaggaaggcaacactatgatatgccttggtaaggaactaggcataactttgagtgatcaaagagaatcattcgaggagctaagctatgtttacattttcaaaatcaaatggaaaaacccaagtttctgaactgattgatgcaaaagggaatttgaatccatgcttttccattattcaatcacccaagataatgttcacaggttcatgtgaagcctggaataacttgtatgcatgtttcatatcaaggagatgacccatcttggtctttaaagcttttctcgaggacgagtaaaggactaaagtgtgggggagcttgttggcggtccttaactcatatttccaactgccaactctcacataaaatctgcataaacaaacaccaaactttgcaagacttacacataaataactaatgaattccacgagttttggtgattcaccattgtttgcaagacttatacataaatatggtggaattataaagaaaggcacattccgaaaagcataaatgtagaatccgtgcaaaggaacaagatgaaggcccaagtatcctacgaacatgggccaaccaccgacgtaggagaggtcctggctgacgcaacagccctccacgtgaacatggtggtgagggggagcccatagaggggcagccgcacccctggtgcgccctaccttctcagccctccttcgtgtggcagtgcattccatacatgggttttccatgtatatttctcctatataccgacctatttggactataaaagaagagtagaacatccctcatcatcatcaacatccaggaagaagagctactagatattgagcaacactccaaagggcgactgtagcgaagaagagagatgtgagatgcaaagaagagagcgactgtagctgcatgagtcttctactcggtctactatgtacaccaaagggtaaaaggagtgccgggcctgtcggctccctacaacttatacctctgagcacttgtgcttccatgggttctcctgttaagtaagtgttcgtggttcttatggtattgtgtattttgattagctaagctatgtttttgtttgtttgcaggttcatcgttcgttcttgtaacagatgttctagcgtaggactacgatcttctcggactccacgatcaacgttagaatagtaatcgatagcatagatatggtgtctaggctagaggttaccttcgttttcttcgtttccccacggtagaggggtaggcggcaagtggtgacagccctatccgtccctagcactcccccacgtacgggttggaagtagagctataagccagacatctacctagtggactaggtgctggccggtgcatgaagtaaagatctgttcttagacctctaaaaccgtaggaatccatctttgccctaacctttcctacccttgtgttatccttgcatggattagctagaagaataccttcgttccctgtggaaaatacgatactttgaatacagcttggtgaagtgctacgttggtaattccgttacgctttcagattatttctgtttgcgttaaaaaataccaacaagcaaaggttcaaccccattactgactaagtcaagcctgatgattatttagcgtcgaactcggcactaaagtggaaacacttcaccaagaatggagaatttaaaaaaaattacttggagctccttacatccttatggcaagccattgattatgcaattgaagatctatcaagcagtttaactatttggattcccagctaactggttcgataaccagttgaactggtcggatcaccagtcaggctggtctgctacaagtcagcttgctctgaaatgctcaagacggtgttgctcaatggatacaaggcgcttggggactagctgtggagggtataacccccggtacccacaacaaggcgcatgggccggcccaccaggaatggcctgacctagtacctgaagacctgtggcgcacggcagcgctcggaggcgctcggcgtgcactgcaagtctaccataaggcaattagcagatagatagggatctgatctgataagctagatatcagatcccttgattgatgcttatcattgtaaaccaactagattagatcttaaccgacttgtaaaccctatctcccggctatataaggagggcatggtaacccctcaaaacccgataactacacctcatcttgtatcaatatacaatccaccagaacacatgacgtagggtattacgtcgccttgatggcccgaacctgtctaaagctttgtcacagccagattttcgttttaggatttataaattatctaataaattattaatagaatttatattaaatgttcattaatttacaagtgaagttaaatgtgggaaataaaatttcctaaatttaaagcatggatggatttaatttttattaaattctccatgattaattatactctctgaaattttctcggattttttttcagagctcaattcctaaatgatacaaagaacagttcagtaattatttaatcattaatgatctaattataattatgttaagtgttttttttgtttaaaaatccttaatttataaattgttgtctaaaagggaattattagaaatgatcttaaaagcctagaagagaagatctaattttaatttgttaaatctcaatataaaattgggctagataaaattttgttaaatacttctcttgattctttagttcctagatttttctaggacttatttgagccaaggaagtatttttaataaatggaattgcatttcatgaataatttaaatagaaaaatgtttttaaatcctccttttggctttgggccgaaagtcggcccaaaaccgctctctctctccctcggcccaagtcggcccaagccgagccgcccgtgcgcgcgcgtgcgaccgccgctgacaggtgggtcctacccgtcagtcgtcatcttcctctcgccgaaaccctagccaagctgcgctgccgccaccctcgccttagtctctcgtcgccagtagagctctagcgccgtgccgcctcgcgccgccgtcgccgccgccgctcctaccgtgcgctgccgtcgctccagtcgtcgtcgtcgctcggggatgtcatagccgtggtcgccgtcgcgtcgccgtcctcatccgccctttcgccgtccctgtcagccgccggagcaccgtcgccgctgttgatccgaccgttgccgccgctcttcctcgtcgccgtcgtcgtccgttgatcttccgccgtcgttttggtcaccaatgagttcgccgtgctgtccgctacgtgtaggtgtcctccgtttgggccgccgcgccgttgttcgctggcgagcacgcgaggccgagccgtcaccggtgatgacgtcatcgccaacgtcatcgttgccgtctgccgtggtccggtcgtggaccgatggatcttggccgtccgttttggatggatgaatctcggccgttcgttttcgtgaaccgtcgccatgcacccggtcctccgcgaaccctagccgatgacgcaataattcccttttccttttcaaaaataattcattattgcgtcataattcaattaaaatccatataaatgctttaatccggtttaatctttaaaaattcataactaattcattgtaactcagtttaatgtggttcaagttgcaaaagttgtataaaataaagatctacatattaaaattatccataaattgaattaaatttatttaatcctttttaaatgggctttaattagatttaatcttgtaaaattcgtaataaattcatatgaagtcagaatgaggccgttcaagtctcaaaattcatctaaaattatgatctacatgtttgtttactttttatgtattgtttatttggagtttcttagtctttttcctcgttttgtgtgttagcttgtcgtttccgtcgtttcgaaagttcgcgagtgcgccggaagtgttcaagaagattaattgaagaccctttattgcaaggcaagtcacacagatcccaaacacaattcctttgagcatgttgatcctatatttaaattctctatttatttcaactgtgcatttatttttgaatgtcaccgggtggtgtgaacctattcctttgttatggctagtttgcattgattaccctatttcttgattacctcgggttataatttgactggttggatttatatattggttcaactagatgttagacataattgcttagccatgcttagaaacattagcacacaattgggataactaatgtttcactattacttaatgatggatatttaatgatagctcacgatggtcaatcgtgattggttaattaattaatgtgccaactaaaacttgataatggtgggttgtgagcacatggttttgatggtcgtgctcatgacaattaaggaccggttcacgattttcggttgtgaaacattaaccgtgccaaccacaagccagaatgggcaacggctggacacttcgtataacaaggctcattgcggagcaccagactgagaagtggcggagataagcccacgggggtcgctggggagtccatgccttgtttataagggggtgactatgatccgggaacggtgcactgctttgagttgagttatgcgaggggtcttgtcacaatcactcaacatggtgacgtgtctgcgcggacacggtaacatgctggtgggttgtgtcttgtgggtacagtggtacacctctggccagagtaaaactattcgaatagccgtgcccgcggttatgggcgggtctaacaatgtctttcgtgattagtctcacacttctcaccataataaatgatgctataactggtaataatttgattagctcctggtttggaatggtatattcctggtttggagatagatctgtgcagccgggtatggttgttcagaatggttgggcctgtgtagcatgggtgtgctgttcagtgttgattaatattgatgattaattactctattgttttacaaattctcaaatgtttgctaaatgctgtttttgcaaatgagccctatattatgccatcctttggtatccttgtgcacttgcatatttgttgtgtggcttgctgagtatgtcatatgctcaccttgcaataatcaatcaaaccttagttgaagacaagttgcgaaggagaagacgtttggcttataccccagttgagctgcctgtgggagtggagccggagcttcgctagattttattttccgctgcagttttcttcatggtgaggactaagtgcctcttaagtaagtatttatcgttttagttaatttgatgaatctgtatattaaattgtcagtttgtgtacctcggctgattcctggacgaggattttatgcacaaataagttcagaaattactagtgaatttctgggcgtgacaagcttcatgtccctgctcttcgtgttcatcatctggttctgatcatgcacgtccctccacgtagttaatctaccatcgtggttatccccctcagtggactgccgaccatatttagtcaaagtgaactataggagcctttgagcaagtttaattgcatagccaactactaaatgcaaatcatctatagccaatctaatagctcattcatacaatagttatccataaaccattaatacatggtcccacctctcatacacacataacgtattggagtttgtgctacagctggctacgaatctgtagcccgctttccttctctctcttctctcctccacatatgcttacaattgacttgtagcctgctattgtactcactcttatagattactgtaacctgcccttaacaactaattaaggtggaattaaaattccacggtctcataacacagtaacacatgagccaaattcaaataggctgactgtcacctaatttaaggtgactaaataaaagggctaccatgccaaaaacaaaattatagttcttggacatgcaaagctgccgagcttgtcaacatcgattctttggcctgatctgttgtagtatgttgttgctctctggggtagatatgtgtagatttctcaatatcgtcatcagtgacatcatcagtctcattaccctctttgctcttaccccacagcatggtgtaaagacttgcgaccagcaaaattccacccaagatgctgccaataaaggaagagaagaaaaggaaagtttgtttatttcagcgtgtttttagaatattgcacctttgatcagctgacagtgagtatatatatatatatatatatatatatatatatatatatatatatatatatatatatatatatgatttaatttacttgccgaggtgaacaatctctccaagaaagaaggatgagcaaaatattgtgaacacgaagcagagtggcgtccaggaggcgaagaacatggggcctctcatctctaggcaccacgtttgcaggtagtaggacactcccgtcaccataacaccctgaagcaaaccaccagtcgtctaatagtcagatgcgtgtgccgaagaacatgccaatagtgaatacactagtggaagaggatgattgaaaattttatgtgcacaacttaccgagtataggatggcgagcaagctaatgtcgaatcttagcttccatctggagaagtcgcgctctgcgaccaccgcgacgacaaacgactgcatcgtgctgaacaggcaccgagtcacagtcacaaccattttatctggatattccttttgcaccgcagcctacacagtcaatagacaaggagtagagaccccgataaatgtgtcagcaattgcagctgtggatcgatgtagacaagcatgcaagaacagctcagaattttttttggtaaataattaaatatgcatgcatccgaacttgaaaaatgatccacaaagactagcacatgttggcgaccaccataaggaatgtccatttgatccacacacccctcggaactactgttttcgagcttgtgtcagaggcgaaggcacggtgatggttgatagggcttatggatgggccggtgaagaagacgatggtgaagactccagctaggcagagtgctacacttgtgaccttggctatgcctgaagagctcctcagcttcacatactccgtcctgtcctggcaagcaacattccaatcttggtattatctactactccatccattcaaattataaggcggtttggttttttatgatacattacttttattatgtgtgttgatatggtgtatatctaaatatctatatcaaaatttatgtgttcagaaaagtcaaacatcttataattaatattttcacaactaacttgaatctatttatgatacattctcaagttaggctttagtgatatcgatgatgataaacctcaaaagcaccgccaagaagaaggtgatggctgggagtgagctgtctactgcagatgccactgttgcagaggtgaacttgagacttacatggtacagatttaccccaagcgtaatcctgaaaagcaatttccacaagtaaactagggactaattaaactcttaacatggcatgagtatacaatcgattgttttgttttgttttgttttgttttgtaccaataaattagagtttgcaaagatgagcgtatacccgattaaggcacagaagaagagctttatgagcaccccaagtgtcatggcaggccgtgcacttctcctacaaatataatcaaacggacctgtatttctcagctaatcaaacaatatagcaaactaagcgaagtagcaatataacaatataggaaaatgattctatactctcaggagtacgtactccagctttcatagattactatcggatctacactttatacccgttttgtgttttattttttaaaaaataatacataattttccctcattaatcggatcagcaaacggcccaaataaatcccagaagacggcagatcgctctccccagtccccaaccaattcggcattcgcgagcgacggcaagccgacgccagcagcgtgaagtataagcggcaacggtgcaaaatcattcatccagaccttggcgtgttctgcacctcgcatgcactgttttcttttctatcctattttctttgccttctcttgccgatcgagcatatccttattttttcctgttggatctataagggaagagcacatatgttggatgcatagatgtccagtgattttggtggtttgggaattgtgatgtatctttttttcacggtaattcaatttattctttaattagttacttgactgattaaccccctataattgggcatgcagacggctgtcggccggcggcagttctgttatttttttttaatcggaactaaaaataaactttaatctgataaaaagttttaaatctttagtcccggtttataagagaaccgagactattgtaaaatttgacggaccgatcaaagatcgtttctctagtagtggctctcaacccagcggccagtggcactactatctgctgaatgtattgcatgttttgatcggcgaaaagatgtactgatactctccattcagaatttagtttgctgctacagcatcaaatatatattttctagtgattttgtttgtgaatttgtcagtggcagatacttctcatggtgatactcatgtcctaatgtattatgattttttctgagatctagtgtgttctgtgattcatatctaagcaaccccataccaattaatatctttaaaaatagcatatactatatttatactaactaaaaatagataaaaattagtacataccgcaactaacctaaaatgtggagtagtatatactgctactttataaaagcatatactgctattaacttaaaaattagtatataatgctacaaagttaaaagcagtacataccactactactattgtaaaaatatgacatataatgctactggtagaattcagtatatactactactactactaagttaaaaattaaacagtatgtaccactactactctataaaatagtatatactgctagtaactaaataaacagtatatactgcatgctactaacatttaaaaaaaagtatatactgctactaagttaaaaatagtatatatatacctactacattacaaaatagtatatactactattaacttaagaaaaggtatatactgtactaactcttcaaaggagaagaattcagtacatactctttcggagaagtaatcagcataactgattaagaaaaaagtatatgctgctctaattaagtaaaacgagtacaatttatgctgctactacttaaaaaaaaggtatatacttaaaatatttataaccctttttttaatcagtttgaatggtagaagatccatctgtttagaggatggtacgttcattattcaaatttaaactaacagcacactccctacgttcaattgtgcaccaaatgcggtctgtacctgtgcatgcatgcaccatgcagcgattagagaaaaacaatattttcattctcttcccaccagtttaattagatgctaatggttatccactaaggggagagagtatgtactcccgggagtacataacaatgatcctataaattaaaatggttctatactaccgtccatagaaggcagccccgatgaagagcgctattggattcacatgtggacccgttttgatttctattcgagaaaaaaaaaatccgtagtacgacataactatcccacattaatcggtataccggagtgttcctgacgcataaatacctctctctcaaaccatcctattggtaaatcgggtcctcggtgagagcacgatctaccggcggtgatccggacggatcaatggcaccggccgattttacggcgacatcggtgtccatccgatactaggttttccttttttttttaatttcacgatcttgtttgatttgatttcagatgcatcaagcaagagagagagatgggttgttacatacctttgtagaagagctgcagggagcaagatgagggagccaactgcctggcgatagaagacgaagatgtagatgttcatcccgtggttgaaagcagccttggatatcacaaacatgccagtgtagatcagttggacgacgatggcgacaaaataaggcttcatacttgctttcaccatcttgatcgatctagcaatggcaggcgtgcgtggtgtttgtgcgagtgcgttgtcttcagtgtgcagagtgtgtgttgtctacagtgtacgagagcgcccgtttagtttctctccatcaacctggcactatttctatatatttatataaaaaagaagcagtcagtatgccaagtgtaaacgcaagagcacggtaggtactgtagctttgattttgggtaactgatcaacacgccagatccacacaatctgctatttttagtctccacagataggagacccacttcgagtgtacattggcggattcggcggcggccagctcgagaggaccgacgctccgtggctgaccgtgccatgcagatgcctgttcgtaactaaccgagtggtggcctgcgttttctcctctcccgtaactaacagagtggtggcatgcatttttttcttctcccataactaactaggttagtttagaataataacgataattaagaaaatattcttttttagattttgcttactaacagattgaaaagaaatctatatatgaaataaactttcaagtaaaatttaaaactttctatcgaaaaattaagggatttgctagatgtctattagattaatgggtaggccaaattaaatcccaataataccatattggaaatttagtgctatgggtaataataccatattgaaaatttaagtgaagagatcttaatttaaatatggagctagtggagaatctctgttcaccggttgagatggtggatggacagccacactcgtgcacagagctgtgtattaactcgggttaatcgcacggattgaattctccgaatgtaactctcacatgtgctacaaatcctctgcgattaatcgcgtggatgctctccctctcttgttctgtatcggaagatgattaattctggtgtattaactcgggttaatcgcgcggattgaattctccgaacataactctcgcatgcgctacaaatcttccgcgattaatcgcattaacccgggttaatcgtgcagattgaattctccgaatgtaactctcgcatgcgctacaaatcctccgctaacggggttaatcgcgcgaattgaattctccgaacgtaattctcgcatgaggtacaaatcctccatgattaatcgcattatattctagtgtattaacttgggttaatcgtgtggattgaattctccgaacgtaactctcgcatgcgctacaaatcctccgcgattaatcgcattaactcgggttaatcgtgcggattgaattctccgaaagtaactctcgcatgctctacaaatcctccgctaacggggttaattgcgcggattgaattctccaaacgtaactctcgcatgcgctacaaatcctccgcgattaatcgcattaactcgggttaatcgtgcggattgaattctccgaatttaactctcgcatgcgctacaaatcctttgctaacgggatgaacagacacaacgctcgcacttatgttcttcctctctcgcactttctttccggctgttctcctatttcggaactccgtctgcttacgtacttgcacgggtaggcaggcaatcaagtctttggggagcgtctcggtgcaactgctcatgttctgcttcgacttcttcctctacatcgcgatggcttccactggaaatggcgcaccaggagctggagggaacggcgatgctccaggagacaacactaacggaggcaatacaaatgactcaacctccttgcaccgttttctgggtatatggttctatctctaattgatgttcttcatgttacttatatattaatcatgctatccttaggattgcaatcctaggtgaatgttgatgatgcttatgcttatgttatgaaaaacatgcccatatttctatttagtcacaccactagattattactattgtgaatgttatgtttattattgtgttattttagattaaaatataccgaattatgatcaaatttacaaaatgccagcctgagggatcgacatctcagcgagcgagattggtgaattgaaaagtggggacgaagctgatcatggacgtcggcggcaggtagaggcgccgctgctggagaagaagggcagcaccggcatcggcgatgggtactgcactgagaggtgcccgggtgcggcgtcgatcggcgtaaggccgcgagctccggcatcccctacaggagcttcctctttgtctggatcatcacgctctgcacaggtaaccaccacttcattcttctctcttccactcacccacatgcatcatcaatcgcgcgcatctgcacctgattcgcttccccctcctcttaattgatgtccacatttttatcgagttatatcatgagtttgtgtttaatttctcctatatatgttctccattgatcatgccaccttggagtgctatatagaagtatatacatactgatgcagccccttcaattaatcaaaatctttaaattaacaattactactaattttatgaattgctttgagattcgtgcacctcaaccaactattgaatttgggcatgacactaagggcttttttggagagattctgaatagcttctctcataatcagaagctctccaaacaatttagcttttcattgatattctaataagttgtagttgtataatcttaggcaataaaatagaagtcagaagctagaaaatctaacttttttatattctaaaaagactcttcaaatttaatctctggccagatctaggagcggagggagagaaggggagccgccgccgtcgccccgtccatgcggccgccgtcgcaccccctcctctggccagatctaggagtggggaaggagaggggggagccgccaccgcgtccgcgccgccgccgtcgctcccctcctccggttggattgggagggagggaggggaggggaggagagtgacgggccggtgagagagagagagagagagagttgagagggaaatgagtggtggccggtggggaggggtggaggagaagataaggaagacttaaagatatttttttgggtaggtatgatttttgcaggcggaccacataaggttccacctgcgaaaatcaatttttccaagcggaccacttaagaggtccgcctgcgaaaataaagttatttttcgcaggcagacctccacctggaggattttcgcaggcggatgacgaaaatccaccccgttttatattttcgtaggcggatcatatttggttccgagggtcatacccgctttgaaaaataaaaggccaatttcactaaaaatccttttttaagtagtggtggctattgattaattgtagcttaatcaaatacgtgaaatttctatatgttacactaaaccatgattgcaaaagatggctaaagaaatgttagtatacatgagaacattcttcaattgatcagcatacaaagtgatctactgctaactgacgaaaacgagacaacatctaattaagccactaattaaacattattacttttgaccaaggtaaaataatgagtatagtactggtttcgtttacacaaagatcgagggttgcactctacgcgtacctgtttgttaagtagttaatcatgagtgatggagaagccgggagttaatcatatttgccacacaaaatcaatatgcaattattgaattcgtacggacaagctgacgatgtagactgataaataaaatcctgtatgcatgcatgcatgcgccattttgtactccagtaatcttttgtttggcatgcatgtcagcatgtgtgcgtggttcaggcaatgtgatatatagtgaattgattggcaatgtgagagtgagttgattgaagtagcaacaacctgtcgggcctagcggccggccagcctgactgactgacgtaggagctgacgatgccattgcacattgttggtgctactgatgctcaattagattagatatcctcattaataataagctattagtagtgttttactgtttgatgataacttatttctagccgtactgggctaaaatgtatagtaatactgaaattaaggaactgctggattcaagcagcagctggttgactttggttaccagcacacaattaacctaaaatttaattaactgttggttctggccgattaattagttatcttacggttgcagcagcaatggtgttaccattaatttttttaatttctacgtaatctatcggtgggatgtacgatggattaataaacttcaactaccttttaaaaaaaaaacttcaactaaataattgttattactgtcatgtactctgacttatttttcgaggggacaggcagggagttcctacaatttaatccagtttataaggaaaaccggaccaaaaaattttacaacagcacggttaatttatgaaaaactggcgaaaaccccggcattgacatactgaacctaaaaactaagaacagcagtccgacaagggataaaactcctaaaatgaatccttcaagaaggatacgccgacagaacaacgacatcgtccgatcctaacgaatctaaggttttcatccggagaaatctcttgaagtggggtttgaaccagggctccaatagcaacgccttcaagaaggtaaacggcacccaagggtgtcgccgttgctagcatcggcaagttgagcaaggctttcgcctcggagtcccatccaaacatagcatccgcgacggaagccaccaaataccacctgcacaccgggtactgtttaagaagattgacagcaactgcagcaggtggcaattccaacttggattggtgcagctatacatgatgtaacatgggaaagtttattcgtcgctcgaggaaacactcctttaattttttatactatttgaaaaatcataaaaatattaataaaaagtatatcaataatacaatatattgataaataaaatacaagctcaaatttaactagaaatgaaaataataaattaactcagaataaaacatgtcattcatagttaaatttattttttaagttatatatattaaattgaatttacatatttgtcgagtgacacccccacatatttaatttattttattatcttttttattaaatttattaataattttttaagatgacataaaccgacatacacaagtaaagaaacatagcctccaacaacaaaagtccatcatataatcatatactatttggacaacggaaagcctgtttcgacttgtcttctcccctccggcttttctgttccatgcgttttctgctctgcaactgcaagcaagtccctctgctagctgcgagcctcacgtgcccattcactctctttatttattgctgattcccgatcgatcgatcgatcgatcgatcagcaggcaatagttaatcgatctcaacaactacccatcagttattcaatacaatacagccattcagacagaagcaaggtctatcgagtcagagagatcgacatctcggcgagcgagatcggtgaattgatgggtgatcatggacgccggcggcaggcggcggcgccgctgctggagaagaagggcagcaccggcaccggcgtggacgatgggtactgcattgaggggtgccccgggtgcgtcgtcgaccggcggaaggccgcgagctacggcatcccctacgggagcttcctctttgtctggattgtcacgctctgcacaggtaatagcctcccttcatttattctctcttccacccacacccacatgcatcatcaatcgcgctctcatcgatctgcagctgcagctgattccgttcctctctttctcatttgatctccatattttagcgagttttatcatgatgagtctgcttaattagtttctcctatatatatatatatatatatatatatatattctccattgatcatgcagccacattggagagctatatatatacatacagtcccttcaattaatcaaaatcatcaaattaataattactaattttatgatttgttttaagatttgtgcacctcatacaaccgttcaattttagcaatggcttattcgaggggtttctgaatagctgtagcttcttatgataatcagaagctcttcaagcgatttaacttttcgttcgtactctaataagttatagttgttgaattaacaaaataaaatagaagtagaaagctagaaaaccaattttttagctctaagaaataactaccaaggctgtgtgtttagttaccttcatacttttaacttttctatcaaatcaaatatttgaacacatgcatggagcattaaatatggaagaaaaaaaccaattgtacagtttgcatgtaaattgtgagacgaatattttgagcctaattacgccatgatttaacaatttgatgctatagtaaacatttgctaataatatattaattaggcttaatagatttgtctcgcagtttataggcggaatctgtaatttgttttgttattagtgtatacttaaaaaaattttggacggggaactaaacgcagcccaaattagctgattattactactccgtcccataatataacaactttttgttgtctagatttatagctaaaaatgcttatattttgggacggagggatacaattttaagcttttttttttacagtccatagattagatttctagaggttgaaacttgaaaccgccaatggcagggtgcgtgtgcatgtgtagcagacggtcgcacactcgcacatgacctgacctgctgagattaaattcgtgagcttaatggttcattcattgcttttgtactacctatattctcgtttcttgattagcacaagccaaccattgctccatgcatgattagcgcttactcagacttcacttcatccacgttaccttctgtaaatttgttttttactttattaacctggccgtatggtttttcataatgtctcccatattttgaaagaaaaacaagatagcggctcatacgatatttcaatttgtattatactcgtataagtagctaacggtaatagagacagtagcggtggagttcacgcggccgcccaacccgttcgggaagtgcctccgccgttggctgcatgtgtgcaacaataaaatgagttgtttaataaacttgctatattaagggaattgtatactagtttatataaccggctcatgatcgaattgagaacaaaagcatatccagtggagttaaaatttttaagtagaccatcaagttttaagtgaagtctacgtaagatgatatctctactacttaaaaagcgaaccggttcgtttgcactcttttcgtacgtccttacatgtgtgtataagcactatctctttaagaaaaacccactaacatgtgatttctcactgcccacaccctaaagcctgttcgcccataatttcaatcatgttctatgataaaggtgcacttttcgatcggttaaacaccatgacttttacaaaagtctcctatatagaaattccatgatatactttctataatctgttttatcactttttaacatctaattattggtttgtgcccttaaataattattttcacttttcgtggtataatgtgagtttatagcattgcatgctaattccaaatatgcatggagctatatgtgacgtggagctccaaccacccaagtcggatagagtttttgtcgctttgtccaactgttggtggctcatgtgaactttggcgtgtatcacgtactccctccgtattttaatgtatgacgtcattgactttttaaccaacgtttgatcactcgttttattcaaattttgtttgaaaatatgaaaatatttatgtcatgcttaaagaataattgttgatgaatcaagtcacaataaaataaataataattacgtatttttttaaataagacgaatgatcaaacgttcgataaaaagtcaacagtgttatacattaaaatatggagatggtacaatatacgaacccatatgtacatgcatgtgttaagttcgctttcatcaaatatttactattgctcgatctctgaatattctgagtcttgaaatccacagaaaatatttgaagatgattgtgacggtactgtttgtacatgtctgggagacgtaaggatctgaatgtgttcgtgaaaaagttgaaggaaaaaaattcaagtctaaaaaatatgttcaaaattcgaacatacaataggaacatacacagatttgagtatagtgtacatatataggcataagtagtacaaattgaaacacgaaaaatgccaagtccaaaaaaaatattaaatttgaatatttagaaagtttcagaacgagtatgaagttcggaatatgaaaaatgcacaaattccacatcaagccagtgtgaggttgcaaatcttttgttttcttctcatgctgatgtgctgatggaacataataaatgagttgcaaatctgttgttctcttgtgctgatgtgctagtaatcctaatactagtattaataaatgacttccacttccacccacctccatggagctaaacatattcttgtgtgtggcaatgcgcgccgtggaattttagcgacgaccacggcttcgttttggcttcctcttccacctcttcttgttgctggctttccttgttgggttggccattggccctctccttgtttgcctcctcctctcctctcaatctcaggccctccctccctcgccgccgagcttctcctcttttgccgattgatagccgagggtgagggtgagcctccctgtttgttctgggggggtcgcattgcccttgccgggcgggagaggaggggatggaagaggaggtgccgttgctcaagggggactaccaccaaggttgccccggctgtgcctacgatcgcaagaaggaggtctacaggggattgccttacaaggaattcctctatctctggatgatctgcctcaccgccggtatgtatggaacattccccccctttttgcaacctgtgacattcagggtgtgtttggatccttggctaaagattttctaaccagtcttggtttttggtacaagtaaaatatcctagctttcaggagcaagctagccttgatgggctagaaaaaccttgctcagcaggacagccgaattggctctctctctctctctctctctctctctctctctctctctctctcaacagcaacaagcgcatgcgtgaggggaaaaaaaaatctggcaactgtttctcattgtggggtaaaagcaaggaaaccaaatgtggtgcttgggcaagagcagcatagctgaaatgagctagtttgcacatttcagctatagctcaacctagctgaacatccaaacgtaccctcattatgcagaaagttcttgtttttttttttaactcatggttttctaggatttttctttttctagtgtagtacgaatgagttgactgaatatcgccaacaaagagaatcttggtaccacgtaggaacatgacagcatgtcaacattggggatcttggtacctgtaggaacatgtcttctttcttgcaaatgctacatgttactgcaatgtccatgtgcagttccatatgggtttggtcggtgttcagtcatgtcaatgattcctgttcctgtggggaaatcgctgattctctataatagtagattaacaggaccaagttagttaagccaattgcctcaacaagatttctataatagggggatgttgacatgttgttgctgtttttactacgcacttctccatatttgctttcagtgctgcttacaaccgttaattacaatgtgctgtgatgctccgactcatactacacacgacgaccgtttacaccggtcattacgttgtccatggtgttacagttgcaaactagtaatgccacgtcctggttcatgtgatgtgggttagctggggggtctattatgttaactagaaaatttattgtttgagggagatcactgtgcgaacaatattagatacgcaattaattcctgttatgtcatagtgccagtcatccaaaccttattgggcacataattaattcctgtaatctttcattgcaccaatagcaacttcattgataggatctccaatgatgggactgtaggtgatgctgattcagaccttgtagatctttaggttcttcgttgtgtttgtgatcttttttacctacctcggttgctgaaattttcacaacactacatggcatctatgtcaacagtcagcagaagcatacactgaaatgtcctactccgtgttagatacatagcattcagtctgcaatgcaatattgatatgcgaaaatgccttttaactgattttccttaatgatgtaatgttttttaacagatttttttatactgctccaaatcgtgataaaggtcatttatgtaaactgtaaacttggaactgatgcatgacttgtttcccacgtgtcctatataagcatatgtaattgtgcatatttttaggggtgaagttccatgtgctgttctggtgttctgcatgagctccttcatcatggttgcattgaacagtagtctttctcttttacaatagtggaacatgaaattaatttgtctacttgaacactgtgtcctatctgatgttgaggatactgagtgctatcttgtttccttgagagtattgcttaaaaaaatgtgagtggaacagtcaaaatctgagaagcatctagcacttcaaattttcttcatttcaagtgcaactagctctatatctagccataataccttcttttattatccctgttctcaccagcatcatgtagttgtttttagagaagttctcaagtagtcccctgatatcatcatctaagtaataatataataaatattgttatcaccatttgtatctacaaaagttttaaatgtatttatcgtaaccacatatcccatctattcttttttttacataaattttcagtgcatactcaagatttctaattctgtccctgtccttttcagctttaccaatatcatcattgttccccttcttgtacttcatggtatgtctattttcatgtcttcttttgatgactaaaactagattttttttttcttgtgggtagtttatctccttttttgacgactatctctactctagcaattaagtcttcaagacgtgtcttattacacagataagagacttgcatgttgcaaaaaggacagaagatattgggttctatgccggctttgtgggtaaatttctcatgaattgcttgttcaaatttaagattaactctggctctcaccttgactgattccttatttacttaccttataggtgcttcgtttatgttcggtcgatgtttgacttcaactgtttggggaatagcagcagatcgtattgggaggaaaccagttgttgtgtttggcatttttgcggtgttagtgatatttttcctcctctatatgaaataatagttgatatctgg

SEQ ID NO: 60191 - DNA, 500 bp, Oryza sativa
accacgaactgctacgtaccgcgcgtttatctcgtgctagatacagagcattgacccttctgccggtctgcccccccggccccgtgcacgcgtgcgccgccccggtcagcgtccatctctgagactctgacgacgacgacgccgccggcgacggcaccggcgccaccgatccatccatccatccgtgcatcctactgtatacttacctgtctctcgctgccctgcactgcatacgtccgcgcctagctcgatccccgcaggatttctctgtaggtgacagacgccggtttgtctggacaccccctcgcggcgcgccggtgcgtgcgtcggtgcgtgcgtgcgggccgtctgcttgacgttttgaccattattcctctctgtcgatcgtgtggtcagtgcgcatgatctaagattaactgaggaaggactcatcttgtgcgttgacagcgttgtccgaagcccccggacagaacgggtctaagtttgcactgttattttgg

SEQ ID NO: 60192 - DNA, 1071 bp, Oryza sativa
cctaagtgttcaaatcgttgggatatatagttaacccttccgttaagatgtcccgaacaaacaaatgctcgttcggtaatgaatatgccgagttagagagtacgataactacaaatggcacacaggtggaatcaactggttaaacatctcaatttccaaatgcctctagttcttgagttgagtgtttccagtaagcaaatctgctgtcaaaaagtgacaatgggtagtcaggtcaacacaattgtacatgcctgtagcaccaacactgcagccctgttgaaaagaatatatatctacaatgccaccattttatccccccaactaatttttggccaaaattcaacaatatactactagccatattgtcgcccattaaactcatgaatttcttctatatatgtattctaacccaaaatgaagctcttcgtcagaacttcaacccgctacaaactataaaacatcaaggcaatgaaaaccgtaccggttaaggattctctcaacaagaaagttgggttcaggaaccagcgaaaaagtaatgctgttccagaggtggaaagtagaagagtcatttacaatcctagaaaacaaagcatcatgttgggttctttcatccgtgctatctgtttttgagaagtacctgcagtacatggatatcataatgagagtgcatattgcaaatttgtagccacacatctaaagagtcaacaattacttgaacaacaaaaatatgtgaaaggttgacttttaagttacttgaacaacaaatatatgtaataggttgagttttaagagggctggggtgcatctggtttatctctagtactgtaaaagcggtgtagttgtcctccccaacaatcgcacctcccccacataaaaaaaaccaccccacccaaaaaactagtgttcccatgcgaaaattgacccatcagaaaaaccggatacaaaaaaccgaacccggtaaaaccattcagccatcttcctgagttccttcagatcaatggcatgacactaataggttgaacttggctagtgaatagagttcagtttttcttttaaaaatgctcatgcgct

SEQ ID NO: 60193 - DNA, 4907 bp, Oryza sativa
cgcgattgaatgcttgaatcccactcgtacccggcgcatcttctccccggaccagtgctccggcatcaaccgcttcgtcgcgctcttcgccgtcccgctcctctccttccacttcatctccaccaacaaccccttcgccatgaacctccgcttcctcgccgccgacacgctccagaagctcatcgtcctcgccctcctcgccctctggtgccgcctctccgcgcgcgggtcactcgactggctcatcaccctcttctccctctccaccctccccaacaccctcgtcatgggcatcccgctgctcaaggggatgtacgccgccgccgccgacgtcgactccggcagcctcatggtgcagatcgtcgtgctccagtgcatcatctggtacacgctcatgctgttcctcttcgagtaccgcggcgcgcggcttcttgtcatggagcagttcccggacaccgccgcctccatcgtctccttccgggtggattccgacgtcgtctcgctcgccggcggcggtggtggagccgcggagctgcaggcggaggcggaggtcggggacgatggcaggatgcgggtcaccgtgcgcaagtcgacgagctcgcgctccgaggcggcgtgctcgcacgggacgcagtcacactcgcagtccatgcaggcgcgcgtctccaacctctccggcgtcgagatttactcgctgcagtcgtcgcggaacccgacgccgcgtggctccagcttcaaccacgccgagttcttcaacatcgtcggcaacggcaagcagggcgacgaggagaagggcgccgccggtggcgggggccactcgccgcagccggtggtggggaagaggaaggacctgcacatgttcgtgtggagctcaagcgcctcgccggtgtcggagcgcgccgccgcagcagcagctggcgcggtgcacgtcttcggcggtggtggcgccgaccacggcgacgccaaaggtgacgacacctttttggatcatcttttcgtgcactttgacttccctttttgtttgcccgcgtgtattacactgttgtttgcttctgcgcaattaatcactcttgtcttgtgctcttgaccatccgatcagtagaatcaacggtccagatcacactagtctgctcgttgtttggagaactcgacagcgcatacatatttaatactacattcttgaagtgatttttttttcacaaacttactttcttgaattgttacttttctgatcttaacagtgacattgactgttaactgctaagtatagatggatatgcagagttgaattgtactgttaagacaaaatcttaacagtaaactactgatttgacaaaagagaatgttctttgatggatgcacaggagctcaggcctatgatgagtacagtttcgggaacaagaacgagaaggacgggccgacgctgtccaagctggggtccaactcgacggcgcagctccggccaaaggacgacggcgaggggatggcggcggcgatgccgccggcgagcgtgatgacgaggctcatcctgatcatggtttggaggaagctgatcaggaaccccaacacttactccagcctccttggtgtcatctggtccctcgtctcctacaggttaattaagcaaacattttactcacaattttcacattgacatgttcatcattagccatctctgtttgctgcatgtttgttgatcttgtgaacaatgtgatgtaattcaggtgggggattgagatgccagccatcatcgcccggtcgatttcgatcctgtcagatgcagggcttggaatggccatgttcagcctaggtttgtttgttcatctctgatacatatgataaattgctgtaattttacatgcgttccatgtaggactgcaaataactgaattgtgttttggtttttgcaggattgttcatggcattgcagccacggatcattgcctgtgggaactcccttgcttcgtatgccatggccgtcaggttcctcgtgggtccggccgtcatggctgccgcctccatcgccgtcggacttcgcggggtgcttctgcacattgccattgttcaggtaagctgcaagttcaggcttctgcaccaaaatgcatccttaactgcaaaagaatctatcgtaactcaacaattgtcattgaattctcaggccgctcttcctcaaggaatcgtgccctttgtgtttgccaaggagtacaatgttcatcctaacattctgagcacagcgtatgatctctttaccatcttttctttttcagtattggaaaaatgtccccattttgaggtttcttttcttttatacccagaaatctctcgccctgtttcccggttcccttttccattgtatcacatatgccatgcactgaattttctgaaaaggggcgcatcttgcagcttttgatgattcctaatcatattgttttagactaagaaagccattttactcatgatttatcatccacaaaggcagagtccataacactaccattaaccataattgtatgctcatgattttgtatctgacatgaccatgaactcttgttctgcagcgtgatattcgggatgctgattgctctccccatcacattggtctactacatactgctggggctctgaagagctctccaagtctcaactcaactgtgcaagaacttgatgttactgacagtttgattaggatttatggttctgttttagttgctcagattttgtttggatgataggtcagcttagtgatgctagttagacaattatccgaggacttttgggttcaagtgacggccagccacggtttctgattgaagattaggaacatagacatcacattagtgacaacaggcatctaatttgtaagacattgagaaggtctgtttcaaattactgacaatgtagtaagacattgaacagtgcttataagcttatttagcattccaataactgatggtaatgcacttaaaggagctactctgaaggacttttttaatctcttgagagattagctccggattttttccttttggaatgtttctttagtttgagggctctgaaaacacgaaaatagaaaaatcgtaggaacatgatgtcatgctataacaaatattataggaaataaatttattaatttataggattttgcaaaaaagtattgtttattagtagcaccatcggaaaatcaaaggaactttaaggctgcgttctttttagtttttagaaacggctaattagccgcactaaaacttttgaaacggctaattaactacacgtaaaacgataagtgtgattagtatatgattaattaagtactaatatgtaaaagaattgatgaatatatttattagattttttaaacaactttatataaaaaatttttacgtaaaatgcaccgtttaacagtttgaaaaacgtgctaatgaaaatcgaggagtagcatgaggtctagtctcatgttttctttcaaaattcctacacaatgagcaataggaattttaaaggattttggggaagtcatttctatgttccaaaagatcatgttgggaaattttccaatggattttaagggttgtttggttccggttacacttttcatcacttgccaacaaaagttgttacactttgtttaaggtgaggtgaataaattcttagtcataacttactaagcctaagcctaaggaaactttaccatatttttttaagttattgacacgtgagacccaatttgttagaagagaattttattaactatggttaaacacttaccaaattgattaactaatcttaaatatggtaaactgtggtaaagtgtagtttccaaccaaacatcctctaatcttttaaattcctctttttttttctttttatccacttttcctttgtttaaaagaagcggaaagatggaatctttttgccacttttttcaagtttcaatgaagaaaaacatgcgtagcattttgagcatcttttcatactcccaagtataacaaaaagtttggccccaaaattaaaatgctaatggctggcctgtttgctcgaaacaacaggacagaaaatgatagtgttgggagtcagacaaaagtgtttggctttaggcatgcgcacttgaaggttgaagcagcatccgacaattatactccactcttctcgtctgtatgacagacttgacggttggatgtatctgaagcgtataaccaacggtaattttatcatctttgccgagacatatttttattataaaatttggtagtatactagtatatcgaatataaaaaatcttagtgtaaaatttagagtatcaatgcatggatcttctgaacaagattttttactcttcatcacagtcttagatcatccgacatagtacacggttactaatgtttattggacgtatccacggacctgatttgcaaaatgccaaaatcatagaataaattggttgagtttaagaaaaagcaaattcaaaatatggataaaatttctacgaattgtcaacgaaattgcaacagtttttatcattttttgggtttagatcccaacctatatattttggatttcttgtatatctcttctatatagctgggtattcgttttacattactatacctccctcagtctcatagtatagcaatctaggattacagattgaatgtgatatttcaaacctgtttagatttgttgtactgtgaaatgttctatctggtcttagcttggatggagggggtagggtaaaaatgagatggatatttcccgtatgcctgcccgctcgtattattttgggacaatttcgggtcaaaaatccgaataattgggtgcttgtacggatatcgagccgaattttactttttggtggatatgagaatctagttggagggcggtatttgatggatacggagtaccccgataaa

SEQ ID NO: 60194 - DNA, 589 bp, Oryza sativa
ggtaatccatatctattcagacaaggtgtgatggtaacaaaatgtcccataggtgacagctctactttcaatcttcaaggcatgaatatttgacactatacttcaaatttgtaaaacacgatccattcatttctttaattatcaccaacataaattcatagatagtacaatgcaaaaaagacttgcctgtgcaaaaatcttttaggctaaaattcaccaaattacctgcactatttccttcttcttatggacctcccctttggggattggaacatactcctcagcttcaagatcgtattctgtagcaaaagcatcacatctaccaactcttttgaccgcaccactattagcttcaatgtatataacatcacccactgacacctgcatcccatgtatcactgatgtaatgaaacaactagtgcaaaaaatggaagtaacagaagtgaatctcagtatcaaggcatctaatcagcttcacgatgacaagttatgaatttccaatcatgcaattttttttttacaataaacattctccaaagtttactttatagattaaatattcacaacaagacattcttctgaataagaa

SEQ ID NO: 60195 - DNA, 5633 bp, Oryza sativa
tacaggaggaagtacttgatgttgttcgtcgggataggcgacgacatgaaatttctaggacttctcgcagtttctctcgggtggttccggtcgtcaatcaacctgtgcgacaacctgggggagctggtgtgtaaaatctgaggactcaaaggctgtccctgttgatgacaagtttgctactcttcgagcgtatcgtcgagctaagggtctctgccatacttgtggtgagcggtggagtcgcgagcatcgttgtggacccaccgttcaacttcatgttgtggaggaattgctgcaacttttttctgtagatgaacctgtgtctgatgaacctgctgctgaatctttgcaaactgaacctgaagaaattggtgagcaggagggtgctctgttgactatttctcgtgaagctgttctgggcacagagtcacccaagtcagtacggttgcagagtttgattcagcaccatgaagtactcatgcttgttgactcgagtagcacacacaactttatcagtgttcaatggctgatcggttagctggttgtcgtcgttctgttaagccactgacggtacgtattgctgatgggggtctgttgcaatgtggggaagaaatgcttgattgtcaatagtggactcaaggggagtctttctgtgcaaatcttaagattcttcctcttggttgttatgaagtaattttggggatggattggttggaacgtcacagtcctatgcatattgattggaagaggaaacaattgcaatttgagctaaataatcgcactgtgcgattgcaaggggtgttaccagatgtgacttcttgtcctcctgtgtatgttaatcagctgaagggacttattcatcgtcatgctattgttcactcagttgaattgtgtgttgttgaatcccagggagtagagcaagctatgccagctgcagttgctaacttattgtaggaatttgcatctgtgtttgatgagccgaccggattgcctccttctcgagtgtttgatcatagtatccctttgttgtcaggagctcagctagtgaatcttcgtccttatcgctataatccggcacagaaggatgagattgagcgccaagtggttgacatgctttgccaaggtgtgattcagagtagctccagtccattttcttctccagtgctgttggtgcaaaagaaggacggaacttggcgtttttgtatcgattaccgatatttaaacgttattactgttaagaatcgttaccccttgccaatcattgatgaattgttggatgagttggcgggggcctgttggtttacgagcttggatttacgagccggttatcactagatcggttatcaccagatcaggatgaaacccgaggatgagcataagacgacttttaagacacatcaaggacactatgaatttcgagtgatgtcctatggactgactggtgcaccagcaacattccaagggttgatgaacattatatttgctccatttttgcgcaaaggggtgttagtcttcatcgacgacattttggtgtatagtcgcaacttggaggaccatgtgaaactgcttcgggctgttctggaaatgttgacaaagcaccagctaaaggtgaaacgttctaaatgtgcttttgctcagtcctctttgacatatttgggccgaccatgtgattagtgctcatggggtgacaactgatactaagaacattcagtcagtgcgcaattggccagttccccagaatgtgaaagaagttcgtgggtttttgggcttggcggggtactaccgtaaatttgtcaagcactttggtattatgagccggccattgactgatttgctcaaaaaacatgtggtattccattggacttccgagacacaggcagcctttgaggcccttaagacagcccttactactgctcctgttttggcattgccggatttcttgaaatagtttgaaattgaaactgatgcttcggctttcggtgtgggcgctgtcttgatgcaggagaatcatcctcttgccttccttagtaagtccttgggaccacgaaatcgtaggttgtcgacatatgagaaggagtgcttggctattcttcttgcggttgatcattggcgctcttaccttcaaggttctgagttcattatttgcacagaccagcggagtttgattcatttgggtgtccaaaaactcactacaccttggcaacagaaggcacttactaaacttatgggttcgcgttatcgtttggtttataagaaggggactaataatcgtgcaaccgatgctctctcccggcgcgctgctgacaattctgcagagttgtgttcagtctctgtttgtgttccgatgtggcttgaggaagtacaagctggttatgcttctgatgcccatgcctctcatcttattactcagctcacattgaaaaaggatgtagtacctcatttttcctttgatgctggtattttgcgctataaagggcgagtgtggattggcaataactttgccctacagtctcgtattcttcagtccttacatgctagtgcccctggtggtcactcaggagttcaagtgacttactctcgcatcaaaaatctttttgcttggactggtttgcggcgtattgtcaaagagtttgttgatgagtgtgctgtttgtaagcaggccaaggctgaatgggtacgttatcctgggttgcttcaaccgttgcctgtgccagagcatgcttggcaaatggtctctctcgacttcattgaaggattgccgcactcgtcgggatttgattgcattatggtagtggtggacaagttttcaaaatatgcccattttgtggctttggctcatcccttctcggcgtttgatgtggctcaagcttatctcaccaatatctataagctccatggctttcctcaatcactgatttctgatcgtgatcgcatctttacaagcacactctagacttctctgtttaaattggcggacacccagcttcggatgagttcggcttatcacccacagaccgacggccaaaccgagtgggttaatcagtgcttggaaacctttttgaggtgttttgtccatgcctgtcctaagaagtggtatcaatggctggcgcttgcgaagttttggtacaatacttctctttactcagctctggggacaacaccctttgaggtactttatgggcatcctcctcggcactttggtattgtggatattgcagcttgtgctgttccagatttgcaagcatggttctaggaccgtggggtggtccttactctgttgtgtcaacatctgcatcgcgctcaacaacgtatgaaggttcaagcggataagaagcggtccgagcgccaatttgctgtgagcgattgggtgtttttgaaggctcaaccttatgttcaatcattgtgtttttgaagattgggatcgcctgaaggagcgtgtcacgaccggaattgacccaacgggcgttccttacgtgcgtgtattattccttgtcccaggaggcaaggtacaccaaaagttgatacatttcagagtttatcaagcggaagcgtaaatagttaattcattacatgggcagcgaaggcccagcacacacaaagacaaacgagaaacagcggaagactagggcgacgaccacaggcgcttgacagcaggcacgagctagacaccaaagccttcatcttccagggactcctcttctgggtttggaaaaattgagcaagactgagtacaaccaccgtactcaacaagacacacccacaagtgcaggataaatgtaaaggagtacaaggggggttatgatataaagggttagggtttgcagtaacagcattaaaagacacttagttgctcaaagctattttgtaaacacgtttccagagctatacaatattattaatcaaggccgtgaacccacacgagcctgccttaacccaaggcctctgatgattcagaccgaactagcaacccgaccctgggtcccagctcgtcccaagccaacccaggccaaccattccacattttagttgataagcaggttttaagaattaaaacactaacttgggtacattgctcggcttgcccataaccgagggcgcggctattcgaatagattatactctgatcagaggtgtacatctttacccacaagacacatcttcctcacgtgtagccacgtgtcacataccaccacggtatacggacggaagacatgacatagtttccaacccatcctagccatagacaagagtaccgacccaaccccacctacggccggaacctccgggacaggtaggcaggactgagcccctagcagcaggacaccggccctgtgccatgacatctcgactaccgggccgcagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacaaaggcccgaagaccggtccttatatggccgaggtgctactatcaaaaccatgcaccccgagcccagcctaaaaccattttggagattttgaatagagggtgaggtgtgaatccaattccacaataatcaaaccattccatagtgtccaggtgatatgaatctcccaaagtctagagttgtaaaaccacctaatgttacctaattaattagcgaagcatctacctaaaattatactagtggtaccatgagtagagtgtctactagttggggttttgtttattctagggtgaacaaggaaataataacaataaaaataataaggtcataacaaaggtaaataggcatggctagataaaacagtgataacgcgggaatttaaataaagcgataatgcaataatttaaatcaaaataattttataaactgggatttaatatgttcaaggatgatgtgacttgccttgctcgctttcccaaacgtcggcttcaacttccacgaagagcggatcttccgaagctgcggcgtctacacgaccaacgaaaaaaagaaaaggcttttactctaataaactccatataacaagcaggaacaaagcacaaaaatgggttcttgacttattaaggaaaaattagagacttgaacggtccaattccgagttcaaatggccaagttatggccatttgaagtttatatgctctttaaatgaatatttgcgaatttcttcatttaaattttaattaaaaaaaaggtttattgcgtcagccgaggggaggggcgcgcggaccgggtccacgggagtggggcccacgcggcagccccacggtccacggtggaccgggcgcacccgggctcacaccggccggcgccgttggtcccacgcgtcagccgcacccgagggcgcgggcggctgacagccgggccccacgcggcagccgctcggtgcgcccgaaggcggccacgccggcgcagcgacgggaggcggcgcgcccgcgcccctatggtcgccggcggcggccataggcacggcggagcggcggccgagagaggggagggaaagggggaaacgaagcggcggtccacggctcaccccgggtcgacggcgacgacggaaacggcgaccggagcgg

SEQ ID NO: 60196 - DNA, 9845 bp, Oryza sativa
  unsure (1)..(9845): unsure at all n locations
gataattaagtaggtatgtttaaccaaaatgttgcatgcttggtgtgattgatttaaaattcatacatcacaaatccggtttcttttgtgctggtccaaaattcagaaatatcaagtaggagtatatgattgtaacttttgttgttatatttggaaaaaaaattgcagtacaactacaaagtagatctaattaagccagttactcgcaaggtgcatttctattgatattgaaatagtgcaaaattgttctacaaaactgctgtctgtaaaatttcaactacaggttcaattcgtctcaatgactccaaaataaaattcttgcaaacagtaggatcgaagaaaaataaaataaaaacttgctagacacaacaaatcttattctctcccttcttttcacacttgatgtcaaataagttggacgtaaaatcttacagaattatttttctcctcaaactagcttggttcatatttttaaaaaagaacatgatttatagcaccgttcaacataaatatggtatttagttgtattccccccttataccatactaagttcgaattaataatctgaacatgaataaaaacagtagaaatatatactatgttgcatctctgcatatggtatagcacatacaccggcggatccaccgcccagcgacccgatcgagcagtcacccgggcttatcggtggaagatccttttgaaattctatgcaatttaacaaattgaaattgaacattataagcaaatgttagctataattaagtatgtccaaggctttaaaattttactgagcacatatcatatataaattaaattaatgcagggcgggagatcgtaacatacgaaagcccaagccccaccatgggcatccaccgcatcgtgatggtgttgtatcagcagcttgggcgcggcacggtgttcgcgccgcaggtgcgtcagaacttcaacctgcgcagcttcgcgcgccgtttcaacctcggcaagccggtggccgccatgtacttcaactgccagcgcccgacaggcacaggtgggaggaggccaacctgatctgatcaatatcgatcgatcttcgatcttctagctcttgtacatgttgagtgttgaccaatataatggccactcatgcatatatatatatatatatatatatatatatatatatatgcagtgtgtctagccagctgcatgcaactttgtctacgtgcttatataattaaacaaatgcatatatagccggccgtatcataaagttcctagctataaaagctatagaataaatgtcgccccacttggtcagttggtgtacatgacggctcctaagtgtgctatcatgaatatgctaataatagcagtttagtatatcatccccgcaaaaaaaaaaagtttagtatatcaagtgtacgtagagatgtgacattttgtcacacattggaaaataaactatattgtaataatatgcgtggtcgtttaatattcaatattttctgagtagatttcatataaccctagatattatggtgttaaacacaattatagtggtttgcagtggcggaccgagaaattttcaaagactagggttaaggtatgaatcaactaatgaagtgttggttttctacaaaatttacatagtgatttaacacaacttaacaaaatttccttccattccaaattgatctatatatttcataggtacaccaagacaaaaaaaaagctaatagctctctcatactatatttactctagcaacaaactcgatgcatgcaccatccctactatttcctagccaatagcaaatcaagatattacatgcgggttataaatacttgtgtgcatggatgcatgcatcaatgtccattactccaatgcacaaataacgaatagacttaatgaatgaacacaaatatgatgatcatttagaaataacctaaaaaaactatatgatgatcattttggaacggagggagtaagattttagaggcatgtctagggctcaagccctagctgccctagtcctgcctccgcccctggtagtttggcacgtgacacataaccccgagtatttggtatcgatgcaaaactatgatgttaactaattcaacataataatgtagcacaatgaaaaataataaccttatatggctacaacatttagacgatacattaaacgaactcataaatttcaaatataagtttaaaattcataataagtgtactacatcaaagacaaattagttaacggtaaaaactgtagaatcataatatatgtggttctatgcaacacatcaaaaccctcatggttttgtgcaaacatgaaccaaaatatgtagggtttagtgaaatttactcatattttcataacctaattagcttttaacttaagagaactatctgaaatgtgtttagtcattgctattagatacagattaaaatcctaaatacatatataattactctatccgtcccaaaatataatactacttatgtcccataataattgtatttctaggatttgtatttgtcccaaaatagttgtcacaatagagtactaatggtcccattgatcacttctcgttcaaatttcttcatattatagcctcaactactctctcactctttacctatacacccttgaagaagggacatcatagttttccttcacaaaccttaatatatgctaaacactctagaattacaattattttgggccgggtgtagtaacttttagaggtaggcattggtaagaagaaagcttaaataaaataataaatggttgtgattagctgagatgatgtagctgagaaattaaatgggtatagcagtccaattaatactcatcctcactactccattctgtgtttgacccatggagtgaaagaggagatttctctctctgcacgcacgcttcccaaactgttaaacggtgtatatttttgaaaaaaaatctatagaaaagttgtttaaaaaatcatattaatctatttttaaagtttaaaataattaatacttaattaatcatatgctaattactcacctcgttttgcatatttttccaatcttctcatttctctttctctcaaccccaataaccaatgtctgtgacgactactacccaacaaaatttcatggaaaaaatgtgagctgtatatgccagtatgttgaataaattcagctgttcattacaactgattctatacaaaataaatttagaactattacagatataaaaaatatacttgaataattgcttggacaattacattctttggaaacaatattttctctagttattcatggtaaaggcataatgccctgtttccagaaaaaaattacaatctagtattgtttcaattataatattttagtaattggtagttttaataatttattgtacactatatgcactttacttcaactatgttcatgttagtttttcttgcacatgccttcatcatttatgtttgaaggagtgttttttttaaaaaaaaaaaactccgtacccctattctcaaaatcttgtgttcgccactggaaaaaaaataaattccttcaaatatatatgcactttatttgggacacagctttgccacagtggtatatagaaacatactggaataattcatcttcatcagcagctgactttatctagttttgcttgagtacccaactgtctgttatggtctaatatatgcagtgatctggggtgatcactaaacaaatactccccccgtcccagaatataaaaagttttaggttggacacggttattaagaaagcaggtagaagtaagtggtggagggttatgattagatgagcagtggaggtaggtaggaaaagagaatggtagagtgttgtgattagttgagaagagaatgttggcggagaagctgttatattttgggacaaattctgagagctaaaagttgttatattttgggacggatggagtagtacttatgaagacaccttggtctcacagatgtttttaccatttttcatgaaatatctgaaatgcaaaaaaaaagtggtttcattcaaggattatatatatacatgaaatggagaaatattatcattaataaatctaaggctgagtttgaatataaatgtgttgagaacttctttccctgcaaatgcaaaattaagcgaattattagcgcatgattaattaagtattagctaaaaacttaaaaaatagattaatatgatttttttaaaaaaacatatttcctatagatttttttttaaaaaaaaatacaccatttagtagttcaggccacgtgcgtgtgaaaaactaggaactctgtggctaaagagcacttttgacaccaacgggcaccggtggtttgcgacagtactacatgtacaaaagcgtggctttcatcttttgcttgttgagttaccttacacagcttaaatttgaattttgaaataaagttggttttttattgtagtttatttgtctagccttggattttaattaaatgctaataattaatatagatataaaagttttacaatagattaccttttttactttcgtctatattttttttaagtcttatttgctataactacaaatgacaaaagaaactccgtagttagttaacttgttagcaaagtggattggctaatgttggggcaatgaaacatatgtgtctaatcccaatgttgggacaccaatatttacaaacatagtcagcaatccaacaattttggcagaaaccaaacaaccccaaaaaactagggcttctattctagagctagtgtcatattggtaccaaccaatacatgtcagtacgagacatggtacctcatcaataccagactagtggtatcatacccaggcgagggggaagagtagaaaggatggagaaggttactggcgtcggttcttccacctggcaactacgacgatgagctcaggcagcgacagatccggtggcattgggattggcatgtgttgtatccaatgactgggagcttaggcgcttcaaatccaccatggatgggcaatggagaggggcgatgagaaggctacagctacatcggggttgtgtggtgtctcaggtggaggcggagtcaacagcaatgtagctcgccggtcagccaagcatcccagaacaaacaaagaaacctaggagtcgagcccaatccatgagctgaggaatgataccataccatatgttaagggatgtagccggatgcgccgcactcgaagtggatgagaggacaccgccggtgtggaagagaatagaggccatctggccttgttttccgacagtgctaccgccatggcccataccgtcatagagaattgaatgggaagagaggaatcgtaaccgtcggctagggcctcacgttgcggcactcctagagtgcagcgtgggtggtagctctatcgcgactgtcgccaccacccgtgcattcacttggtgaattatttggaatcataccgtactgatgctagggtacggaatcccgtctccgagcattcctattaacaattggtgtagcaagcattatgtataatgggcaagtggggagtggatctcatggaaaacatcatcgctttggtattgcccatgacaccatactccgttataattaccaccagggaaggtgtcgaatggcaagcaaattacgtctgttagacaagttccgcatgattttgcatgcgcagattgttttctatccaggccggtgtgttgttcgttgctgctggttgtgttgttgtgtccaattcaggagctgcccaaaaagcatcattcctttttgtgtggaggcctctttcccttgatgcaatcttctgtttgattattgctgcatcttgggactgtgcggaaaaggaccagtgcttgaagcacaaaactttaagtgcgatttttgtgtcattttccctgaatcgattaaatttattccaaactgatatggcaaaagtagtaagtatcacatttgagatttgctaaccatttgtttgttctaaggcttaaaagtactgtacgatagcatattgtgcgattaattaagtattttattagtactcaagatgatattacactacaattatcagcttgtcagcacttctcgatgaattgatcaccgcaagctctcactctgtcagctcaaactcatgacaaaagtaatgcagcgtactccctctgtcaaaaaaaaaatcaacttataagagggtgtaattcctcttattacaacaatccctttataagatgaggggtcacgtcttcttatagattaagttttttttttatggaaagagtacgtggttaggggccacggcccagactatacaccatgatcggttagtggcgaatgccatatcctaaacgctccgatcgtggcacacaacatgcatgaactggatgtgcgtatatatggtgtgctctagtggcgccgacaggctctcaacagaaagaagcagaaacctaccggaaaaagaaacaaatgtgcaatgcaagtgtttggctgggcagagtttttccgagggattagagtgtttggacggatgaagctatcgagtgttttgtttgattagagaacatggaaattttgatatgacgggatgacgaattgagggaggaacccctactttttaatagctaggtaggagtgagagttggacaggaattctccctctatgttacctaaacaaatctcggccatccatttttacttaagatctaccgtctagctaaactccctatcaattcctaccacattcgccaaacaagagattgaaattaaaaatcaaatttttacactaatattgctactaatttactcgtttaaattcctaatatcctctttccctaagttgctaaacatgccaagtttagcacatcttaggccccgttcgttgctttaaaaaaatttccgcacacgcaaaacgagaaagctcactagaatatgattaattaactattatatatatatatatatatataaagcgtaccatttaacaatttgataagcgtgctaaaggagaatgaggaagttgaagaaaagaactaagcctaaggccatccccaaccctccatgtcatttagtatgtgtttgatttggggacaaagtgggatgggttagactcatccctatttttaggatgagatgatcccatctatctgtttggcataagggatgggatgatcctacttttgaaggaatggcccacatgtcagcgagagaaaaaagtgggttggatttgtccgccggtttttgagggaccatgccaacccggatcttaagggaatattccttgtcagggaccatcctatcccacctatctccaaaccaaacacactataaaaaataggttcaacccaacccgacccatcccaagttcccaaacctttaaccaaatgcatgcagtatccatagcattaaatacattgccacataagaaaaaaaactaatgtgacaggagaattaatgaggagagagataaaaagatgaaggaaccatttctcatgcaagaaaccatctctacataagtaccaagaatgaaaacaagggaatatatgagaatttaatttgaagacatcatcaattgaatatatagtttctatgcatagtgcctatatgacatggcaaatatgaaaactacttgataggtatttaaaattgatgaagatgaagattaagttgacgcacatgattagttaacttttaattattataaacttgagaaatggatatatttgatattttaaagatatagaaagttttcatacgaagatattgtttagtactttgaaaaagagtaaattacattggtggtacacaaacttgtcaggtgggtacaatctagtgcataaacttgtaaaatgtttgtgatggtgtatgaacttgtctggtgcgtgcaaaacaaggccaaaaggacacaacaaggctaatctcatcgatttaagtgctgattaggatgcgatgtaaacatgcaagtgagaagacgccatatagacatatatatatatatgtgtgtgtgtgtgtgtgtgtgttcaataaaaggtaaaataaggcatgattgttgtcaaagaaaaacataaagaacctgagtaatgatgcaagggtggaaacaaaaagaatgttaatgtaagaaccgagtttataaatatagcatatctcatgcccatctcatatgtgcatatcacgtcctaatctacatccaacttggtaaaattagccacgctatgttattttggtattggttcacagccactaggcaagtctgtacaccaaaacaagcattttacaagtttatgcacttgattacactcatctgacaagttcgtgtaccgccaatgcaatttactctttganaaacgtgataacggaaaccgagataaaatatgtatcttaatgagaaaagaacatgggccctgtgctaatagcttagataattctgaaaactcaattccctctcctgatttgtactatgcaattccttgtgttgctgattgattagcaaacaccgagagaatcatgcaaaggttttgaagccccagcaagcaaagttgcgagcttctgaattgaaaggtcagtgtagaagtagcagtctagcactgggttcaatgtttttcctcagaaaacctttggagaatgttgtcattggccttcttttttttggttcatatgagttatgtgtgtgattctgatcttgagcgcgacacgaaacaacacaaatctgatgatgtttacgtctgaagctgcaaattgcccacgaggacatgcacggagaataatgaggtaagaaaaatgttcttcttgaccactgggtagccacaccccatgtcacttcacgtctgtcgaagcgtccatcccagccttctgtgtgtctggattgcgaaactgtaggctctattatcagaaaaaggattcactgcaaacatatcacattttgcctcatttttttctctgaaatttgnttcaaccagttctcttcatgtctncgcttaaattttttcaatgaagtgtttttgtttcattttttccctgtaaattttctttcattttcattaatttccttcagttttttacatttattagagggaagggaggaaatgcaaggcgtaagagagcacgattataatggacaaaaaataagcccatgccaaattcttaatgggctgatgtgagcctaacaaatataagattaaataggctatcaacgaatttttttatttatttatttgtaaatatttaggaatatgctttggttttcaaaaattacagaaatatacccgtaacgtcctttatatgagcgctttttcttgttttggaaaaaaaaaagccctctacgaggactagagggacttaaatgcaaaatttgctttatagcttatattaaaatattatttagtaatttcaaatttttttttggagttggataaaatcaaactttatattaaaattttcaagctcgataagatccttatagttaacaacttatttatttaagatcgtttagaagttcgaatatttgttacatacaaaagttgcataactcaatcactattacaaaaacggacatacatgttggcactatcgggctagaaatgctaaaacttgtacttatagtgcttttccccccaaaacacgcatccacgggacatcatcggctaaaaccgtcacctttatagagagataggtgtcggttctaaattaaaaacccaacacctataatattagtgtcggttcatttagaagaactgacatctataatatattataggtttcggtcttttaagaaccgacaaatatatttatattataggtggttttataaaaaaaaaacggatacttattaagaaaacccgcgggagccaactgaa

SEQ ID NO: 60197 - DNA, 668 bp, Oryza sativa
  unsure (1)..(668): unsure at all n locations
gcgccaaaaatgaaaagattttggatggatgagacatttcctagaattataaatgggacatggtgattaattaattatgtattagctacacgaattaaaaaatgtattataatgattttctaaaactactttgttatagaaagttttttaaaaacacgcatcagagaaacgtgtgtgtgggaaacatggttggagaagtttgaaacatccactacgaacgaacttagggtttgtttgggagcttttgacaattacagttttttttaagaatcagaagctttctcaaacagttcagattttaagaagttgtagaatctagtaaataaattaaaagttagaaactgaaaaacctaatttatgtagatttttagaaactgactacttaattaactgtttcttcgaatcaaagtgcggtgccaagcttccgattgttcacgatagataccccacataatccctgtagagcaaattattgggattggatgcctggatctgatcgaaggacactaccatgatgcgaattgagtacttctcggtcagtcgtccctggccccaaaactgcagtgaattgacgagatcacgtacgtgcatactatgccgccggaacagtgctagctagtactccctgaaaaaaaaaaaagataaactcttcattntcgtgtccaatg

SEQ ID NO: 60198 - DNA, 7800 bp, Oryza sativa
  unsure (1)..(7800): unsure at all n locations
ttatgcggcaaaaccgaagacgctgaacaaatgggtatctagctcacacacgtaaacatattagaagaaagtagtacagttttagttacacaacgcaatagaccagacaggctgttgccggggtacaaggaacaaatgggtatctcgtggatgtcaagaagaagatcgaacatgtggactgaaattatataagagcagatcgtcctcactcctcagagtgtcagccctcagctctgtcttgcccttaatttcattctttcttcggattcaccgagagtggttgatgaaagccaaaccaggtgaattactgaaattaaagattcgagagatacgaactggggattggacaaaattgaaacgacaactcccacgaatatatgttccaataatgacaaggtcggggaaatgtattagaggatggatacaaaattaacctgatgccgtcttttggtgagggggggacacatgtcagcaactctgcatgtacatgttcttgtttcttcagagaacggcagagacagacgacaactagtgcgtcatacatggatggattttttttttcagatggaaaattgggattttacacaaattaaccatttattattggcgcatgcaacacctataactcgattcgttagcaaattgcttagtgggttcggcccaattgatctggtgaaattcagctcagcttgacgatttgcagtttcattacaaagcccaaagctaggctcaccaaatcaggaccagtctgaaacaatagaagaggtatgtgcaaggaccctcggcttcggttcggcttcggcttctttaaaatttgcagtcaacaggatcagatgattaaacttacaacacaaaaatagaacaatagatagacgcaattgtgatatgcctctcatttctcatctgatagctcaaattgatnggatnnagatggatnnaatttgaannaaataaattgtgatagctattcgagggataaacaaattaattaacttctacaaagttgaaaagttgctttatcaaagtattccaagaaaactttatatagaattgtgttcataaaatgcaatgtttaggagcttgggaatcatgcgaacaaaaaatccaaaatctaaaattagaaaagaacagggccttagactatggtgctaagttttaatttcttcgaattcattaagacctctttttgaatgcatgatttgaagaactgcatgaacaggaaaaaaataatgagaaattagggtggcacaccaacttgatcctaagtaatgtcaaaagcacacaaattacttgaatcgcgttgtttggatgcttcacaggaaaatactacatgaatttggagagggaatggcagaaaggaaatgttccatgtggttaaatctaatggtagaattcctctaaatttcctatgtatttggttattctataggaatttcaaagggtcaattccttttgttctaaaggagtacatataggaaaattttccaaaagattcaaccctacaagtgctccattggtcaaaggaaaaaatgaggaattttttagaactgaagtcctttaaaaataaatcctacatggtcatttggaacagaggaatgacctttcgaaattcctgtgaaataaatgtaggtattttgaaggaaatttagcaacatatctaatattttattttcttgtctcttaaaattctatgtgtttctcatagcgttaccaaaccatttttccttcttcttcttcttttttttttgcaaatttatgtgggttcactttctgtatcattcaatgagacgtgataacacatcttatttttgtgtgttttcctattccatgtgggctgagtgcgttgactggtcaaggtgtgtgtctatgttaaaaagagtgcatatacctctaatcttagttatacatgtgctatgatgtatccaactgatgaatatgatgtgtgtgagagtgtggatgtatgagtccagcagcgtgtgctcagaaaaaaaagtacatttaaatttgaattctctgacatcattcgaaatttcacttggaatttacttttgtcccacattgatacctcgaaatttcacggttttcattaacacgtaaaccctgattgcaatgttgtacaatgtgcagttttagttcgttttaactacaattgttgttgttatatgtggttttactttagtttcatctaagttctaaaacattttgcgtgtagttttatattgggtgaatagctaatttagtccctcaagtttcacaaaaggctcaatttagtccttcaggtttcattttgtccacataggtcctctaagtatttgttttggcttaaaatcatccttggcccacttaatatgccatatggatatttctagttaacaattctattagaaaatgtctcttttgcccttaatatgtacacaactatacactagaaaaaaaaacaaaaataaataaacaacattgcatatgtacttcccattatttcaacatgtgcacataaaaaacttgagcctaatggctatcgtatacacttgcaagtacataatttatttttgttttatataaattactatgcattatctataaaaaagaattcatattttttctctaatatatgtgaatgagggggtataagtgtcatttatcaagagaattgtttgttatgtaggttcaaggataagtttgaattaaaatagaaacttgaaggactaatatggacagattgaaacattaaagacaaagttaatccttgcgtgaaactaggaggaccactttgactattcacctttttatatttatgtatgacttataattttgttcttgtattgttgtaaatgtgtgtatgttagaatagtctattattaattcaatcatcacgtagtagatgaaccattggattttcatccaacggaaaaaaaattatagcaacccatagaaaaacaaaactacttgggctgagtaggtttgcttctttttctgtaagataactcagagttccaaaccaacttctaaaaagataaacactcttactaatcaactagcacagtgcccgtgcattgcaacggaacactcaaatttcatgagatgattgtttttgtgatatgagcatttcttcaaaaaatgatgtttctaaacaaaaataataaaaagtcatagttacaactcatccaaaaagaaaccaatccaaatctaaatgccggaactaccttttatgaaagatcagtaaagctaggaaagaaaattactataaccacttcaattgaaagtaggatattcagcatgaattgtttcgtggttgatgccacgccatcagcaaaagccatgaagcaaaatcatcatgctaactcaaacaactcgattagctcaaatcccgagataaatacttgaaagatgaaataaaaaaatataactctattagctcaaatcctgagataaataataaaaatcaaatggaaaaggtagtttcttaatcttggtaacatgaaaattagatagctaagtcggtttattcagtatttttgtaagaaaaaaggggtttattataacgagattgattagctgcagaaaaaaaacaatctatgaaggagtgattgattataagtaaaataatacgggaaaattgtcaagtgaagagctctaacattcgcggacaaagcacaaaacagaccttgaaggttagtgaattgcagggccttgcgaggggtggcaaaaaaataagcgaaaaaaaatgttggtgcgtcggtcattagtttctaattaacctgcggtctgtggtttaggaaattttggtttatatcgtctaggaacgtaaaagactgaaataccagacggtcatgtgcagaaaaagatcaaagtgaaaggaatgaggccgagatagaaagtactgagactgaagaattctgttttaggtattgaaagatcgaattttaagcaattaatttagttagtagccatggttaatcgattgggaaaaaatctctctctttttgcttgctaggagaacattataatttatttgttgaagcgaagtcaacatcgaactattatgagtaggatgtaactaattgtccagcaaattacaaccaccaagcagcagcaggtggcccaaccaaattgcacaaaccagtctaccgaaatctctactattataagaattaaaaatatttatgcctaaaattttcgtatgtcgcatgcatccgatacgaagaagatcagcgtccgtgtttagttcccgtctaatcatccgattggcttgtgcatccgattagtgctgacctgcgcactaattaattatccgtcatcgagcgtgcatcggtttccctaccccgttatatcgttggatcgagcactccaattcagcctaatcaaatattaatttgaggaggtgtggagcgatctggctagaagaaaatcaaaaaggaaaaataaataagatggaagttttgggctggtttgaagttttgggctggtttgattaggtccgttactgatcaagatttgactagatattgcttacagggttgacggatttcttttccgtgacaacacatcctaccgtgcacatcagcacatatgggcgaggtcacagttgatttgaacaaataaatcttaactacttagaaaatttgtaacttttcattcatcacatcaatttttcgtccataagtccaatgaaacgatggcctccattcccacatgcgcgagtaacacatcgcctaaggagaataaagcacaaattcaaaaatagatacaaaatcgaataggacaatctaaagaaagagaaaaagaatagaaaaataataaaagctgcacagatcttatcttaatctttgtcaccaccggatctgcccgtgggaagccgccatcaccatcagatccgcttgttggaagccgtcatcgtcgctggatccgcgccgatgccgccaacactggatccgcccgcaacaagccgccgacattgctgtcgccaccggatccgcccgttgaagccgcgagaggacgttgtcgctcatgatgggggagggccccacctccaccacccgtgctgagtgagggcgctgccaccgttgcacgtggtgggggagtgcaccgccgctcgcgtgggaaagaaggggaatgcatcttgggttaggtttttaacatacaatgttttatctaaatcacaagcgatcctaaccattcgatcgaatccggcgactctcagggcacctacgccgacttgggccatggcctgccatatgggcctaatgcatttaacaagccagccacggtgtgaaagagagatacgggccatccttctaatcatgggcctaattatgttttatttattttcagtggatttaaactattttttcattagtaaacttaatttaagcactactttaagccattaaaaattgctgaaatttgatatagtttttcattcttcatactaaattacttctagctaaatggagtcgacaaaaatgtaattacttatttgtatgatatagaattaggtatagatttaattcattgtttatttacaggagtgtcctatataattcccatgaaactataaaataactataatcattatcataacattagtttttccgttgtaacgcacggacatcttttctagtaaaaaaagagtgaagtacacgggcgatccttaaactcgtacggatgtgacatctatattcctaaactctcaaaataaatttttgggtccccaaacttgttatgagtgtcatataggtccaaacaagctccaacccgctcagtaaaatgatgtggcatgccacggtgacgcttacgtatcagtgggatccacatgtcaatcatatagaagaaaaatttaaaaatagagagagagaggagaaatgatgtttttaattttgaaaaaataaatgaaaaaagagaggagaaaaaatatgttcttaattttttggcaaattttgctacaggacacttcgattttgtggttttagctataggacaccgtccgaactcactcttggggaaaacactccataaacgaggtaatttgccaaacgacactgcgttgattagaataataattttcggttgaagattagagagaaatcacgtgaaatgtcaaaaatgcccttggacccacacatcagttctcctatctctcttctcttctcttctcttctctctctatcttcactccataacgccgccgcgctatgctacccgtcgtcttcgtcatcgtccagccctcccttggcgggagtggagagggcatggaggtggaaggcggggtggttgtggtggcgaagaggcaccgggcggcatcgattgccaaggctcgagctcgtcgcggtggaggagatggcgaggacggcgggagtagcagaggacagcggggaggagagccgcgccttcatcaccaactgcggccactcccgcagcggaggacagcaatgacggcgggagcggccgccgcggtgttcacggcgggggacggcgacgacgtagcagccggagccctcgcgcacgacggcggcggcgaggtcgatcccctcctcgagtgggacgcggtgcgcacgtagcagcctacccaggcggtgacgatggctagcagcttgcggacgtcggcggagggctggacgatgacgaagacgccgacgtaggtcggctcgagcagcgcgtactcgagctcgacgccggtggggtccttggcataggtgaagggtaggcatagacgaggaaaagcgagccggtgcgggcgtggaatcgaggatggggcagagcaatgggaggaggtccttgtggaagtaggccgacgatggcgggtacgacgtggcgagcacaccgaggttgtgtgtggtggtgatgaccacctgcttgtcgagtccgagctgcgcgagtgcttcgtggaggcactacatcgccgggagcagcgaccacgacagcgacgagttgctagcgccgggagccccggctggatgacggaccgaacccacgatgcagcgccgcagggagttgacactgcggcaaggcattcgtcggggacaccgacgacgagctccaccccagtgttggccgggtcggcgtcgtagagccagactcgaccgaccttgagcgacgacagcatcgacgacatggccattcgccgaggcaggttgttgccgacacggtcgtagttgatgcccgagagctgacatggaaggaggaagatagagagagaaaagaagagagatatgagagctgacatgtgggcctaagggtatttttgacatttcacgtgatttttctcttctcttcaaccggaaattattattttaatcggcacggtgtccatgggcaaattaccacgtttatggagtgttttcccccaaaagtgagttcgagcggtgtcccacgactaaaaccacgaagtcgaagtgtcctgtagcaaaatttgcctaattttttctatatgtggctaacatatgggttctattgacatgtacacgccaccatggcatgccacgtcaacacacagagtgggttggaacccgtttggacctttatgatacccgagacaagttgagggatccaaaaattattttgagagtttagaatctaattgacacgtccacccaaatttagagaccgctcgtacgctttactcttagaggaaaaaaaaagaggaaacaggaaatggggaaaaaaaatcccgtagatctcgtcatctacaccacgctattcgtatcgctcgcgtcgctgctcccctctatctaccaccacgccgttcgccgctgcctcatccccacccctaccggtgagctcgggggcgtctaatccggcagc

SEQ ID NO: 60199 - DNA, 7972 bp, Oryza sativa
gcatgttttatgattaggactgcaatgctttcaaaaaaacgtatcatcgcttttgaaagtagttttaaatgcgcaaaaatatataaaccaggaaatgacatgctgaaagcagtaaaggcaacaaaatcaatacctggtgtaccaacaccaatcgtgtctccgagtgagatctccgagcaacccatgtcataaagctccttagctacatatgctacctttgatggatgaattgtgccttcaacagggcaaccaaccacacatgaaacatacctatgacaatcaaattttgcaaattctcagatcagattgctgtctgttcattttaactttcaggctcgatagatcatcaagcttatgtgacttacccacggattcgtattccatgtttcttggcagaagttacaacatcatggtaccgaacaaggctttccttgatggtacaattaaggtttgacttagaaaaggattcagaggcagatgcgaaaactgcaacttcttttgcaccagctgcaacagcagcctcaaatccctggataagtggagataaggttgattcatcacaatagatcaaaagtcttcaaaaaacgatacgtatagatagtctattggtgctatggtgctagtatattgtagagtctcccaataatagaacagaaccagacatactctgaggttaggagttaacactggaaaccgcacatctggcacatgcttaatcccttcaaccacatcctttgcatctgctagctgcaactccaaattgagtgataaaggttagctatttgaacttgaactgctaccaattttatcgtgtttttgttctgcaatgaattttgcaatacaagttttacaagctaatgtcccaattttaacattttttgttatgtaataaattttgcggtacaagttttacaaactaatgtcatacaaaaaattgatagtgaaagaagttagatggaattatcagtaacaacttctgatgagaaattaagtgctaccagatatgcatgagtttctcatgcagcatgacatgctaaattcttagaaaaggcggttcgtttcttcacctaatctgagtaaatactgacaaaaaacaaatcaagagctatcgtgacaatctctcaaatgtctgtgatttaaattaatgtatgatactagtacacgccttcacctaatctaagtaattacctgtggcacccattttggggacacaaaacttgtggcttcaactactgatagaccagaagccaccaatttgtgtatcagttcaatctttacagatgtgggtacagtattcttctcattttgcagaccgtcccgtggtccaacttcaactatcttcacaaaccttggaaggtcccataaaacctgaaaaccagttaatcatcaattgagaaaaggagtaacttgtggtaatacattacgatcactatacttcatcagcggccattttcacttatttagttataaaggtaaatagagaagactgacatgttgcattgccacagtcataatgctacatgtgagttcattccttctatttgaggtggtctgatgaaacctataacaaggaaatgaaattgaatacacccaatcacccatgagccatttcagttacacatgatcaaactaccttccgtggaagagctctgaactccatatccaccccattgcaggatgaatcagtatattggccttgcatatgccatgaatgagcactgctgtgaaagatcgtctgattgttgccaccattgcgatgcttgtaactgaaagtaagttcacatggtcatatcatacgagtttcagggcatacttcagtaataaaattctactgtcactaaagtaaactaacaagttcctgaagaaaaatagaagtgttgcaaaggtggaaatgtacatgatttgcttaaacctctggaaatactggaaaaacattccgcgtcaaagtaaaaataccgacaaagcaacaactaggaaaggaagaaatgtagcacggtaaagtttgcaacagtagaacactagaacttacttgttggtgttgctgtcatcaacacttgctctgcaggcacttggagagaacctttcaagtctgttaatactcaactttggcaggtccccaagaccaagtggctcctcgaggcttgacattctgtgaagcaggaggcgttacaattttaacaactatgttgagatgaatcttgatatgttaatatataaaggacacgcccggggtgggggagttgaggaacatagtcagaaatggtgcactagtccgcatggaaaggaacgtttgaaatccaatccaatgggactcgcaaaccatgtccattctcccggcatggtcaatgtgcagtgtgcaatgcttgcttgcacaccggaactcgaacttggccagacttcttctttagatattgaattgcacatgagatactcaccctaattaattatccatcaagcaggtctctttaaccattcaatcatgaaatgccatgcttgatgaactaatatatgatgatgcccagtaactagcagcaaaaatggaacagcgccaactgctctgtattaattcattttttttccttgtaaatactcaaagcaaaccaagatactacaaacccacactgcaacctctccatgaaaccaaatcaagcaggccaatcggcaacatacttgctacgaagaacagggaacagaaaggggaaagaaccaagaagaaacaagaaatcacatacctcaatcgaacgacgaattcgaagcaaacccgatcgaatcgcacccgagattgagggatatggggcaccgaactcaacaagccttacttgaatccgacgcaaaggagagagcagagcgccgaaaatggaggccgcggcttgcgcctccgcgtctccgccaagggaaaggaactggtcggcgaggtcgcgcgtggacccggttcacggtgagatccgtggtgcagcgccctgggccccaggtgtcagtgggagttggctcacgggacccggtccagggagttgagtctggcgggctgtgcggacgcagtggcgttggtggtaggtctcgttcccgttttctagttcggtgagcggccagccgaccacctaaaaaccccggactccttatcggattcggtttttggataattgtgcattacccgttaacacttagcagagcctggcattgcatttgcatggtcatgaacccatggtcttcatatgtagtagtagtagatttgtagcgaagaataatgatgatggtgattatgaaaaatattcatggttgtctatatgttcagatcagaatgaatcaatcagctgatacgatctggatttgtggtcttgtctcatgacagcaacgagacccgattcgcaaatttgtatttaatgatctctgttagtgcagacgtggtcagctgagttccagaagaaaaatcggattggaaggagtggtggccatgattttgttgatgtatttcctcctcgtgttttataagagtaaccatcatccgtcctattcaattcaatttatggttgaaatagcaatcgtcattatagcactagataaattatacatacgtgttttgcaacaaatataaaaaaaggacaaataatatcaacgtatatataaaaaaaaggaaaaaaatcaaattgaggccgaaaactttacacacctcaactattattctaaataacgcccctcaactttaaaaccaggatacccaatacccgtcaactattaaaattgtctggctgatttaccctctcaaggttgttttcactagattaaaggggccttcatgcatgaccagtcagccaaatcaaaattaaaaaaataatatggatcccacattcatgcgttggaggagcaattagttatctacatgatttgaaagagctcaagcaataaatctcattgtgcaaattacaattgctgtggaggaagattttcagcgattcgagcattgtcgccagggagaagataagaggacactaccagggaagaaaattacacaggacttctttgcgtgacagctgtataatacgaatctcaaagcaacatgttttcttccctgatttccccagagacttgacgagtaaacgtgttctcctgctgtcgccgcacgccggtcccaagtggtctcactgcgtcccctgcaatccttggcggtgccccctcactctggcccttccttgtgtccttgtgggctgtggccctccgtgcctctcgtcgcgtggccaacggtgctagctgcagctcagtggcttgcacgtgtcgaccagctgactctttgttagactgactatgcaggtggtggggattatcacttagttctcgccaacacttacgttgtctcagatgaggcggaccaggaggttttttcggagctgtcaattggaaagaagttcgacacctaaaagataatagagtaggcatacctataagacttcaccatggtcttggtgatgtgctaagcaatggtggttgcagggctagagattggctcatggcggagccaagagcatctcactaacactagtatcgacaattacgagtttgcgacgatgccaagattgtgcacaccttatcgacaaaatcatcacttgggtgcttgatagagctctcgacactttaatttcctcatccttgtggcatcatttttgcagtttcgtccatgtccgacgtggaggataaggcaaaaataccaaaatgaccttgtagccacctataaggtggtagcgctcttgttgttgctagtccagtctaacttccatgttgctagaggcccaaagggcacctccgcataaacaaagctagagcacagctctgcatggcatcctccctatggctctagttgcctagagtttggtaggtaatctttcctgcacgcccccctgactttgcattgcatccttcggtgagctccgtcccctgcttttgacgtggcatccacctttgagctctccaccgttgtttgcatactcccactgtcccacatctcatcgtcctcgacgtatccaagaataattacatcatgccaaaaatatctacacaaattagatgagttagcaagcttgtcctctaatttgatatgcataagttgatataaatgaaattggatggatgccaaacttttgagctaatctaattacatagtagtagaagggaaaaaaaaagaaataacaccataaagaaatcatcatacttgtttctggtttcaatacaaacttttttcctctaaacttatacttcctccgtctaaaaatgttgctaactaggatgagattctgaacggttaaattcgaggacctatattttcaattttctgcgcttgagaaaataaaagggaaaatgtcatgtctcctcccgttaaaccctagcttaagcccccttcctcttctccgcgcctccgcctccgcctccgcctccggtctcccctcttctcacacgctccggctccgacggacgattcccacccagtaatggcgatggatttggacgagccgctcgacgcggagaagggcgaggcggcgctgcggcggctgcgcgacgccgacccggtcctctacctctccccctccgacgacctcgccgccgccgcccgtgaggcctccaagcacctctacgcctcgctcgtccccttctcccccgcgcagccgcccccgctctccaacctcctcgcaggccccgccttcgacgccgagcagatttggtcccagattgagctgctctcccgccccctcatcccccagctgcgccgccagctccgccgcctcgagaagcaacccccgtctcagccgccgcctcgtacggaatcgaagtccgctgatgccgaagagaagtcagaggaggaggacgaggaggatggtgaaggtgacgaagaattggaggagttggacgatgtagatgatgaagaggagtcagaggaggaggaagaggaagaggaagaagacaaagaaggattggaggataaagcagggaatcaagtggaggacgagttcttcaagataaaggatctcgataagttcatggtaaagggggaggaggcggaatatggtgggggtgccaagcaagggaagaagaagaagaaaacagagaactggatggaagaagatagtgatgaggaggaagaggaggaccttgatgaggatgaggacaatgaggatgaagaagatgacgatgaacacttggacgtaagcatttcgtaatcacatcccttgttaaattcttagagaccagtattagctctcataaagaagattgatatatagaaccactgatctagaagtatctcaggagtagacaccggaatttctgtagtcgcaaaagatagtatctgtattacctcaggaaattgagcatatggattaagttttaaaacagtttcccgcttgagctaataggcttatattgggagctagcattgggtatggtttaatgcaagatgcatgcttgctaaatgtgattcttaagtatcgttttttattaatatagttggaagactttgacgatgaagaagaagaagaagagggtgcagttggagatataatgtaagcctttatgctattttctgaaaatgctcatatcatgattgatagaatcacagaatgcgaaacagttcgggtttccgcacagtgtttttttatctttaagtgattatatactgggatatcaaatggttttaactacatttgaattgcttttttgaagatcggtatgatattcgtagaaatggaaatggtagtcatttataaatttgaattgtagaatcacttgaataattcttcacaaccttttcctattttatcattttcatgctcgacacataatttgatctgtttaagttaactgtcatacaatatgacctgtttagctcagagaagggcatacaaaggcaaatggagtaggaaaacaatgggctccaaataatggcatggaatggactcaattaaattagaaaacattaagtatgtaagacaaacatattacattttcatgtaaattgttaaaaaaatgatgatagcacaagaaaatggatttatgaaaaaacaattagattaagcataaggcaaagaagaagtttgttgaacactaaaatataggtataaccacgtgtggcaatgtgggaatagaatgctgtgaaaaaaactgccacattcgcataactcataggataatagcaaaggatacctacaagtttatatgtcatgtacaaaaaggttgagacacaatatcaccctaaaaaacacagctttttagcatataacctaggcaaaactgagctgtaagttctgtctacttcttagccactgcaaatgtccctggaaggataagagatctgattagacaattccaagatctcaccatgcacataaatgcattacatcattctttcctgccttgtatttgtccagtggagcctttacagaagtttccatatgttgtattgactcagcaaagcttaatcgttatgcccagacttcggttgtatttaatatttgttcatttatagtattatgctttgaccagcaaagatgatttttccaggtataaggatttttttgaggaagctgatgaccaaaaagtaaggaagaaaggtggctccaagaaagttcaattcaaggatgaaccagatgaaccagaagttgatgacaaaaatgatgatggaaatgttagtcaagtactacacttactcacttcaatataaacaagttaggcacatgtatattatcagcatattcttccaattctgcaggatgaacagggtttgtcaactcacgagaaggcgcgcctgaagatgcatgctaaaatagaggaaatggagaaagctaatcttgaacctagtatgtggaccatgcagggagaggtaatatataatatgtttatccattcattagtttctagaacaaaacagatttttaactttgaaactgttctggtattaaatcatcagctcatggtaaagaaaccacttgaa

SEQ ID NO: 60200 - DNA, 2695 bp, Oryza sativa
  unsure (1)..(2695): unsure at all n locations
agctattttcgcaagtggacctgttgtatgcctgcgaaaatggttgatttttgcaggcgttgatgtcacgccccgaactagtcccgaccggaactagcccgtgacgctccaaattaacctgttaatcgataccagtcccaggaaacagtgctggtatcacagggagacagagtatcacagcaacagaggtctctttattatagagtagaagtacagtcatgttgggctgcggacagatcccgagctcacaactgcattacaaaaggaaagcggaagccaggacttagaccaatcatcacaggcgcgacttgggaactaggccgaaaccctaaaactcatcgtagccgacttgctcctggaagaactcctcgtcagcaggatccacttcatcttcttcagcaactgggggggggttatttatatagagcaagggtgagtacgggagtactcagcaagccaggggaaataagtgtttaatgcaggcttcaaggaaaggctgttgttttagtaattgattttgtttgaactcttttctaaaaggtctaagtgagtgcttctcaaacgacacggatgagacagtgcgtctcgtccggtcggagtatgtgcaatgtatcagtctttagatcttgaaacagggttggcacccggccaacagcttttcaaacggccacccgggccaacaacatttcaaacggccacccgggcctagctgatcccgtcagctgctgatttttcaaacatcgaacccagtttcacaacagcaatttcacaagcagtagtcagacaaaactacgctaggaatcacctcacatccgcccatgaccgtgggcacggctgttcgagcagtttgttaacctctgcagagggggtacactttacccacacgacattactaacccggatcacccagcccgtggggatcagccatgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaagactcccctgataagctagttactcagccaggggtgtcccattccacccatgtggtcgtacttgtcttatgtttggatgaaattccaagggaatcggtccttaagtgcgagagcgggaaaccgtacacccggtacgttccccggtccgcggttttggaaattcatttagttcgcaagcaccgacccaggtgtcgggttttccaagtcttttgtaaaactccagttttacccaagttgtttctcagattttaagtttgaaggcgaccgtcgatacttgcacagagtgcacgaatatatgtttgggccgcttgggaaaggtgtttttctagtagtgtacaccttaaaattgagttaggaatttcaaaaacataaattttgaaacaatttttgtatttatactgggcatgctctgagttgtggagaacgagatcagtgaagatgggttttcaatttttgagtatctttatggagaacttgttggagtttattttaaaactaaaagaaatccaaaatctaggattgggaggtgctgttgggcacggtattgtaaccgaggttcataaaattctaggattgggaggagccatcggttttcgtgttttttttttacgttctgacgtggcgctatttttattggaatttctaatgctttccgataaatcaaaatgtcaaacattaaaattgatcaaaattcagcggaatttatcgaaaagcggtcgaaaatcatgatacggatagagcttgaaggccccctttgaatcaaatgaaaaaccataggaattctagaggattttatcctatgggaaataatcctatagagtcatttgaaacaaaggattgttttctatcaattcctttgaaattcctatggaatgaactttactagagcaattttggaggaaaataagcatgaggtgatgaggtctcacctcatgtttttctctttatgtgtctaaggttcctgtatttttcctgtatgctaatcaaacgatagtttgaagacttttctgtgtttcaaaatcccataggaatccaataagtgtggcatttaattcctacgtttttcctattcctctgttttctcaatcctgcgattcaaaggtgcccgaattctagcggtcagctggtaaggtaaaccctgcttgtacagtacaatagagtaatagacaagccataaccacaaaagtactgtagtagtgaaaaaaaaaccagaaacagccgcaatcaaacactcttgaaaaccctaatccccaaaactcagcaaaacccaactcgtgtttcgttcgcaaagtgcctgtgcaaaggctcaaatccccaaatccatcgaagaaatcttgaggagacttcgtttggacgttttcccagcgcgctacagtgttttgcccccgcgcacgcttttcaaactactacacggtgtacttttttgcaaaaagtttctatacaaaagttgcttaaaaaaatcaaattaatccatgaggcgatgtcacacagggggggnnngggggtaataaaaaaaggccacactagatttataaaaaagacaaaaataaatgaaaatcagattataattataagacacaaccgtcat

SEQ ID NO: 60201 - DNA, 14399 bp, Oryza sativa
  unsure (1)..(14399): unsure at all n locations
agcccgtcacaaatgaccatcatctgtgacatgcaccatcttgaggcccgtttaagataacaactaggcccgttacagatgactcatcagtgacgggctatatacttaatctctatcgggcatgaactaaaacccgtcaccgatgactatttttccatttttcatatgaaatgtttatatttgtaagttaactatagcaaaataattttacgggtagtaaatgatttcaaatggaaaaaatgtcaacaataaagttgtataacttatcaatatttacaacttttagtttggtcatttttcaatataacatttttttgaacaatttgaatttgaatttaaaaatatgacaacttcaaacaacattttcaaatactaatgatttcaattgaaaaagtcatcaacaacaaagttgaataactcatcaagatctaaaacttttatttttgttatttcttcatctgacgaaatgttagtaatattattcacaaattttacatatatgtgttatagtttataaaaccagataagagatatgtcaattttgtgaacaatgttactatcactttgtcgtatgaagaaatgaccaaaataaaagttttagatcttgatgagttattcaactttgttgttgatgactttttcagttgatatcatttagtatttaacaatgttgcttnnagttgtcatatttttaaattcaaattcaaacggtccaaaaaatgttatatagaaaaaatgaccaaaataaaagttatagattttgatgagttatacaactttgttattgatgactttttcagttgaagtcattcactgatctaaaattctatttgaacttttcaaactttgaatttcaaatttcaaattgtttaaatagagtcagatggagaaatgaccaaaataaaaaatttgcatctcgatgagttctacaactttggttttggtgacttttccatttgaaatcatttaataaccccaatttgacatcctggcctagggcataataagattaatagaatactcataccaacatattacaattacttttccggaagccaatctctaaagaactttgacattaagtgtgcttggtctggagcaccgattgagatagctcttcacatcagtgacttctagcctgtgacggacgccatgcccgattgagatggggcttaccgcccgattaagttgagggtatccgttctagtgcatgaagagtattctatgcagaatatatgagcattacagcatatgagtgtaagttgcaagtatctaagagaggagacaaatcccagcagagtttttaagctagctgacactgataaatcaccattaattgattgttaggttgttagcgtctgtacatctgtatgtgacctccctccattcaagaaaaactcaattctgaatatgaacctgaacacattagatttttttctttggatggagagagtatttttcattccttattctctcctctaaaattatggtgttaggttgagaaatttcatgcacatggaattaaattttaccttggaaaaaaaatgttgtttctaagggtcaaattttatcatggttccaataggtggattcagcactatcgtaggatcccattttggtgacaacagagagtttagaatatcgagatgatatcattaggcttttgctccaaatttactgataagaatgttgttgttaacgcaaatcactcaacttaacttcagataaaaacacaaatcacccaactgtaataatatttactactccctctgatttttaacgtttgacgctcttatccaacaatcttaaagttctgtaaattttgctggaccatatctgcaagttgtacgaagaagataatcgtgacacaaaaccaatccacaaagccaaacaaccaaaacaaacacaacttactactaatagtagtagagtattattcgaggcagctttcaataatttcatttatagacatacagtacacacgatgttttcactttttgttttcataaataggcaagaggtttgcatgttttttattaagcagagaaataagtacaataatgagaagatgttcctccacttcacacgtgatcatactcctatagttcgtttaattctctttttacttgtaaaaacggtggatgcaacagcaagccagatcctttaaacttgacctctgtaatctcatcaatcctcctcgccatctccggcgtcaggtgattcctccaatctccaaccacgccacgccggaaggatatgttgtttggcacgtctttcttggtgaagttggtcatccccgatcgattcacctctaaccccgataaactttccatggcacaaatctccacgatctttctgtccactctggcatcctgctcctccgttgtgaatgggcgcccgacgaactcggcgaggcgtctcagatggccgagagtgtcagcggcgagctcctcgtaggtcaagaagagtacctcgcttggcctctcgacgtgccaattccagtagctgaggacgtgctcccagtaaagcccaaacaacgagacaccattacagaattgtcgatgtgcgtcatcaatgttccatggcatgaacctgttccaaaagtgccagagcgagacgaagcaatctttgggatcccggcacaggtacaccaccttgcagcctgaggctgcgacggagtctggcaacgattgagacgggatatgcgtcatcaacagccatggctccggcagggagctcaagtcaggtatccgatctttgacgaacacctgagactcgaggaaagagatgagctggtgggggctatgcgccaggagctcgtcagccctgcggtggagagccgagtacggaagcgctttgatccaagtggtgccggacttggggaatgtgacgaggaagatgtcggtggcgcgtgccgtcaggtggctcttgacgaccatggcactcacgacccccgccgtggtcatgtaccagccgtcggggtggcggctgtatggacgtcgatgccgctcggcgccgtcggaaaggtctccgcgacttgccggagttgatcgtagattttcttgtgggcttttgcttcgtccgccgcttcggttacagaggagagccggaaggaggaagccatgaagagtccacactaaacagcaatgaacaaaattatgtgatcttgtgactctgcagtgtgtagagtagtgcaaatcaatatacatataggtgaagagacacaaattttacgcgttcgcgaaaaaagaagagacacaaatcgggaagtcatgatcagtgttcaaaaactgataatgacattctaacttcctggcattaattgagttgttctcacacctctctctctctctatatatatatgacctttttttagtgcacatcgtgctcagcgttagcttgcacaaaagtattcatgcttaccatgacgtcgtcacacgtagtatactgatcagaagataacattatggagtactcttactccgaaaaatatggatcaagcatgataatagtgtacgttactgtcaacttgtttattagtaatatcggcttctagtttgatatactacacataccgacacatgggatttggcactgatataattattgcaaattgcattccaaaaatgcatcgtgccatcgtgcaacctacttccataaaaaactcaattgttgatttggatctggatgtagtgtatgtccagatttaaactcaagattaaaatttttatgggacagagagagtgtaggatcataaaaggccttttccaccccaaaaggtagccattgagatgaggggctcctccacttatatcttaggtgctttgcccttccacaatcaatgtgggactattcaacggggagtactagtaaacatctattaatttatcaaagaaatagaaaaagaagcctccacgttcgctctcatgggaggaatcttcccatcgtgcgcccgatgcccggaaaaaatcagccggtcaaatgtttctattaactaacgagtaaaacatgttatatatggtgaaaaaaaagcaactaaaacatttaaaaattttacaaaacatggtgaagatacacgttgaaacatatcgctattgcatataattaaaatagctaatcttaatggattgaaacatatgtttttctttaatcaaaatataatcatgcgatatctcgatgtaaagatttaattgtaacaaatacacggtgtgatcggatcatagattggataaatagtttagaagaaaaatcgttttgaaactcgctaaaatgcatgcatgcatgaggtggagagagaggagtgagagtagtggcagcaggtagtttcaagaattttgtgaaacatactaacgacacctattgaaacatttcactatcacgtatgaaacaatgagtgttaatggattgaaacatatatttttttcgccataatataatattgtgatatcttattgtaaagatttaattacaaagaatacaaggtgtgatcagatcgtagattggataattagttgagaaaattcattttaaaactcactaaaaagcatgcatgcatgaatgaggtggagagagaggagagggagaagtggtagatagtttcaggaattttgtagaacacactgaagacacatattgaaacatatcactattacgtctgaaacaaagagtgttaacggattgaaacatatattttccttttgtcatattataatcatgtgatatatctattatattattaaaacagccttgaaagaagacatcacgttcactgtgggggctagaaattcccacattaatcggagaaaaagaaaagaagagtctaactaggaatacaatttaaaaaaagtgaaattcgaaattataaataagcactattgaaagaaaagtcctcataggaacacaatacgagattaattaatattcagcataaaaaataaaataaaatccgaaattagcaaaataaaaaaagaaaaagaagagttcgagtagaaatacaattttaaaataactaaaattcgaaattaaaattaagcaaatttgaaaggagagtccatataaaaacccaatacgagattattaaaatttggaataaaaataaaataaattagaaattagaaaaaagaaaagaaaataagagctaaagtagtaatacaatttaaaattaactaaaattcggaattaaatataagcaatattgaaataagagtacatataagaacccaatagtagatgaattaaaattcggaataaaaaataaaataaaatccgaaattagacaaattaaaaatagagttcaagtaggaatataattttgaaatgacttaaacttaaaatagaaaataaaaatattaaaagaacacattacaatattagttaaagtttgaaaaaaaataaaataaattctaaaattagaaaaagaaaaaatatttcaactagaaatataatttataaataactaaaattggtgataaaaaaataaagactattgaaagaaaaaagatcatctataacacatcacgagattaattaagtaatatgcctataaaagagtagagttgtgacggttgatgggacatctaaaaactattaataaaacaccaaatagaattctaatgacgattaaaaggaaggacgacgggaaggtcgtgaagcaatcggtcaaggcggttggcgggacttatagaaagtaaaaaaaaataaatccaatgataatcatatttgattttgaaaatttcgacgataataaaaatgagaggtagtgagcgggttgtataagattacaatggcagagccgccgatggctggtgggacttctagaaagtaaaaaaaataaattccaacgatagttatgttcaatttttagaatcccaatgataataaagagtaggcggtggatgagtcgtagaggagtacagtggtagagtttgacgggatttctaaaaattatatataaaaaaagaaacccaacgaaacaataaactctgaaacctataagatccaatttttaaaggttcgtgcttctaaagtaaaaaagtaaaccccaatgataatcttgtttgatttaaaaatctcaataacaataaaaagggcaacagcgggtgaaccgtagaagagtacagtgacaaagtcgctgactttttggcggaacttctagaaagtaaaaaataaacctaaataataattatattcgatttttaaaataccaatgacaataaaaagaaaaggcagtggatggttgtagaggagtataatggcagcgtttgatgagacttctataaattataaaagcgaaacccaacagtaatttgaggagcttgcaataatttcatttatagacatacagtacattctatgttttcactttttattttcataaatagacacgaggtttgctttttttttttcattaagcaaagaaataagtacaatagtgagatgttcctccacttcacttgccaatagttcattttattctctttttgcttgtaaaaattgtggatgcaacagcaagccggatcctttaaacttgatctccgtaatctcatcaatcctcctcgccatctccggtgtcaggtgattcctctaatcaccgaccacgccacgccggaagaatatgttgttcacgtaggttttatcaaccatgtcagttgtccccgactggttcacttccaacctcgacaagctctccatggcgcaggcctccacgatcttcctgtccactccgagctcctgctcctccaccatgaacgggcatccgacgaactcggctaggtgtctcagttggccgagtgtatcggtagtgagctcctcataggtcaagaagagtacctggcttggtctcttggtgtgccacctccaatagccaaggacatgctcccagtacgggccaaacagtgagacaccatcgcagaagtgtcgatgtgcctcgttgatgtcccacggcctgaacctgttcaagaaatgccagagcgagatgaagcagtccttggaatcctggacaacacctatcatttacatacgatttaaatagttataaaaaaattaaaaaaaaattagtaacatcaattgtgatgatataagtctacacacaaacatgtaggactaaatttgatttacaactagagaaacaaaaataataaaatcagacagtgaatagtacccgtacagtgcagataaaatttgttatttttgtttcatcatatatcgatcgaatatagacttgcatgtttgtatagtgtcttatattatcatagtctatcttaccaaattttataatttttttatataaatgtttaaattacatacatacacctaggtgccaggtgccatggcatctaggtgtagaaaatactttctgttgggatcccggcatagatacaccactttgcagccggagtcggcaacagagtccggcaacgactgggacgggatgtgcgtcatcaagagccgcggcgccgggagggagctcaggtcagggatccggtctttgatgaacacctgggtctcaaggaaaggaacgagctggtggggactgtgcgccgctagatcgttggccccgcggtggagagccgagtgcaagagcgtcttgagccaggtggtgccggacttagggaaggtgaccatgaagatgtcggtggtgcgcgccgtaaggtgactcttgatgaccatggcactcacaaccccctccgggaacgtgtaccatccgtcggggtggcgactgtacgtgaagctgttgctgctgttgggtgccgtcgggaaggtctccacggtttgtcggagttggtcatagatttccttgtgtgcggctgcttcatcagctgattggggtgcaaaggagagcgggaaggagggcgccatgaaaagtgaatgcagaacaccaaggactaatggttgttagctggtgttgtgatgctgtgattctgtgaatatgtgggagcgtaaagtgcaaatatataggcgaggagagacagattcggaagtcaatagaacatgaatagtgttcaaactggcagtgacattttgacattaactatcttgttagcatctcttaagtgttttcatatgagtctccctttcttttgtcaatgcacgtgatgatcaacttgagcttacaagaatttattaattcttctgaggatcaaattgtatcatgtcgtcaatcagtgagtttagctcttaatagggagtattaccgccccttttcttagcgaggatgacacatgtgagaacgtactatactgattagaagatacctttagaatcttgtcctgagaaatatggataaaaaatgataaagacagcgtgttatatattgtcaacataaaacaccaaactgggtgattgttagtttagcagtaatatcagtttctagtttgattacatagaccgattcatggatttgagagtgagaaaataactgcagattgcatagtgttgcattcaagagatgcatggttgctaagcgcaagaatagcttataataactgattttgcacagaaaaagatctggtatactctgtaacaagacttgagcgattttgggccagagattgagacctcagtgctggaaaggagctccggcctacgtacggcctgtacaaattggcccagacgggactgcggcctcggtgctgcccataaggattggcccagactccagaacagggttacggcactggaaataagtctatttatatccctcaactcatttatgtggttgaatcgcattcctcaaccgcaacaccgagtataacccgtccaccaaatcccaaaaccgttgcaaattgactcctaggatggtttcaaaggcagttttgtcccacatggcatatttggccccgttgatttgctgagtcagcttgtgaaacccatatgtcaaagacaagaataaaaatgaaaatggtggggcccactgttgcccaccgccgtcacaagcgttccccacacattgccttcgccgcctctaccacatcgcatttgccgcatttccccctccaatcccgcaatacgccaccgccgtcgctggtcgatgccccctcctcccccgtcgctgccgtagcagcaatcggggatgacgtcggcggtagcagtaggcagtgccaatcctccaccccacgtgccaaaaccctagtagcaccccacgcggcggccacctcctcctcccactcatgccagccgtcaccgacgtctcttgctgcggcttcgtggaatcagtttggtcattgccgtagcacgcgtcgatgccaccaatgctgtgggccaccatcggccatccatatgtgttgcgtgcagacggaggtgcaggaggaagagggtgacgggagcatgatccggtccaactcccccatctcccgttacatcgtcctctccttcctcaactccggtcactactcactagtcactactccatcctcttttcttctcgacggctggcagcagggtggggtggtgaccaacgagatggtcggctagaggagcgagagaagggcctagagaagaaaaggaggaggcgaggccaagccccaggatagggttgcccatggtggcgacggaggcggctgctgcggcgggagggaaggggaaaggggaggggggaatgcggcgacggcaatgccggagaggcagggaagacgatgtgcgcaacggcggtgggcattgacagtggaccctactgttttcacttttatccttgtctatgacatgtgggtcccacaagctgactcagcaagtcaacgggtcaaagatatcacgtaggacaaaactgcctccaaaaccatgtggggagttaatttgcagtggttttgggagttggaggatgagttatatccggttttgcggttaagggatacgattttcaaccagggacatgacttaagggaggtataatagacttatttcaaacggactacgtgcggcccatatatgttggtcgggaacgtgattatagactacgtgaggcccatataatctgggccggaacagaaagctagcccagatatgacggtgagcgagcggcgagagcgagaagacgccgccgctgtgaacgagagaggatgaggttggcgcgcggtacgcacttcgccatggaggagcatgagtttccaaaccacctctcatcatctcatgccaacacgtcagtcagtcatcagactgagcgtttttttttttttggcagccgtacgtcgatcgagcgatgcatgcgaagtttcttggtgccttcccgatcaaccaactccatctcgttcacgtatgcattccggtcgtcggcacgttaagtttgataataatgttcacattgtacatacgacttacccaatcacgtaccttagtaattacgccctccgtacaaaataagtacagttttgcactattcacgtttaacgtttgaccgttcgtcttatttgaaaattttttatgattagtatttttattgctattagatgataaaacatgaatagtactttatgtatgactaaatatttttaaattttttataaattttttaaataagacgaacggtcaaacgttgggcacggatatctacggctgtacttattttggggacgaaggaggtagtaacacgtattgtacgtgtggtgtgtgcccccgtggtaatgttgatgttgattgctgttgctgctgacatgccatgcatgcgtacgtgttgaagtcgtgaacacagccgaaaatccaagctgcgagatcgacaaattaaactctctcaagttgcatgcagatcaatttgttacttacctgttgcaatcgaaagtgtttattttttcgagagtgaatatttcctcgttttatttatataatctaaataattataaataaaattaaatgaattggcaagatgtgttatatcactccacaggtttaaacttttgacttacacaaattcaaaaaataacaaatatgatatattagattatacatacatgtataagtcgcattatagttgaatgatatattatatattaatctattttactatatatattttcaatatttctactgacatttttagtgacaagaaaaaacgatggaacattcctccattcctcccatagacaaaagacactcccagtgcaatcctcttccttattttagattgatcatcgttctattgtatttgtgacattatataagatgttatatgatataatgatacaatttcattttcatacatacttcctctatctcaaaatattataacttctaatctaaagtttaatttttatcacaaatataacaatctagtacggtgtaaaagaatatttttactactaaaactacccattctattcattttgtttactataaccctaactagtcttgactagtaatatgcccgtgctaaacgctactgtgcaattcgatttatctttaagaacttttaagatttcacgttagcaaagaaatccgtggattgcaacacaaatatatattaatgagctcaaatatattagtatatattatatcacacggcacacacatgtacacatagttgaaatgataatttcctaaaaacaaaattccaccatgtaatttctctagttcctctaaaaattcggccatttactctaatctccttacaacatagacgctaaaacgacaaggctaatagttaggattgacttcttagttcaataaccatacaacggacaatgtgacatcacacaagcatatgtatgtacaatcataattttacaatctcaaacaatcattcgtgtctatatgcacgttgataattcattgaacatgatatgtctacacaaatatgttgccggattcaacaaaattccttgcacgccataattgacaaagggacagagccgtcaacttgaactacagcagttaggaaatttctctgatccaatgtatataatataaaccagcacatttacaaattatcttggtagggttactatgcgagccgagccggctcggtatccaaccctagttaccattgttagcttaaactattatttatcaaatagatctatcatcgatagttttttttttctagcgaactgaatgcgattgattctcgttgcagtacctctcaaacaattttgtttgacaataatggagagaaattggtgcaactacaactcctttaactccctgctattgtatatgaaggccgaaggccatccaagttatgttatcaggcttatcagactcccgatgaatataaagaagttaaaatcacagcgaattttcagacacaaaaccacctcagaaacgaccataaaataatatggtcaacaacaaccttgctccaattcagaactcgccaaaatcaaaagccttcaaatgatcttcaacaatacatttaatgaacacaagggataaaataacagatattagtataacttgtgccaatggataaaatctgcgcatgataaataatgagtgcctacatatacaacaaactaatgatgtcactataacagtatctgttagcatttccatcacagcccattaattcgcaagaactctccatgctttacaccaacacaaacatcactaaataaagctttcgaagagaacaggtgtgcgctaactgaaccctagcatcaaacacaaaaccctaaaagaaaaaaggaaaaagaatcacccagtttggcaacttcattgctgcagagaaaattattattttcaggtgccgttacttgacacatttgcttctttttcttgcagatcaacaattaattcaaaagagtcttgtgtttcggctgggcatttcgagtcttcttttaatctcacgatgaagtacagtgagtaaattgatacacactttgtaaagatcattatcagatttgtgcaacctataataaaaaaaaagctttatttaccattatgttactgcaatatcaaactctcaacctcttatgccatactgaattggcatcaataaattgacccagcagtggacattctcaaattctcacattgacattcaattatcacattcaatattgattcacaatctgaattcacgtcaatttacaatctcaatctcaatcttagctaactatagcttttcttttctagagcaccatatttcatccatctaatataatacataccatatttacaattacaattcacaattatatcaatacaggacaaaaatatattacacaatgaagggtaagggagaagatatcgaaccaaaggcaagacaatatggcagaggaagatatcactattattattctgcttataatcacgcttcttttgattgattgttgatcagtgaccagttgtgttaaaaatcaacctggaatagtttatcaccgtagaaatgtacaattattatttgtctatcacagtataaatgtacaattgttgtcacactgccttcaaaacaaatcaatcattacactacggtaatataataatggcaatgcccactttttaaccatgtgctgcaatgggaatgaaatatgtaccttgcacgggtggctgatgcaatttcaatacatcgcgcgtgtatccagcattttagcctccacttgcatgcacgctacgatcgccttccctcacgctatccagtaaacaacaatttttccaccaaacatgtttaaatttatatgggacaacatatctgtagcatgtagcgtccaaattgatcaaacgcagtggtatagctatattggatcctggaactgcaacgaagaacagaattgcacttaccatggcttagggcgcgttccttgaagaacagaaaattaaacttaccatggcttaggccgcatttggatagggatttttttccagcactcaacacaagataagccattaatatacaattaattaagtattaattatttgaaacttgaaatagtttgtttgattattcaaaaaatttctgtatgagatatttttataaaaaaatacattttttagtagtttaaaaagtatgctcacgataaatgagggagttgcaaaagccaaatgcactccccatctcagtcttattccaagaatcctagctagtatataatggtacattaatttctaaattctaaagtattacctaaccagagttttttgagagagattattttgatgtaaacaaacataacatcctgtaaacctgaataatcaaggctctacaaactacaaattgaaaaagaaaaaggaaaaaaaagttgaaccgaatcctgaaattaaaatcacctgccatcatatatttcattcaacacagctgaacttttacattaatcactttcgactatacgtattttctccatcctttctatttctgctgaaaataaatgcccctttcctttctatttgtgctaccaggctgatagattcataaatctgggaactcacctgcagatgtgaaatggcttccagatgagcagtaaatccaagccaacact

SEQ ID NO: 60202 - DNA, 2178 bp, Oryza sativa
tagattaatcaggcttaaaaaatttgtctcgtgaattagcttttatttatgtaattagttttgtaagtagtctatatttaatactctaaattagtgtctaaagacagggactaaagtcaagtccctggatctaaacaccacctaagaaatctgtaactagaagttttatttgtgataccgtggaaatcataaacatttctattctaagagtattttccagctggtttccacatatatatatatatatggtttcacaacatgtttccccctttctctcccacgtgttttactcgccgcggccaccggcggcggcaccttggctgcttatgatttggtgagactcctgttgactattatatatagttggttcatttgaccacgtcatttccttgggtcatcagtcatcgccagcgttgtggaaattcgtcgtcacatggagcgcgagaacggtatacttttgttcggcagacgcacaagcacacgtacaaactacacatacgtaacatcgatcatacccacacctccgcgcacgtgtcctctaacatatcaatccaagaccggttaaaataacagggccatcttatctactagatacatctgacttgaaatattttctttctaaactaaccctacagacatatatatttagcagggcgtatccatggttggggcttgttggggcttaagccccagctctgcccgcacaacttatgagccattccaagctgcaataacgcaatactgaatactaagagccaatgagtatggaaaactttaaaagctgtgagtattaattgataagattgtttgttagcttgttaatcctatcacatgatcgatgagtagattctgagataatgttgccaattaataaacgttgagaataccaatttgttaattttggttgaatttttttaatgtttcaaaaactataaagtcattgataatttgggaatttggtcatacggttaaactattgacatggccatgggccacaccaacagttttgaatcataatttggttatacgattcatcttttctttgttttatttatgtaataattgattgagtttagagaaatgacaggcatatatatatacttggcaccaaaataatttacatatataagagcacacgcttaaatttcattctagatttaccactgatatttagtccagcttggtaacactaatcaggactaaagattattattgggggtctgacacgccatgacagcttttaaaccatggctaaaaataatctttaatcccggttggtgttatcaaccgggactaaagattataaagtatcattgggcttttgaaccgaggctaaagatattcttttgtctctcgaacagggataaatatgatttttttttcatccgagtaaagatcagttctgcagtagtatatggtctaaaagatggaaatcggtgatacatccctaatctcactaaaatcatgataaaagctcacgtgcatatgcgtaatatttataggcggtagcatttaaatcctggtgggtggagtcatgcaccgacatatgactccaccactgcactactggtgctttcccggagagagagcgatatacaatgatgtgatacaagagtaggtggcgtatgtgaagcggagagtgatcgatgaaacatttagcaagataaagatcacgatgagaaaataaaaaattcacttgattatataacatgatgtgtctaaagacctgacatgatttttatgtttgccggactggtgtttcattgctatggaataatttttttgtccattttaatttttaaattgcattggctcccattcctagctaagagttacttttctctccatttgaaacgtaagtcacacttccttaaggttatattcttttcttccactccaaactcaaactttacacacttttcaaacgttaaatgttgtgttttattttaaaaaagcttctatagaacttatttttaaaaaatcaaataaaatccatttttaagtttatgataatattaatgcttaataatcatgtactaataagttttctcgttttgtatgcgctgagaatatcactccaaaagcatggatcgaacgagttcgttggatcatattgaaatatatatataacatcaagttaatatcaccaaatccaccactgatcatctttcttaatcg

SEQ ID NO: 60203 - DNA, 15780 bp, Oryza sativa
tctcttttttttgaacgaaccggcactaagcgtgccaatttcaagctttcatcagcttggagaacgagaactccatggttgacggttgcattgtgttttcttttgtatgtttttttgggtaggtttggatgagaaatgcgacgataggtcggagctcttggattcttcccctgccgtccgcaagagcttttcaggcacgtagtttgctgcgtgaacattgcatggttttctgatcattttggagaattcgtatgcaaacacattattacgctgaatacatgatgcagttaagttgatgaatttgtttttcttggtttcagatcggcattgcgccacaaaaattgagagcttgactctaagctgcttggattcaccccacaggcagttcgatacccgggaataccggtaattatttaaactgaatgttattttttttgaagagaaaaggaagttgtgatgaatttggaccctacctgacaattttgcagggtgttcgtaggcacatggaatgtggctgggaagcctcctaacagcagccttaacctggaggattttctacagatagaaggattacctgatatatatgtcttggggtacaaaaatacttcccattttttaatactctgcatcagttcatcatctgacgttgcattcttgagatagaaaaaaacatataaatttgctctatgtttgtgcatggacatgatgagttgaagataactttgcattcttagccgtaatgcagcatgctaacatgaatgccatctctgaagaaattgctgatcaattctgagacgttgcacaggtttcaggagatcgttcctctgaacgcaggcaacgtgctggtcatcgaggacaacgagccagcggccaagtggctgggcctcatataccaagctctgaacaagccccaggaccagtcctccggcgacgagctgtctccgccggagacctccgacagccggcagggcggcggcagcggcagccgcgactccatacccaagtcgtcgagcggcggcatgctcttcttccagaagccgtcgctgaagatgctgagcaagaactaccgcgtggacagcgcgctggtgaagacgtgcacctgcctgaccgacccgtccaccatgcagcgccgggcgcgggagatgcgggagttcctctaccgcatcgaggcgtcgccgccgccgtcgttggcgtcggcggcggcggcggccgacgaagacgggggcccggacgccggcggcgagctggcgaggagcagcgtgaactactgcctgatcgcgagcaagcagatggtgggcatcttcctgtccgtgtgggtgcggcgggagctcgtgcagtacatcggccacctcagggtggactccgtcggcagaggcatcatgggccgcctcggcaacaaggtgctcgacgcggtcttgctttgcctctgctcgctgtttggttcattggattcatggcgccgccatggctggctctcctgcttgcagggttgcatcgcgatgagcatgacgctgcaccagaccagcgtctgcttcgtctgcagccacctcgcctccggcgagaaggaaggcgacgaggtgaggaggaactccgacgtcgccgagatcatcaagagcacgcagttcccgcggatctgcaaggtgcctggccagcgtatccccgacaagatccttgaccatgagtaagccattgccgataaaagatcatgcatttgctcaaggctgcaatgcacaaacattttcacaaactctgcattgtcaaaatgtactactaactaatgatgaactcatctgcaaatccagccgggtcatatggctaggagacctgaattaccgagtcgcgctaagctacgacgagacgaagacgttgatgggggagaatgactgggatacattacttgagaaagaccaggtatgagctagtatatgaagtatgaatgaacaatgctgccgtgtaaacctgcattttttcagatatgctacagtgatatgacacagtaagcacctgcttagtttggtaaaatgttactgacaagatggcattcctgagcagttgatgatcgagagacaggcagggagagtgttcaaagggtggaaagagggcaagatctacttcgcaccgacgtacaaatacaagcagaactctgactcatacgcaggggagacggccaaatcgaagaagaaacgaagaacacctgcatggtaggagaacaagctgcatgctctgaagattcagacatgctagcactgacacttgttgagaagaaactgaaatttctgacggatccatccgtgtaaaatgcaggtgtgaccggatactgtggcacggccagggaatcgagcagctgcagtacatcagaggggagtccaggttctcggatcacaggcctgtttgcagcgtgtttgtgatcgaagccgatgtagataatggaagcatgatcagaaagggctactcaactctggattccaggatccatttcgagtctccgataccacaaagacacagcttctacgatgatttctgacttgtgattagtggttttgtctatactactatacttgtagcttaattacaaaaagcaggaatgtgtctacttttgtagtgggtgggctgcatttttcaagcctagcacttgtcttacactaactggagtaaatggtggcttctgaccaaaatacgtctgaacaacggacaactggctgagcggaagtgctttgtgtcttactaaatttttgatgcgatgtcttagtaaatcacatcatactttccttttatattgcgatgatgttcaaagaaagcagtaaacagttttctattgcaatgatgttcaaagaaagcagaaaacatttctccgattcgaaaaaaaaaaggattgcaagatatagcaggcagtaagtgaataaaccctcgagagaaatgacaggaggaaactgagtgcaacaaagtgtcgtgctgttatttatcatctggcagatattgttgcgaaagggttctcaaatgaggtcacgaaggttgggatggtggtgccgactacaaaacaagtcaggcaacacattcctgctgtgtgttaaagcgtttctagttaacatttggtgttcatctcttggtgagagctgagaattcactgtgttggagttcatatcaacagttggcttgcatttttcatggtggtattcatggatcagacgatgaacagacacttcaatctgccggggttatacctttaccttcgcctggcaagcttgtcagctcaactccgtttgatgaagtcactgcggctttcccattttcagattcagtctctttttcttctctcttgtcagatacagccactgtttcttccctcttcccagatacagagtctatttctgccctctcagattcactctctgtttcttccctgttttcagattcagtatctgtttcttccctcttttcagatgcagtctcttcactcttcaaacctgaactaccttcttgtgccatgtccttgttcaccatcacatatggctctgaagcaagagcagaattttcaggactccagaacaatggcatcttgatgtcatcttctctcatccttgcagcataatcatttatgttaaaagtagcctggtttttgccaccaaatgcagattctaattcttccatgttaaaaaggtcttccatgatcttgttagtctcaggcctatctgggtatacaaatttgaccttgttgaaagtctttggctcaagaatggggcttgcgatctgcatttagataaaacatgatgttaatttagttttatatgctacaatagttagttgcctacgggtgtgacagcaagaatgtatgtgctgtgctccatcattataagaaagttccaccttgaagtgtataccttacgttgtactccattacattatatttgacaatactaaccactgtgattttatctttgacaaatatttttttataattacaatgttttgattaatgcaagtagtgtagttatatttagcatgcaaagtactttgacaatacaacatatttttagatatttataatattttttttaaaaaaaagacgagtggtcaaaattaatactacaagaatagtgtctggtgtcaagtataaaaaacgaagggagggaataagtctacaatgcaaacaagagaacaatgcatgatcagacaattaaatggaacacattatccctaaatttctgattgaatataaatactagtacgatgatcaaagctgtgtaaaaccataccttccagaaagactcaaaaaacttaggagcattgtaaagaattgcaacacccaatctttcaggatagtgaccttgtaggacatctgctgtcaactttgtcacatgaagtgatatgttagataatgagaatccagcaaaatcaatgagccaaaccatctgactctggtcatgcggaagattcagaattgcattctccatacagtataccaaatatctgatctgccccttggccttcttggtattctggaaaacaagataacaaaattggatgactaatcacagtttttatgcacgcgtaaactataaattttttttacaagggaaaaggagcatcaataaacctgaactccaggtctcatgacaagaatactccgtccactcttgtcaaagtaatcagttcggtagatttttccagttgcagcttcgtttgctatctcatcctatattgaaattcaaatagtgcaaatgtttcacatagctctagaatggtacaaggagaatcactcgtatgtggatgtggataacatgacctgttattacttctctggagcaataaaaggtttcttaagtaaagaggtgaggacagcttacccaacggatctcatctggcttatactctgaacgccatttcaaggttttcttcaccttttcgtggccttcttcacttcccagttcctcgctaccaggtacctcgcaatcgaagcatctgagcaatatagcgcagcttttcctgatagttgtcctagggcagctcctaaaactttttccaacccccaatatttccttaatgagaagaattcaaaaatgagaaacaacaccaactgatctaacaacacaatagggttaaggaaaaaattgctccacggacaactcataagtaaagaaagggtcaaggggatgatgactaagaaagattgagttgcatttaaatcttatctgatgttttagaaccaaacaaacaaaaacctgaacctttgtgatactggctcaccttggatagccgctgctcaaacagtgccgcttcttttccatcaccattgttcacaccgcttgcggagctcatagtgtccttttgttactacctaccatagagcatagaacatacaagagctcataagaacatcaatctgaattacaccaaggacgataaccacatcaacattatgcattatgcatgaaaagcaaaaatatcataatgcacaagtgttgaccagtgttggctttgctgttatgcagtgaaatatgttctattagcagaaacaaaatcagtagttcctttttctaaaactgcttactgtcttcagctagtgtggcactatggcagcgttgcaatctaacaagccatttagaacagacagcacagaatggctaggaaatggtccatcataaatgcaacgatgttaacattaaccaccaactcgcatttcaacgatatccagttatcttccacgtgatcctggcacaacacaggagcgcacgagacccccaaatatccaatccggtgaacaaaacgaacaacgaggggacccgaacgcctaatttcagcgcagcaagtagcgtcagctcacaaagtacaagtccacaacccttacccagaatcatcgaagctcccgaaagaacccaaccaatctcgcccaaaatcgcactgatggaacagaaccaataaccacagaaccccaactcttgcttcgcgcgacgccaagcacatgccgcaagaaccaagaaacctagccacgttcttgagatggcacccaggaaatgccagaacacaccatgattctcccacaaactccagaacggcgtagcaagaaatgcaagattccacctttcgttggctcgaagccaataaatgcaaccacgcaaaaccaaaatacccccatacacatatccaccaatcggaagatctcccgcggatgcaacaaaacgctcggggacagcaacaaaacccccctcaaaagaacaaagcaaactttctccgttgaaagaaacggatgcttccagtcaatctcctccacccaacagaagccgcgacgacgcaacaaggtaaagctagttcttagcgctcacctcggcgagacgggacgcgcgcgcgcggtgagctcgactgcccgagcccccgattccggagtcgtcgggcttcttcgggttctcagcccaggcgtcttcctcagttcctcctccgtttgctttggaagccggggaagaaccgaagaagggaaaggtaagaagagactggtctgatcgaatctgacggctcagatttctttgactctatcgcgtggacgtatccgacggtggtagggctcgtggtacgggcccacactacgggaacaccgggtaatggagaggggaaaaatacatgtaagattttttgtccggtagatatgagctgtttgtgaagctggctttgggttcgttggcgctgtgatcgtgagtgctggatatgataggataggattggattgtttaaatgatgatttaatcgtatttaattgctgaaaaggttctttgaggtgtgtactccatctatcgcttggagaatctctatgctattatttccagcataactggatatttgggtgtttttttgccattgatcaatgatcagcagctccatcggatgttgcttttctaaaacttgtgcatcaggagacgttggtgtcactcagtatatcaacccttttttgcgacatccttgtaacattttctttggttggaggatgcaaggagttgattcagtacggggctctggtaggcagtagcgtcctgtttgaagttttaaggctacctttttttttttggtgattttgtccatagccgtccctcttgaacgttgaaaattttccaaagtacagtgctggttaggttggagaagtattattggggcaacacagtttgagttggccatgcatgacgctagctgtcacaaaactgttaatttgggggcgtgactcacgtttgtctgaagaacgtgattggattctccagagttgtattttctaaacatgggttttgaccctatctggagctctggaagtaccgggactccgggagcagcatttcattgtggcagcaccgcggtagtggtacgtgtacgtctctccgctgaaaatgggctggaagattcatttctgggccgaatcgacgaagatcttggttgatcaacccagtccgcacgtgtctccgcaacattttggcccaactcacgcagcgaaacaggctgaaaggccgaaaccccggagtcccgcgccccgtcgcttggtgggccgaggcgggaggaaagagttgctatccgatcctacacggattctacggaggcccagaaatcccaccgtttctccgtgctcggcccgcaaaaaacgctcatgccgcccccttcttgccgatcgtgcatcctcgcggcggtgccctcatctgctccgcgattctgcgtgctgccccactacgattcgccagccgcggcggcggtgccgggtgcgtcggtcggtcgctagctgacccagtgagcggtgatcgatcgtcgagatctgtacgcgcccgtcgcgatcgatccagggacggctgagttctgacttgtagtaacaatctgtctcgttcgttcttccacaggtccggtatccgaacaaaggtcaatactagtaaatctttgcaattgtgggatagaatagaagttctttttgcaagataaaacagaatattactaattgcaattatctcctttcgttgttactgatcagcttaagcatgaactttgcttctctgcccttttttgtgaacgttacttacttgtacacctccatacgtgcacaatatcacactcagtacaatcaggtagcatatatatgacgtcaacggtgcctcaatctttcttaaataatcattctcttgttcacataagttagattctttttttttctttttgagaaaagaagatagatggttacacttgctgagcaacttaaatcctcagccccctgaacgaagcagcagatttcccaagcaagcaaatgaaatgcaaccatgcgctggcttggaatagctcgatcagtacccaaccccaactcaatgaactggacccagctcgatcaaggcgtgaagctcatctcgaactcatcatcgccaaccatcatgaaatgcgacccatgatcaatcaccttcttgccgtcctccgtcgctctgctgaagtgcttgcatgggctcacctcgaactccacatggacagtctgcatcgacttgaggtgcaggctctggaagccgatcagctggctcgccggcctgccgccgtccgccgcgccgttcggccagcgcaggaagagcagcacggggtgcctgccgtccatggggccatggttctgcaccctgacgagcgccgggaacttgagcttgtcacacgtctcggggccaatctcttcgacgtcatagctcaccgtgcctgcagctgctgtcgccatcgccttcaggccatcgatgctgctcaaagacggcagcttcgtgccgtttgcgacgaagtggtgagagtacttcgagtagctgaggccgtagccgaacttgtagacggtgttgcctcggtagaacctgtacgttcgtccgggatatcccgtggatggatcggcacgcatccgcatatctgtcatgggcacgctcgtgaactcctttggataccaggtcactggcagccttccacctgatgaacataggtcacatgtaacacagttcagtatttgaacgtactcatctactgatgagaagatcaaaaagtgaatgaaattttaccagggttgtgctctccaaagaggacctgagcaatcgcaatccctccagcctcgccagggtaaccagcccacaggatggccccaatcttgggattatacttagcaaaggtcacatccactggaccaccacacagtagcaccaagatcaccggcttctttgccgcgttagcgaccgtgttgatgaggttctcctgcattcctgggagcgacagttccagcctatcaacctcttccctctcctgatcttggtctaatcccatgaacagcacaacgtagtccactgaacttgccaattgcgccgcttcaccaattgatgacacattgcaggcagccgagttgcacccagctaggaacctggtgtccttcacatagccttgcagcacttggagaggagtcaccgatatgcaaggagggccgaagtaattcccaagcaatctcgtggcgtcatttgcgttgtgcccaatgacagcaatggatgagacttgtgatttggacagggggagagcattggcgtcgttcttcagtaggacaacgccatgttgtgctgcttcaagggcaaggttttggtgctcctgcgtgcacacctggtctgggccaatgttaccgtagcggttgtactttggattgccgttgaagagccccagcctcatcctgacagcgaagaggttgtggagggctctgttgatgtcttgttctgtgatcttcccttgctggattgcagatagaccatgttcctgcacgtagctgccgcagttcacgtccattcctggaagtgtgttgttacagaaggtaagaaacacttcttaaaaaaataatatggagtatatcggatcgttgcattaatgttagaagcaatttgcatttgttgttttattgttttaacttttttgttgatttggacctactatctactgtcttttgctactcattgttgttgacttgaacccttgccatgtaacaccagaatgactacttacatgctgagttagttttctttttgaaccttttatatactgtcttttgctattcattgtcgttgttgacttgaacccttgctatgtaacactagcacaactacttacaagcagaggtgatcttccttttttattgacagatggattcctgatgatatcatgatgttcagtgtcatgccatgaattatttcttagtggactcactgaaatacctttgtttagagaacagatcattaatctcactcaagtacctaaatcagcaaaacgggaaagctgtatgcctgtatgggtagtgggatccaaatcaacttttggttgcagttcagtgacctaacctaacctccctatatctttgcattattcccggagggctccatgtgaggaaaacaaacacttgaaagttgcaaaatagtactacttccgtcccgacacttgtctagatttgtcgccaattttttttttgtttttacagaggaagtaacatatttgagatactacaatatattgtggaattaccccatctctgacaaagagtaataggacaattgggtgattctgaccagtaaatatatagtggacaagtattactaggtgtgatgtgcaaattcataccagccttgaggacatctgcaactgcatcttccgctgtcttggcatatccttggacatcatggatgatggacacagcatcacaatctgaggtgatatatctgtcaacagaggaaaacttgcaaggatcagttgctgggcattgtcacatacacactgaacaaaaacttcatgtctaggccaaagaaaaaactgatagctccagtcattctggcttacccgtaaaacctccaatctccccttgcagttttggagaggaggttgtaatcggcacaagttggcacgccattgacgcggttgtaggagcacatgatgccgctggccccgccgtcctcgacgcagcttctgaacggagggttgtacgtgtcggccaggtcctgcgccgtcacctgaccaaaaaaaatcgcatcactcagagcctcgtcaatggcagggtcacccaattagccagaccatttgctgacagaacaacgtgtcgtgacgggtcaccaccttggcgtcgaaggcgtagcgggtgacgcccttccagttctcgaggtcgtaggcggtgaagtgcttgcagcaggcggaggcctcgaggtcggtggagttgatggcgccggcgagggcgtagccctggacgccgcggacgaacacggcggcgtacttgccggtcaccgtggggtcctcgccgggggtctcctgcccgcggccccacctcgggtccctgaacacgttgatgtttggcgcccagaacgtgagcccttccgcctgcccgttgttgtacaccgccctcgcctccgtgccgatcacctgcgttgcgtgcccccaattgcacagcacccaaaccagaatcagtttacagaggaattcaggtacggttttctctgctcttgtttcgtgttactactctgcatgttgttgcggtttgctgcgttgtttagtagtatctgctttacgacttgttaccgtctcaaaaggttgcggtgaatctcattacgtgcttttgacaaaaacaaccccaaaagttgcatgcatgtaccgaacacgttcttacctactcctataggtccgtaggtgtacaaaagttcatagggccgacgggtgatggattaccaacaagctgcctaaaatgtgtggattattggactcagtatgtaccagtagcaccctgaatatattactgacattctgggcataaattaggcgcaaagactcctctgtttcttttaacccctcaaaggtaaaattgagaaagagactacaaatcgtaattcccagttacacttattacacttaagtcccttccagtactgaacagtaactaaccactggtgttagcgtgaatttgcaccaacacggtaaaaaagtaaaagtgaggaaacgatcgaggccgtgcatgcgctgagcacgtacgtgcgtacctggccgatacggtaccagaggtgcgggttgaatgacgcggcggtgaggatgacctgcgggaagctggtggcggcgcggagcgggccgtcgaggtggatgccgcggccggcgttggagacgccgtggagcgcctccgaccaccacttgtacgccgggacgccgagccggtcgacggccggcgactggtccccgagctgcgagatcttctcctccagcgtcagcctcgacacgaggtcgtccgcgcgctgctcgatgggcagcctcgggttgcagaacgccgcgctggacggcgcgccgcaggagaagggcgggcccgacgccacggcgaccgccgccgccgcggcggccagtgccagcagcagcaggagcggcgccggcgcgtggaggagagcgcgcgcgcggcgtcccatggcttcgtgtgcgggtgtcacgtactgcgctccggagcgaatgtgtgtgtaagtgcgtgccaggggtatatatgaagcaaagggcgcgaagcacatgggagtacgggctgctgacttgtggggctatgccgctattcacgtgcaattacaatcctgcccgtttcgtaattttgcattgacaaatatactcccaccgtccttaagtaacaaaccaggatggatctaatcaccataatatgtccatctcaaaaatatagttaccatgtacagttgtattggattagatataacttagtataacgaataattgccagaatatgtagaactagaatatgatcaatcatgtgctaggtttttatattttagaagagagagtagaatggatttaattctattctaggtcgttatgtccagatttatagttttaggatggatctagtcaaattctagattacagcatatcggaacgaatgctctccatggatcatagtgatgagaaagaaaagagcattgcctttgtatagggcaaattcactgtgttggaacttggaatcaagccttttgttaaacgacaatcttaaaaatccagccatttagccgaaagccagcgatggcaccgaacaagttcggagtgcaacaaacgaaaaacgatcgcatactcctcaagcgatcgatccagatctacgtaaagttgtcacaccacgacgcgtcgtgtggctgccactagctaacataactgctagcgagtagagcagtagcggaaatgctcatgcttacgcttatggaaaatgcttacggatgctgtaagatttagcagcaggaggcaagagcggtgtgaccaccgatgggcaaactcgtgacttcacaggtttgcctgcctgcctgtgctttgtgggtttggctggaccgacgcccaaggaaagcaagcgatagtgcgaactgggaagaggcgaggcgaggctggcgtccgcgcagtagaccgtggtagtggtggtggcgtcctccgccgtgcgattcccgcgatatcctcctcctttgccactccgtggcgcgcctgacgtaacgcaactgcttggacccgcagaaagtcagaaatcgttcgagtcgtgggaaaaatttctgaattatagctcggtgattttatggtatcggatttttgacgccgaggacagacgaagcgtcagccactggtcaaaggagaaagaacaacaagttcggacttcgaagtactctgatactattgcccttgcaacaatgctcgtggtctgatcgagaggaccagatcgctctgtgtgatcactgatcagtggagcctacggcctgaagagaatattgaccggaggttaagattacattttgtctttttggcactttgcagagaagtgactggtgcgtgcccatggtccggtttgtactcgtaccgcatattcataaattcctcgagtaaatttcacaaaactatatatactataactaaattatcacaaaactacagatttaactcggtatatcacaaaactacacatttaacatcaaactagctgggtggcccgctcacttgcgcggctagcacctaaacaaaatcatatattttttagtatggttttactttaaatttgttaaatagttatccctgtatttctaattatatagtttttaaaagtcacaccagctgctaccccttacttctgtcatatccttctttatttgcttgctcggtctaccactatttctattcattctccttgaaactttaaaaattggatctgttttttgagtttattatctcgttgggtttcgtttttataatttctggaagtctcgtcaaacgctgccattatactcctctacggcccgtccactgtcttttctctttattgtcattgggattttacaaatcgaacataattatcgttcgagttcattttttttttactttttataagtcccgccaaaccgtcagcggttttgccattgtactctttatgcctcacccgctgtctcctttttttattgtcattaagattttaaaatcgaacatgattatcattgtttttttttactttttagaagtttcgtatctttaaaaattggaccctgtagtttttaaaatttattgtcttgttgggttttatttttttataatttttagaagtcacgtcaaacgatgccactatactcctctacgacccatccgacacctactctttattgtcattgggattcgaaaaatcaaacataactatcgttggaattcttttttattttctagaaatcccgccaaccgtcggcggctctgcaactatactcctatacaccccggctgctgcttctcctttttattatcattgagattttaaaaatagaatataattatcaatggggtttattttttttactttctaaaagtcccggcaaccgccttacccgtttgcttcacggcctggcgatagttggtgggacttcttgaaagtaaaatatgaattccaatgatagttttgttcaattattaaaatgctaatgacaataaagattaagcggcggatgggtcaatgctaatgacaataaagattaagcggcggatgggtcacagaggagtatattggcagcatttgacgggatttctaaagattctatttggtgtattactaacagtttttatatgtcgaatcaaccgctaccactctactcttttataggcttgttatttaatttatctcaccgtgtgttttagatggtctcttttttaataatctttatttttatcaccaattttagttatttataaattgtattctattttaaatctttttccttttttctttttctaatttcagattttttttaaaaaaaaatatttaataccgtatagtgttcttttaatatttttatttttcgtttttgaatttcagttgtttcaaaattgtattcctacttgaactctcttttaatttttctaattttggatattattttatattttattctgaattttaattaatctcgtatggggttcttatatggattcttctttaaatattgctttttttttaattctgaattttagttgattttaaattgtattcctacttgaactcttattttatttttgctatttttggattttatttttatttttatttcaaatattaactaatctcgtattgggttattatatggactcttttatcaatattccttatttttaatttctaatttcagttatttttaaattatattcctacttggactctgttttatttcctaatttcgtattttattttatttttatttcgaatttcgattaatctcgtattgggtttttatatggacacttctttcaatattgctttatttt

SEQ ID NO: 60204 - DNA, 14989 bp, Oryza sativa
catataataacatatatgttttctcaatgtattattcaaatatattaaaatgacaatataattttaaatttctaaattgtatttctatatggactctgtttttatttttctccgattaatatgagaatttcgcgcaattacgcggctagcacccaaacaaaatcatatatttttttagtatgattttacttaaaatttattaaatagctatctagctatctcattgtcttaagattttgaaagaacaaaccttatcatcctcgtgtttctaattatatagttttcaaaagtcacaccagttgctaccccttatgttatctccttctttatttgcttgctcaatctatcaatatttctattcattcttcttggaacctttaaatttggattttatagtttttagagtttattgtcatgttgggtttcatttttataatttctagatgtcccgtcaaacgttgccattatactcctctacggcctgtccactgtctcttctctttgttgtcattgagattttaaaaatcgaacataattatcgtttgggttcatttttttactttctagaagtcccgccaaaccatcagcggctttgccatagtactcctctacagctcgcccgctgcctctgttattgaaattttaaaatcgaacatgattatcatttgcttttttttttactttttagaagtttcaaatctttaaaaattggacttgcagtttaattttttataatttttagaagtcccatcaaacgatgccactatgcccctctacagcccgtctgccgccaaatctttattgtcattgtgattctaaaaatcgaacataactatagttggaattcatttcttattttctagaagtcccgtcaaccgtcggcggctctgcaattatactcttatacaccccgcccgctgcttctactttttattgtcattgagattttaaaaattgaatatgattatcaatggggttttttttactttctagaagtcccggcaaccgctttccacgtttgcttcacggcctgcctgacgtccctccttataatcgtcattaggattctattttggtgatttattaacaatttttatatctcgtatcaaccactaccactctactcctctataggcatgttacttaatttatctcgtcatgtgttttagatggtcttttctttcaataatctttatttttatcacaaattttagttatttataaattgtattcctaattgaaatcttaattttctttttctaatttcagatttttttaaaaaaaatagttaatatcgtattgtgttattataatgtttttattttttattttcaatttcagttgtttcaaaattgtatttctgtttgaactctcttttaatttttctagttttagatattattttatttttattataaattttaattaatctcgtattgggttcttatatggattcttctttcaatattgcttatttttacttccgaatttcagctaattttaaattgtattcctacttgaactcttattttttattttcttttgccaattttggatttatttatttttattccgaattttaattaatctcgtattgggttcttatatggactcttcttttaatattccttatttttaatttcgaatttcagctatttttaaattgtattcctacttggactctcattttcttttctaattttggattttaatttatttttatttcattttttgattaatcttgtattgggttcttatatggaaatttatttcaatattccttatttttaattccgaatttcagctatttttaaattatatttctacttggactctcctttccttttctaattttggatttttattttattgttatttcgaattttgattaatctcgtattgggttcttatatggaaacttctttcaatattgcttatttttaattccgaatttcagctatttttaaatagtacttctacttggtcttctttttctttttcttttctttttctccgattaatgtgggaatttctaaccccccacagcgaacatggtgtctcctttcaaagctgttttaataatataatagatttatcacaaaactgcacatttaagatgaagtgtcacaaaactacatatttagtaactaaattatcataaaactacaggtttagaatcaattttatcacaaagtaacgatgtttatagctccaccataacaatgatgctagggatttaaactccaaaagttgtagtttttttataagttcaatattaaatatgcatttttatgatacttaatctaaaatctgtagttttgtgataaatttggtgctaaatctgtagttttataatacaactccttaaatctgtagttttgtgataatttgatcaaaatacctgtagttttgtgaaatttattcaaattactttgtcatcattgatatggctggtgagcctttctggcccgtcgacagacatagtagtgaagtggagtagtagcttgttgcatcactagaattctagaaatgccaaatggcgacagtgcttcgtggatataatttccagtgagcttggtggtgcatgcacttgtttcatcagagtgcctgacaggtcaacacaataatcttgatcgacatggtaccttatctagcaccggcaaacaggaagccgcgacatcattgtgttatatcgggcgtgatgtgtggaaatagacgggagagaggaggcaggtcagagcaagttgcacgggacgtcgctattacagcgagtaaaagacaggctcactctactcctagtttactactacaggactggcttgctaatctgtgttcaaactttcatcgttgaaactcaaaggacctgtttcggagacaggtcgagatcaagatctttacaattgaattggatgtgtgagcgttgaaggcgatcatggcagaaaagttgagacatataggtaggaaacggctttgtaagctgccgttcagaatgaaagaagtgatagagtcacacgagacaagtacatagacctttgctgctggttttactgcaaaattttttgatgggaaaattggaaccatgccattataattttgcaaaatttgagatatgtcatcctgacccacatgtcattgactcatgtaggtcctacttgtcattgagataccgatggcatatctcaaactttgcaaaattataatggcatggttccaggtaaacgtttcacctaatcacctacggagttttttttttcctttctgttctaaagaagtgtgctaggtagttacgattccatatcaacaaaagccggcattcccaggataatcgtggctaactgacgaagcagattgcaagtgcggtgtcggtgaggagctgagtacgtacctcaagctatcatgccacaggtatgatgaatttcacgttggaaagaaaatccagcaacgccatctgatcgtgttaggtggcaattaggtccagggctccaggttgacagagttcttgggatttccattcttctgaactttactgaactttttcattcacatactgacaggtaaggtaaactcaacatttgtccggtccgtagttcataccctactaccgctagtgcactgtgcaccaaacagatcgggcaattcagcgcttgttttcttgcaagcgtttggactaagcatgcatgttcctggatctagaaactgtacgcccacaactccacaaggccacaacatactccaaaaatgaggacagtgtacaactagctgcacatgcgatggtattgcagctaatcatatgagacgtggagaaaacactgcaagctccaggtcaccgtgaacgcacgcgcatgcactcgactctgtccataattgctggtgactgtagcggcgtagccatgtgtatcgtattcgagcttgagcacaaaagcggcattaatttttggccgacttttctcgctggagtgtagacctcgacatgtctggagttgtctccgggttcgtaggaactgtgctttgctcttagcctaatcagaacgggttggcgaggtcgaaagtccgaatatccttttgcagttttgcagtgttcgcatgatgctgattaattcatttaattggctagtaaccgagcaagaaatggaacgtgtaagaaattgaagttgctgaattcagctaggtagagtgtagattatgtggttttcagggccagagtcaaaagttggtacgaaagttgggacggtgcctctgagatcgtgattgtttaattagggttttgtaccattactaaatgctctcaacatagtgctcgcggaaactgcgaagtggcaggcagatctctccttttacaacccactatccaaaataaatataaataaataaaatcacgtttatttggcagatggcactcttgctcttcgacgtgatctgtggctgcggcaaggatacaatgattgagaggtaacacagtgcagttcatatcggtgctgttttatcttgaaacctgcagctccattgataattgctgtgaacaagcagccatttgggccaatctcgcacagaagtgtactggttaacttgacatgaacgccagagtacaagttgaggaggttgccatatgctttgggatggtcaagtttgttgcaaggtttcagtgcgccacgtcacagaaagcaaggatatgcttgcgcatacattaggccgttttgatcgcctatcttctcaataatatgagaaatgaataatgaattgcttagccttgacgcataaggaacgaaacggcatcaggaatagctttattttgcattttgcgtcatgctgtataagttacagactttgatgtgcataccattttaacagtctttggcttcatttaacatacggagcatgttcaaggtttatcgggtagaagtactacttcactgttggctgtcaaggatatcctgacgagacagaactggtaccggagtaatcagcgtcccaccagcaggtactgatcgctgaatccactgttcattgatatgatcaagatgtacagccgcaagatcgctatcgatcagaaatgtggcagctcacgttattggctgatagaatttgcaagattgtgttacaatcgcggcaccgacagtggtcttgcaaagttgcacaccttcccaccacccacgcaaaagattttaacaaccgtagagaatgttaaagatcagattgaaaatccttgacaatgcttgtggttacagcgatacaggcatcggccggctcacgcaagtcaaggatagtacacgtagtaacagcaaatctgcagagtacttactacatgttagccagtgtaagcaaacagacctgaacattgaggggcggcaagcaagaaaaaaaaagaagtcaaatcatcgttcttccaccattatgcttgggagcaggaaacaacatacagataccacatggcgcaagctaactgccagttacaactgaggagaatcatgtcgctaacttggagttccgaccttcccacacgatttttacaaacaaagatgctgaacactgcatataggtagtaccatcactataaccaaacttcctgactggcaataaccactaatcttcctagcaatcaaccaatctcaatgcacaacttgactcaaactggcccagctgatctgaagaatcccaggcaaaagcagtttaacagcacaaccatgaaagattcattttcccaacaacgaactgctagccgtctcgagatctgtcttgcagttctctctgaattcctttaacttcacaagagatgaatgctgaatgtaagaaattttttgaggttagcacataatcaaatattggcaatacagttcatcagtcaagtaagggaagttacattgacgtcaaacttagaaaaggtgtagaaaacatagtacatgattgatcataaaaccatacaacaatatgaatactggaactctgtcctatagcttgatgaacaatatagtacatgatggataccagaatcaatgaagttccgataacagaaaatcatgcaaggcactgaatgtaatattaatttatgatttgcaccaagtcaaatgctcatggtactccaagaccatagtcaccaaagtatttggagttacttttcatgaagacaccacagcaacaaaataaaatatttagtgctccatagaggaccaaagcccccctgccccaaacagacacaagcggaaaaaaaaaggtgctggtacacataaactagtttcacaacctttatttaattaaacaacgaattcacaaatgccttttacattatggataaaatcagaacagagcccttcgcacccaaagtatcacaacctccattgcacaggaacggagaaacctacagctagcccaaaaaggcccttgaattttttttgggttaattagatccatgctattataactttcacggttttgaaatatgccattacaatccaagtatttggaattataccattataacttcagggttatttgatatatatcactacttaccccttcaacccatattctaattttttggacgaaattacccctttcttcttcctccaatccttcctctcttgagcaagccgggatcagtggaggaggagctgagcaggtcctaagtgcatgtccacaagctccttgtccatggcgcattgcacaaccgagaagtttcctccagtatcagaaaagcagcacactgaatcctacaaatgttgctcctcttcatcgatggcagattggaaatttgatttccccaaactggctgtgtagctcggcacacagcctgcagccatggcgctccgtcgccactgccgcttgaagagagagagagagagcatgcacgtctcctccacatcatcgggttggcgaagacaggcccaaccccatcgccggctacaccacctccatgaccacgaccatggagatgtcagaggccaccacgaacgtgctctccgccacctactggatgctcagcgaccctgtgcagcaccagtgtcacaaaccgtcgctcgtcgagcacccagtgtcacagaccgtcactcggcagtgtggcagccccagccactgcggcgagcagggagagcaggagacaggttgaccgccgggggcctcgaactgctgtcgtcaatgctccgagctgtagctcgccagccaccagatccagaggatgaacagaagagagagagggagaggagatgaaggaagaaaataagggcaatttcatctataaaaaatacaatatgtgttgaaggggtaagtagtggtatttatcaaataaccctaaagttataatggtatagttccaaatagttaaattataatggcatatttcaaaaccatgaaaattataatggaacagatctaattaaccttttttttaatgacagaaggggccattgtcatattgaagatagcagcgcagtcaactaattccattttgcactccgggcatgttcacttcattgccaaaaaaaccttaccaccaaatattggtaaagtaaggtgggggtgcctccgtggctagtgtttgctttgataccttaccaaaatttgggagtagttttgagagtagaaagttctagaattaccaaaaattagtagggttatgttggcaatggtatgttcagttccttgccttactaaaccctccattttagtaaacagtaatgttttctgctgatcacatcatatatttttctaagggacctaataatgaattctaaaccattgagcatcacatggagtaatgagcaaatgatccttccaaatttactggcgcgtacaaacagctagtagatccatattaaatacactgtatcaaacacaacatttttgcaaataatctcaggtatgctttaaacattgatgccaagcaaatgcccgtacaacattgaatatgccaggaagttcgggggtgataaagaaacttacaagctgtgcgctctcacggataaggacattttctgtatgaaggaagagtgatctttgctgttgatatagctcaaactccatctctgcagcccgtttcaagttgtatctgcctgcattaacagaatattcatctccttggcttctcttgcccagcaatctagcgaactttatgctcttcttcaatgctaaaagggtaagttttcagagattgaatcaacattagtgagatgatcagtagtggcctacatcatctatatgtagaaaaggaaatgtgctgcatttgcaaagacataccagcaagccgtccccttgtgtcctgataatggagatcggtccacatgaatgcagctattttgtacaagaaaacagaggttaggtgtacattcacctagcatcatgatgacgtggaaaacatatcttgaaggaagaaataaatgcaaacatacccttaagacagaaagaacaagcacacgacttagtggtatcgtcattttccagttcactatttccagtgaatggtgatggacatcggaacatggcatgtcatcacaacctgttgtgaagtccagtgaagatagtggcttctgattccctgatgatccagccatctcctcttgagtaagacattcaccatcattagttgccgttttagtactatctctggtatatgccaagtattcactatccatgtcatcatcatcatcttcttcacagccaccttctgattccagcgaagactcctgctccttatcatgcaagccagatgagcctaatgacatggcacaactcctcatgtcatcggattccttggatagcaacacagctgcctcagcagccatgtgctgcatcttagtttcccgaaaaattgagggcctcattaaattctctttggcaatactatcaaaaaggggcaatgtgtttcgtgtcgctccaccacttgcttttgcagtttcatcaaactcttttcttggctcaacagccttttcaacccggacaatcttgattccacctgcacttttctccaaattcgatggggctgggcgcttgccaaggacatttgttaaatctccaaaggggcggcgaccactaccttgagcgttttcacccattgcaacttccaaattcactctggtcggctaagtggatagcaaaatcttcaccaccaaccttgtaaaacagaaatctgcggacataatcagaaacaaaagacactgtaagcgctgtattcagctgtcaacatagtttatatccaaaataaaggctaggttttctggatcattaaaacagttggatctggcctatagatgaggtgagcgaagttcatataattggacattacgagaaaattagagctcgtgcttgccatagtgtctattagatgtgaacttcaacgagatcgagacctctctgatacagaatcctcccaatctcgccaccgaccaagtcaaggatcaaaagcgaacaatgcaggtacgacataaatcaacctcaaactcctcatagactagagagaaaataggttaggtttcgccccttttacatcaccattccggatgtaaacagctgaagcctcaatccatggagaggatttagcgcaccatttcggatgtaaacagctgaagcctcaatccatggagaggatttcgctaaaagctgaatccaccagaaggctatcacaatgagccaacagggattccgtccgccgcgcaaactagaccgccagaaaccgatccggggggggaggaggaaatcccgcgggatcctacccacccctgcgccgccagaagcggcaagtgaagacggcggcgatgcgagaagggaggaggggggagggcggcgactggggagcacaaacctcgccgacgcgagacggccgcctttcccccggttcgccccgcgggagcggcggcgcgggcgagagaagcaggagaggagaggggagaaggaatggtggggttagtagtaggaggttttattccgagacgcggcccgcggtggagaggagcgaaaaaatggagcgggcgggcggcgggggcgaggggcgaggggcgagggatgggatcccccgcgcgcgcgctcgcgttcggaatttgggccgcgcgcgtcgcggtcggcgcgtgacggggcggggaggcgcgtggctccggcgcgcttttggagttcgtcgcacagtgacacgtggtgggtggacgattcggtgtgttggcgatgccgaggcgaacggcgttgaacaggcctggactagtcgattggcttctgggttgggccgttagtgggctaagaaatataggaggagtgagcattcggatagatgtcgtcctcctttcactggatagatagaagggtatatctaaacgaacttttgattagtttttctttcaaaagctttcaaatttttagtgtatttacgttgtaacttatatataacttagatataataattagtcaggaaaaacatgttagacatagtggccagcccatcaatcgcacttttgttgcacagattgagtttgaatctgaagcaccgcatgcataaataattttcctcacatgcatgtaagaatctcgagacaattcaatggacacaaatttaaaagttggtagaaaactaaaaccgtcggaagactttttgcaaatttgagataggatggcttagaggcagagcatatattataagaacctaagcgctagcctcaacatgttacatagggcttgtttggtttgctaccatgccaaaccataggcaaattttggtaataccaaatgttttggcaacttatgtgtcttattagtatattttggtagcaaaccaaacactagccaaactactattcaaaatgccaacaatttgatagagcacatttcagcatcaaaccaaaatggcccataagcttacgctatgatgggtagaagagagaaagtatgagagataaaagaagacacctcttatacaagagatagtcgacaaaagggaggaagatgaagattatattggacaaacaagtattgggctaatatattagagttaatataaaggtaatttatttgtaaatgattacctttatatccatgattagatgcacatgaacaagagagcaaacacccctattagtataaacccactactttaggctgtgtttagttccacgctaaaattggaagtttgaagaaattaaaacgatgtgatggaaaagttggaagtttgtgtgtgtaggaaattttgatgcgacaaaaaagttgaaagtttgaagaaaaaagttggaatctaaacagggccttactccaaatattacccatgtcagcaaaagtcattgtttaatcaatgcactgttatttaaattattatttttctccttgttccgtgcactctctcctgacacaagtggaattgctcaaacctgcattggagtgcaagtgcagccagcgcgtaaacaatcgtccgatgatatagggttgattttgtttgataccctaccataccctaccaaaccattggtagtgctaaatcttgagcacgttttagcactaccaattaccaatgttttggtagagttggactatatgggttgtattagctatggcaaatattggcatcgatccaaacatctagtataaagtactatttaatttgccaactttttggtatgacaagttttggcaccaaaccaaaacaacccatactctctcaccttctaactcaccactaaaactggtgtggcttattgtcctaggctgcgttcgttctagcttgtttccaactcctctcacttgttttcagcgtacacgctcttaaaaaagtttatatttgtaagttgcttaaaaaaatcatatgcgagaatatacgaaaagcctaggatcaatattcaaattgttgcaagttgcaagttgtttcaagttgcttaaaaaatatacgaaaagtaagttttctgggagatttggaaagaaaaaaacgcaagaattttcaggcaacttgcaaccaccccaacggccattctatccagaattaaggaggaagcaagactttggatcacggttggcgcaaagccgctagctgagttcctcctttggaagagtaggcttttctcggtctgggaggaccttaaacttacttttcgtatattttttaaccctctctatcaacatacgagttaatccttttgcctcttgttttttttttaaaaaaaaactgttgtggcaggtttatagttattgtatctactcttacagatttgcttttttacagtaatcttcttttatagtatcctgctgcaacgcatgatgcaaagttgcataccgcagacaacgattcatactctattcattcttaaaaaacttttgggaatgcaacaaatgcttggccgtgtttaattctttgcccaaaattttttttaagtatacggacacatatttaaagtattaaatatagactaatagcaaaacaaattacaaattccatctgtaaactgcgagacgaatttattaagcctaattaatccgtcattaacaaatatttactatagcatcacgttatcaaatcatagcacaattaggctcaaaagattcgtctcgcaatttacatgcaaacaacgcaattggttttttcgtccacatttaatatccatgcatgtgtccaaatatttgatgtgacgtttttggccaaaaatttttttggcatctaaacacaccactcttgttcaaatttatctgtacgagttgattattttctttttacagtttgattcatgaagtccgaaacagcaaacttgactagtcagctgttgatgcgaaaaaaaaacacacacacactggcctgggagatctgcttagctccagggcaggaccaaaggttgatgagatgcgggcgtgccagtcaatttgatcccgcaactgacaagatatacaaatagcataccaataagccagtcggctgtcaagccgatggagtaattacagtcgatgccgatatcagccgatagcggtagggttttgagctatcagctatgtgtttgatgtagaatctgatacttgatgtaaataatgatatatatacaatcggctgatgatgatgtaataaaataacaatataatcaagtagaaaccaatcggcttataatgatatgataggacaagcatggatctgaatgttaaagcgtacatcggctggaggttcgatgtcataaaattcacaagattagataaacaatgaaacctttgttgcaatcggctaaatccaacttatatgcaatccttgtaagccgatgcaacgtccagatacctcgtcggctaaaatgtcacgcccagaaatttagcccaaatttccagactattttgtgtattaaatccctgtccaggaccagtcagggtacacaaaacgacaagtaataaacagttccaaacgtaaataaagcgtaaaatacttacagaagaggcacttagtcctcacaccgaaacaaaagcagcagcagcggaaaaaggcaatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagacgtgcaaggggatacaaggaggggtttgtggctatttgcataaaggcagttgtaaaacatttcattgagcaaaacagtaaaactgtgagtaattaaagtaacattaaatctccactgatcaacgctacaccacgttgaacaggcccaaccaacccacctggactacagtgcattgggtcgatttaaaaagatgggactaatcacggtgaatctggtcgaccgcccataaccgcgggcacggctattcgaatagttttactctggccagaggtgtacaactgtacccacaagacacagccccacgacacgtttccgtgcgccgacatgccaccacgacataccggaaagaggccgtgacaggacccttcacataaccccctctagccaagcacaccacacctcaggtttcacccccatccccagcgggcaacgggcagtcccctctcgtgcctaggtgaatccggaagtgacagaggccgtcgcagggcccgccccgctccatcacgcccacccttgcctggatgcgtcgactagaggaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgtattttaatcggataattacgaccatgaagcatggccagatgtctcgagcacgcagctcactctgataccaaaaaggtctaatattgtaattatcccatcaactgagctagtggtaattaagcatggctaagcatatagttctagctaatcacataagtaacatgagctagtcgatttattacccaaggttgacaaaggatagatatcaagtaaacgtggcacaagcgagcagataggtaaaccctgatcccgtgtaattagcaaaacatgcatgtttatttgtaaacagtaaaacatttgtaaattaggatcaaaatgctcaaggggaatgtgtgacttgccttgcttcttcacttggatcttctgaactcttatccttgcgaacgcgatcttccgaaacgacgggaactacacgctggcacgcaaaacgaggaaaaactctaataaaaaccaagaaaatagtacataaaaactaaacaaacatgtagagatcaattttagatgaattttgcaagttgaatggctcaattcggagttcgaatgaattagatatgaattttagaagttttgagccatttaaatgaatttctataattattcacgaattattgcgcaattattatttattttacaaaggaaatggacctcgctgacgtcatcaaaggggaggggcggggccggcaagcgggccccaccggtcagcggcacaagggcgccggtccaccgtggac

SEQ ID NO: 60205 - DNA, 20759 bp, Oryza sativa
ccccttagactcgggtagtagcacgagtagcctccctgtagctagccggcgccgccccgaccgttgccgccgctcgccgtgtgctcgccgccgtcgccgcccgagctcggaagcgccgctcgtcgccggcctcgctcggcgcagctccgcccaatccaacgctagcatcggattcccgtagccgcgtagatgctctcgccgccgggaatcggcccctcgtgacctcatcgccgtttcccccttctcccgccgccggttgccgccgccgcaattcgccgccgtcgggcatcctccggcgaatccgagccgttggctcgtctcccctcgtcctgtgcaaccacccggtgtgctcgcttttgcctgtatcgccgtggttcactccaccgctcgccgctgtagtccgccgtccgttccggccggcgtcctcgtctacctcccgccggcccgcgtggcagccacgtaggcgccacgtcggcgccagctcggccaaaaccgggtcgagtcgaccccggttagccgctccctccccgtgcgcgcggtccaccgcgagccgtgaggctgcgcgtgggcccgccgcatccgcgtcctccgcgaaccgcgcgcgtgcaccgcgtctctcccccatcctagcgccgcgccgcgtgctccctccgcacggtgagccgagccgctgacaagcgggtcccactcgggaccacgcgaggtgagcccggtccaccggctctctctctcctcccctcccgcgcgcgcgtgccttgggccggtcggcccatttagctcagccgagccgccgcttttctctcgggccacgccctagccgcccgagggaagtctaatttccctccctcttttcttttcttttcttttctttttcgaaaaggatttaataaatccttttcttttagaccaaaaaaccaataatcttagaaattcaatatcttcccaaccgtaagtccgtttgactccgttcaacttccaaaattcctcaaatctcgagatctatctaatggcatgcttagaggtcattaatagggctttattttcgccgtttgttgagttgtcccgttttgcgtatagtttcggagcccgaagacccgcagtgcgaggatttcgaggatcaagctccagatctcgagcaaggcaagccacctttgaacatcttgagcctatatttgaatttaattatgttgcttgaaaaatattatgcattgataggattgcacttaatctgtttgtcctgtctgcaaggcagattggcggacctacctaatttgttgcatttgatcattcctttgttaattgttatatcatgtccccttgtaaccatctagttgcgcctcgatattcgtgcaccctgtgcgagtatcgacggtcgccttcaaacttaaaatctgaaaaacttcttgggtaaaacttgggttttacaaaaggcttggaaaacccgacacctgggtcagtgcttgcgaactaaatgaatttccaaaaccgcggaccggggaacgtaccgggtgtatggtttcccgctcttgcacttaaggaccgtttccttggaatttcatccgaacataagacaagacgaccacataggtggaatgagacacccctggctgagtaactagcttatcaggggagccttgatgccgagagacatgtggattcactggggtggtgtcggggaggacccctgggcttcctggcacagtatggtctgggacctaacctgttgttggtctgggacccctctcgtcggcatatggtaaacctgtgtcggcatacgaaatgccttgtcatgaaagcttggaggtctcccgacgtggctgatccccacgggctgggtgatccgggttagtaatgtcgtgtgggtaaagtgtgccccctctacagaggttaacaaactgttcgaacagccgtgcccacggtcatgggcggatgtgaggtgattcctagcgtagtgttgtttgactactgccttgtgaaattgctgttgtgaaaaggggatcgttatttggaaaatctgcagctgatgggatcagctaggcccgggtggccatttgaaagttgttggcccgggtggccgtttgaaagttgttggccgggtgccaatcttgatcaattctaaagactgatacatttgcacatactccgaccggacgagacgcactgtctcatccatgtcgtttgagaagcactcacttagttgctttcagaaaagagttcaaataaaatcaattgcaaaaacaacagcctttccttgaagcctgcattaaacacttatttcccatggcttgctgagtactcctgtactcacccttgctctacataaataatcccccccagttgctgaagaagatgaagcgaatcccgctgacgaggagttcttccaggagcaagccggctacgatgagttttaggttttcggcctagttcccaagtcgcgcctgtgttgtttggtccaagtcctggcttccgcttcccttttgtaatgcagttgtgagctcgggatctgtccgcagcccgacttgattgtactcctactctataataaagagacctctgttgctgtgatattctgtcttcctgtgataccagcattgtttcctaggactggtatcgattaacaggttaatttggagcgtcacaggctagttccggtcggtactagttcggggcgtgacacgtcagctcccgccaccgccgcgctccctgtcgccctccacgcagccacgccgccgcccgccgccagccgccaccgcggcaccctctatgccagccgccgccgccgcccgggctcagccgcctgggctcgctctggtatgggaggaggaggaggtggggtaggggaggagaggggaaggggaggaaggggagaggagaagactagccagatcggatctgaggaggaccggaggaggctgagaacttgttgtttaatgagagctagggagtagagagagagagagagaggggaatggggagggataagattatttttgtttataccaaccgggactaaagataattggggcctgaattcgacccgacaactttttaaaccaggactaaatctttactcccgaaactaaagatcaaaaaaattttaaccaggactaaaaaataatctttatgtaacaccccaggtaaccacgtacctagagtgccacatcaaaatacactcaaaccactaactcccaaaattattagaaatttcggcagaatcttccctgtaaatacggacatccacgacaggcaaatgtaagttaaactaataacaacatccttcccacaattcgatccatccttataattccatggaaagaaactaatagatatctaaaagattattacaagaccgaaccataatatagtttaagtatcattatggacctaagcaatatagtttaatactgtgcaaataaatgtgtatataagggtgctacttcccgcccatgcatatcggtcgcaatatgtacctaaaaccaaataaaacacacgagtgagtataaaattactcagcaagtataatatggaactagaaaacacatatacacaacattggcaataaagcatgaacataaggctttctttctttgataggaaacacattttcaaacaccaagtcaaagaagatagtagttcccatcccgggcaggcatgaattgaaatagtagtttccatcccggacaatagtgaatacatcctagcatttgccagcaaagccgagtaagcgtgatcagcgcttacccacaggaatatgaataaagatccaaattgcactcacatgactacacatggtccttgaataattgaaaaccagaatcaaagaaccaaattgaaaccatattgcacatccatggcaagcatggaacttgaattatttacctagaaccaaaatccggaatattaaaacaagaatagcatcgtaaacataggataaacatgaaaacctaaatggcgtgaataacaatatgaatataatcggtcacatgtcacatagaaatatatcaaaaataaatagatagagcaaacaatccatgaatcacacaattagttcgtcatgcacttgcctccaatgaaggattggtatcatgcacgatctgataggccaccacctaatcataaacaaaacctcagcaaacacattcaaacatgcgtataaaacaatgaaaaaagtgaacctactgccccatcccatcaaaacgcaataacaaggaacgccgcttggactatacacaagactactgcttcaaacatttatatcttgaaatatgaaaagtctatgactgaaaatatatacattttgaaaatctacagaacaataaatacaactttgatgtagaaagcatatttttattctgcaatttaaatggtctaatttgcgcttgaaagtagacatcagaatctgtccagaatttcagactgtccacactaagacaaccataactggagttctactcgcccaatcatggtgtactttgccaatatggaaagctaagaaaaacctctacaattttgtctataggcagcctggctgattccactgtttaacccctccaaaaacagttcaatctactactatccaaattatgacacaaaaacaacagtcatactaaaaaaaatatatctcctaaaccacttgagataaaatcgcgccctttggtcagaagatagatccaaacattatctacaacttttatatggacactttgatcagaataaatcattttgaccatgaaattaatgtaaaacagaggcgctataaatcggcccacgcccagaactaccaatccgaatcacaacgtccaaaacgcttctctaacccacctcaaccacgaattaaaccactagaaacaccctagaacaactgatacaacaaggggataagcctcacctagggttcttttagagaacttatgaggagacaataggggagactccggtctaacccctacttctactcctctcctcctactcgttccgtttttccactttgcttcttcatccaagctatgaagatggagatctagggagagcaatttgctgttgagggggagagatgcgaacacaggaggagaggaggaaggaggcgccggctaaggagaggggtggcggtaccacaaggggaggtggggtttggttcccctctctctaggttttaggggagaactaatgggctgagtttatgggccttctcatgttggcccacttctaaagatatttttcttttatgtatttctattaacatctttattttaacaagtcaacccaaactaaaaaaacctaaatattttttttaatatacggggtattacactttagtccccgttcctatttgaaccgggattattgtagtttttgggcgaccgaccaaagatgatttctccaggactactatgataggtaattaatgaatgtagcctgatgatctcacctttaatttgcagccgtcctttgcaatttggctaagtggatgtcatgtttagaagcatgcagatacactcggctattcttcaagtttggtttataaagtatactccctccatactcataaagaaagtcgtttaggacaatgtttaagtcaaaccttgggaatataaatcatgaataactctcaagttgttgagtttaaaaatgtaaaaattatatatatagatttgtcttgaaaaatactttcataaaagtatacatatatcacttttcaataaatatttttatagaaataagaagtgaaagttgtgttttggagaccgtgtcactgtcctaaacgacttcctttacgagtatggagggagtactagatatctctttctgtgtaattaataatcgatcgatctgacctactgttacgcttcgcaactattttcgtatatcttatggagtattgcatgatgtatatctgaaatacaacactatgcaattcctagttattatatcgctgtcatatcggtgggtgtaactaaccaaactagaagtctacaagcctactgctaaactataaatgatcagtacactttggtgctttaggttgataattgataacgcttgtcttatcatgttcgatcaataattttcatcgtaagatcctaatggtatcttctgatcagtgtagtgcatatatactataaaatgggcaagataatgcatcttgctaagagctaatccactcatcaatgtcatagtaaaatacgacgcgttaggttgccagtcatattttgtcatagtttactatgtccaagattatataggtttcactaacttagcaactactccattcgcttcatcttatcaatcgttttgacattttatcaaatctacctataataataattagcaattacactaaattagtttcattaaatataacattgaatgtgttttgatatacatcgttctcacatttgtcatcaatcataatacaatgagcaagataataccaccatctgcatggacaagatctccttctcagctacaacatctccttctcgctttgagtgatttcgtactagttgattaactggacgaaaggggagccctcaatgctccacacgccaccatcttgaagtccaagcaaatctacgagtacttgcatgaagaccgccaagacgaccaaaattggaaaataatttggaaaagtaaatctcctccgaagattcagttcttcatttggttattatccaaagaacgcctccccacaaagcagaacctgtaaaaaaagaaaattgtttcgtccgcgaactgcgatcttttggtgttttagaagaaactgcttttcatttctgtgttgattgttcttttgctcaggcgttctggtcgaccattcagattgtcccaggactgacaagctcagccaatctcgcaagtttaggccgcctagatggcattcccatcaagcacttcagagtcttcttctttctctgcttttgggttctgtggaaccacaggcatgatgttgttttcagggggctgcaaacatccttgcgtagactagtaactaaatgtatagatgatgcaactctttgagcagagcgtttcaattcggatgataggggcattgtttcctcgtggaaggaaacactagcgtctgcttttcaaaactctgtaatttaacatgtaactgcaagtcttccttcattttataaaattcaggtggggaaactcccccgctcccccctgaactttctaaaaaaaaattatacaatggacaagataataccctccgctaagagctaaatccatatgtcacggtaaatttaaccctccgaagcattaacaacttttttcaatctcaagttgagcatcacgtgcattaaagaaacaaaaagagataaaattaatctacataactagagatgctattgttcaacgaaatcttcaatgatctaaaaaagatgctaacacctagacataataacaagttaatactaattaatgtcaacttgaatactttattattacttccggactactctcctctccgagatagtactatatatttgcacttcagctcccagtggatcaaaaaaaatacattggtcattggtgttctgctggattcattcttcatggcgccctccttccggctctcttctgcacccgagtcggccgacgaagcaacagctcataataaggagatatacgaccaactccgacgagtcgcagagacctttccgtcggctcccagcctcatcggcctcccgtgcagtcgccacccggacgggtggtacacgttcacgaatggggttgtgagctccatggtgatcaaggagcacctgacggcgcgcgccaccgacatcttcctcaccaccttccccaagtccagcaccacttggctcaaggcgcttctgtactcgactctccaccgcggaactgacgagctggtggcgcacagcccgcaccagctcgtccctttcctcgagtcccaggtgttcgccaatgaccggatccctgacctgagctccttaccttcgccgcggttgtttatgacgcacatcccatcccagtcactgccagactccgtcgctgcatccggctgtaatgtggtgtacctttgtcgggaccccaaggactgcttcgtctcgctctggcacttttggaacaggttcatgccgtgggacatcgacgaggcgcaccggcaattctgcgatggcgctcgcagtttgggccgttctgggagcatatcctcggctactggaggtggcacgtcgagaagccgaaccaggtgctcttcttgacctacgaggagctcgtcgccaacacgctcggccagttgagacgccttgccgagtttgtcggatgtccattcacgacggaggagcagaagcacgggtggataggaatatcgtggaggcctgcgcattggagaacatgtccggattagaggtgaatcggtcgggaacgatcaccatagtcgatagcactgtcccaaacaacacggtcttccggcgtggcgtggtcggagattggagaaaccacctgacgccagagatggcaaggaggattgatgagattacaaagagcaagtttaaaggatctggcttgttgttacatccgcagtttttacaagtaaaaagagaataaattaaaacaaactaggagtatatgttttttctttcaaaaaatagtttgtgtgccgttttcggtgtttaatagagatacaatctcttgcgtattcacgagtgaagaaatacatatatgtactggaaatttgtaaatcaaatcattgcaagtaatataataaaatgttgccggttagccgtgagttgggttgttaggttgtttggctttgtggattagtttggtgtacgtaactatcgtcatacagttttcagatcattcatcaaaattcactaataacgttcaaatgatccacactgtttcttgatatgctaaagattattaaacatcctccgaaacatttctataccaccatgtgacactctaataaattagaaataaaaataaaaatactgagggaaaaaagcaaaaaacattaaaccattgattattacttgaaccgaaggaccattcaatgtccaaaacaatttgtttaagagcagtaaaacgagctacctcaattggcatagggaggcaagcaaagagaaactgcgattctagtccaactgtccaaggctataaggatgatatgctacggacctgctaatctgctcttccatttgttttcctccaaattattttttcgagtcacatctatagttagctgaactgatcttacacttagcaactaggagtatgtcgtatatatactttattgagatgattgtccatttccttctagtctagaaagtagtttgcatgatttcatctctgaaaagaaagactgtaattcacaattacatcactaccaaacccttgtttcggtgcgcatagttaattaaagctgatcttactactagacaccatgataaatttgaccctcagaaaaaacaactttttttgcaaggtaaagtttaacccccatgttcatgaaatttctcaacctaacaccataatttgagaggagggaattaaggaatgaaaaataggtcacataagtacggatgtacagactctaacaatcaattaatggtggattatcagtaccagctagcttgagaactctgctgggatttgtctcttctcttagatgtatgtttgcaagttacatctcaatcatatattgtcaggttcacgggactaagactcattattgttttcgtaggactacacacacttcatggcttcctcctcaactgccgaagcggccgacggaacgtctcacatggaaatctatgaccaactccggcaagtcgtggagaccttcccggcggcagtcagcggcatcggccaaccatactgtcgccaccctgacggatggtacatgtccaggcggggggttgtgagcgccatggccatcaagaggcatctgatggcgcgcaccacggacgtcttcatcgccaccttccccaagtccggcaccacatggctcaaggcgcttatgtactctgctctccaccacgacgcccacgagctagcgtcccttttctggagtcccagttgttcgtcaacgaccgcatccccgatctgagctcgctcccggaaccaaggctcttgacgacgcacatcccggccaatcgctgccggactccattgccgcctccggcagcaaggtggtgtacctgtgccgggatcccaaggattgttttgtctctctctggcacttctgtaatagattcgtatcatggaacattgatgtggctgtccggcaattctgcaatggcatctcgcatttcgggccgttttgggagcacgtcctcggctactggcggtggcacgtcgagacgccaagccaggtgttcttcttgacctacgaggagcttgcagctgacacgcttggcctattgagacgtttggccgagtttgttgggcacccgttcacggttgaggagcaagaggctggagtggataggaagattgtggagatttgtgccatggagagctcgtcgaggttagatgtgaatctgtcgggggcactgactttatcgagaaagacgtaccgaacaacatattcttccggtgtggagtagtcggagattggaggaactatctgacaccggagatggcaataaaaattgatgagatcaccgagatcaagtttaaaggaactggcttgttgtttcatccacagcttttacaagtagaaagagaatagaaggaactatcatgtactaatgtttgacgcgaacagccggacatgtgttgtattcatgaaaatgagtgaaggatatgtgtactgtaattctatgaatcaaattattgcaacctgcttcgagtaataacaggtcgattagcagtataagttgggtttgtcatttgtttggcttttgtatcacataattgtcttcttcgtgccccctgcaaacccaccaaagtgtaagactacttgaagttccgtaagcatttcgcaacgtcttaatcacccatgaatattaccaaatatgggacaaggagacaccttaatcttgagaaaaatatggagataagccaacgtgctcaattgggtgatctaccctttgggctcgtggctgacgagtgtgacatccttgtaccgagcaagtatgtttgcttctcaaatcagcttttctggcattacttggttgcccatatattggcagaaggaaaccatgcacaattataatatacatatggaacacattattactcagcaatcaacaaatgccgcagtaaggaaagttagtaaaaaccacatatttttacacgagcttcagtttcagatgtaagttcaatagaattgccatagcatataatttagccacagggagtgagcttcttgttgcctgcaccacgagggttatcgtccttccagtcatcccatcctctcgctttctcctcttcggcgtcctcgtcctcttgggctgaccgactgccatccttgtgccatgcggagtttgattcttgaatcatcttggcagttctttcttgccatttctccatcattttcatctcacgtaagccagcttcttctatgctcatcgttggcaacctaagaattattggatcaaaggatagtctcatatgcatattttcactaacttttaggactgaacaatgcaagatcactttaatagagatgatctatagctcaacacttaattgctgcaggggaaatctaatgttttttatgagcaaatgtagaaattgcagcagaatagtatcatttcttggaatttttcatagattatgactaaacataaggtcacacctacgaatcactatctcagcatctatacgattgcaccaagtgttcgtagtcacaacagagtacaagacaacagtttattgtcagtgaatctagtattgcactgaatagcaaacttaacatggtgccttttcagcttgaaaaaatgattaatttaacagtgtaaaccacgaatttgtcacggacttatggcagaacatgcaccaacaggacaaggaaacacctacgattgaataaacatggtcacatactaatgtggtgaagcaaatacaatgtaaaggaccactttacaaatttaccaagaaataatttgctcatcgagtaatgctcaacgaaaaaggaggtcaaagttcctacaaatatatcaaagtatgactagtatgatgcattaaaggttgccacaaataatgcccctccacattctgccataaccgaagttcaccatcacaataaaaagaagcagtgcagtttcagccaggtatgtagtagtattttaaagcatacctataacttggctgaaaaacttgtgctgccattctctctctttcactggttagtcctccaccaacaagacttgcagggccaaatatcagcggctggtgtttgtgctcatgtgcttgtgaaacacttgctctaccttcaatgacatcttgagcaaatgttgcacaagtgattggatcagctggtttggagtatggtgcacggttggcagcattatggtgccatgcttcagccctttttgtacgttcatcaagcatttcacgagcaaatgcattaccatcctaaaacatcatgagcaggaaattatttcattactaaaggaaacctccatgtaagtgcagaatttattgaaacagacatgcaacacaaaggaagcaaagataaaaaaaaatctaattgtttttttcttacggtagaacatctaccatcgagtgctataaaaggatcatgaaaacaaaatcaaacatctaatattacttgcatgtagtaacaacaaaacactcagcactctgcagacactgagagagagagagagagagagagaagtgtgatgaaatacttgcaatggcaagttattatcatattatgacaattaatttaattgtatctcctaactcagaatccggtgtataatttttttcaaacagaattactgtatacaactatccagctacctacttggtcatggtctacttggtgaaggtaagctctactacaacataagctcaaggcaaagcgaagttcaataattgtatcagtaaaaacacaaccagaaatgtacagaacggttatagaagaaaagttaaaaggccaatatgatactggaaaggatcaaccaaagatactattgacgagaaattggcaaactttattcatttgttttaccttcgctttcctttcttttactgccggaagcatttcttcttccttctttaacatgtcaagaaggtcaaaagcctataaaatgaagtagaaatgagtgcgtctgatgatcaggataaccaaagcgagcacagtagcttaaaagaatgcaaataaacatcccaagcagtataagagaatcattcttgcccataaaacacaaaccttgcatagagccaatgagatagtagctaaccatgcctgcaacatagaacaaaaaaaaaaagaatcaaaaccacggcataaccatttatcatttgtacatcaaagtgagttatgacaggcatggcatggaacccaaactttggaagcacacatcgacagatcccaaaaggttgattgcccacaaaagtaagagatcgtatataaaaagcacaggaaaggcaatgagcatcatattgttacaggaaaaagattggtggtgacaatctgccagtacagaataaatacgctgtgtgtttcatttgaacaaaaatgggtcaattcaggaaatgtgatcagttccctatgggattttttaaaacttatcttgaatcatcaaatttgtcaaattccatcttttattgaacagaacaaagcctttcctttccttctcttttctggaaaaagtaaatattcttcttccacttctagtacattgtagctaattttagtttggggtattttcaaatatgctatgtggtaatttaagaatatatcacgatgtttccatttggtaaacaagatcagatttgctacgtaaatgggttctaaatgcctggtgctaactgctaacctctctttcttcctctccatcatcctcaaaagcatcttcctccccagcttcaataggagctgataaagcagctgctctcaatgaccgcctacgcctttctttcctctccttgatttctaggagctttgtttctgcagccttttggcgcttgaaccgtgcaacctaggttcggcaaacaagaaaattagagtggaaattaaccgactttggaaaaggtcaagcagattatgagtcccagattttgcagtctcaataatagatttggatcccagtttattgtgttcgtaaattgcagaatgattgatgacccctttaacatatttgagaaaaatatttcgtcaaggctcaccttctgtgctcttcgatttgccatggtatcaggttgcttctgcctagatatttcaagctcatcctctgatataagctccagtgcttcacagatagaaatgaattcctgtgtaaccgtagtgattaaaacatgagaaacatgagtgttgtgatgacagagtgctcccaattgaaaagggcataagaaagacatgacaaatatgcaccaaatcaactaaatgtgacaggacaaactgatataaccttcaaatgatcctgcgacgccttaaggactgggatccgatcttcctgcgctaccctttcagtcatttccccaaggtagtacggtacctgaagaaaatcaatcggaatcacagatataaccacatgtcgcagatgcacaaacatgatacggtaagagaaacgaatataaacgcagatgtagtgcaggaaacaaacatacgagtaggtatttgaggttggcggtggagatgtcatccttggtctcgttggaggagaagaggccgaccttactgaccatctcgtcgcaccgccgcagcaggtcgacccccttgcggatcccttcctgcaaatatcccaaaccaagcaatcacagtgagcgctcgcacaaaaccgccacgagagggttgatggggatgaggagaaaggggggtgaatcgaaggaaaacctggtcgagggaggagctggaggcgagggagtggaggtgggacgccttgtcgaagagggcggggagcgggaggtcggcgtcctcctcctccgccgccgcggcggggtggaggcgcatctgcacctgcatcttgttgctgacttcctccacctcgaccattctcagtcgccgagcgcgcgagaggggagagatcgccggctaaaaccctaccggagcagcgccgcgcgaaaggaagggaagcgacgcggaggaaggaaggaagggaaactggaaacgtcgggaagggcggaggcggccggatttgttgacggggaggcggggctcggccggaggtgctcgatgggccgttgatgatcgatccaacggcagaaatcgctgtgttccgcgcactgacgggcggcaataatgtttacagaaaaacccctgtttcgggctatttttttcacaaaggttatcctaattttggagacgactacggatcggacgtccgatgctattgttttcgtcggacgcctgttctactattgaatccacgtccatcccttcatgtccatccgattaaaagaactattacatgcgcatgcagagaagagcagcaacaagaaaagtttaactgtgcatgctcagtaccaaatgagagaggtacatggatagtgacatgcttcaaacttttttctcaaaaactatttatccaatttacaatccgattgctctgttgtattcgttgtaattaaatctatataacaagatatcacatcattatattctaagaaaaaaaataaatgtttcaaccgtttggacttggatctttcacgtgtgagaaataaatgtttcaattggaatttaactatgttgcacattttaagttttatgttgcagtagatctttataaatattgcacgtgatattatttagatgtttcaataagtattttctaatgtttcactaatttaacgtaaatgttgcaccggcgtttttttagtgtctcaataaatagttacggtgttgcaacacttataactcgatgtttcatatatagaataaaaatgtttcaattaggatttaacagtgttttgttcttcttatttattttttatcaaaatgtaatcaactaagatcttattgtaaagatttaattgcaacggatataatagtgtaatcagattgtagatttaataaatattttaggagaaaaatagtttgaagttactaatgcagtaatgcatgcatagcccttttttttacatacatgcacacttatatgttagagtgaagagtgaagtactaaggagaaaagtaagagaaagagagagaaatgtgcaaccataaactaggctaagagaaaagataagagagcagacatatagtatgtaggtcgtgagcagatcacgtccaattttgtttggtgcgtcagacgtttgactgcaagcattttcccctagtttttgcaaaacaccccttgtggtttgttttcaccctaaggtaagtaacacaacagttccactaactccatttcatgttatagatctttttaactttttttcaaactaaatttatataaaaacttagcaacatctataatgctaaattagtttatgacattaaatatattttaaaaatatatttgttttcttacaatatttctatatatttttataaattaatcaaactttaaaaggtttaactaaaaaatcaaagtgacttacaatataaaatagatgaagtattatttttgttaaaaacccccgttttagcatcgatcatttcaaagatcatcgttttttgcgagagaatatatgtgtgtggaagtttttgtgtatgtgtgtgcgtgtgtgtggaagagtgagtgtgcgtgcatgtgaacaacacttttttaaggaaagtgtgaagaacactatgtgatgaatctggtattaacccttgaaagttgtgaattcacttatggttaacatattaatcagatgaaagaaaacttatagttatgagtacacttgcacacaaatttgtgtttaatagttgtaataaaatttatgttagtaacatagtatgctagtaacacgtactgtactaaactctttcatctagttatgagtatcttttattagcagtagacacgaattatcaatttatcagtggagtatatgttagtactaacatgctactagtacatgaattctatgtttcacttgaacaaaccacatattcatggaacttgaaagaaagaaagaaagaaagaaagaaagaaaggaaaaaagcaactaacttatggtgatcacctttacaacgaaatggcagcattctgcttccattacccaaaaacaaaatgtttcaaacaacatgaagaaactttctttccatagactaacaggaaaaataactcaaacatctctttacatgtataattgttcaaactgctaagtattgccaactgctccagacaaaaagatcacaaggattcatttctcatccaatctttcaaactactaactaagaagccacattctattgtgtggccatttacactattatgtaaagagatgttcttttctttagggtctcaccatctacttccttggtagccctcaatctggtttctctgtctactgtttctttgctgaatgtacccaccactattccttttccttccagatatgctgcttgggtcctggtatctattcctgttgatcccattgaagctagccctgttatttgatgaatgatgattgttactattattccaattgccccaactagaatccgccaaggcactaccccaaccagagcaatttttactccactcattccaagattcatgctttgttccccagtccatgttggatcttgaatcttgctcccacttgttaacttcggtgggcttttctacatagatgtcccagtttctagattggttctgcctctgctggcacttgttatctgtatcagtgctgcccaatccatcagctgggagtaactcatcatccatctcgaatggtaaccgtaccatattcaggtcagctatcaactcagggtcgatcttgctattgtggtcaaccttgtcaatatacatatcagggtctggcaaagatatgtctgaaggttgaccatggtaattagcccagaatctagcctttgcattcttaaaattatcaaaggcttctgagtcatcccattgctctatgttcttatacatgcagacatatctcttgttgtcacagaacctgtgccaagaaatgccgccaacataaatgcaaaattccctttcccataatgggattgggtggcaattgtgtcctgtaaatacgaaagcaatatcagattcattgtagcagcataaaaatgcagggagatgatgaattctaaaatgtttatacaaacaaataacatatacaaaaattttctggctagattgcttaagactactgtacagattagaaatcacctgcagattttggacgggtcaaatcccaaaataccagcatcccttctaaaagtatgggaaacaaagacaccaaagtacccaacggttactttcctaacaggctaaacagaagaaccattcaaggtactggataaatgggttcagtactaaaacactactccttctaagggatgctcctttgtcgccacacaactgcgcctttcatgactactccctccgtcccaaaaaaagacaaaccctggtttccgtgtccaatgtttgaccatccgtcttatttgaaaaaattatgaaaaaaattaaaaagataagtcacgcataaagtattcatcatgttttatcatctaacaacaatgaaaatactaattataaaaaattttcatataagacggacaatcaaacgttggcacgcaaacccgcggtttgcctttttttgggacggagggagtatgtcagttatctaatagtttatttttaatagaaattaataatgtctccttacgcatatcatggatttaggatccggctgcttgaggaaaaaatgtaatggccacataagaagttatcaatagccaacttaacattttgtgtcccctcattttttctgaagatatgcgcacacaagtgctccctctttttttttatttgacgttgaactaaccaaagtcaaataaaaaaacagagggattagtttgcttattgcaataccattacagttcaaactatgaactgatacttggtagtcaaataaaactagcattttctgacatttgggtaccttttcaaatagtaagacaaattagaccaacaataataagcctaatggtaaaggaagtcgcagtagcaactctggttctaagcttaaattgactgcatcacacagtacaggacagtccaccatctacgacagttgtgtcattcttagggtggcaggaaacaaaatgatattcatgcccattccgagaactccaatccacaggaaaatcgtcagccaacaagaaagtactagacctagatatctagatcgaaaattttccaacccgagtcttccctaacaaatcaccatctgaacaccactgtacagatttagaaatcacctacagattttaaaaatcgcctgaaatagcagcatctcttctaaaagtatgtaaaaaaaaagacacccaacagttactttcataacagactaaacagaagaatcattcaaagtactagataaaagggttcaatcctaaaatactagcattccttctaatggatgctcctttgtcgccacacaattgcacctttcatggctatgtcagttacctaatagtttattttaataccaagtaccaacaatgtttcctcaagtatatcatagatttaggatcctgccgcttgaggaaaaaaatgttaagcccacataagaagttattgatagtcaacttaatattttgtggctcctcatttttctaaagaaatgtgcagtaagtacagcgctttgttttctttctccattaagtacaacctcaaccagatggctgtgatatggctaatgcaaagcaacgccattacagaggacaattcccttaatctcctatccttgacatcctcaaaagacaagccttctttagtaccaacatttattgtacttttttgcattgtgtgttaatgtggttttactattttgaagcttctagaattatcctaattttagagaaataacttgtatgatcataataacataactccgccttccatttcctagggtaagcttactcagatcagcttaacttttgatgagtcaaaagcagatagagtaattcactgttaaatatttttacaaagatatgaaaataagcattcatttttcacataggaaatctggaaattcaagatccccttgaaaaatcgaagtgttcctgtggcttattttgagaaacagtatactaacgaaagataatttaattagaagaggttggtagaagggggataaattttgtcaattatatgatacagcagaatcaatgcaacacctttttatcgaatgccgaattgcaaaactgatctggaatgttgtttgtagcctttaacttgaaaccttttagagacataaatcatctttttggtagttggatgtagagctttcagaaaaacatgaaacatctcatttgggttggtgtggctgctattttatgggtcatttcgaaaacaagaaattctgcttgttttaagaaacaacttcctggagatcccacagatttgatttattatgcgtcattggattacatgttgggctgatttgcagatgcaggaggaagagcgaagaaggctgctgtgggggggggggggggg

SEQ ID NO: 60206 - DNA, 37195 bp, Oryza sativa
ggttggaaaaccaggactataggtgggttcccacccgggagtaaaactcgtttatccaccagtgagtggaagcctctgatatatatacttgcattgcatatagtagcggattctcactttctcagttgatcttcattcggtgcacgctgacagaatattttacatgcacgtacacggctgtcttaattagcacactactacagaacatcatgtcgccactatagtgtcgccagtataggttccggtaatgctaaaacctgtatttatagacctttttccatcttcgtgggttgaaatcgtaaaaaactgacactttaagtaattataggtgacacaaaatataatagacgtcggtttttatttagaacagacacctttaatatattataggtgccggttaattaaaaccgacatctataatatattataggtgcactacaagaaaatgctttgtagagacatttttctagtactatagagacacttttcaaatgcttttacaatactatagaggcgttttaaaaaatgtctaataaatgtcttatggtgaattgtctctacaaatgaagaggtattttataaaatgtctataaagtggtagaggcattttctagagacattaaattataccacaaccatatgaaaccaatgtaaaaatgagaataaaatattttcccttgtttttgccaatccttgaactcatgatctcttgaacaaatcattcttatcttcaagacactaaccaactcaacccatgtcattcattgtatatgtttatgccttaagttacttatatttagccatttagtatacttttattgtaagaagtgtctctacagagtttaaagtgtctcaagcaaatgtctttacatgttagacacattttaaagtgctgaaagaatgcctctacaagataaaatctaataaaatgtgctgaaaatatttctaaagtgtctctagagtaaaattttctagacaattttgaaagtgcctctataaagtgtctctacgctataaaactcctgatcttagaggcaacttgcaaaatgcctctacaaaagtgtctttatataatgtttttgttgtagtggtgcccgtatcttttaaaaaaaccgacgcctattgaaatcgagtcgagccggcatcggatgagccgaccggcgggccccaccaagacgaggcgaggaggagataaggttcgatcgtcgtctcactctcttctctctctccctcccttctctctcgtctcactctcttctctctcgtctcgctctcttctctctctccctcccgtctctcccgcgcactccgacggttggccggcggaggcggcagtggtgaccgcgccctcccctccgccagatccgggcatccggtgggaggggaggcggcggcagggagctagaggggagcccgtggctgcagctgcccggcggccggacgggaggcggcggcgacaccctcccctccaccagatccggccggaggggaggcagtggtgcctccgctccaccagatccggccgggaggggagtcaacgacgacaggaggggtggcagcagcaagtggcgtggctcacgggcggtggcggcgacgacctcccctctgccagatctggcgggaggggaggtaatggcggcggcggagccctcccctctgccaaatccggcgaggagtaggtagcggcaacgacggcggtgggctccccacgggcgacagtggtgggctcccttgtctctcctgccaccagtgagcacccccaaccgtctccttcgcttgccggctgtgccattgttgatgtttgattcgatgatttaatgatgtttgatgtttgattcagtgatgtaaacttgttgatgaatatttgattgtgtgatgcatgaatttgttgattatgtgatatgtcctttttctagatttttgatttattctgtgagatgaatattgccaaattttgtgattgtgtgatgtgttcgttctgttcttgcggatgtgggaggagggactgcgatcgagccagctttttttttattcgtcgaaaaaaaggtgccggttctaaggaatcggcaccttttttatttttaaatcagtgccgcctcccttatgccggttggaaaaaccggcactgaaggggtttcccaaccggcacttaatccttttctgtagtagtggcacccaagcctggaaaagatcgacgaattcgatctgtgcgtgatcgattgccaacgttttctgaagatcgatctttcatttcaattcgcatatcgttaggtcccgtattttgattaattgctactactagctgctgctatacaagctactagcaagcttgtccggtcgtcagtgcaaaagtatatacgtccatgcaaagcatcccggcatgcagctgctcagctcctccatgcctccatgctcgctatctctctgcaatctgcagctatgagaattatttatttttatatatcgatctgaacctgaagatagctaacagcatgtatgctggtaatactttgaccacagttgaagtgtacagaagaccaacagccttttattagtggtggttcaattcaattacttcagcatcttatttgccagagagaccagcaacagtggttgatgtcaactgtacagtagcacacatgtgcagacaacacaataaaatgtacagtataatacactgcgaaagtatagactatatggatgtatggtcatggataagtagctgctactgcaattctacaacaccactcgctggccggccatgcttcaacatttattaattatatgtcgttagccgcttttgtatgtattaataatccttgttaattactagttgttagtgtaactatagctgccatgaattactggatagtgaaagtaacatctcatttagctgaacgcacaaagttagctagtgaaagtactacttcaattcagtactgctgttgttcatcagaataatgctattgctagctagctcggtccattgttcatgcatattatttgcaacaacctacctatcaaatcggccaatatgaaacagtagagatctctgtagtaatgtatcggagagcagacaaaaattaagcatgttttgaagtgccgaggcctaatgaagcaatgatcagtcaccagtaatgcatctgcagaaagatatacaatcataatatcatgcatgctagggtagatgctgcagagcagacaaggttgtattcgtgatgggccggaacacaaagaattcttgggccaggccgaccgtccgtttgggtttgggttaggttgtctcaggctctcagccagtaccagcagcgttcagtattggactatgtcttaaatatatagttacatttttttagataatgacatactagtatatagttagataaatcttcaaaacatatcattcgatccttagtccaaggagattggccacaaagtaatctgttctgtttcttcctagtagatgagctagacatgtaccaagaagacagagatacccaagtccattggaaacagagtaacaaacaagtatattccaacaagaaatgcttcagtgcaaacaaatgatgaacttacaaggctacaacttggctaatgtacatccaaaatcctgaaacccaggtcataatttataagcaacaaactaatacctttttcttgttctcttcgaatcatccaatgacaagaaatgaggcaagcatacacgcacgcatttttttttctcctataaattcaacagctgccacaacattgaaaccctgctcctactgagaccacctgatccaactatactagctgctggtaagtggtaagtgatctctcattaattacttggcatttttatcagaggaattagttagcgttttttagcaatgttttctggtacggacgcatcgtcgccggagctgtcgctctgctcgccatatgggccgtggacgcaaggccgtagcccaaccgaggagctgggcctagctctgttggagtgtgcggcccacgtagagactgggcccatggagaaggccacgcgttgcctcgcgcgcgccacgggcctcgccgccgccgccgccgccggcgacgggccgcggaagcgcctcgccgtggcaatggtggactgcctcgcgcggcgcctcctccgccccgtccaggccatcaccgacgcgctcatcgacccctccgtctacctcgaccggcgttccgtcagggcggcgcgccgcgggttctttgaactcagtcccttccccaaggtggcgttcgtcgtcggcaaccgcgccatcgtcgaggcggtggagaacgagagcttagtccatgtcgtcggcatgtccggtccatttacccagccatgccagtggatccagctcctgcacgagcttcgccgtcgcccggaaggcccgccacgtgtcgttcggctcaccgtcgtccacgacgacggggagttgcttgccaagatggaagagttggtctccgacgaagccgaagagctcggcatggagttccagttccatggcgtcgtcggccagctcgaggatctggacttcagtaaccttcgcaatgtccttgagataaaatccggcgaggcgctcgtcgtcagctgcactctgcaactgcatcgtcttcttgctgctgatgacgatgcgatgtatagctctcgctctgcccatctcaaccaaatggcgagcatcgcgcagctccagcacatggcggtgaattcgtgcccgtcgagtagcggcggcggaagcgtgcagtacaaagacgatgacccttaccgaagcccggccacaccgctgacgttcgtctcgccaccggtgtcaacccctcacttccagacgccggcggcgctggcgagcttcctgtcggcggtgcgcgcgctgtccccgaagatcctggtggtggcggagcaggacgcggaccacaacggcgtctccttccggaagcgcttctgcgaggcgctccaccactacgccgccgtgttcgacagcctcgacgccgcggccgccaccacctcggcggcgtcgcgcctgtggtctcccgacgaacgcgcgcaggtggagcgcgtcgtggtgggcgaggagatcaagggcgtcctactccgggatggcgcgcaccggcgggaatggcacgaccggctgcggcaatgggcggcgcgcatggagatggccgggttcaccggcgtgccgctcagctacgccgccatcaagaaggggaacgacatggtgaggcgatgcggattgagacgctgcgagaacaaggaatgcggcggctgcctcctgctgtgctggagctcgaggcctctctactcgatctcggcatggcggccggcggcgagcagaggatctgggtcaggttcagagagaagcgagtacgtacatgtcggtgccgagccagatgatcgatgactccggtataggggtgggcattcggtcttgatcttcggtgtttcagtcatttcggtctttgaaaagtgtagatcgaattttaacgtaaaaatgtcaggaccgacaaattcggtcttggttttttcggtctcggtcttgatcttggccgaaattcaataatatttttataaactcaaagaaataatgaaaattttcaacacaaaaatcacaaaaaatttttgtaaacacgtataagtaaagactattattagattgcgtgcctagaagtaggatgttgaaattagagtttaatcttattgaaattagtggattgtgtgttgcatttagacattttttttaatttggtctattcggttaaccgagaagactaatcgaattgaccgaataaaattcggtctttcactgcctagtaccgtattgttgacggaatttctcattatcggtctcggtctttcggttcggtttttttctgcccacccctactccggtacatagctttgatgaccaaccagacgaaagagcatgcatttgtaatttagttttcaatttgtaacttatttctttttttttcatttttttgcgagattaattaatctgtataagaggcagagagttcttgagttgcaattatgtggagaggagagattcgagagaatggttagctatgaaaaatctaaaattatgatcaaactcattttttttctgagattagagtgtggccattttgatttgtttgaaattctagttagttttgggccgaatctaacaaggaaaaagtgtaccgaaggtccctcaacttgttagcggtataaaaaacatcctcaaaccacaaaccacatatgaagggtcccttaactatacaaaaccggtcaccagaggtcctttggtggtttgaccggtcatccgacgtccttcggtggttttgacaccggttttggtctacgtggcggctgagtcagtgtgggacccatgtggaccccacatgtcagcgtgccacgtcatcaccctgtatttcccctttcttttttctcttctccgcgggggtagaacggaacatgcggcggcaagcggtgctgagcagcggccggcgaagcggagaggagcggaggcgcggagcgccggtggcggcaggcgggtgagcacggtggccagcgtcctcctcctccatcgccgcatcgacggtgtgtgccctgcttctcccggtggtcgtcggcgtcctcctcggctcctcctcctccgccgccgcatccgcggcgtcaccggcaccggcatcctctggccggcggagcccgccgctccgttcaactcgcacgcgatgctcagctcctccacgagctactccgccgtttgcccatgagcgccacgatgctttccgccgccggctgcgcgcggtcgacgagcacggagaggagcagcgaaaggttctgcttcagcgtgcggagcgccgggcggatgcgggcgtcggcatggacagctcgaggagctgctcgtccattgcgccgtcggggaagctctcgtcctccacgccgccgcactcactcggctcaccattgtagtcgtagcaaaacaaatctgtttcagacaaaagcaaactccaaatctttgatcgaacaatgatcttagccacaattcagtgtgatcttgatctgaatcttgattgttcttaccccggtactgcacattgttgatcaccagcgtcggcaagatggtcacatcccctctagcgccatgtccaacctgcatcaagaacagcaatggcgaaggtgttcgccagtcacacaccgaaaatcctgcatttttcagcatcaagctggtcagttggtctaacaacctgaacaatctgctccgtcttgagcgcgtcgttctcgatgtagtcgtagcacccgacgctgctgcactcgggctccgtgtcccagcggcagaagaagtagcggtcctcgtcgccgtagaacccgggcgtgtccagtacagcaggggcgatgcaggggatgaggcagagcacccgcgccgacggcgtctcctcgatcgagtactccggctcgccgtaccgcaggcgctcgctgcggccgccgccgccgacgacgccgaggcccacgccagcgcgccgcaggttgctgaacaggcaaaggctgtgcaccgcgctgcccttcctcgcccagagcaccgccaggcgcagcagtcgccacgctcgcctcccgatcgacgccttctgctgcttctgattcgccgctgctgccgccaccaacgccattgccgcaaataccagattcagcggaagaaaacggtcgcaaaatgctcccctgctcccgcgtcgccggctgccggacctcctctcccgcctcgccccgtcagtctcctccccacccgctggttgccctgcccagagccccagagagaaaattgagagagagagagagagagaggaggaagggagagaagagggggaagagagagaggaggctgacgtggatatactgacatgtggggttcgcgtgagtccgcgtgagtcccacgctgactcagcagccacatatgataaaatcgggatcaaaaccgttgagggacttattgtgaccggtttttattagttaagggacgccggatatcaggtattgcggttcgaggacgattttgtatcccgctgacaagttgagggaccttcggtgtactttttccatctaacaatgccaagacgggccagttcttatgggctccaagccccaaaggcccaatcaaccatacgcaaaggcttcggccaccttctccttcttcccagtccccacactgatccgccatgtcgcgtcggccgttcggcggcggcggcggcgatgtccgccagtctccaccggccagccctcgcttctctactccagatcgaggcgggaggctgcggagtccttggtgtatttgcgcctggaccccggctcccctgtcgcggctatcacccgtgcaggagtagcagcactctgggttccgcgtcattgacaccgcgacgctggcatatttcccctcccggactccggatcagggacgttctggtagcagtttgtgctttcctttattgcacctttaaatttgcaatgcgaaatgttgtggataagttttaatttagaaaaagaaagtgagtatttactacagtatgtcgctactgtgctaagtgcctttgtggttgtggatgatgcgtaccatgtaacaagtaagaaatcacttaagctgttggtactaagcgttaccaattttatcgaattaacaaaatttcattctgatcaaatgctagttatgatgccattgggctaaccggctaaaccctagtgaaaaggaaacacaatgcagctatactaataaagaaaaacagaccaatgaaatgtgcatctgcctgaaatgtagaatatataacccggctgaaatgtagaatatataatgtgattcttcccttgttaaacccataatctttcacaacaaatatttagggtctggccaacagggcagttgggtttgctagaacctgtgtcctaccttagcaaataaggatgctaaccgcataaaaattgctaagatattagtatcacttaacagtatgtactgcatatattttctcattctaagtaggtaccacatggtccacatctcttctttctatattatttttttaaaaaaccataatttaataagcttgccaaaagttccatgcatagtagtattccatagtccaacgagattgaccccaatgtttgtcagttgctacctggtggatatgaagaaaccaaagggacaaattcgaacagaacaaactgaacattcctatattattcctttcattgcggacatgccaacatgtaaaactttgcctataccgtgaatccttccaaattgcctaatgtaattctatataaaaccaaaaatctttattttgttctatcagttaaagacatgagttagagtgctttccttatgtatcacatatgtagctgtgcataaaattggagttactccagcaaactcagccaaacaatacttcctacttgaccgcgccaatcttttcctagagagcagaaaataaaatgatgcatgggctatgggtgcaagatcagggtgtggtggatcacttagcgcagctcgtccctctcttgcatgagtgtgcttcccatgtaactgagggatcttttgagaaggctgacttcagctttaagaagatcagaatgctcaccatagctgacgggccattgcagcgcctatccacgatcattgttgacagcctagctcaccgccttctctcctccatccagggccttcctggtgcccttatcgatccatctgattactttgagaagtcaaccctccgggctgcacgccacaacttcttcaagctgaacccctacctaagcaccggttttgtcactattaactgggccattatggaggcaatggaggatgaaaaggtcacagtatgatttgaatgtgcttttagaaaaaaaaaagttttcaatagatatgcagcttacccaatacattgggatctgtcattgctttgtggttgaagtatgtatttttgtcacctgcttaatttggatgccaagtcttctttttttggctaatttatttaattagcaatttagcatggtgctagaatataattctcctttccaggccatataaactttatagcatgctgacttcccagaacatcaatgtttgtcactattgattcaagaactagagttgatactgttcctttctacttttctaataatgctgggcagtgtagatttgttaagatttcttcccgaaaacatgccgaattttttggagatcaaagtaaagaccaattagagatgcaatagttattaatgccattttaaaactttcccattataactttaaaactttacaaggtgcaatttatgttgaaaggtcattaatgtttaacatggtaggtaaaattgatatacatttgcacacaacattctttaagaacaaagtcaggacctgcagaattgttggttagcattagcgagcattactgagaatttgagattatttgtaccatgcttgtaatcttctaacgcaggtagatttgcaggttgccacattgttgacttgtcctgctcagctgctcatccatggcagtggcttaagctcctcgatgacttccatggacggcctggcggggcacctgaattataccttactgttctccatgatgacaatgatttcttggcgacatgcagtcattgctatctaagaaagctgaatctcttggggtgtccttccattttatttctgtgataggcagacttgagaccttggatttcagcaatctccgtagcacctttcagataaaatttggtgtggcagttgcaatcagctgcgctctacaaatgcatcgcctcctcttggttgatgacaatttgagctccaccagcattgctcagctccagaaaatggccaacttcactcagcctaagcaaatggccagctctgtgtgcagcccagcctccacactgaactatctgcagacaccatcccctcgtacaccaaaattgctggcaagattactgtctgccatccgagcgctcaagccaaacatcatgttgattatggagcaagatgcagaccataacaccctgctgttccgtgatcggttcaatgaggtactcaactactatgctgccctctttgactgcttccatgcagtggctgcagctaacccagggaggactgatgaacgcttacgtgtggataggatgatcctgagggaagagattaaaaacatactggtatgcgagggagtccatcggcacgaacggcacgagaggctggaccagtgggcaatgcacatggaggaatctgggtttcacaatgtgcaacttagcttcagtgccatcagggagggtaaagagaatctgctgagctttggattgaaaaactgccagaacaaagaagacaggggttgccttctactgtgctggggttatacgaatctctactctatctcggcatggaggcaaaatagaggttcatcctctgggagcagagagcatatgttagttcaacgccaaataatatggccattccagtaggcctctctgtccgtggcaattagagagcagcagactacatccaaatttcccactctgggtgctctgttcagcatatgtctggcagctcaaggtacaagctgataatgtgtgtttgcagcaagatttgactcctgcactaaagatatgctaataagttcacttggtgtaaaaaaaaaaggatggtataggtaggacatagaaatatcttttggtgtgaagtatgtaaagaactgaaaggtctgtgttttttttttctctttgaaaattggaaccaacgaaatgggattggcagagatgcttaattcatcatcgatccttgaatgattacccatcatttcgtagttttctctgtttgcaaaatgattatgtttcttagaaaatggtacttatgtttcggcagagtaatctcatatccaaagtttatgcgcctgattaagaggctgagaaactcctatggttatgtatgcaaattaatctcatattcctagcttttcctgcaaaaatagacgagaaaattaggtttggaggtaaaagaacaacaacagcttgggtccaaatgcgaacgtttgctccaagaaaggccccttgcaatcacctacacttcgacgtttgcaacttcagacaaaaccaggttttgtttggactaagaacgcagattttggagctattagtttcattgatcctgtgcttagtcatggactgcaatagactgggagcacaaatagaaaaaaaaaatcgtgactgcaatagactgggagcagaagaaattgatctcaaaattgtcagatagcatctgatccaaatgctggagataaattccaagggaataattccaagctccttagttattccaccaagatacagacgacatctcttagttctatccgaagaagcatccacttcttctttgtcccttcgtcgtcccatgacaacttcgtcgcacaggaacacctgaccttgcaacatttgtctcaaacccaacaatggcgacatgccaatgatgccattgcttgataagcttcacggctctgaaaactggtagcagttgaggctgtgctgcacggacaggggcatgttccaggacgacatgctgtcgtcggcgacgtcatcgccggcgtcgtcggtgtactcgccgtcgccgtcgccgtcgaacgggtcgtgggtgcaggagctgagccatgaccagcagagcgttcggctgatcggcctgctttaccagtgcgccgccgaggtgtccgccggctccttcgaccgcgccaacctctgcctcgagcacatcacgcagctcgcgtccctggacgcgccgcacgcgctccagcgcctcgccgccgtcttcgccgacgcgctcgcgcgcaagctgctcaacctcatcctgggcctctcgcgcgcgctgctgtcgtcggccaactccgccgacgcccacctcgtccccgtcgcgcgccgccacatgttcgacgtgctcccgttcctgaagctcgcgtacctgaccaccaaccatgccatccttgaggcaatggagggggagaggttcgtccacgtcgtcgacttctccggcccggcggcgaacccggtgcagtggatcgcgctgttccacgcgttccgaggccgccgggaaggcccgccgcacctccgcatcaccgccgtccacgacagcaaggagttcctcgcgaacatggccgcggtgctgtccaaggaggcggaggcgttcgacatcgccttccagttcaacgccgtggaggcgaagctcgacgagatggacttcgacgcgctccgccacgacctcggcgtcaggtccggcgaggcgctcgccgtcagcgtcgtgctgcagcttcaccgcctcctcgccgtcgacgacgggaggaggcacgccgccgccggctgcctcaccccggtccagatcatcgcgcgctccagcccgagaagcttcggcgagctgctggagcgggagctgaacacgcggctgcagctgagccccgacgcgtccgtggtgtcgtcgctgtcaccccactcccccgcagcagcaacggcggcgcacccgacgacgtcgacgccaaagctggggagcttcctgtcggcggtgaggtcgctgtccccgaagatcatggtgatgacggagcaggaggcgaaccacaacggcggcgcgttccaggagcggttcgacgaggcgctcaactactacgcgtcgctgttcgactgcctgcagcggagcgcggcggcggcggcggagcgcgcgcgcgtggagcgggtgctgctcggggaggagatccgcggcgtggtggcgtgcgagggggcggagcgggtggagcggcacgagcgggcgcggcagtgggcggcgcggatggaggcggccggcatggagcgggtggggctgagctacagcggcgccatggaggcgaggaagctgctgcagagctgcgggtgggcggggccgtacgaggtgaggcacgacgccggcggccatggcttcttcttctgctggcacaagaggccgctctacgccgtcacggcgtggcgcccggcggcgtcgcgacgcggccacactcggtcgtagctgtgcacgcgcatgtgttctctgtgtgaaattgacagcttgtttggattggatcatttgagtggagagaactgaattgatcagcttaattgtgttgttttcactgggagattgttgctatttgccagcatcatcatcgtcatccaaggtgctgcacggttgaatttgcaacctggttgcgatgttgagtatgagtgtatgacactattaatgtgacagtactactgtgatcgatgcttcacagtatagatcactttggatcataaagatagtttgtgaaaagtgaaactcagtgtttagatcactttgtcctgcagcttgagtgcttgacctcttgtctttgtcactgaaaaagtgcagggctagtttgcttttgaccggaaagttgcactgcatctcgctggaattgcatgcaccgttggtaagttgccccgcaattgcaacgcactgatgtctccggtctcccgcgcgctcaacatgtacaacgcatgcaaactgttttccacgggaagattaattaaggccccgttccaacgtgcctatcgggcaggcaattagctgcttggctttacttggagaaaacactcaattgacgtatgtttaactaagattgaataaacttaaaaatatatttacttaaagtttttaagaaatttctatagaaaactttgttttaaaacatcatacgtttagcggcttaggggttagaacacagctattaatatatgagtggattacaggacttctactccctccatactacaagggattttgggttacatatatatgaagtataaacatccaataataatgctgaggcacctatgatatgatgatggaatcataaccaagtgtgggagtatggtgttgcgtatatagagatatgtgtgcttgtgtttactgtaagtctaaaaattaaaaaaaaagatcaatggctggtgtatatgatggtatgtatgtgcatcttacgtataattaatttatactccccccatccataaaagttagacatatttcacatttgagtttttctaaataagttatttctatttgtattctttatgtatttaagacttaaatgaagagataaatttaaatgtttgattagaatttaaggagtcttctaaatactcattggttgcatacttgcattcactccatgattttgaaacatcaaagatgatttaatttctcattggtcttggtgacaaaagtaatatgtacaacttttgtggatggagggagtataactctaaatgttgacagtagtggtagcagtgaataaggccattcacaacccaatgactaagtggtgtccatagcattaaataagctgttaactaggatgaaaaatgatgcggcaagtgaataaatgaaaaaaagagaaggaaaccatgtcttgcatgagacatggtttctacacaatatccaagacatcatgtgaaataagtagcattaaatttaagtatggaatagtggtgtttgcattggaagagtggtgtctagtactagtttcttgatgatgtggagtttatggaaactatgtctagtgttttgggttgggaatggccttagaagagtagtgtgatgatgtggagtttatataaactatgtttagtgtcttgggttgtgaatgaactaagctaccatcactccgtatcattgacgtgtgtgcctctcaacatcggtgaaacttgtgtactcgctttcaattcccaatcctcaatctgtcctttgattctattgcaatgcacgggcaaatcagctagtaaaggaaaaaaacgttaccgatctaaactgaccgttctgttcatttcttctgtgaaactcgtactacgtacaaagagaacaaaagaaatcagtggagacaatgaacagcagatgaacgacacgtacatacaggagacgatcgattaacatgcattacgtacatcgatcaaaacctagtaaccaatatataatcacgcgcagccatacatcatcatgcgggcgaactcgtcgaagcagacgaacccgtcgccgtcggtgtccacgccgccgatcatgcggcggcagtcgtcgacggagcagagctcgtcgccgagcgacgcgagcacggcgcggagctcctcggcggagatcctcccgtccccgtcggcgtcgaacaccgcgaacgtctccttcagctcgccctcgtccgccgccgcggccgcgatctcctccagcacgagctccccggcgcactccgcctcggcgagcatcgcggccagctcctccttgctcgacacgatcctccgcagggccacctccaggtcctcccgcgtcacggccaccgccgccggctttttggtgccggaggaggacgccgccgccgacgccggcaacacggatctcggcgtggtggcggcggaatcatcggatgatgacgccgccaacgacgacgacgacgaagacgtggtggagccgaaggagcagctcttggcgccgctcctcctcttcttcctcctcttcttggaggaagacgaagacgaagaagaagaagagccgaacaaatgtgcaagcttcatcatggcgatgtctttagaaatcgagagctgaggaaggggcgaggaagatgagggggaagacgaggaattataggggaacaaggcaaggtgagcttccacgaagcttcgtgcgcgggaaaaccgaatcgcgcgggcctaccatttctgctgtttattcggctgggctttgaaggtttcagtatgtcctttgaggaggatacggcatgagcgagattttgtaccaaagttcacatacaaaattacacagacaatgactaccgtaccccttcatggtgcgtagtccactagcttgtgagttgtgagacaattcggaaatgtgggcctgtttagattccaccttaaaattttacaccatgtcacattgaatgtttaacacccgcataaattattaaatatagattaaaaaataactaattacatagattgcgactaatttgcgagacagatattttaagcttaattgctccataatttgacaatgtggtgctacagtaaacatttgctaatgacagattaattagggcgttgtttagttcccaactttttcttcaaacttccaacttttccatcacattaaaactttcctacatacataaacttctaacttttttattcaaacttccaattttggcgtggaactaaacacaacctaggtttaataaattcgtcttgtggtttacggatggattctgtaattagtttttttattagtgcccgaacaccccatgcgacatcctatataatacccaatgtgacacgccagaactttacacccctggatctaaacaccccatgtacttcagatttcccatcgaatgcaacttaggccctgtttagttcacacacgaaaactttttaccatgtcacatcgaatgtttggacacatgaatagagtattaaatatagacgaaaaaactaattatatagatcgtgtgtaaattgcgcgacgaatcttttaagcctaattgcgccatgatttgacaatgtggtgctacagtaaatatttgctaatgacggattaattaggcttaataaattcatctcgcagtttacaggcggaatctgtaatttgttttgttattagactatggttgtttggttgatgcctaagcttgccataactaagcttaggcaagttgtggcatgtggtaaaagtatggccaagaaatagttagccacaagtgtggcaatgttaggtctagttatctgagtatgacatgtgggacctaagggtagaaaagtgtagaatgacacaactgtggcattgaaacaaacatacgcctaaaaactgtggtatgactgaagtgtggcgtggcaaagtgaagcaatcaaccaaacaccccctataggtgtccatatatccgatgtgacacgccaaaacttttcacccctaaaagtaaacagggcctcaataccaaatgcatatgcatgcataggtgcagccagtgtctaacccataaaaaattagtgaggttctagatatacatataatctaattattgagtaatataatggttaatatgactataacaacagaaaatagacaagctacccgatatccggggactacaggaaagcttcaagtaggaacgtcattgggtgtagcatcatatatatgtgtactacttaactacccttcattttaaaatataataagttttagcctttgacacctatgtaagaaaatgagtaaataggcttggttgccttctcggaactggtgagttatagacctggactagttaagactatagtaaacaaaatgaatagaatgggtagttttaatggtaaaaatattgttttacaactagattgttatatttctgataaaatttaaacttttttcagggaaaaaaactttagataagattatcatatattttgggaaggaggaggtacgtatgaaaatgaagtttgtatcattatatcatatcgcatcttataatgttatgaatacaatagaacgatgatcaatctaaaatacaagaggattgcactgggggtgtctttttgtctattggtgggaggaatgttccatcgttttttcatgtaactaattaaaaatgtcaatggaaatattaaaaatatatagtaaaaatagattaatatataatatatacaataatgcagctcatattcgacttatacatgcatgtataatttaatatataatcatatttgttatttttttgaatttgtataagtcaaaatttaaacctgtggagtgatataacacatcttgccaattcatttaattttatttataatttatttagattatatacataaaacaaggaaatattcactcgaggaaaaaaacactttatttggattgcaacagataaatgacaaattgatcagcatgcaacttgagagagttttttttatctcgcagcttagattttcggcgccggtgttcacttcaacagttcaacacgcatgcatggatgtcggcagcaatcaacatcaacattaccacgggggcacacccacacaatacgtgttactcctaattaactaagttacgtgattgggtaagtcgtatgtataatgtgaacattatcaaacttaaacgaccggaatgcatacgtacgtgatggatttggggttgatcgcgatcgggaaggcgccaagaaacttcgcatgcatagctcgacgtacgtacggctgccaaaaaacgctccagtctgatgacttaactgacgtgtggacatgagatgatgagaggtggtttgaaaactgatgctcctccatggcgtagggcgtaccgcggcaacctcatccgctagctcgttcacactcacagcggtggacgtcttctcgctctcgctgcgcgctcaccgtcatcgctgagatgaactcaacgtacgtaggctggaattctgttccggcccaggttaattatatgggcctcacgtaggctataatcacgttccagcccaacatatatgggccgcgcgtagtctgtaaccccgttctggggtctgggccgaggccgcagtcccgcctggaccaacttatacaggccgtacgtaggccggagttcctttccagcacatatgccgctcgcctccggggcaataataagccggaatcactagttagcgtcgccggcagcgtgcgttttaggcccataaggcctagcatcgctgcgccggcgcgcgcgcctctccacgcctttttatcttttttttcgttttctttcctcactttttctgatttttttaatcttttagcatgttttgagttttaaagttttaaaattttgatttgaaagttttcaaatcttaagtttaaagttttcaaatcttaaactgaaagtttttaaaatttttaaatctggacttgaaagtttttaaatctcgattctcgagttgaaagttctcaaatctgagttgaaagttttcaaatctcaagttgaaagttttcaaatttttcaactctggacttgaaagtttttgaatctcgattctcgagttgaaagttttcaaatctgagttgaatgtttttaaaatttgactttaaaatttaaaacttaaatcgaaagttttcaaatctaacttaaaaaattttcaatctgttagaaaaaaatctcccaaaaaatctccagaatatattcttaattagtatcattagtgttaagtatattgactaatatatgtagttaagactaaaggggaggaagtgctcgccaactccctttcttggcgcgcacgcgcgccgtagcaacccccataataagcacgttggattaactccactttacgtctctacaattttcttttcatcgagtttaagtcacatccctgagccgcaatacaagaaatttttattatcacctaacttaaaccgggttaaattaggtccttcagcactggtttcgctgatgtggcaagttgaatacagtcaacctgtcctgtttgattcagcttaggattattataatctggattattaggagtaagctgaaataagcagataacttattatgatagattattacaatctataagccagattactataatatgataatccactctaaaggtgcttttttagattattgggtggctaacaactaacaaccaactaataatccagagaaacaaacagctaacagcttatcttatgtcggcttattataatccagcttaaaataatttggcttaataatctagattacaataatcttaagctaaaacaaacaacacctgagtcagcataggacccacgtggaccccacatataagtcacatgaaaatatataaaaaaagaaaaaaccttctctctccaccccccggagcacacggtagggacgacacacctctcttcatctcgagctttggcccaaagatgacacctctctccatctcgagcttcggcctcaggaagtaaggaggtgaaagccgacgatgacgaggttgaggcggggcatgggggaggcagagggccaaggacagcacggcccgccgtattaaagacgagagtgaggaccggcgtcacccaacctcgcttagcgcctaatcgccatcctggttgtccaactgtcacgccccgaactagtcccgaccggaactagcccgtgacgctccaaattaacctgttaatcgataccagtcccaggaaacagtgctggtatcacaggaagacagaatatcacagcaatagaggtctctttattatagagtaggagtacagttatgttgggctgcggacagaacccagctcacaactgcattacaaaagggaagcggaagccaagacttggaccaaacatcacaggcgcgacttgggaactaggccgaaaccctaaaactcagcgtagccggcttgctcctggaagaactcctcgtcagcgggatccgcttcatcttcttcagcaactggggagggggggattatttatatagagcaagggtgagtacaggagtactcagcaagctatgggaaataagtgtttaatgcaggcttcaaagaaatgccgttgtttttgcgattgattttatttaaactcttttctgaaacaactaagggagtgcttctcaaacgacacggatgagacagtgcgtctcgtccggtcggagtatgtgcaatgtatcagtcttttgaattgatcaagattggcacccggccaacagctttcaaacgaccacccgggcctggctgatcccatcagccgcagattttccaaacatcaaacccattccacaacagcaaatttcacaaggcagtagtcaaacaaaactacgctaggaatcacctcacatccgcccatgatcgtgggcacggctgttcgaacagttttaataacctctgcagagggggtacactttacccacacgacattactaacccggatcatccagcccgtgcagaacggccatgactagagaccttaaggctttcatgacaaggcatttcgaaagccgacacaggttcaccatatgccaacgagaggggtcccagaccaacaccagattaggtcccagaccatactgtgccaggaagcccaggggtcctccctgacaccaccccggcgaatccacatgtctcttagcatcatggctcccccgataagctagttactcagctaggggtgtcccattccacccatgtggtcgtacttgtcttatgttcggatgaaattccaaggaaacggtccttaagtgcaagagcgggaaaccgtacacccggtacgttccccggtccgcggttttggaaattcatttagttcgcaagcaccgacccaggtgtcgggttttccaagtcttttgtaaaacctaagttttacccaagatgtttctcagattttaagttttaaggcgaccgtcgatacccgtgcagagtgcacgattaccgaggcgcaactaggtgggtacaagggaacatggtataacaattacaaaggaaggatcagatgcaacaagttaggtaggtccgctaatctgccttgcagacgggacaagcagattaagtgcgatcctatcaatgcataatatttttcaagcaacataattaagttcaaatataggctcaagatgttcaaaggtggcttgcctcgctcgagatcttgagcttgatcctcgaaatcctcgcactgcgggtcttcgggctccgaaactacacgcgaaacgggacaactcagcaaacggcgaaaataaagccctattattgacctctaagcgtgccattagatagatctcgagatttgaggaattttggaagttgaacggagtcaaacggacttacggttgggaagatattgaatttataagattattggatttttggtctaaaggaaaaggatttatttaaatcctttttgaaaaaaaaagaaaagaaaagaaggagggagggaaattagacttccctcgggcggctagggcgcggcctgagagaatggggcggctcggccgagcttaatgggccggccggcccaagaaggcggcccaaggcgcgcgcgcgggcggggaggggagagagccggtgggccgggtccccatcccgcgtggtcccgggtgggacccgcttgtcggcgactcggctcaccgtgagcgaggtgcacgcggggcatgctagggtttgggaagggaggcgcgacgcatgcgcgcggttcgcggaggacgcggtgcggcgggcccatgcgcagcctcacggctcgcggtggagtgcgcgcgcgagggggcggagggaagcggcggaccggggtctgcttgacccggtcgcggccgaggtggcgccgacgtggcgcctacgtggctgccacgcgggccggcgggaggtagacgacgacgccggccggaacggacggcggacgacagcgcgcgagcggcggagcgaaccatggcgatacaggcgaaggcgaacacaccgggatgttgcacaggacgaggggagacgagccaatggctcggattcgccgggggatgctcgacggcggcggattgcggcggcggcaaccgacggcgggagaagggggaacggcgatgagttcacgaggggccgattcctggcggcgagagcatctacgcggctacgggaacccaccccttgcaccggattaggaggaatcgcatcgagggaggccggcgacgagaggcgcttccgagctcgggcggcgacggcaacgagcacacggcgagcgacggcagcagtcgaggcggcgccggctagctacgggggggggggggggctactcgtgctactacccgagtctaaggggaggagatggaacgaggagagagaacggagggaggcactaccgtgtgggggtgatggggcgcagtgacaatgggccgacggcacgggagcgatctctccggcctctggccgggggagaggaagaagacgagcgcccggagtccccttccgcgtcctaacgcgcaccggctcctccggcacacgcgacggcggcggccggcgagagagacagcaatggcgcgggcgagaaacggggaagattgggaggggaaagaggaagggaggcgcttgggtttatagggcggcgatgtcggtttggaaaccgaccttgggcggtcaagggagcgagctggcgctcggcgctcgcggccaaaacggcgacaggagggggggggggaggatgacgccggcgggagggaaaagggaaaaagggggagagaaagagggcttgcctccttgccgctttggggaaaaggaggagggagagagggcgacgcggcagaggagggagctctgcctccgtcccttggaggcacgcgcggggagaggcggggccgagtcgatgacgacggcgatgacggcggggcggtttggagtggagcggcgacacgggcggcagacgcggggcaggcgcggcaggcgctgacggcggcggtgactggccggtcggccaccacggcgcgcgcgcgcgcgcgggcggcgcggcgatttgggcggcatcggcgggaacggccgcgagagtggagagggagagctcgacgcggctcacgggcagagcggggagagagagagagggagagagagagagagggggagatgggccgagagggattcggcccatcgaacccgagggaagcaaaatagacttttgcggagggatttgatttgggaaggatttggattcgggattgaactcgacgatagatcagagatttgagatctgagatgacacggacactagacaacaagcaaagaaacggatttcgcaaataaggtttttaagagatagttttcccgctagacgccacgacggaacgggcgctacaccaaccgcggtatacacacaaagtttatacatatatatacagagtttatacgtatgtatataaagtatatacatatgcacatacatatagagaggagagtctaggggggaaatccaccgcgcaggcgtgcgaccacccgcacagtagcttacagacacacatcttgtagcagcgttctggtgccatcgccgcactcttttcctacaacaaacaccttcctctcctcctgtcgcccggacgatgcccttgatccgctcgacgcatgcaatacacgacgaagaaacctagcccattgtttctccatcacaacgcgtgtagactcgcgcttgctggaggatgcactgaactactgaaagtgttcgatggtatgccttaagagatatctgatgtcctgaaaatgctgtgctggacttcaggagttcgtctggggatcggaagcaggatcatatgccttcaggagttccttcggatgatatataggtaatgaaaaaagctcgatgttttcgcctctgcatctgtccttcgcgatttggctgagtggatggcatgtttagaagcacggagatacacttcgatcagttattctcaagtttggttatggagtataccagagatctttttctgtgcaaaatcagttattataagctattcttgcgcttagcaaccatgcatctcttgaatgcaacactatgcaatctgcagttattttctcactctcaaatccatgaatcggtctatgtaatcaaactagaaactgatattactgctgaactaacaatcacccagtttggtgttttatgttgacaatatataacaggctgtctttatcatttttgatccatatttcttaggacaagattctaaaggtatcttctaatcagtatagtacgttctcacatgtgtcatcctcgctaagaaaaggggcggtaataccccctattaagagctaaactcactgattgacgacatgatacaatttgatcttcagaagaattaataaattcttgtaagctcaagttgatcatcacgtgcattgacaaaagaaaagggagattcatatgaaaacactttagagatgctaacaaggtagttaatgtcaaaatgtcacttccagtttgaacactactcatgtcctcttgacttccgaatctgtctctcctcgcctatatatttgcactttacgctcccacatattcacagaatcacagcatcacaacaccagctaacaaccattagtccttggtgttctgcattcacttttcatggcgccctccttcccgctctcctttgcaccccaatcagccgatgaagcaaccgcacacaaggaaatctatgaccaactccggcaagccgtggagaccttcccgacggcgcccaacagcagcaccagcttcacgtacagtcgccaccccgacggatggtacacgttcccggagggggttgtgagtgccatggtcatcaagagtcaccttacggcgcgcaccaccgacatctttatggtcaccttccctaagtccggcaccacctggcttaaggcgctcttgcactcggctctccaccgcagggccgacgatctcgcggcacacagcccccaccagctcgttcctttccttgagacccaggtgttcatcaaagatcggatccctgacctgagctccctcccggcgccgcggctgttgatgacgcacatcccgtcccagtcgttgccggactctgttgctgactccagctgcaaggtggtgtatctatgccgggatcccaaggactgcttcatctcgctctggcatttcttgaacaggttcaggccgtgggacatcaacgaggcacaccgaaacttctgcgatggtgtctcactgtttggcccgtactgggagcatgtcctcggctattggaggtggcacgtcaagagaccaagccaggtactcttcttgacctatgaggagctcactaccgatacactcggccaactgagacgcctagccgagttcgtcggacgcccgttcatggtgaaggagcaggagatcgaagtggacagaaagatcgtggaggcctgcgccatggagagcttgtcgaggttggaagtgaaccagtcggggacaactgacatggtcgataaaacctatgcgaacaacatattcttccggcgtggcgtggttggtgattggaggaatcacctgacaccggaaatggcgcggaggattgatgagattacagagatcaagtttaaaggatccggcttgctgttgcatccacaatttttacaagcaaaaagagaataaaatgaactattgacaagtgaagtggaggaacatctcatgattgtacttatttctttgcttaatgaaaaaaaaatgcaaacctcgtgtctatttatgaaaataaaaagtgaaaacatagtatgtacgtatgtctataaatgaaattattgcaagctgcctcaaataatactcctactgtaagagattgccaattactagtaataagtcgggcttgtttttttttttgttatttggcttcattgattggttttgtgtcacatgattatcttctttgtacagcctgcagatatggtcgagcaaaatttacggaattataagaccgttggataagagcgtcaaacgttaaaaattagagggaatagtaaatattatttcagttgggtgatttatgtttttatctgaagttaagttgtgatttgcgttaacaacaacattcttcaaaatgcttttttctcataaacaacttatccgatctacgatccgattatactattgtatttgttataagagtaaattttacaaaactacatgttttgtggtctaagttgcagaaaaccacacacactttgacacttggcacttgagtacatatattttggttgtgtagtttcacaaaactacactatcgatgtatagattcacccgcgagatgatgcgactgtttcacctaggacggggacatagcatcctattaccagccatcgcatgaaattaatatgatgccacgtcctcatcctagatggaacaaccacgtcatctcacgggtgaatccattcatcgatagtgtggttttgtgaaactaaactaccaaaatatatgtacttaactgccaagtgtcaaaatgtatgtggttttctgcaacttaaaccataaaacatgtaattttgtgaaatttactcttgttataatataatctttataacaatatatcacatgattatattatgacaaaagaaaaatatatgtttcaatccgttaacactctttgtttcatacgtgatagtgatatgtttcaatatgtgtctttagtgtgttccacaaaattcctgaaactacctaccacttctccctctcctctctctccacctcattcatgcatgcatgctttttagcgagctttaaaacgattttcctcaactatttatccaatctacgatctgatcacacattgtattcgttgtaattaaatctttacaataagatatcacatgattatattatgatgaaaaaaatatatgtttcaatccgttaacactcactgtttcatacgggatagtgaaatgtttcaataggtgtcgttagtatgtttcacaaaattcccgaaactacctgccactactctcgctcctctctctccacctcatgcatgcatgcatttagcgagtttcaaaacgatttttctcctaaactacttatccaatctacgatccgatcacaccattgtatttgttgcaattaaatctttaaaacaagatatcgcatgattatattttgatgaaagaaaaacatatgtttcaatccattaacattagttgttttatatgcaatagcgatatgtttcaacgtgtatcttcaccatgtttcgtaaaatttttaaatgctttgcttatttttttcaccatatataacttgatgttttactcgttagttaacagaaacatttgaccgactgattttttccgggcatcgggcgcccgatgggaagattcctccccatgagagcgaacgtggacattttctatttctttgataaattaatagatgtttactagtactccttttgtcccataaaaaactcaatcttgagtatgtccagatttaaactcaagattgagttttttatgggacaaagggaagggagtaggttgcacgatggcacgatgcatttttggaatgcaatttgcaataattatatcagtgccaaatcccatgtgtcggtatgtgtactatatcaaactagaagccgatattactaagaaacaagttgacagtaacgtacactattatcatgcttgatctatatttttcggagtaagagtagtataatgttatcttctgatcagtatactatgtgtgccatcagtataacgtcatggtaagattaatttgaccctcataagcatgatacttttatgcaagctaacacgctgagcacgatgtgcactaaaaaaaggtcatatatatagagagaggtgtgagaacaactcaattaatgccaggaagttagaatgtcattatcagtttttgaacactgatcatgacttcccgatttgtgtctcttcttttttttcgcgaacaaaatttgtgtctcttcccctatatattaatttgcactactctacacactgcacagagtcacaagaacacgtgttttgttcattgctgtttagtgtggactcttcatggcttcctccttcccgctctcctctgcaaccgaagcggcggacgaagcgaaagcccacaagaaaatctacaaccaactccggcaagtcgcggagacctttccgacggcgcccagcggcatcgacgtcccatacagccaccaccccgacggctggtacatgaccacggcgggggtcgtgagtgccatggtcatcaagagccacctgacggcacgcgccaccgacatcttcctcgtcaccttccccaagtccggcaccacttggatcaaagcgcttctgtactcggctctccaccgcagggccgacgagcttgtggcgcatagcccccatcaactcgtccctttcctcgagtctcaggtgttcgtcaaagatcggatacctgacttgagctccctgccagagccacggctgttgatgacgcatatcccgtctcaatcgttgccagactccgtcgcagcctccggctgcaaggtggtgtactgtgccgggatccctggattgcttcgtctcgctttggcacttctggaacaagttcaggccatggaatattgatgaggcacaccggcaattctataatggtgtctcgttgtttgggccttactgagagcacgtcctcagctactggaattggcatgtcgagaggccaagcgaggtactcttcttgacctacgaggagctcgccgctgacactctcggccatctgagatgcctcgccgagttcgtcggacgcccattcacaatggaggagcaggatgccggagtggatagaaagatcgtggagatttgtgccatggaaagtttatcggggttagagatgaatcagtcggggatgactaatttcaccgagaaagacgtgccaaacaacacggtcttccggcgtggcgtggttggagattggaggaatcacctgacgccggagatggcgaggaggattgatgagattacagagatcaagtttaaaggatccggcttgcggttgcatccacagtttttacaagcaaaaagagaattaaacaaactataggagtatgatcacgtgtgaagtttcattattgtacttatttctctgcttaataaaaaaaatgcaaacctcttgcctatttatgaaaataaaaagtgaaaatatcgtgtgtactgtatgtctataaatgaaattattgaaagctgcttcgaataatactctcctactgtataagaaattgccaattattattagtatgttgggtttgtttttggttgtctggttttgtgtcacacgattatcttctatgtacaacctgcagatatgcatggtccagcaaaatttgtaagactgttggataagagcgtcaaacgttaaaaatcagagggagtagtaaatattatttcagttgggtgatttgtgtttttatctgaagttaagttgtgatttgtgttaacaacaacattcttatcaacaaatttggtgcaaaagcctgatgatatcatctcgtcagcaaaatgggatcctaggatagtgagcctgctagaagctaaatccacctattggtgctctgataaaatttgaccctcataattcataaacaacatttttttccaaggtaaagtttaattccatgtgcatgaaatttctcaacctaacaccatataattttagaggagagaataaggaatgaaaaatactttctccgtcccaaaaaaatcctaatatgtatctatctttgtcttcagattgagtttttcttgaacggagggagggagtaggtcacatacatacggaatgtaaagacgctaacaacctaacaatcaattaatgatggattatcactgtcagctagcttgaaaactctgccggaatttgtctcctcgatctcttagatgtttgcaacttgcactctcatatattcatatattatcaggctcatcgctcacgggactaaattccattgtgttctgtgtcgcctcctcaacagccaaagtggccgacggatcaacgactcacgaggcaagtcagcgacatcggccaccatactgatactgccgccgtcctgatggctggtacatgtccaggcagggagttgtgagagctccatggccatcaagaggcatctgactgcgcgtgccaccaacgtcttcattgccaaccttctctaagtccggcaccacatggctcattggctcagggcgcttctgcactcggcacacatggctcattggttcaaggagtcaaggtgcttctgcactcggctcttctccgtggaactcaagagctagctggtggcgcaaaagccccaccagctcgtcccagctgttcgtcaacgaccgcatcctcagcctgaataactagaaaaacatagattaactagaaaatacaaaatacgagatgccgattatgtcttgcgatttggattcacctacgtgtatagtcattctggcgtaacgatggttccagcccagcctgcatataagtggtaaacccgttccggcacaacttcttggaggcagctccttctccttttgttatccagattgaaaatgatagacaaaaatgtagtcatgagctcgattagtttgttgtaattttcttttcagacccctttttctttattaataaagttttccctaacagcaggtgcctcccttgctgtgttcctttttttttaaaaaaggagccggatggaagccgatcaacctatcatgggtctcatataggcttcagtcacattgaggaacaaaaagggccctcacggaggtcccagtaccgtttcggcccaacttataatggtccaagcacacgtttgctgccatcccattttggttccaaagtgtaagatccgcacatttgcagcaaagttcttgagccgctgcctttctttttttttttataacacgcccttcggccctagatctgctcgacgcaatccacgacgaggaaccttgggtcgtctacaccgaggatatggtgacccgttgcggcggttgtctctctcaaatgatgcgttgctcattgtgccggcaaggtccacatactctattgtttctccgtgtttgtgacctacgatgggctctgtccgtaggtcgctaggctatgacatgagggctagattccttgcattgggattggttttgtcgaaactcgtgcaaagtcgtgtttggtggtgttcggcagtacttctaagaacgaatcgggatatgtatttatttagattcatccatagaaatgattcttttttttggaacggagggtgtatgccttaaagatactaggtgattccccgcactttgctgcggaaattcctaagtaacttttaatattttttaataatcgagctaaaaataaaaattatattagttattaagaacaaataaaactggtttgtcaaactatgttcagagagatacatttagtagactttatctgagattgtaaatgaaatatgatattccgcactttgattatatggatgaatatgtattaagtatctattatatattaaaagtccattaaacttcctacaaacgctactaagctgccacatggcactcctataaactctcctaagtcgccatgtggagttttaatatattagaaacatctagcccttaattttcatttaaattagtgggtccattattttacatcattggattagatttaaaacagggcctccctccatgtggatacatatgcctccctcactgcctgcaagtacgtacgtacacgtactaacagatataccccccaccctttttcccttcttttattttttttacctaggaaacatccataatatatatgacgtttgaacatgtttatttactataaaaacatgtggcgttttaatatattagaaacatctagcctttaatttttatttaaattggtggatctattattttacaccattcgattagatttaaaacagaccctccctccgcgtggatacgtatgcctccctcactgcctgcaagtacgtacgtacacgtactaatggacataccccctcccccaccccccaataccctttttttcccttcttttattatttttttttacctaagaaacatacataatatatgacgtttgaacatgtttatttactataaaaagaaatatgtaattatcatttattttgttataattcgttaaattttctacaaacgctctcacgtccaaacgctcctacgtcaccacgtggtgctataataaattagagaaaattatagaaattctaacagaaaataaaacatctaaccgttgattttcacttaaactgatgtatctattgttttagaccattagattattagatatataaaaataataatctctcgctcctaatatcccgttcacatacaagagaaaatccttgcgtattattcatccggagaaaaggcaaaagctatacgtatgtacgatcgaaataaaaaccaaagaaattaatacgtataattgaaaaaacgaccagccaagattaattccaactaaccatgcataatcagctcacggctcaagcacgtatgtgcattatctgcactccttttttaggttgttgagtgatttgtccattaaactttctataaacgcttttagatcaccacatgtcactctacaatcgctactacattgtcacgtggtgctataataaattacataaaatcataaaaattctaagagaataaaacatctaaccattgattttcacttaaactaatgactaatggacctgttattttagaccactatattagattattagatctataaaattaatctctcactcctaatatcttcatcccgataaaaggcaaaagctatgcgtatgtacgatcgaaataaaaaccatagaaattaatacgtatcattgaaaaaacgaccaaccaatattgattccaactaccatgtaccatcagcttacagccggctaagcacgtatatacattatatgctctcctttttttaggttgttgagatatctaaagcataataaaatctaaacagcattgatttatatctccaattgaatatagactttcatggttatcccggtcagtgtcctcttcatgaagggctccacgcatgtattaacttttgaaaactaataaactatatgttggttctatgatcagtttagttctttatattcctgacaactataaatcaataatttaaatccatgtattgatgttttattatcaattaaaaaaatagtgtgagccatacctatctattattgacctatagtagttagtgctaactgataaatacataatgacacataataattaatgtcataatatttttttaaataattatggtgtaaaatatcacctgtcaaataatttgaatctacatatgtaaaaatgaaaaattgaaacaagggaatttagttatatttttttcaagtagatcttatctaattttaatgtgtgagattaagattctcaaatatgtttttgatttttttcaggactattttattggtatttgaaaagtgagaagcacacatgatacacagacaagaaaaaacttattaaaaatacttccagcgagtgatatggctatactacaaccccatagtccatcatgagaactatggtcatatatgtaggttttttgtttgtcatatagttttggcaacaaataaataatctaataacatgtgcattaaactacccatgatatattttcttttacttgaggaatttcaatgtgtcgggcatagttgatggatgtatgtcatacactacactaacatgataacctcactctctttcaaataataatattgtatatgtattattgaaatttgagtaatattgatatttacactataaacaaattgtgtctattatataccacaaaaacaactcaaaactttcaaaatgaatattttaatcacctccatcttctctttttccattctcaaaagtgtgccaagcatagataataaaccttgctatgctgccatgatatagcaaaggcatacatctggctgagttgagccaccatgggtggtcacccttagcaatagagctcaacttcctacttaacaatgcaatcctttataaaggtgctaattgtgaattaggcgttaaaactgctctccacgatagtcttgacggatacggctacacctatatgtgacccatgtttcaaggtatcgaggaataaagccttggtagctatgtttggctatgggcattcatatctaattttaacagtattatactattaacacgtataagcgatactgttataacatatttttttgataaaatattattggaatatttattcataggtttggaaataagttagatcgacatgaacaattaggtaagtagtggagataaactttttagtcgattagtgatgtattgtgcttattttgatggtacaaatacagtttcatctattaaataagcactcaggtttcaaaagaacgatattaagtatccataaaaaattcaataataataagtagtggtgacattaggcaaatttatatataaccgggaaatagtatttttgtttgaatctaggaaacatttttgtcatttattatatataagtctatggtcttttccgtggtctatatatttctttttgtattttcttataaacaataaacaaaatgcccacgcatctgcgtgggcttcttttctagttataaaaatgatggatacatatatattaaaaacattgtgaaaaataatgtgaaggaagataattggatgttgatttgtagaatttaatgaattatatacgatgttgcatgcttgcataggtacattttgtatgtaattattgctagtggatgatgaggtggcatgtttgcatgttgagctttaggattagtgggttataactttttggtaagataggatatgatgtcctaaaatgttgcgctggcactggtggagagatggtttgtagttccggttggtaacccctctgtagtcccggttggaccgggactacgaatgcgggactaaagatcactatctttagtcccgattgaaataaccgggactaaaaatacatatttaatcctggttgataacaccaaccgggactaaagatggcagcgccagtcccagttggtcaccatttttttctctttttttattttcattgtttctttccaaattgagttgctccttcccaaatctccctaaatatccccgaatcaaagtatcatcccaaatcaatgaatcattcacatcacaaattctaaataaatacaactcaaattcttaaagaaatacatcacagatccaaacatcaaatacatcacagatccaataaaccacaagttcttagatccaaatgtatcacaaatttggaaaaaaaaataaagttgtgcttccgctgccgcctcccctccggtagaagggagggcgccgccggccgccatgtagcgcccattccgtcgtggcgcctagcggaaaaattatctctttaaaactctatttgcgaaatctgtttctttgcttgttgtctagtgtccgtgccatctcagatctcaaatccccgatctatcgccgagttcaatcccgaatccaaatccttcccaaatcaattcctccgcaaaagtctaatttgcctccccgggttcgatgggccgaatctctctcggcccatctcccctccctccccggatctctctctctctctctctctctgtctttccctcttcttcgctctgcccgcgc

SEQ ID NO: 60207 - DNA, 9814 bp, Oryza sativa
cccaccactcaccggcgtgctgcagccagccgccgtctcccgccgactagccaccaccgagccgcgccgacaccaccatcggcatcgccgtgtcgatctccaccccggcccctactccattttcccatgccacctccgggacgccgccgtcacgcgcaccacctgtatccgtcgccattgccacctccagccgcgtcgcaacaccgctttggtccacgccgtcacctctctctgctccacaaggacaaggagaacctcggccaccttttcccatcgccggaaactctctggacgtccgttttcccgtgcgccggtgagcccttccccccttcctttctgctccggccggccacgtcgccgccccgtcctccctaacacctcccctcccatcctagcgtgcagctgccgctcgccgcctcttcctgagcgccgcccgtcgccagagcgtcatcgtctccgtccgccccgagctccgccgtagccgcctcccgttgccatctcgccgccggccaccttcttccgcgtgtgctactcagtgagctccccctcccctttcccaccgctctccgccgctctcccgcgcgtgccgccgtgccggtggtcaccgccggcgaccatcgggccgcacgccgccgcttcccggccggccggtcggcgagccggctcccgcccgcctgtggccgcctgattcaccccgggtgaatctgggccgtccacatggccgttcggcaccgccccatgtcagtgccctcgtggcgccatgtcggcgccacctttgccgcctgtctgccgtggccgccacgtggccgtccatgtggtgcacccgcgcctgtgccgcggtggactctcggtccaccgcgggccgctcctcttgcgccgctgactcgtggggccctcctatcggcgccggcctctttgatgacgtcagcgcgtcccttttcctttgagaaattaatcattaatgcgcaataaattcgttaataattctagaaattcatttaaacggctcaaaacttctaaaatccatatctaattcattcgaactccaaattgagccattcaacttgcaaaattcatctaaaattgagctctacatgtttgtttacttttcatgtactgtttccttggtttttattagagtttttccttggtttgcttgccagcgtgtagaatctgtcgtttcggaagatcgcgatcgcaaggataagagttcagaagattgtttgaagaagcaaggcaagtcacacattccccttaagcattttgatcctaatttacaaatgttttatcatttgcaaataaaattgcatgtcttgctaattacatgggaatagggtttacctatctgctcgcttgtgccatgtttacttgatatctgtcctttgtcaatattgggtaataaatcgactagctcatattacttatgtgacctagctagaactatatgcttagccatgcttaattaccactagctcagttgatgggataattacagtattagaccttttagtatcagaatgagctgcgtgctcgagacatctggacatgcttcatggtcgtaattatccaactaaaatacgactgaatggtgggctgtgggtgcatggttttgctagtcgcacacatggcaattaaggaccagttcgcgggaaaccctggaagaattcctcgtacttaccacaagccagcgtgggcaacgactgggcttgtagtgtagctttcctctagctgacgcatctaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaaaggttctgtcacggcctctttccggtatgtcgtggtggcatgtcggcgcacgggaacgtgtcgtggagctgtgtcttgtgggtaccgttgtacacctctgatcagagtaaaactattcgaatagccgtgcccgtggttatgggcggtcgaccagattcaccatgattagtcccaccttaataaaccgactcaatgcactgtagttcaggtgggttggttgggcctgttcaacgtggcgtagcattgatcagtggagatttaatgttactttaattactctactgttttactatttgctcaataaaatgtttcacaaccgcctttatgcaaatagccataaaccgtccttgtatccccttgcacgaatgcatcgttggtgtggcttgctgagtacggtggttgtactcagccttgctattattcccctttttcagaagtgtagtgcttctgagctgaagacgaggttagaagaccaagactcagacccagttgagttttgcctgtggagtggagctgaagccccactaggattgcctttttccgctgctgttgctttcgtttcggtgtgaggactaagtgcctcttctgtaagtatttacgcttttatttacgtttggaactgtatattacttgtcgttttgtgtaccctggctagtcctggacagggatttaatacacaaaatagtctggaaatttgggctaaatttctgggcgtgacagctaccgagtgaagcggaggcgcaacagctcaatatgtgaagcttggtgaagtggaggaagacgaggtggaggacccctaggcggcggctgtggaatctggtgacgggggagaagccgatggaggactggagagcaatgatgatagcaatggtcctaggtccgtgcgtgggtgctggagacccacgcgaagctaggggcaagggcaagctcggctcccaggctcacctccccccccaccgcagggcggtcctgactttttatggccccggtgcgaaactaaatttagaggcccttatcatactatataataacaatcaatagatacatatactaaattaatgttgtaaacatttaaattgcattcagaaataatatttaaatataaaacattgtacatgttacctcaaaagtttcttatgggattctatctaatcatctacccttttcttttttttcttttcttgctactcgatgcatactttctcgacaacatggcctggtaattgaaaaaaaacattattatagtagtttaactcataaattacaatacaaaattacaaatcaaaatttaaaatcgtaccaattagtttatcacaagcgtctagatgcacacggcaagtgagtcggaaatacacactagtgccttcgtcggttcgtccacctatcggaacaactgaataaacctaacatacgactatacattaatacacgggtacatggctatttacatattaacagataaaaatcacaatggtacgaaatttcaatttttcatatgacgattggttaacggccaaagcttgttatagcaaactctctaatctgatgactatacataactgaagcgggcgaagctaatccagctgctaccatgtaaatgcacaaacacataggatcctagctaatagtaatacctgaatcaagattcaagaggtggcaggcggcagtggctgcgtccaccgggcggtcacggagtcacagctgcattgcgcctcgtgccttactgccgtcgactgtcgtgcggagcagcagaaggaaaacgagaagccggcggccggcgtgcttatgcgtcatgcgtggccttgcgctgttgcgccgcgcgatttcggtgccgtgaggaggagaagattagaagacatgggcggcatcacaggatcgcgttctgttcgcctttcgcttccggcttccgtgcacggcgtgtctgttcaccttcttgttgggcctgggttggggggggggggtttcaagcggttgcactgctctgggcccccaaatcgcagcccccatcccacacacacccgagggccggccctatgcccccctctcactctcaagctccgcacattgccgttgttgtcgctgccgagggacaccgcccgccacctcctcctgtactcctccaatgaaagtactcccttcgtttcaggttataacactgtgtctagattcattagtatctatatgaatatagataataatactagaaagttttataacctgaaacggagaaagttatactcacatctcaaaaagcatgtggattgggtgatgaaaatttagaggcagacgaatcaagtgacatgtgctcaaatttctttggcttaatggccttaactgaggaatggaccacttccaagcaggaagcatgcgttcattggatcatccccgtattcccgtgtgccagtcgaccaaacgcgtccccgatgcttcgtgccgtgctcactgctcaacctttggttcaagaacgaataacgaaacatgcagcgccaaggtaagccgcacactcaattcggcggcggccgcgcggccgtgccgtcgctgcccacgcgcatcacgccctttcttctactaccttcgacccaactatacgtgacacatgttccggtgttctcacaaatacgacggagtacacggtgtcgtcgtttcacaactcacgcgtacaccgtgtgtcctcaccatcttcaagcctgcaacaaccgcatctacttcccacgtcatcatcttcatcattaatataacccgtactaccctccacagctttcttccattttgaatttcgaaacacacaaaatatcagaggacgcagacagacttgataaccctcgttccccaaattcgcaatccctctctctcccatggccggctacccgccaaaccccggctccggctacccctacggcggcgccggcggctacggtgccccgccaccgccctacggctcctcccccgccccctccgccccgccctacggcgagaagcctcccaaggaaggtaagacctcctcctcttccgccccttactacggcggcggaggcggctacggcgccccgccctccacccagccctacggcagcggaggcggctacggcgccccaccctccacccagcggccccagtcctacggcggcggctacggggctccgccctccagccagccgtacggcgcgccatacggggccccgccgccctcgtcggcgccgtacggggcgcccggcgggtacggcagcccgttcgcgtcgctggtgccatcggcgttcccgcccgggacggatcccaacgtggtggcgtgcttccaggcggcggaccgcgacggcagcgggatgatcgacgacaaggagctgcagtccgcgctgtccgggtacagccagagcttcagcctccgcaccgtccacctcctcatgtacctcttcaccaacaccaacgtccgcaagattggtaagttcatcgtttcatcgtctcactctcacccgcgaattgagtagttctggccttggggatggtgtgcgttagtctgatcgcgccatggttgctatcgtgcgcgttgttctggtcagcggcatacgtaatggtggttgtgcttcgggcgatgtgtagtcaaacgagtggcacgcgattggcacgtggctctccgcgggattatcaagcttcccacggtatttgcgatgccagtatgcgacttttggcttgcgatgtggagatggagtcttccagccagggctgtagtcagtgtttgcatcatacggctaggacttgtcgtttgggaggaagacgggggaacgtggtggggcaacgatgtagtggcaacttgttaaaagctggagtttacttttaggtgttgggatgcgggttcttttaattaagtttcttaaattgcatcaatttctttgtgggataggattcaatagaattgtggaaaatcctagctcatcttgtgtggttatcatggtgtggtctactttggtacagcatagacacatatactactagtttatttgcacaatgaacttgtaagttctcccggcttgtgatctagaaagaattttgggtttactccagtaaaagggcatgctactttggcacatagtttatacatgttaccttgtatacttacttttgttagtcagttctatttaaaatttcaaattactgctaaactgaaaactagatatttgcaactttaatcaatgccatttctcctattcttttgtcatctgttttctgtgtagagaactagagattgaatcatgagctttgaattgcttgagcagtgtatactctgaaaccagtgctatgtttcaggctatcagctagtgagcttgtatatggaattttggacttttagttctaacctgtgaaatgcacctgatttaacaaatactggattgctagatactgtactttgaacttaagcatttcttatattattcgtttttatgtaaaccacattgaatatgtgtctttgatcctttcaggtcccaaggaatttacctctgtgttttacagtcttcagaattggagggtgagatgctacagcttcagctttccttttcttctgcgcggtggaactaatgaagttactgttgaaactgaatacgtgcattttctgcttgtactgtgcagtccattttcgagaggtttgatcgtgaccaaagtggtaaaattgatgcaacagaattgcgtgatgctcttctcagtctgggatattcagtttctccaactgtgctagacttgcttgtgtcaaagtttgacaagactgggggcaagaacaaagccattgaatatgataacttcattgagtaagatgactccttcaattatgttttgcagattgctttcttagtaattgttcaagctattagcttatccaatcatctacttcctctgttttacaatgtaagtcattctagcatttcccacattcatattgatgctaatgaatctagacatatatatctatctaaattcattagcatcaatatgaatgtggaaaatgctagaatggcttacattgtgaaatggagggagtaatcattttctaaaaaaaaaatccaatcatctcaaacttggttagcatatgtttatatggtcagctaattataggattggttcaaattcgtttcagccttatttttaacattttatttttgaacatttgttgacacaaaagtagtctttgggatcaaatggctggttaaagatgatatttcctatcaaatataattgttaagatgtttcttgcacattttgaggcaataactaaaaggataatgtatgcatcaactagtctttctacttctgttttctgatgcaaaactttgaatccatctagttgttttctcatcgttctatttttcagccttggattttaaaccacttaattgtataaatataaaagacttttgttgctttgatcacgtgtcatggcttattataagccccagccaagcaagtcctaacctcaaagttaatattggatatagtttaaaatcttgatatcttctatcattccaattcggcctatattacagtcctaacactattttgtttgcctttgcagatgctgcctcacagttaaggtaatgcactaattccatcacagacgctgttaagtcctagcacaatgttctgttttcactctgttaacatacatttgtaacaattttacagggtctgactgagaagttcaaggagaaagacactgccttctcgggctctgcgacttttacttacgaggctttcatgctgactgtactcccttttctcattgcataaaatggcagtgtgctgcacagtcgacctttcaggagaccatgcccattgtgttgaaacggttctgtaacgtgtgttcatcgacttgtttttaactgagtttattgtttggatttgaaatgatacaagtgcttccctgatcgggcatgttacaatttacaacgctcatgtatgtgaggatagctccgaaaatgatgtaatgactcttccgctagaaatcgcatatcgatcagcccacaaattcaatgcatttgtgaaatgactcatagaaaggactaagccgagtgaaatgaaagtttcgaagtgctttgatatcgcttgaattatcagttgtagctgatgtgtagtccttcagtccgggtgattttggcgttaacttgaattgcagtgcagaattccatcgcagcagggcaacggaaacaaaaatgagtagcgtattccaggtcttggttgcatatctcacatattggagagttggcaaatgttctttttgaatagattttgcgttgttggtagcctttcttttgtggatttggatccgatggaccgtttgatgtaaattcaagggtctaaattatatgtagtactattcacacgcggagaaaactagaggtactgtaacaataatacaactgtagactgtagtatcagatctcaactatttgctgaaaaaaatggatggttgaaattacttgcagcaaagttagtactgcactgaatttcaattcatcttttccgatagccacgcaaagaattgctactctattaggaaggagttccgacaaataaagtgctagataggacatgtctgtattgagcttattttacccggcatatgttggtttgggggtgggggcgcactgatgtgccaggctgaagatgtcatgagataaactgcagaaactgtattttttgcccaatagatgtctgaagatgtggccaaataaactgccaatatctgaatatatcaatgttaagctcatttttggccgatagatatatgaagatgtggtcaaataactgcattttctgaatttgtacaaaaaaaaaagatatggtcaaatatttttttaacataaactgaatataaaaaaaggtggtggtgtgctggagcagtcgctcggtctaggagtgaaggcgacctccggggcaactccgtatagatttgtaatgtaagtctggtttttcacacaaggcctaccgaaggctcccacgaggggaaaaaacttatcatcaggcgcctgtgcctactccaccaaccgcggcgcatgccgctgcaaggccgtcactctcgagaattcacgatgtgtcctaactccaacccacacacccaccttgtcccccgaaaacttgggttacgacgccagcgctatctggctctgtgagaatccatggatgtagcggtgtatttgtgcccgccattctcaatgtcactaaacagtgcggtactaaacgaaatggaacggagaacacagcttggctagccagtagctgccgactccgagagtccgagtcggagactttcgaaatggcaaccctgtcgttcttgccttctcggactcgagatcttcaccgattcaaactcgaacgaacgagattatgccaaataaattcaacaccaacctgtgctcttgcctttcacagcgacacgaatcgatcgagcgcgcgaaaacagccgcatgcgtgatctttgcatgcggctagggcgaccgcatgcgaaaattcgattttcgcttgcgggcgcttaagccaacagcatgcaaaaataaaaaatcacgaaaaaaaataaaattccaaaagaaaaaaaaaaacctacccgccggcgcccgagctcaccaccgcgccggatccgccaagtggaagggcggcaggggcggcgccggcaccgccggccggatcaaccgctgcgtcgagggcggcggcacatggcacaactcgcagcgccgccgccgcccgctgccgtcgtcttcgccgcgcccgagctcgccgccgctgtccgccgtcgtcgtcgtcgccgcggtggagggcgccgcgccggatccgcgtgggaggagggcggctgaccccggatccactcgggggagggccgccgtgctctggccgccgccgccgccgccccccttctcggactcgagattcttcaccgattcga

SEQ ID NO: 60208 - DNA, 11825 bp, Oryza sativa
  unsure (1)..(11825): unsure at all n locations
aagcggctggaaggcttcactctggagtttgatttctaagcatgatgtgctctgctttcaattcacctgaagcattgaccccattcttctcactgttgacaaaaaactggaagtctcttagtagggtgggcttttgatctgggttgagcttttttgctgggttctgtttggctgagtccctagagtggctccctgtgtctttactttgtgctggctgctggcaattagggggttgtgtgttgacacccaacccaaattgaccaatgtaaactctatcaggatagttggtggtttccttttatgttttcccgaattctgtagctgcatttctgttaatggaaatgtgggaatggcccttgctctaaaaaaaattttctaggctaggctcctagtcatgccacattaaggtccaggtgagttggaaccccccatgtaataacgaaatgagctagggcaatttagtagtgttcaaaaaggtgctaagtgggtgacggggtaacatggtggtgtctagttcctagttagcaatagttggcctgaatggcaaccgtgctaggtggcaggttggcgtctagcaagattcaagtacagaagtggtgcaccctggctatgtttcagcatttatatttcctctagtggataaggagaggcggtgttttaaattttagtgggaagcaaagaccatcctaaattattactatttccattaggccgttgtatattattttggcgggaagcggagaatatcctaatctagaaatacatcaccactatttccgttacatattcttgtcggaacagatgacacactgtgcttactgtgtggttggatcaaatgaccaacttgtatgtacaaagtttgcacattagtagttggcaaactgccataccattacagctcaaacgacaaattgatacttggtagttgaacaaaactagaactttctgacatttaagcaccacattttgaaataccaagacaaattagacaaacaataagactattggtaaagaaatttgccatagcaactctggttctaagcagacagtccactatctacgacggttgtgcattcttaggatgggtagaatgatattcatgtcgattcctagaattccaatccacagaaaaagattagccgacattaccagacctactgacctagatatctagatttaaaaatttctaaccctattatcgcctaacaaatcaccacctgaacttaatcgaatcatacaaaaacgcaatccaatccatagaaacaaagggaacagaacaagcaaatcagtcatccataccgagatcaggaggaggggaaggcggtcgtggagcgcggtcgtggcgggtcctcctgtaccatggccgccgatggtgattccaattccccatcgccgggaggaagaggaggaacaccagactcaaaatgattcgccgatgctctctctcgctcttgacggcaatctcctccggcaaaccggaatgctatctcgccatggaactaggcgccgcccctgcaccgcgagattgggcgccgccgccgcaatttccaaacagtgagatgagctgaggcgacggcttgccggagaaagctatagctttaaatgaagccaaaagatgaagctgcttgcgtcgcactgactcgtgggcccccggcccatcgaaggctatacgtctcctcgcgggcgtgtggcttcttctccctttgacccaagcagcagcgtctcttctccctcttctccctccactcctccatgctctgcgtcgccatggccgcgcgccccgtcagtagcaccacctccacctgccgcccatgctcccggcgcaggtttctgcttccaagccctccacctcctcgtcccctggtacgggtgtgctcgtgggtgtccccgcgagcgcgggagctcggtttccaaggcagcgattcgtggagcgagattggaggccgcggcgaggtgctctctcgtccgccagcgccccatgctgctggcgaccgtggcgggtagagtgttagctgttgactgctcccttcatgtgttctatcgctggcaatctgtttgatgaaatgtctctgacgttagtgagtggtgtttcttggtctcagnnnnnnnnnnnnnnnnnnnnnnnnnnnnnnnnnnnacagaaattggggattctctggtgagggagcactatgtgccttcgaattttctgtccccttcttgctgatcacaaaagatttcgtgatgcctgtgtcaagttgtgattttaacatgtcaaattgtactactgcgtagaaacaattgtgaattgtagtcagcagtgtagttatctgtcataggaaagagcaatatcgtatattcctttttattacattgtgagggcatatagctaatacatgcataaaattttattgtgatcagctagggtcatctggacttgctttggctgaccttagcgttggagattggtttggaaatttgctatattcagcgggtcagcaagccaacgaagctgttcaggatcagctgtctgctcttagtttcactaggttagcttttcggcccctgcagtcaattgcctatagacagaatctgtttacttactttctttcattatattttatgtttctgtccatctcttttctgacatgtttctctattagcttggctgtaattttcggtgctggacttgtaactagtttgtctccttgtacactcagtgttctgccattgactctaggatatataggtaagtatagcgactaccttttgagatgctgtttttttgttgcccgggatcagttataattgatggcactgatctgatgacacattctttaaaatctttcaggtggcttttggctcgggcaaagatcgatctgaggtatattctgttatttataaaataacttatagaaattaaatagaacatgtatacccaaaacctcatagtatgtcataacatccattcaccatgtagaaaaaacaaacttcatccatgttattcttgatgtaaattgatatgtttccattctatatattaggttgttggaaattcagttgctttttcattaggactggcaacaaccttagccatccttggtgttgctgcttcttttgctggaaaggcctatgggcaggtaggacaaggacttccagtggctgcttcagggttagcagttatcatgggattgaaccttcttgaggtaaattcatgatccaatgtgaaaactcataaagcggagcatgccaattaatttttcaagctaacttgttgccacaattcaaatcaagtatcggttgatttgatggttttccttttataaatagttgtaaatcctttgctgcgatggtaatttatttcaatgaaatgtgtatcactcctgttatagtagatattagctcactgccttaaactgttctctatgctggttatcttgtatttacaggtaattgagctacaacttccctcatttttcagcgattatgaccctcgagctgctgcagctaacctcccttccagtaatgctttgacataattttctattttgtatcaaagtaccatatgcctcattatgtttatttcagttacggtaaatgatatcttgctgtttccctataggtgtacaagcataccttgccggacttacgtttgcattagcagcatcaccttgcagtacacctgttcttgctacccttctgggatatgttgccacttcaagagtatgcataacaggaacattcataagttacattaatattttattactttttcttaaatttcaaaacagtaaaactgtcataaattttaccatagtgtctttaattactaaagttagtgaatcacataccttatgatatgcagtaatgttgatttctttgtttctaatatatgttacacttgacttagcaatctgtcataattgttggcaagaagtttatgttcgcctaatttattaattttctgacatgctgattacgatacattttctgtcaggatccgattgttgggggaagtttgttattgacttatacaactggctatgttgcacctcttctcattgcagcttcttttgctggagcactgcaggtataaatgtcttctgatatacacatctgttaagtatagataagatagtgccatcaaatatggaactttaaatctcacttagacttgactaacagtttaacagcgcatatcctagaacaacaacacctgttcattttaagtttagtgcctgataaattatttgctttctgtagagtttgctttccttcaggagatattctgcatggataaacccaatcaggtatgtgccttagttctttctggatcttgagaggttcctggtttgtaatttgattgcaaaagacctgcacgttgcaattaattatctgtacgaatagtaataattttttgactaccttttacaaaggaaacactgaaaatccatatttgttaattgatagcattcgctacaatttcactgtcttggttcaaagagcttgaaatcacatttgtttggcatgcttttttgggagaatatagcacatcaaatttaccttatcatccatttaatattcttttgttaagatattgttctaaacttcttgccacaattctgtcatgtgctttgcacagttccaattcctcagaagcattcgtgttctttcttttttttaaaaaaaaaaagagaaagatctctaaaaaaatataagccattccttctttaaaaaatctgccttttatactttattttttttggattaacgccttgcgctaacatttgccatttgcttggtagtggtgcatttctactgggtggaggggtttataccctactggacaggctgtttcctgcaacatcaatggtgatgtagaatgcatatcatagtcggacaagagctgcagtacgaggatcgccattgttgaacatgcgaattatgtcagagttgaaatgtaaagtaggtaatgataaaatgctaacgaactatcatcagctcttcgtagcttacataggtatatatgatatcttagtctcagcaatctgtatagaacgagataagttgatgtttaccccctacacccacccacaaatgttatttagcttccgttgcttttaaagaatacgtggaattttgtagacagaggcaagagcagaacagagaaatatatatatgcccttctacttcaattcacaggctgcacaagtcgatgctaaacacgatgaccaaaattgctacggataattcatttcggtggatgcattaatgctcttggaatgtaacgaattctttagagacctcacaaagtcacaaactcaatacatttctgctaagacaataacaggcactaaggatacttcatcaaaactgtaaccctcgtttggttgtattgcgctccaatcatttcattcatccactccatactcttttttttagataatgatccactccatactcttagagcattacaaattcgttctattatttacagccacattcagaacagtgcgattaacaaagagacagaggtgcctggttgaaaatggataagattttacttgctcattgccctgtcctatttgtcgctcttgctcttgctcatacccaagaactttgtagtaagtgctaagatttcaccgtcaaaattataattaggaactgtaaacttctatatagtgagtgaaacatattatttccctacacatatattcccaggccaacttcctttggatcagtctctatcatccaggaaggcctgtcaatcaaaatttacggtattgtgtcagctagcatactcagtattgattattagcttactaatgggtgttgaaattgagcagagaggacatcacttgttcatcacgaagatcgttgttccttgagacgcccgctcaagaagcaccttccttgattcaattgctactccctctggctgcattatgaataaaagtggtgattttagaaaattaaaacaatatattgtgtcgactagtgtgttattttgtcctcccattagtgcaccactaacctcctctggaaaccagacgccaggctgtgtgctgccctcaagaactgctaaaacaaacgctgctgttgcatagcccaccgatctgaaaatccaataaaaattaatgctaagatgcaatgcagatagttgtaccaaatgattttgtttgttcttaaaatttaaaactgcaaagtaaatcggaacttctcaaaacaaccatgtagtaagatcgctccaagttttgagtatgaattcctaggatttagggtgttagcattacaaaaatgctgcatcattcaaatgttaaggaataatcactctgggaagtagataccctgttagcttttaaatgaggacaggtttacatggttttctcaggaatccctttttgaataaaaggaaactcttatacatagcatgtaagtttttgaaactggggtctcatttagagagcacctatgtgaagcttcctgcgatctagggcaaaaaatgtgatagttattttttaaaataagtcttgatatttgatgactaatatggtaaatatcaattaggtaatggaccttgagaatgctcaactgcttgtgcagaagtgtctacttacacagatagttttctatgagaaaataatccaatagtattctttccatttgaacaatctaagtctacctgcatataaatgaaataaatttgatcaaaaggtagtgatcagtagctacatatacaactttggacaaagtttgagtataattaatttactcttactccaggtatggcttgaggaaaatactagaagtagtatgcttttaggctgctaacctggaccaaggaaacaaatcttggccagtaactagtaaaaacaatagtctcagtggaccaatattttgtggaaatcgatggctatattgagagttacatggtccatacttcgctccctttttgaagaagtgataaaatcaaatcttataattgatcaaatcaaagtttagaaagtaaattattttaaaaaactgaagaaaaattggctgaacaaatattttaaaactggcattcaaatacctgttctggccacagcttgaaagagtatgcagttaactctggaaatagcttgaagccttggaaggaactagtacttctaaaacacacaggcaaaaattttctatacaaaagttgctttaaaaaatcatattaatccattttttcaaaaaaagtaaataattaattttgcgtgtgcatgaggtgagttcccaacctcacctcgagaacacagctttaggtacttactctcatggaaacacgctctccagcaataccatcgatagctcggacaaaaggatcaacaaatccaaccaattttagaaccttatttttatccctcaagaattcctgaacacgaacaagttgcagtcaggtgtaatccgcattagcaccaaatcaccagtttaatattatcccatttttaagatttcagcagaaaacaagcaaaccatgttgctttaacagtaataatagtattagttgatttcaccaactacataattaaataataaaataaaatgtaagcaattggttgcttaaaaattaaaacttctatttttttagtagagtttactagtactagaatactaatagcaccggttgtgtctgaaagaagtaacttgatagtgcataatttgagaagtaagacatacaacaggtaaaaagtttgcgaaggcctgcattacccaattccagaaaaaaggagcagtaccgaagcgagcactgacagtaggcacacctaaaaccttataagcactcttcacctcaggcaaattcctggaattagtggcataatataaaatttattagcttccattttgaattctaaccaaagtggtttttccttattgtggtaagatctcaaaaagtaattaatgttcagtgcctacagtaagtaaacatctttcttcctaacccctttgccaaaatcaatgctgagagctccactgtagggcttcaattttatttcttctcctgaatttgtaatgagaacaaaacttagattttcctcatagagaaatcctataagtgcactaataaattattgaaaagtacctttgttatatgcgattacatcctccgcaagaagcagaaaactagttgttaatattgttggcccagcaccaccagtgcctgcagtataataaaagaatctagaaaaaggatttagcaacatactagcatagattctgatgaatacgacaacgctttccatacttcatgactagtttgacctttaatttttccaggaaataaataactcctaaccttaatctttcaggttcaccagcattttcacttctagcagcatgaacaagctcagcagccatcactgttccaaaagaagaaaacagtgtatttctaagcactcaaaaaattaagatatgaagcttacctagctagatcaaaacattgtcttcatagtttactgctagatcatgtctctaactctctattatgtatttgatatcttcaatcttcatattaatacatgacactaatcaagttggtgattttacacatatgtaaactgcctcaaagagcaatggatactatccatgagtactgatggaaattgtgaaagagcacatgatgatatctggacagtgtaacttgaaaaatatcaaagtaaactgatatgtttgatagaaatgcgaagtaagaccattgctcactccaggatagatgccggcagttgtaatagctgggataccgcaatcttttgcttgttcatggaaaccctttgctctccacgaatagtctgtatcatcacaaacatcaatatatgccgtctgtaaaaaaaaaaaagttaaggatgtcactaatttcaacgtgttattaaacttatgcatttgatgatcaggcgttgcacatttctaaccttggtcgctattgctgcctgtaggacagtgcactcattctccctttggaaaggtccagcagcatgaacaactaaatccacatctggggcaaaaaaagaaaaactagaatggtcaaacatcagaagaagtttgtggatgacttttcaaaatatttgcaacaatcttttgaaatcatacggccggtgttccaacttaaaagcacaacataagcaggtagttccattactaaccctgtagcacttcctccagcatgttcctgtcgcgaatatctacttggacaaactctgattcatccccgagtttagatgccaaagattcacctttctccctgaccaaaaaaaaaggatactcgacaaatggtcatgctactataatcgtctcattgtacagatggaactgcacaatattgcaggcatccagccaggatgctattgacagaagaaagaaattgttcccactattgaagtgaactacaaaatggctacttggctaggtgtggtttgcattcgttcaaaagtaagaaattgcaacacaagtgaagtaaattcattctgcagattaaaacagacgaggaaattgagtaacagactagtgcggaggaggcatagcatatagggggcaccaacaggttcctgccggcgatgaggatgttgaggtcggggcggagcttggagagcgcggtggcggtggacccgccgacgcggccggtgccgccgagcacgagcacgcgcgcgctggaggaggaggacctcctctgcgcctgcgcgtccgtggagggagcggcggatgaggaggcgacggcggcaggtggcagcggcatgcatgccctcaccacggtggccattggctctttgctcgctccgctccgctccggcgacatagccgagtggtgtcagtgctctgtgctgtcagggatggcgcaaggcaaggaggtgcttgtttggttgggtacgtggaagccggtgggccgttggttcggtcgcctatcggattatccatccatctaaccgctgtttcctccctcccttcatatcgcttacgatgggctgaattagctctatcttgggcctcagtatgaactatgggaaggtgagatggcaccagggtttcccaaaccgccgaggtcggggttaccgcgccccggcggtaaccgtgaaaaaccgtataaaaccgcgcaaaatttattaaaaattcaaactatttttaaaatttatttgaatttaaggaggttaccgcggtatttatattaccgtgcccccgcggtaagcccggtaacttttaataatcagtggtagtttgaaactagtccttattgctaaatcctctcgaggtaaactaccaataatctcacaaataagcatcttttattttattttgaaaagatgggaaatcacaaactgagtacgcagtctggctacaatctttggattaaggataggaaataaagtaaaggtcaagtatttaggtattgccgtattgcaagacctaccaaggccatatgtgtttcgggaccgtggcctaagaaatttgaggatatgccatctgatttgtgtgcctttgaattcttgccacccaatctgtgtgtctttgcaaaagtgtcactggaggtgcgaaacttttggtttcgtgccacttttgcctagggatgaaaacggtcggaaacgatcggaaaacagcctcaaccatttccgtaaccatatttttctcggaaacgaaatcggaaacggtaaagtcggaaacgaaaacgatatcggaaatatcggaaaaccggaaacggaacaatacgaacggaaacatgtcggtacagatcggaaaccggtaacaaatacggaaacattaaactataaaaacatatatttaactttacataagtatgttatatatatatacataaattcaagcttatactatataaattataaattaacttcattttagccatgtacaaaagttagagattttattgaagagtcattcaatctataagctgtgggtcaagtatagacatgtcctataatatcgacatatttagaatacggtaattaccatattataagaaacggtaatttccgcgagaatacagtaaatacggaaacgatcggtataacagcaaaaccatttccgttttcatttccatattttttaccatttccatttttgtttcggtcgattaccatttccatatggctcggccggtagaaagtcgaaaacgaacgccggtcggccggtaattaccgttaccgttttcacccctacttttgccgaagaagggtaggaggcagtgcgcgggcggtgtctcttggcggtgatgccgcgacggcaacgataatacgacagtcagctactgtaacgccccgatttttgatcggaattaaaaatcattaaataatacattttctatgaattaaataaaagttaaatcaatttaatcaagtgaactaatgggagaattaaaatttccttttaaaaatcattggccggaaatattttgtaatattctttgtgccctaattcactctccggatttttccgtaaattttcggagctcaagaaataattttaatgccacaaagttcgctaaatcaatttaaagaaaaagaaaaacaaattaaatccctttcctccctttttgggctcggcccaactccctccctcctccttcccggctaggccggcctccctttcccctccctcggcccgctcggcctccctcctatcctccctcgcaaaaagtctgttttgcgtcccttcctctctcccttcgccgacaggtgggaccggcggccccacctgtcatccccttcctccggctccaaccgctgccatggccgcccgagcctccccacgacgccgccgtttccgcactccttctccaccccgcgcgcgagtccgccggccgtgggaccccgccg

SEQ ID NO: 60209 - DNA, 9774 bp, Oryza sativa
gccgccgcgctgccggagctcgcgctcgcgcccgcggagaaggcggcggacgcgatcaccatcgccgccggcgaggtcgacaagaagccgtacgcccacgacaacggcgtcgtggcgagatcgagagaagcccagaacggcgggaagccgccgtcgacgccatcggacgggcaggccgtcccgccgccgccacagccccaccggaaggcgcgccgttgctggtcgccggagctgcaccgccgcttcgtcaatgctcttcagatcctcggcggcgcccaaggtacagtacacctacacatgtaactcgatcaagatcgaacaccatgattacatgccgtaccaaagatgaaaagacaacaaacaaattaatcttgagcttgcgtttttgttttgttctttgcaaattaaagtggcgaccccgaagcagattcgcgagctgatgaaggttgatggattgaccaatgatgaggtgaaaagccatctccaggtagggtaattatcatctcatcatgcaattcatccatctcacgtacgttcttaattaaatactgtttaaattgatcattgactacaagacagtatgattaactgattgctagacatgaatgccataatgagcattttgatctgaatttttttttgtttgggcagaagtacaggttgcacacaagacggccgatgccgtcgccggcgccgccgacggcagcgacgccgcagctggtggtgctgggaggcatctgggtgccgccggagtacgcgacgcaggcggcggggccggccatctacggcgcgcacccggcgacgcagccgcactacacggcggcggtggcggcgcaggagtactaccaccaccaccaccaccacctgcagcaccaccccgccgccgccgccctggtgcaccaccgcgccgtagccccgcccccgccgctgccgcctcagcagcagctggcccctccctacagcgccaagtcgtcggcgtcggcgaggctcgggtccccggactccgacggccgtggcagcggcggcggcggcggcgccgccgcctccggagccggaagggacatgtccgagagcatcgaggaggaaggcgagggcgaggagcgggaggacgacgacgacgacgacgagatggcggcgaccaacaacgcccacgccgtcgacggcgacgacgacaacgacgagatcaacaccaccaccaccacgagcgcgggagcgattaactactaattaatcaaccaaaccaaccaatcaaatcaccacgcgtcgtaattaattactcattagtaataatactagctagtagcttaattaatcgcgctaatccgggagattaattagcgtcacctggaaaaagggaaaagtgattttttgttggcgcgcgcgcgcggagaacgggagccgagccgagccgagccgaccagagaaggagcaggagcttgagcttgtctcactcgttgatgtgatgcatatgtatggaactatggatcgatggataatgtgagggctttactttgcttttgcttttgctggtttttttttctccctcttgtttttcttccttttttgggactctcagctgttcctgatttaataatccggtagtactagtagtaaatatcaaaattatgtgatggtggagagattaaatatgagctagatgtaattgtttgggagattatgtttgttgttgttgttaagttgagaattgtgaagagccaccaataatgcataatgcagggtttgcttctgcaattaatgtgattatatgtgaatggttctaattaatagtagttgttatgttttggtatgcacaaatatagcatatgacattaaattttccaatgggataatgatatgcttggtggtaccaaggctgtgttcagaacctttgttccaacttctcttctcgtttttcgcgcccacgtttttctaaactgttaataggtgtattttttcaaaaaatttctatacgaaattgcttaaaaaatcatattaatcatttttttaaaaaaaatagtaaatacttaattaatcatgcgctaatggaccgttccgtttttcgtgtgcacagcttgtgctgggaacatagggttctgaacgcagcctaagtactccatccggcaaagattacttgatatttccgacagctaaaatccattaagcgcaagttattttgtttgtccgaaacgtcatatagtattatcgtccagggaatatattgcagctttaccgctgtagaagcaatcctgacactttgaaaagcaacagccgcatcgattttcaggaatttttgcgatggctattcagattcttgatgttttataaaagtctactggtcaaagttaatttagttctttattaattcttcgcataaataacacccttttcaccatattttgactataggagaatatttttggagacaaacatatcaactcggttgactcttttatttgcaagaactttgattattacacttttaaaaatgaactttgatgattacgcagtattacagcggttttagcctgcaatcaactgcaggcccatgaatacagttttagctatactagtgatggaccattatgggccaggccgtatttaacagccgtctcagaaaaggaataagtttatcatgacttcctcactctcgctcctgattgaattgcttccctcaaccgtaaaaccaggtataatacatctaccatcttcgaaaaccggttcaaattgacttctttgttggttttagaaacggtttctactgacgtggtatgttggcagcatcaacaggtagagcccacgtgtcagggctctcctttattcccctccttctctccctacagtgggagactgctttgtccccaccctcttctcttcctgcattgggagactactttgtcgccatggcccaggtcaacgaggcactcgaggaccaggcgcaggtggtggccttgtcggcgtgtacgacggccataatagccccaaggcggtgtagttgatcaacaagaggctctcctcccacatcgaaggaatcatccaagcgactatggtggcgagccaaacctagaaaggtgcagtgatggtgacgaggtaggagatgagaagagggtggcgacgcaagggttccaattgcatcctccaacatgtctcgtctctgctaccgtctatgacgagagagggtaccaccttcctcggctcgtcagtccgacttgccaccaccaaagccctctccggagtccagttcgccaccaccaccgtcctcttgctgttgaaaggtcggagaggaagaaaaggggagaaaggtgggttagcaaatgaggtaagttattgacatgtgggtcccaagcgctcaatcaacgagtcatccgtggtcaacctaccgtgctaggtgaaattgcttcccaaactattaaatgagtcgatttgcactaattttttttaagtcggagaagacattatacccgttgttacaattgagggagacgattcaataagaatcaagaaatgagagagagaatataatttatttcccaagaaaaacacatgcatatactactatttctgggccgaaacgagttgagcatgatgccctcatcccacctgtccgatcaaataacaacgctttatattcggcaccgaaagattgagaggaaaactaacatttttcgcgggtacgtttttcaaatgatttaacagtacgtttttattaaaaaattaaaaaactatattaatatatcttttaaaatttgaatacgctaactactcatcatttacgatcttctcacatcctctcctctcaaacaaactagattcgtcgctgcaacccaacggtctccgtactccggcgagccgccgtcccgctccagacgcggcgcggccgtctcctccggcgccggccaagatcgaggtggatagcaacactgcaacacacataactctagaagtaattaaatatctctctccacggccacgtgcggccatgtgacggcgcgacgtccctctcgtggcctcagccgccctgacatggcacgggcttccccgtgcggcgagcggccggccggccgcgatgcccgccgcggcggccgcgcgcgccacctgcgtcgcttcgtcaactcccccatcctcacctcgctgtaaccctcacagttgcgagataatctccgaaatgccactgctcgtttgtaccgagacgatcctctcacagtggcaatcctgtgataagtcactctgatcaggggcattctcggtgatcaagggtgtaaccctctgtttctgggtcacttcgtcgcaaagtcaacccccaatactatactagaacccttgattgattcgatgatgcagaaggggaattaaggtgtggaaaaagataatgcgggggaagcatccatccatcagtgttgttcagtggtggtagattagattccagctgatccaatctggtccgggaattttttctagatctgacaccacattctggtcaaattcagagatccatgctgctctagtctgtactagagccgtccttggtgaacagttcttcgacactcacctcactctcatcgaggtctcccagcttgaggagcactgaagaaatttctatgttgaggtcagtgatctgatcatctgatcatgcaagctgaacaggattagttagatatgctgcagaaattttattagattttttgcattcttctgcaagtgttactgcatagttgtgttcatccaagttgatactgatctgatcatgcaagctgaaaaggattagttttactgcattgttgtgttcatccaagttgccaagaagtgtgaagattttgatgtcaatcactcacttggtcaaatttgatccaaagcagcgttgctaaattcatctgagttcagattgcgagtttgtgacattgggtttggttttgcgcagcaatggtgtcaagaagtctgcagcttgtcggcgcgttgctgctgccgctgctcgccgtcgtgtcgtcgtttgatccgttccaccgtgatgcgaaccccatgggcggcggcgccgggcagggccccttcatcccccacgagtacgtccgcttcgccgacgtgaagcggcagtgcaagtccgtgctctcctccgcggcggagctcacgttcgacgccaaccgcgccaacggcctcatgccggagctgtccttcgtcaagggtgactggaagcacgacggcgacggcgacggcggcggcggcgcgccgctgctgccattcgacggcaccgacgtggcggaggacgccgccgccggggcggcgcgcgacccgctgccgctcgcgtcgttctcgctcacgcacgtcgacgcggcgcggcgcgggaggacggcgctgaacgtgagcggcgtgctcggcgtcgccatctcccgcaacggcaccgggccggagatggggccgtacgtgtcgccggagttcaaggtgtggcccgggaacaccgagctgaaggtgctgctcgagggggtgtacaccgagaacgacgacggcgagagcgtgctgtgcatggtcggcgacgccgtcctgccggcgcgcggcggcgacgccgccaacccgtggggctgggccaagcactccgaccgcgacaggttccagccgccgatcaccaaggacggcaacatcctcctcgtgctccgctaccccaagacgctgacgctgacgacgcgcgccgtccacggcgagctcacgagcaccaatggcaagacccacgccgcctacttcgacgccgtgcacctgctgtcgcagctcggcgcctactccaactaccagttcggctccgaggagctcgtcggcacggcgtgcaagccccacccgtaccgcgacgacgtcctcgccggcggcggcggggacagggggctgtacaagggcacctccttctgcggcatcctcgacaggttcacgtcggaggacgtgctcgccgtcgtgccgaactggaggtgcaacacgacggacgacgcgctctgccggcggctggggccgttcgagacggacaaggcggtggacgccaccgacggcgggttcgccggcgtcaggatcgtgatgcaggaggtccggtgcgagccgaggaccgacggcggcgagatctcggcgagggtgtcggcggtgttccgcgccgtcccgccgtgggagcacgcgtacacggcggcgaagcgcagcgggctcggcggcgcgacgatgtccgccgagggcgtgtggcgcgcgtcctccggccagctctgcatggtggcgtgcctcggcgtcggcgccaaggcgtgccactcccgcgtgtgcctctacctgcagaccaccttctccgccactcgccgcagcatcacggtgggccagatcaccagcatcggcggcggtgccgcccacttcccgccgctgacgttccagcggacggtgcacccgatggagctgtggagccggttcggcgtcaccggcggcgagccgctgagcttggcgtacagctacaccaagaccaagcaggccggcgagttcctccggcgaagcgagccgttcgacttcggcaccgtcatcgccaagtcgctgctgagctacccgaggaaatccggcgacgccgccgacgagacgacgagcctctccaacctcgccgaggagctcacgctccacgtcgccgccgtgccggatccgttcccacgcggacgattcgagcggccattccttcagcttgaggtgctctcgctcggatcgctcgtcggccgggcctcgccggcgacgtttccggggacgccagctgcggtagggcaaagcatggcatcatcatcgtcgtcgacgacgacgaagctggatgcgacggctatcctcaacgtgtcggcggagctgacgatctccggcgacgcgtacgtgaacgtgtcgacgctgtccttggaaggcgtgtacaacccggtggatggccggatgtacctcatcggctgccggagaatccaggcgccgtggcgagccttctcggcgatgggcggcgtcgaggaaggcatggactgctcgatcgaggtgagggtggagtacccgccgacgacggcgcggtggctgatcaacccgacggcgaaggtgcacatcgcgagcacgcgcggcggcggcgacgacccgctgcggttcaacgcgacggcgctccagacgctgccgatcctgtaccgggaacagcggcaggacatcctgtcgcggcggagcgtggaggggatcctccgcgtcgtgacgctggcggcggcgatcgccgccgagttcagccagctcatgtacatcaagtcccacaccgacgtgatgccgtacgtgtcggtggtgatgctgggcgtccaggcagtcggctacagcgtgccgctcatcaccggcgcggaggcgctgttcgcgcgcatcgccgcgtcgagcggcgacggcggcgcgacgccgccgccgtcgtacgaggtggacaagagccagctctactggaccatcgactgcgtcgtcaagatcctcatcctcgccgcgttcctcctcacgctccggctggtgcagaaggtgtggcgctcccgcatccgcctcctcacccgctcgccgctggagccagggcgcgtgcccagcgacaagaaggtcctcgtctacacctccggcgcgcacctcgtcggcttcgcggtggtcctcgcggcgcactacgtgagcgtgctggcgcggccggtgaggtcggaggcgtcgtacatggacgcgcgcggcgaggcgcacgcgctccgggagtgggcggtgacgctggaggagtacatcgggctcgcccaggacatgttcctgctgccgcaggtgatcgggaacgtggtgtggcggatcaactgccggccgctgaagacggggtactacgccggcttgacggcggtgaggctgctgccgcacgtgtacgactacgtgagggcgccggcgatcaacccctacttcgcggaggagtacgagttcgtgaacaccagcctcgacttctactccaggtccggcgacgtcgccatcccgctcgccgccgtcgcgctcgccgcggcggtgtacgtgcagcagcggtggaactacaagatcatcagcaagacggtgaagacgcagcagaagaagctgcagcacctcgggtcgcgggtgtacgagcgactgccgtccatgtcgtcggccaacttcgaggccgagctcgtcgccggcgtcaacgagggcgtcggccatggcctccgccgcgacgccagcttgagctagctagctacactgctacacctcatcgatcaatcgcctctcttaattactcagtagtcttctcttgttgctttcttaggtttttatgatgttcttcttcttcttcttcttcttcttcttcttcttcttcttcttctttatttcttcttaattagatcttcagattcttcttatgatatccaaatgtactctactacaagttcaataaagttttagtttcttatagctctttgttcacatttctgcacttcttgtgtgtgtgttcagcttatgtgacacaaagtgttcgtgctgacaaattactttccgatattgcgtgctcttggtgaacacattccaagtttccaataggtaactagacaatgatattatttgattattatagattgtcaacgatgctaagatgattaattagcagtcttcttgtttgacaattctgtcaagcaagcttgcttgctagttagttaattactacactgatttgtgcttaacttctgccaagtgaataactgaatataatgcacctagttgttggttggtgtttaaacaaattaagcattctacctacatgtaggtgaatgagagtgtcagctcgagtgatatctcttgctcctgctcctgatgctggatagccactgctgcctctgttgctccactgtaggaggacacctgcagctgatcggagctgccgcctccgccggcgccggcgccggctaaacgctgaaaacaatttcaagaagagaaacaaatgaagaaaattacagtgaccagttatgttgcttttttaaaagacaaaaacactttttactatcataactagtactagaacaatgtgatcttgacattttattattattccttttgctgttgctgttgttcagttcgatacagatagcatgcagtacagaccagcacactgtcatgcatagcactgaaaaggaccatagcagaaaacagagtttttcttttcttggcaattaacaacagagttactaaaagcccatctttttgcttatacttacacttatcaaccaaaatttaaattttcaactttatgattttggagtttttttttcatcgaaatttattttttattatttacttttcactaagaacacgtatataaaagttttattcacaaattattttttatttgcaaatataacgtcaaacgatgggggccttaggtcaagagataaaagaaaatgatgaggaaataaaccaaattggtgtgccaaattcaagaactaaacacaaaatatatgttcttgtgtccaaaatgaatgcaaaagagaagacaagagatcgatgaactcaaattaacacacacgctctgacctcgtcgtggcggcgcgagacgttgccgtcgtcgtcgacgaggtagccggcctcggcgcagagcgcccggaggacgtcgttctggtcggcgtgcttgggcagcgcgtacccggcgccggcgcgcaggccggcgtagatcctcgtcgccacctgccgccgccgccgctcccgctgccggttgttctcccgctcccgcgccgtcgggtgccgcagcgacgtcgtcaccccgccgtcacgccg

SEQ ID NO: 60210 - DNA, 17071 bp, Oryza sativa
actaaagatatctttagtcccggttgttctcaacaaccgggagtaaagatccgggggtatatatattctcggtgcgccctcgtcttcttcaccaacacttagacgttttcggccgatcgatctctctcggcctctctccttcgccgccactgcctagggcaaatccccgcgccgacgccgccgtatctcgccgtcgtctcgagctcgtcgtcctcgccgcctcctccgctgccgccgcatctctggggtgagagccgccgccgccagatctcccttcatgcatctcgatctctccgatctcgatctctctccgtcgcgccgcccgccacgagacgccgcgccacgacgatgacgcgccacgacgacgacgcgccacgccgccgccttcgccgccgcgcaacgccgccgccgcatgccaacgccacgccgccgccgccgtcgccacgccgccgccgccttcgccgccgcgcgcgcaatgccgccgccgccacgccacgctgccgccgccacggccccgcaacgccacgccgccgccgccgtcgccacgccgccgccacgccgccgcgccaaccgccgccccgatgccgccacaccgccgttaacgaacgagaacgagaacgatcgaacgaacgagagcgagaacgaacacgtcaacgtacgttgccgcgagaatgtgaacgagaacgagaacgatcgaacgaacgagagcgagaacgagaacgatcgaacgaagacaagcgagaacgagggaacgaacgtgaacgagcgaacgaacgaggacgaacgttaacgtgaaatgcaatatatatatatatatatatatatatatatatatatatatatatatatatatatatgttactttgcatttatcctaatacatctttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaattggtgcgacaagtagcaattgactattgtagtcttaattagacttagcatatacgcacgaaacacttagcatatacatgactattttagtcttagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgtagcgaacaagcttgagggtcggcacatcataacggaagtggaagaagatggacatcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtacaagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacgatggaacgctcaacccagctgatggctcactggtcttcggcgatcagatacgagaggctgcgcgacgactaacagatgcagtggaagcctcctctcagggcacgttccgaccagacagagatagggacgagctgacactcgccctgcagactccagagcatccaggacgaacacgagggaaatgggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactcgaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcctcaggatcctgcaccgactcctcctcgtgctcctacacctactcccccgcaagctcctcttccggcaccttcaaagtcaggggccccccagctccaccgcctgcccacacaagggcaacgaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaactaattaggtcattgtatataagtagactatagaaaataatatactcccttttatcgttgtagaatggagattcaaagggcccgacggcggagggttttcgatactggattcatcgaccctcggaaagtaaacgtcgcaatgctcgaccaatatccaaaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcttcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgatcaacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttggtcatatatatatctatatacatatgcatttgcataacatatatatgtataaatacatatatattatgcatgtatatacatataatataatataatatatatatatatacatatatatatatgtatgcatatatatgtattgaaacatatatatgcatggtttaaccgggagtaccaatatccatgcaaaaaaaaaaaaggtcagctcgatctttagtcccagttatttcacccgggactaaagatagcgatctttagtcccggattggtactcccggtttggaaaccgggactaaagggggttacgaaccgggactacaaagggtttctccaccagtgtcctctgggtcgaaatccacgaagtaaacttcccagctatcgtcgtcgtcggcggcggcggtggcggcgccgttgctgggacggcgcggcttctcgtagttgaaggggacgaagccgcccttgccggtgtcttcgtcggcggggaaggctagcccgtagtacggccggcccttcctgtcgatgatgctgtcggtgaaggaaagcagcgcgcagatcgcgcagcagaaggcgatgaggccgccggagatgtagcggttgatggccaggcacctgccgtggttggtgaaggacggcgccagcgcctggaacgccagcgtggtgcccgtggggaggagcttcaccaggttggccgtcgtcgacagcgtcttgtcgacgtagtcgctgttgttcttcttgccaccgccatcggcatcggcatcggcgccgggcgcctgagccggcttcttcttcttgtcatcgtttgtcgggttagtggtggtcgacgacgcaccttttgagccctgggcgccgttcgtgcccatgaattttggccgtgcgcgctgctagagagaattgacagggatcgaggtgttggtgtgttgtgcagtcacaagaacgtgcgaccgcttcgtttctgcatggttgcatgtatatggtacaccccgcatttataggcagccacccaccggggggcagtgaaccagatgccaaaagcgggaaaggccaaagtgacatcgtgcgcatatatgtgcctaattggcccctggcaaacattctacttcaagtagcttgtctacagggtaatggcatcgatggtaagcatatatccgccacacgatatattgatcatcttttcatcatatgctttgcttgcttaattagccctagaaattgcatacctgctttagttcgaccttggatctcattgtacaggaacataccacgcgagctccataaagtgtgcttgcacatatctggcatatattatgaatatataataataacagctagccacgtacgcatgtgtttagtacaatatatcatctctggaaaaggtggatttgctatttccgtcaaaatctcacatctataaatcaaaagaattactccatccgttctaaaatataagcatttatgactaacacgatcttcgagatactattttgaccaacaatatctataaaagtaaaatatttcaaataagaagagttgcatattacgatattttgtttaataagaaatctagtaacatcaattttacatggttgatctttttttattttttttctattaatagtcaaagttaaaaatgtttgacttgtcattatgctaaaaatgcatatattttaggacggagagagtagtatatatattcttgcgagcaattttatagtacttgaggaggtaccactttttctattgtaatttggtaccttttggtatctaggtactaggaggtaccaaattttaccctaaatttttggtagcttatggtacctccacagggaatgtaaaattactatggttcgtaaaatccatctatgatatggtattttacacagtaatcgtgatctctatcaaaactacagacactaagaagggaatctctcccttgtgcccgaaacacatggtaattaaatagtgaaaaacactcggtaattgtcactaccacatatcctcacatctattatctatgatgggcttaagtgcgccgctacatatcacgtgtctataacgagtgacattcaagccattagggattagcactgatctataacgactccagttatatggagttgttacatatgtcatctaccaactttgtaacagtttaagttgaggagccgttacaaacgagcccctcatgattgtaatggctttccattatgagccattagaaatggttgcacctcatctgtaatagctcctgtaggagccgttacagatgtatctcctatccgtaatggttccacacattaggagtagttctagatgacttttaggccggtctagctaaccccaacttaaataaaagaaaaacctggccagcccctcccttgcctcacttctccttttcccctccctccatccccatctccgtcaccgacaccaccccccctccccccagcactctcctcccgaacgacagcagccagtcatcgtgttggcgggcctctccttcctctcctcttcctattttgaaacaggcctaccgtactactacctcatgaactctctctctctctctctctctctccacattgaaaggaagcaagtaaaggcaatggtgatgaccggcaacgactgcagctccccgtagctcaggatggtggatctaccagcgaaagatcctaacgacggtggtgggctagcctcggtaccatcagagttgacggtggtaggcctcgggaccgcaagatctggcagtagcaggcagctttggtgagcctcagcaagtggaggactcggcggcgatgatgaaggggagggtgacgacgacgtcgaccacaccgccacagggatccagcgctggtgagtctccttcatcatcaccaccaagtccataccagtgctggtgaagcgcctcccccagttgctcgaccaccgtggcggctcgggcgtggtaactcagacgacgacgatgtaagttcaagtgcaattggattagttttggtgactaatgccaaatccaattatatgatactattatcttttatatataaacatttattttgcatagtctcaattaatatgaaaaataaaaatgatgagaggtacgtgttaaattcctcgtgttctaaattatctctctaatggttcccaaatagggtgaggaactctaaatattttatattggattgtcatccatcaccaaaaaggaaatgatcatattttatattggattgtcatccaacaccaaaacggaaatgatcaaaagatctatggtcaataatgtgtaaatgttgttctggtgatttatgacaaaccaggttactgtgacttacttttttccatgagttggcaaataggttgttctcggatgtcatatgagttgggatagaaatgtatccattgatggttgactttaatctcaataaggatgaaacacatcgaaatcaagctatactctctttacacatgctttcttttcttgtataggataaactcccatggattcatcaaaaattatgcatacacctatttcactcgaaatattttgtatgcatatattttgggggaagtatatcttatattttattatgcatgtgtgtgatccaagttaatcaattttatttaattgagatctttacatttgtgtatatgtgtgagtatatgacatttgtggtgttgttgattttcatcaatttattcatatcattttatatgcgatcggttggtcaacaagtggaggttgactaccagatcattgggactaacagttttattgagttgaatgaaagaaatagataccaagaaatgaaaataatgttgatgctcaagtgagatcaagtcactgttggtatttcttaacgacgttactagaaatataattcccagcaatggcgcagaaatacttctggtatattatggttacagagttcatccgcaagcacacgaatataccattatagcatttcacccgagagtattccaagggtatcgtatttattttatcacgtggaaagatcatgtagagagaactcaactaataatttatatattacttgtgataatcatattctaagcaggggttatgataatccaagggtagagtgacacacaagcttttctacttatcctcataataaataatctaagctaggtggaaagaaaagagaaagagaatctattcctatacttctaatatacatagtatacatacattctagttaactgatatactagctaataccatttatccgatgccttcctggtacttcgagaagccacccctgactgtcgagttctttacgacagcccgtcatgaccatccaaccggggctaaatacagaggaataccctccccaggaaattaactaaggattatatataggcacggaggaatactcgtactgagctgtcaccatcagcggcccacctctcatccgcaatatataaccccaaataatgatatcccgtaatctagacaccacgtctaaattaccagatactactctaatatcatcgtcatgatatagaataattgcataagcaaacactatacctgcaccaaagcatatcccagataagctagcagtatattcagtataacatgaacataatataaagaaggtactcatatactcggaaaatatttcaataccagaaatgtatctagaagagtattctaatgaaagtacaaagcttacaaaagaggaaaggaaagctactagagccatacccgaactcttccgaaggcttccagactcctgattcctattctaattctattccaccagctagatactactaaactaaacttgagaggaatgagagagctcttgcttgaggtgtgtgagtgaagtgaggagaggagctccttaaataggctgccaatgacggttgtggtagttggaatggtcggaattgccctccaaccgttattggggagtgatccatgccgtccagccaaaacctggatccaacagcgtcaagggaggttcggcccaacctcccctgataatatctaacatatttatgtattgcaagcatcactagttctcctttattttgataatattgatggtcgaaactgatcgataatgaccatcaacagtcacgtatgtctcaagatgaagagctgaaacatgggaatcatgtgttgatccacatcaacagtgattgatatcgtcataagttgaaaggcatcaagtggctggaagaaatgaatgtgaccaaacatcataataaatgaatgtgactaaacagagtggtatgcgttgtccagctaagtccacaagaagaagcacaaggcaaaggtataatgaaactaagcatcctttttcaaatcctttaccggtctcggtgtttttaattaaaatctggattgagtataggaatgttgtactggtaagatgaatacaaatgtgtttgcttaagttctcaaaatgatttatctttggacaattgtttatgatggatttgatagccctataaccaacctttacatggaatccaagatcatcaaaatcaaactctggagtaaaaagttcttatatttttatcttagcaacatcacactatccgacctctatcggactgtctaatccatttgagtattcgtgggaggaacttggttctcagtctggcttgccatttaaaatcggagtttcctatgttgggatcaaagtatccgatctagttagttttatagacctgcgatagaatttttgactgttagaggcctaactccgaggtaggagtaagtcatgcctgattttccttcagggatttaaaaatcatttaataatttatttctagaatttatattaaaataaaaagaaatttacaagtgaagttaattcagaaaataacatttcctttaataaatcatgattgggaatatttttctcgtattatccatgccctaaaataattaatataattttctcagaattttcagagatcaacatcaaattttaatagcacaaagtccatttcagagaatatttaaattgaaaaaccaattaaaagtcctcatttccaggtgggccatcatttccgacccactcctcatcgcacgtgaccaatagtagtctggcccacccgctcctccttcttcccctctctctcgcagtcgcaggtcgctcaacatctctctttgtttctctttccccatggcccagtcttatttgctagcccaactcctaactcagcacgccccctccttttggggtcaccaacctgtcagcccatctcacccacacccgattcagcctttcctcccacctcccacgccgggcatgcttggcttgcctttcctcctctcaatgataggtaggaccgaggcccacctgtcaggctcatttcctaccactagccgaagtcgacgaccgctgtagctcccacgtacccacctgatccacgagccccgctccttccctcactctcaaacaacgcaaatttggtcatcgccatattcacacccacatccccctctctcccgacaaaaataggcgctgacttgagcccacaccctgcccacatcgccacctacatctactgacggttaccgcagctcccaccttgttcatggcccctcaagcctataaaagggaccactagacatccccccccacacacacaccttcacgagctcgccgcaccaaatattgtgttccccatgctgcgtcctcgctccgtcgcttgttgccatcctctgtccaatgctcaccgccgccccatgccacttgtgtcaaaagctttgccatgtcgaggagtgtctcaaccgcctattcctcgaagccaaccgctgccccgaatggcttattcctcatggaggagagctctgtcacaccccaattttcttttggggtttaaaaatcattaaataaatcattcctagaatttatattaaaatttaaagcaatttacaagtgaaattaatgggccgtccacgcgtgctagtcatccgccatgcggttgcagcccctgcgcatctccatgcgcccagagagaaggccccgccaccaccacagtcgggtgagccttccgttgccgccagccgtcacagcccttccgccattgttgctcgtgctgacctccttgccactggctgctacagcatcccgttgccaccaaccgccagggcctcccccgtagacgtccgtgtaggcctcccactgctgatgctccaccgctccagcaactccggccaaattcagcgtggatgttccgtatccaccagtgggactagggcatcgggtctggctgcgcaggatccagatttggctattgatgccccactccctcctcaagcttggatgccttggccaccatccaaatcatctgatgggggccctctcaccgctcctcgccggatcaggacgagcagggcctggatctaggcggcatcacctcttcatccttccttgagagagaggggaaagccctgatgccgccatcctcatggtcggccgactttgccgacgtgccactcgagcagcggcaaggtgggaggaggaagaaggagaagcggcggcggtgtttttcggtcgcttcttgtgtcgctctagggaggaagcgacacgagcgaagggctccagggtggtgatggttctagatggtgcaatcggtcgaggaaacatgaataatgaaatgtagggaatgaaggggattctaaaggagagagttattttaccatggtgaagcaggggcgaaatgtggccgatcacagtggcggtggagaaaaaataggactgcatgctcctggatgccaattaggtgttcaacagaatgtccagtacttgtcgcagaatggtggagccgagctagtgtaagggaaggttgggcaactgtggcgatggtcttttggaagcttggggtgtaggtggatgaaggaaaagagagatgaggcagctaggtggtggtggttaggaaggtgaccatggatgctcgcttgagtttgagctcggtttgggccgagacacggagagtttgggaatttggtatttgtaggctacgaaggcttgcttgagaagatgtggaatggggaggcaacgagacggtgggttccacttgtcggtgacggataggaagcttctggattggattgatggtgaggtggcgtggttgtggtggtgaacaaggagtgttgggtgtccgcttcttggtgttcgatgcaatccattggcgccgaggagggggttggctactcgaccacagattcactgagcggcgggatggacggtgtggcgagatggcgattcttggtgttcgccgttgagtcggcttatccggtgctgtagcaaggtcaagcggggctgaacagtgacagaggcgctagacttctgtgcagaggaggagacggcgccagaaggaggtcgcgcgtggtgttttgggtcaacgatctcgcagcggcagtatggctgagcgggtccgcgcggtggcagtgatgcgggaccagcgacgagacacaatgctgaggcagggccggccgaggtgaggaggcgcggtgatttttctacggagcggagggtgctgctcagtgagatggatattcggtagtggcggcatgctgatctgttgtgttgatgtttggtcagtgatgtgctgtggcagcggggccggggatgagactcgatgacgaggcgagggagtcaaaggaagaacatcagcgagggggatatgggtggtgattggtgcagcacatggggaagggcgatgcagcttggcacgtcacacagtcgggttcgacctgtgttgacgcgaaaaacacacactggcctgggagatctgcttagctccagtacagtccaaaggttgataggatgcgggcgtgccagtcaatttgaccctgcaactgacaagatatacaaatagcagatcaatgagccgatcggctgacaagccaatggagtaattccagccgatatcgatagggttttgagctattggcaatatatccaatgtagataatgatataaaggcagttggctgatgatgatgcaatataacaataatataatccagtagaaaaaccaatcggctaacaatatgatatcatagaacaagtactgatccgatggttaaagcatacatcggctagaggtccgatatcataaaatccacgagattagataaatcaatgaaacctctgttgtcatcggctaaatccaacttatatgtatatgcaatccttataagccaatgcaacgtccaaaaaacttatcggctagtatcctgataaaacactagcatgaacctaaccgatttatattatcaacaatctagtaggtcgaacctaaccgatgcagcacaagattgtatatgataatctaatactcgatgagccaatagatctgtctaatgtgatggatagaacaaatctatttacaacagcattgtgattgtagagatatgtcggctaagacagaagatcagacctaaccgagacagttccaactaaaccgatgtgtctctaaacataatgcaattagagatagaattgagatatcaggtaggcaaatatatcaaccaaaccagagcgatccaagagatcgaagcgatgcagccttgaacaacaccaacgtagccaatagattcactagggccggcggaacgtaggacttaccccttcgccggagattgaactgaaccgatgcagccccgcgtcaggtgccaaattccgccggatgataagtaaaaacctcgggaaagagggtggcgatgcgccgagagtagtattgatcgagagatgatttacaatgacctcgggtgtacatatttatacccatgggtagatactagtccttataggacaagaaagaaatttttctaaagataaaaggaaaacataaagtccttataagacactaaacacactttcctaaagataaaaagaaactaacaaactattcctaattaatagataacttggcatgccgcatcctccttgaactcggtcacttctggataagcttcatttgataaattaattttcttaaccgaatatagcaggaatccaactattgataatgtgataattctcctaggggcttaccaaattttggcgttaacaacttggtgcgaaagatggtggcacagcgcgatgctggctcgagctcggccgagaggagcggtgcggggtcggccgagagaaacggcgcagtggggcatagcgtggactggcccgttgcgtgcgacactgctggcgcgacgcggagctgcccggtcgcattgcgtggtgcaacatgctccgtgggatcaatgagttggacgaatggcgttgcacaagttcagtagtgtgcagcagccacgattcggggaggtgcatcgtgcggtgtccgcgtgcctacacgataagatctatagccttgtcttttaatccctttcttaatcaccaagcagtccgcatgggcctagggcactcggcccaccccatgcttcacggcccaaggccttgccgtgtgtacctgggtaccatgtaccgcacaacatgaaacaagtgaaatcaaagttgacggagcgtggggctcctcaccgggagaccgcgcgggcccccctttgccggttcggccaggggcgctgggtgaggttctaagcccttgatctgtggaatggttcgcgagagagcaaatgcgcaagacacgggcgatgtagacaggttcgggccgctgagaagcgtaataccctactcctgtgttctggtggatctgtgtatgaaggagttacaaagagctggagagcaagagagttcaaactctagagaccctctccctactctttttccccagtcccctctacgagctcaggtcttctccagtctttttgtccgtcccctctcttggtaggcatggtcctccttttatatctcaaggggataccacatacaccatttctacctaccattcttttgggtggggacccatcctactttgaccaaaacttggctcgtacctttgcctgacaccgggataaccctgtcctccctcattaatgggcggagatttgcaatggctgttgtccgaatgaccctccgatgggatgggtcataccaacctccactccgccggaagcaggtgcaacgtggaagcacggttgtttgccgatgacgcgaccggcgtcagaccagtcacagaccggtcattcttgtccaccacgtgtcagtttagcatgctacacgtctgcccttcttcatacaatgacttccttgcaatggttgcgatgaagcctggaatgtatctggccggggctgacgtgccaactccaggagttcccacgccggctccggctagggacgagtgcctggaggctctcatcattccgacgggacggggcgaggcgtgtgtcaggccgcctgttgccccctaacccgcgatctgaccggtctgtgaccggtcacacactgtgaccgatcacggaccggatgagtgtgctgcgctacattaaatgcggcgtggggcgctcgtccaacccgcaataaacgcggttaggtgagcgccgctgtgctcacctaacccacacacgtggcgccaaaccctcagggg

SEQ ID NO: 60211 - DNA, 28732 bp, Oryza sativa
tactccattagatggagggatgccgatcaaaccacaaagcaggacctgtatcatttatgtactactatgagaaaaggagcatgccacaattttggactgataatgaagtcagaacacaggatagatgcagggtgtacattagaccagaaagcagaatctgtatcctatctgccattgccttgtagattgcagtagtgccataatcacgcaaaaaaaattcagatattacggatgttggaatttaattttctaagaaatgcaggtgtattttcaatcatacccattcaattggtgtaacaaatacaaactctactttaaaatatataagaacatttcttattcaaaagactatactaagagaaacttaagaagggtcgccataagcagataaattgtatcataaaaacatgccacacaccatgaatccgaggaccaaaatgtcataatggtaggcagagggtttcttcaagttaaactctttttgttgcgccaattgtgaagccacgctatgatcaaagaagtaaagtcctgcaaccatcaaagccggcagaatggcagcaaatatgtatgctggaggaactgaaaacagatcctgaaaataaaaaaagagaagatattattaatgatgccatgcaaaataagctgtgcgaaacttctaaaattgaagaccataaatattcacatctccagtatcacaagcaagtttgactaattacttttgctaccgtccaatgttgcagtgaactcgactcccagggaagtggactgaacagcctcctaggaactcctgaaggaacatcctttggtaacgtgtacgagaatgctgtccaaacaatcaccataagtgggacaccataatcagcaatgaagcctctgagccaccctgcaagtgtcaactcaaacgcacaatgatcagtgcacatacatgtgcttctcaatggttacaaattataatcatggagccatttacatactgatgtagcatacatagtagtttttttttttttttgaaataaagcaaaagctttgccatgtatatattagtagagaagatagtagtaatttcttgtttttgtttctaaatgttaaaactttcaaagagaaaaaaaactgtgcagcaactatccacataatataaaggaataagaatctgtcaatataagttcattaaaaaaaagaatctgtcaatataaaggctacaaaacaccatctcaagccaagccgtctactcaagaaggaaaaaaggagcccatatggtctggtccaaagctgagaggctcacaacacaagcttgtagcccagcacaacctaagcctgatctaaagcaggcccagtccaaacttcaacacagctaaagaaatgtttggcataaatctaacggttggatggatgattaatggaacagttgttgctaatttgattacccagagttcggtttgctctcaaaattggattcatgagataaaaataagatgaaaaagtgaccaaccttgaccatacacccatgaccttgcccttcttgaccttaatgcagtgtataacagcccaattgaaaagataacaccaagcaggccgttgacatacagccactggaattgatatataggtgaactatggtctgcatctctaggcaccttgaattcctctataattccctgcaatagataggccctggtctaaatattttcttccaagatagaaagaactgagcttattagatatagcatactttaatggcttgttgcaggaacagaacagtaatcaacatcccaaaaagttctcctgcaacccttgtaaacctgctaataacattagaagcattgaacattgccagaagaaacaacatgagcgcagtccagatgcagaccctgtcaacagtaggcaaatcaggagagcattaactttttttctgaaaagctaacgtgatagtattcagattcagttgttaccatccagcccatgctaaatacagtcgttcccccagagcttgctggttcttggcaaagttgtagagatacgtgtacatgattatagttggctctgcaactccaactatcaacagaggctgccctccaagaatggaatggatgatgccacatattgcagtagatgccagtgtttctactgtggtgagtataccatctgaaatgaaccacttttcttttgttagagatgtaattaaatactaagaacaataactcaagaaatagcacgactgtagcatagactcatagtggtaagaaggtaagcatttacttgtttctctgctcagttgcgctccgaaggcgatgactgggagggcagaggcaaagaagatatacatggtaggtgccaatatcctaacaatgcatcaacataagcaattcagaaatgaaattaacaagcaacaaaagcagggaatacacactcaatgaattaactgtttgaaacaaaaatcaacctgaagccagagcggaatccagcaacccagtcatgcttgtaccaagctactcggccttcgatatcagcgacgactcccttaaagggagtccttagtagatccatcagctgtacttagctcgagactaaacagaagctgcaatagtaattaaaattcagaaacagtacataaatattacatggattttcaagacacatatttttttgactgaattcaagacacacatattggcatataaaaacatcagaagccccatgtcgtctacaaaatttgcaaactcgggtcaaggcgtcaagctacctcaagacgagtcaaatcgagagaaacctcgaaacaaacttatagccatcaaaatatcagacgtgtgcttaattgcttggtgtgttacttatataacatgcacggtttgaagtataaatatttattttgcgtgtactacgtacaccgcaacataattttccgaacttttgtattcggaggagacgaatatagattttcaacatacactttctacgaagattttaccaaggtgcaaactagttcgacacttgcagcacaactttttagcgtcagtgccacaaaccacttcaaaattgtcgtcaggtaaggtaaccgcggctagctagcttacaaacatgtccgagtacaaccgtacgatccaacacctcctctcatccctcatgcgtggtggggctcggtttaagccagatacatggaaaaccaatggcacgcagtaaaaaaaaaaaaaagcgcaacgctacacctactaattttttcttactaaaattttgatcatttgatttaggtagatagaagttaaaaaaaattaaatgcacacatagcatgacacaaccgtgttactaagagtttagtaagaaaaagttagtgaatatagcctttttcgaaaagaaaattcgaaacacaagttactcatcaattaataggcgataaaaaaattcagaaaacagaaaaaaaaactcgagaagcagacatccaaactgcaaactcgcaaagttttgacagaacaacttgtagtagatccatttgcaagcaaccccacaaaccacatcccggcagccgccgcaccttgcgaacaaacaaacgtagcgttcctcgaagaaatttgccaccgaaatcgatcaaaaaaaaaaacagccatggaaaaaacccaaacaaatcccccccaaacccagcgcaaacaccggcaggcatgcaacgcacagccaccaccaccagtccaccaccaccaccaacgcgaccaaaacccaaacccaaacccaaacctcgcagttcagttcagttcgaaatagagcggacacagtgcgaaactccaaacaccatcactcacatcagtcgtcgagcaaatcgatggcgcgcgtggcggcggcggcggcaatgctggccgctcgacggcgcgggagcgaaaccctagagttggagggtggtggcggagacgcgggtttctgcgccgccgcggcgggggagggggtatttataatcgagggcgaatcgaatggacgccgcggagaagaagagaggaggagaagccgcggcggccaggaaaacgaacacgtttacctagaataaaaataataaataaataaataaattcctccattattttctagtactacgtcgtcactctctgacatgtgggcccatgtctgacatgtggaggaccacaaagagatacgcgtggggcccactagcgatgacgtggcggggatgggaggctctgccgcgcatggtagcagtagccgtgacaaggttgaagggtcagcggcttgtggcccgggggtgtatgtgtggctgcaggtggggccggatggtggtgacgcgtcatcgtccacccaggcatccactgttgcagggcgccgccacgtacgccgcggcccaagggacacaccaccgccagccaccgcgcatgtggttctcggtttctcgtcaaattaactgatgacaagctaaattggaagttttcaaaaacatgcaaagttttttcttgagtaaagtgtatagccggtccctaaacttatacgactgtgttatttgagtccccaaactctcaaaatgtatattcaaatcccaaaacttgttaaattgtgtcaatccgatcccaaactaccatgacacctccaggatcctacatggcatgccacccggacaatgatgtggcagcatcacaaattctacaccaactgacaagtgggccccaataaaaaactttttttaatatccttttttgttcattcccatcatgtcctttcttcgtttctcctcttttcttcctactgcattgaccgtagccatggcctctggtcgagctgtctttttgatggcatgaacagaggtgcgtccgtgggcaagaaggcaccggcgcagcagccgcgtcgacggaggcgctgcaacgtgtgggtagcggcgccagcgcagtgatggacgcggttatgtcctgggcatcgaggagactctggccgggagcggcgcgactgcgtgtggctcggcacgtttaccggtgaggccgaggcggggcatgcctacgatgttgcggcacagtagttccgcagccgtgacgcagtcgccaacttccgcccctcgtcaagtctgacccgaaggctgccgtcgagctctgtttcttcgcctcccggtcaaaggccgaggtcatcgacatgctccgcaagcacacctacctcaaggagctcgttgttgaaacaagtgtgccttcacctccatctctcatcacctgttcgacaagacaatgatcccgaagcaaccaaaccccgaagaggccgcgtcgccgcctgccgccgccgtcggtactggtgttgcgcatggtacacggcctgctcaagaacggcggcagtggcgttgtcatcgccgcgagggtggcgaggttggtttgccgttgcgctcgtcggcagcggagccgttctggccgaagcttagggttattgccgctgacttagacttcggaattcgtcgccatcgtcgatccttgtccaaaattgaggtcttcctcatcttctctatgccaaactccccccttcccctctcctccccgagccgtcctgctatcggagctcaccagcaaggtacccgtgtgctgcggtgccgcctacctgtttggccgccattgtgtcagcacggtgcaccgccgctgggcgtccctgcccaagccgagaacacctccggctccaagtcgacgccctgatgctcctaggcagccgtgcccagtcggaagctcaccggagcgccgctacttcgcatgcccccgccgcttgtacaacaaaaaaaaaagagaagagaaaggacaaaaaagtgaaaggagaaagagaaaagggaggaaaaaagagtttttaagtgggtcctatttgtcagtcaatgtagaggtattgatgaggccacatcagtgtccgtgtggcatgccacatcagcgccgtgtaggatgctggaatggtggtggctatgttggaccgaaatgacatactttagcaagttttatgacttgaatctgtattttttgagttcggggacccagatgggacgacgtcacaagtttagagaccgggagtgtagtttactctttttttatttagaaaaaatattggaaaataaaatttatttgaactttttaaagaatatttctatataattttttttttattaaaaaacttatcctaaactaatttaggaagcgtgcttatgacaaagcagcttagcgaagattatgtttaaaacacatcctaatcaaacaactggtacgataaattctgacactggtggagaaaccatctttcgtcggtcggccgaattccacaatagtcccggatgcaataaaaatcggggctaaagatgatctttagtcccggttcaaaagggtaacgggcatatttgatcttaacaccaaccgggactaaagatgatctttagtcccggttcaaatgctgtcagggcctgtcaggccccccgggatctttagtcccggttggtagatcgtaactttagtcccggttggtaataccaaccgggactaaagtctcacccctatatatatgtcttcttcctcctccagctgcctgagcaagcttcaaaatttcttcaaaaaagaggggaggtcatgctaaaatttctagtgaatttattttggtgattacatacaaatcggaggtgcctaaaaggtttgcaacttcatcctccaatatttttttgtcatattacatttgcagctatgttttgcatacttttttgtctccaaaaattagttgtaagttgatgagggagaaaatttgtgtggggaagaaagaatatatagaaatttagttgatttgctaaagaaagttttataaaatagttgagaaggaaaactatagtgaaaattaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgttattattgtaagaataattatttttgtatgattttttttcgactcatgtagatggatcggcaatggatgtacgctgaccggcggtccaaagagtttattgatggcgtgcactattttttgagagtggccgaagctaacaggcaaaggggttttatttgttgtccatgcaataagtgtaagaatcagaaggagtattctgcatccaggactattcatttccacttgtttgagtcgggggttcatgccaagctataactgttggacatcccacggagagcaaggtgttgaaatggaagaagatgaagtggaagacgacaatattccgaactttgctcagtacgttggatttgaaggaaatcaaacgggcgaggaggaaagggatgctgatggtaacgacgttgcggatgattttggtcagatgttgcaggacgccaaggaggactgcgaaagtgaaaagggggcccataaattggacaagatgttagaggaccacagaacttcgttgtacccaggttgcgagcaggggcacaaaaagttggataccactctggagttcttgcaatggaaggcaaaaaatggggttagtgacaaggcattttgcgatttattgaaactcgtcaagaacattcttccgaagggaaacaaattgcccgagacaacgtacgaggctaagaagatagtctgcccgctaggactggaagttcagaagattcacgcatgtccgaatgattgtatcctatatcgtggtgaggagtatgagaacctagaagcatgccctgtttgcaaagcactacgatacaagattagacgagacgatccaggagaagttgacgggcagctaacaaagaagacaattcctgctaaggtgatgtggtatttccctataataccacggctaaggcgtttgttcaggaacaaggggaatgctagaatgatgcgatggcacgctgaagagcgtcaacaggacgggatgctgagacaccccgccgatggttcgcaatggcgaaacatcgacagaaaatttaaagaatttggaaaggacgcacgaaacatacggtttggtttgagtacggatggcatgaatccttttggagagatgagcagcggccatagcacttggcccgttacgatgtgtatctccaatctcccccctggctatgcatgaagaggaagtacataatgatgccgattattattcaaggccccaagcaacctggtaacgacatcgatgtgtacctaagaccactggtcgaagatcttaagctgttgtggaagaaggaaggtgtccccgtatgggacgaggacaaacaggaggagtttaacatacgagcgctgctgttcgtaaccatcaatgattggcctgcacttagcaacctatccggacagtccaacaaggggtacaaggcttgcacacactgtatggatgaaacagaaagtacgtatcttaagcactgtaggaaggttgtatacatgggtcatcgtcgattcctcgcagcaaaccacccggtacggaagaaaggcaagcacttcgaacataaggctaaccaccgtatgaagcctaaacattgcagcgggaaaacaatgtttgctatggttaaagatcttaaagtagtgttcggaaaggggcctagaagccagcctatagagagcgaagatggtcacgcggcgatgtggaaaaagaactctatattttgggagttaccctattaggaattcttggacgtacgccacgcacatcggtcccatgatccccagccgaccattcctcctgcaatggtgagcccgtcaggaaaccgtagcagctgcgcctcaacggggcaggtaggatcacagagcatggacgccatacaaacccaggacgaatccacctgccctgttgatgacatcactcagcggacaccatgtgagctgcatattcctttcaagaacttatcaataaaggtaagctcgtagtttatatattttagatttggccattccgctagttgctgcttatatatgttgattactaataaataacctctcaccacatgatggtggcatcgggcatggccatcccaacggacccttcaggtacttaccactgcaggccgattccagcaggatactccaaggtcgaagttgagttggtcgaaggcgcgtacgaggacctcgagctggattaccctggaggagacagtgatacgcatctatgagacacaagccatgccattattctatggcgcaggcggtacatcatcctccctgggcgacaagcggcgtctcgtgcaccatctcctccggctccgccatctcctcctcaggatcctgcaccgtctcctcctcatgctccaacaccgtctccacctcagactcctgcaccgactcctcctcaggctcctgcaccgactcctcctcgggctcctacaccgactcctccgcaagctcctcttccggcaccttcaaagtcaagggccccccaagctccaccgcctgcccacacaagggcaacgaagaaggcgaaagttgacgccgccaagaacaaggacccagggtacgattgcacgcaagaggagcttgacgcttacgtggcatcagaagtcaagagacaattcaagcctcgaagtccagaaaagaagattcctatagacccgagtgtcaggaagttctttaggggtatgtctgcacctgccaaggaggccattaagctatcggactatgagcgaacgctgaagaaagcatcttctggaaagtccaaaccagtccctcagcttggagagcaaccaaaccaggagatcgagccgttggtgaccggtgaagaaatgacgatagaagaatttattactgacaccagtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaagggaatctacgaactataccagctggacgctctcgacgtctctattatgagttgctggattttgtaagtatatcgttcagttagatttcttactacgtctcctttaattaattaggtccttgtatataagtagactatagaaaataatatattctcttttatcgttgtagaatggagattcaaagggcccgacggcggggggttttcgatactggattcatcgaccctcggaaagtaaacatcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtacgaacttgctaagtgtttcatatgtaatgcatcccacgcacattgcagattccactgggtgcttttactcttcgacctgtcggcctacaccgtcaacgtatatgactcaatggataaaaaaagagtctacgtttgacaaggttttcgaacttatggacaggtattgtcataagttcctctgttaattaagaaaatcttgttatgttaattgctactacgaatcatagctttaaactccatgtagggcttggtatcggttccgtcatttggtccgcggcaaatggagagaaagacttaggcggaagtttaaatttcctgtgagtacacatgctctacatttatattgctccgattcaaatatatacaagtgtatattaattagatctctcgtcgtttgtcatttatttgtagtgcggaaagcaaaagcagggaactaacttgtgctgctattacgtgtgtgagtattgccactgccttgcagaccaaatcatcaccacaagagagctcgatgtacgtacaaataaattcaaaatttcattacgtatcgatttcttgtttaattactaatcaatttcatacattcatatagtttattcgtatgagggataacctgaccacacacaaggaatttatcgtggcggttcaagaacaacttatgggattcatcaacgaacaagtccttgatcccaagggtgaattctactacgacggaaacacaattcataggtccttagcttctgagctagcgactactacgtcgaaatcgtagctagctaggacatataatggattgtaattaatacatgactacatatgtttctatatgcatgtgtacacattttctataatgtaaatatattttggtcacacacacacatatatatatatatatgtatacatatatatatatatatatatatatatatatatatatatatatgtatatatatatatatatatatgtatatatatatatatatatatgcatatatatatataaaccctacagcaacagagccatgaaaaaaaaggtcagctcgatttttagtcccggttggtatatctttagtcccagttatttcatccgggactaaagatagcgatctttagtcccggattggtagtcccggtttgaaaaccgggactacaaagggtttctccaccagtgtgaagtccaaccaatatccactttcggtcttgctatgagcttgacgaataaaattttaatatatacttttatttttaacgttttgcttttatatacatgcatagaaaagagttgtgaaaatatatctctaccctagaatggagatgcgggatcaaggcagtgcttcccgcgcagcgtccgcgtggcaccgttgctcccgcggaacgtccgtgcggaaccgtcgttcccgcacgcaattcctcgctcccgcgcgaccggcgcggtccagcgcgctcatgacgcgcggccggtgcggcaaacaagcacatatgcatggatgtgcatatgttgcatacatgcatgcattcacgttgcatgcagcgatgacggcgcggcggttccgcgtttccaggctgcgggatcgataggttccgcactgctgttttgcgcgaccgctggttccacaacccttatgcggtagagatatatttgtgcaaaatttcatcgcattggtatataaacacaaaataacgaagaaaaagatatattgtgaaattttttcctgggcttgaccaccatagacaaacggtgaatctatgccgaatgcgcttacttagctgcttccacgaaagttgccacatgatgccaatttttagcaacccagccaaagactaagaacttgtttggagtgaagctaattattttccaaccaaaattttagcggcctaaatagtattgcattgatgtttagtttgcttttttttccctcactaatataaatttatggtaccaaattttgtagtcgcagaaattatcaagattttagcaccatcaaaaaaatattaacaggggaaaatttagctccaaatcaaacaagtgaaaaaaaaaactttgtgccacactaccacacccctacagtgagagtgtgttcttagttcagcatcacctctacaacgtattctctccgtccataaataatcaatctaatttcaaatatgatatatcatattactacgaatctggataaaaatatactccctccttccctaaatatttgacgccgttgatttttttaaatatgtttgaccgttcgtcttattcaaaaacttttgtaaaatgtgtaaaactatatgtatacataaaagtatatttaacaataaataaaatgatagaaaaagaattaacaattacttaaattttttgaataagacgaacggtcaaatatttttaaaaaagtcaacggcgtcaaatattttaggatggaggtagtatgatactagcttgattttttttatgagtcaagtcaaaggaagtacttgtatttggaataaccccgagcggtagctgatttgaacacggaaagctgtgaaggtcaattagaagaaggccctatgtgcttgtctcggcagaataagattcacttgtccccatctccagatgacctgatcttcgcttggttgttccaaccgaaatccttgcagccaatcaaatgcccagaaaaaaactgggatattattaccgggaccgtcaaaacttcccagaagatagtattgtattcttaacccaagaacgatcggagtggccggcacaaattactgtagtggaattccggaagcttatgttgacacattgtcaatttgttgataacaaacaattactaggttttaatatattttttggaagatgtaaaacggctgtggattgatgcagaggtccaaaaatatcattctcgtttttcaaaaccggaaagtatttttctacccatcgagacgtcactgaaaataactactcaaatgtatggttgcaatcaaccaaaaaaacacccaagaaatgctaacttcggctatagggacttgatatcccacggtatccacaccctatagaggatcttagctatagcaactagctcatcatcttaagaccacaaccttttttttcctctgctattatctaaaattctaaaatttttgtttttgaaggatcacattttgatactttctggtagaagtgaacgaaggacttcaagccaagaaaaatgaagtgacctctaaaattgaagggacaagacttgctcctgaattgtactttatgtttttttttctttctgtggccggtaatcacttgtaattcaagcctgtaataaggcacaagagagcaactgcgtgctggccttttgtgaggttttcagttcgaattttgcatatttcagcgacagctagctggagttgtcagttaccattcgccagtaactattgtcagtcaccattcgccagtaacggctcaaattgcaaactatactctgattaattgtatatctaatgactgattaattgtgtaccttctctggactttctggtccctcgatgaatattcagtgggtacgaaagctctccccgcccggttatcctttcaggaaaagaatgtcatcgggtggacaaatcaaaacctaacctcttcgatcggatgaaaccttagccaaatgttttgttggccacaccttagctgattagctgagatcgaaaaaaaatctattacctatacctatactaatcaaacttcctgagagctcccggttaaaagaatatatgatcgttaatttgatgggtcgtataggttggcgactagttataacaatacatgaaaagtatggcataatataaccttgacaataaaacaaatctttcggaggtaattttttttgagtcacaagaccgcgggtagattattcaatttcagctaatttttatcctgttaattaatatatcagtcaataattagataatcagtatgtatagaaccccgtaatttttggaatatgtccgccgtttcatgagggtgagttcgtgcgtgttacaagcgtatgcatttataccgtgtttctaaaaagtttcttttaaaagtttgataatattttggcaaacgataataatggaccagacaaatcttacaaaatcagatgagaaacaaaatactcttccgcgatactcctatacgactatctcgtcagtttggtggaggtatgaaaacatgaaatgtgcatcagtttcttttatttttctttttaatttttaggaactgtgtaccagttgttgatgcgctataggtaaaatatctggttgttgtggatactcctatatggctatatagcagtactttacatagtgcggagtattacgcagacataacaaaagcgtacaaagtacaccgtctgtgacttaaattaggctctgttcggcaggagggattgggaacccctctcggcacgtaaaacgatgtttgtattaacgcgtaattaattaattaatagctatttttttaaaaaatagattaatatgatttttttaaacaactttcgtatagaaactttttgaaaaaaaaacacaccgtttagtagtttgaaaaacgtgcgcgtggaaaacgggggtgaagagctaggaacctggggatcgaacagagccttagtagagcgagtacaataaaatcaaagatcctttcccttaagaaaagtcgtgtgttctgctttgatcttcaatacggatatttggtcatagatacgtgacatggatgttgttttttctttttctaagtataacctttcagaactgtagacttatattttatttctactctatcaatacaaaacgtcacactatcttgtgcgtattatttaaaaaataaaattacatgagcgtgctatacaagttatcacatcaccagtgacgtatatagaaattttatatgggtgatccaacttatataaacttttttaaacaccctaaatgtaaccaagttagaaatataaattggtcaaatatgcataataatatatcaataaaaaaaactttttaaaagttttttttcacatgtgtatatatatatgcattggattaggattttttttccaagtgagcactaggatcacccctagattcgcacacgcacatcacatttgtgattacatggagaagagatgagagagaagaaaaacgtgctacagattcgtaaccagctacaacacattctgtaataaactatctgagatcgaatgaattaggtattaatgatgcagtatatatatatatatagctaataattatatgaatggattattaaataagttgcagatgatattttaattttgagtaaagtccatcaccagtccctaaacttgtacccctgtgtcatcccggtccctaaactcgcaaatcgaccgttcagatcctcaaacttgttcgactgtatcatcccgctccctaaacttgcagatcactcgtttaaatcctccaacttgttcagctgtatcacccagtccctaaacttggatttgaatatcatctgtgtcaaataggacggtgtaaagactttatatttaaaaataattcataacttttatgtgaactctaataaagacaaactttatatcaaacttgtagccctcgacacgatctacaactttgtagttgaattttttttattttaagtcatttttgttccaaaatgtaattttaaaattaaaatttcaaaatctataaatatgcaacaatattttgggaccctaaacagttttaattcaaaaaattttcaactacaaagttgtaggtcgcgtcgagggctacaattttgatataaagtttgtcttcattagagttcacatgaaaaagttatgaattattttttgatataaagtttttagaccgtcctgtttagggactggggtgatacaactgaacaagttggaggacctaaacgagtgatctgtaaggaccgggatgacacagtcgaataagtttgaggacctgaacgatcgatttgcgagtttagggaccgggatgatacaacggtacaagtttagggaccggtgatggactttactctttagttttttataaagttagtagttgattatattattaaaattgctcgtggtatactaagaaaagtaggagccttttacacgatatttgcgtggtactttgctgcgataatattttactgtcccgtgcaattaattattctgtgaacaattaaacaggaagtatatatgcatgagctaagcggtgacgtacggtacatccatctgttgaagttataagcacatgatgattcgagtactcgctaggcaaggcataaacagattgatcgtcctgagaattatcacaggccatatgcttgaattattgatgcaaaaagattgatcagtctgtggctctgtgcaatgagtgcggcacatgacattttctatgctgtcagtcaagaatctttcgaagagatacatgtagatctcattagtcaagatcacaatgttttacgtttttccgtttagcatgcaggagtagtagatatttgtaatgcaatacaaaattaatggccaaacgaatgagtggtcggctgtatgatctcacaaatcatgggtttttttgttctttttgcccctcaagagtaggccctgctcgtagtgctgcggattataatccggaatcattttgaatttttatggattggttttatggtttctttttatcaactttcattactgtcccgctctgcttttatgattgccgaaaagattgttattaaaaactaagaatttagaatcattatatactataaacactatataaacaaactaaacgtaaattaatcatcttcaccagccggcttgcatgtataaattcatcatgtacttcaaaacatatttaagaagtttaagattataagaaatagctgattcgtgtagtagtaagtttctgagaatttttttaaaaaaatgtgtttcttagattttgatttctagtttattttatggattctataattatagtttttttaatctaaactgtttggagagcttctgattatagaagttgtagtagtctggaaatcaagccggcactgtcttttattgagctgtgattgaaaataattttattacaatttattacatttttttaaagccaaattttaataacgagctagcgagtccaaatgaagcaaacacaactttcatgcaaaattttatcattttagttttatataagaaaaaaacatatcacttgacaaaattttgacttgtgcaccaatctcactaactgggccgatcgacagaaaagctatctcatcctctttttacggcccaatctcactaactgggccgctccacgcatacacgtcccagcccaaaaccctccctgcgtaaataggccgggcctaatcactttaagtgggccgggcctccctctcctgccgcttcgtcctcgccacctccgccacttggcgcgagattcctatcgcgcgcagacgcgccggctagctaagtcgcgagcgttttcggcccatatcctcgcgcacggcccactagctacatccttctttttctattttttcgcaacgaagtgcgcaggacttttagaaaaaatcgtatacgtaattagttatcgataattatggtatattaagctaaccattctttttttctcagcaaaaaaaattgaaaattttgaaaacttttaagtcgaattttgaacttttaagttaaaatttaaaaacttttatctcaaatttaaaaaaatttaacccgaatttaaaaactttcgacctaaattttaaaaacttttaactcgaatattcaaatcttttgaccgaaatttcaaaaactttcaactcagatttgaagactttcaactcaaatttaaaactttcaacttaaatttgaaatttcaagtcaaattagaaaactttcaacttaaaatttaaaaactttcaattcaaatttgataactttcaaatcaaaattaaaaactttcaattctatatttgtaaagagatatgccaaagattaaaaaaatcggaaaagaaacaccgaaaaagataaagaaaaaggcacccgtaagcaccaaaatcggaaaaaaaaaagtgcaaaaaaaaaagacaagggagctatagggtggggcagctggcgtgcgcgccagcaatttagctggcgcgtatgcgcgcagtagccaccccccacgtggcggatcatgtccgtcaggtcggcgtgcgacgacccggctttcttcaccgccgccctcgccgtcgcggcgagcttcctggcgcgcgcccttctcgccacgccgtccgcgccgccgtccatcagctcggccaccgccttctccacgccggcgccggtgacctgcacgccctcggcctcggcggggaggtacatgggcggcgccgtgacgcccgaccggacgccgacgccgagcacgtcgacgagcagccgctcgctgctgaactggtcgaggatggtcggccatgtcagcgccggcacgccgcgggcgatggcctccagcgcggcgttccacccgcagtgggtcaggaacccgccggtggccgggtgcgagaggatgctcacctgcggcgcccacccgcgcaccaggacgcccctgtccttgacgcgctcctcgtatccctcgccgtcgagccactccctcacggcggcggcggcggccttggcctccttgatggtccagacgaacggccgcccgacgccttgacgccgcgggcgagctcgatgacctgcttcgccgccaggtgcgagatgctgccgaagctgatgtacagcacggacgccggcggtcatgcgtcgagccaggagaggatacgcccggcgtcgacgtcggcgcggttgccccggttggccctcgcgtcggcgtccgtgctggcggcggcggcggcgcacgtcggcccgatggcccacgccctccggccgagcgccgccgcgtagccgtcgacgaaggcgccctcgatgtcgcggaacgtgttgatgacgaagccatcggcggtgcgctcggcctcgaccgcgtcgcgctcctcctcctccaggccaggccactggaagaagcggcggaacgtggccgtgtagacgacggcacgcaccgggaagtccggcacctcgaacggctccagctcgccgtcaccggcggcgagcgcgaggcggccgtacacgccgtgcttgctcaggttgtgggtggcgaggaggaagtacgccgacgggcagtgcatgacgacgcgagcgatgccgaggcggtcgcagacgggcgccgtccacgggttgcagtagtcggcgacgaggcagtccgggcggcgaggcagcgcccggacgagccgctcgagccgcgccgccatggcccagatggccctctgcagggacaggtacatgccggggtcggcgtccgccagctggtccatgttctccagcccctccggcacgccgaactccgggccggggaaggcgacctcggcgaggtcgacggcgaggccgtcgcggcgggcggcctccacggcggccccgttgcgcgcggcgttgacgggcgtggtgacgacggtggcgcgcgcgccgcgggcggcgagaaggcgcgccacctccaccatggggatgatgtggccctgcgctatcagcggcaccaccaagaaatggagctccgccgccatcccgccgccgatgagtgtgaggaagcaagcaagttgcagtgtgcgtatacaagtcgacgcgacgaggacgacgcctgtgtcgaggcgccgcgccgcggcggcagaagcctcctggaaaagtcgggagggaggggtgatgacgtatgcgcctagcgaagcttcgtcgtcgcccgcctcgtagtcttcacagctgcctctgtcacgtggactcgtggctcccaagtccaatttcaacaagaaagttttttttaaatgcaacaaacaagaaggtaattaattgagttttaattatttcaaatttaaacaaggatttctttgatattttagagcagtttttatacagaaagttttcacacgaaacgtactgtttagttgtttgaaaagtgtgttaacaaaaacaaggtgtgtttagttcacgctaaaattgaaattttgattgaaattggaacgatgtgacggaaaagttggaagtttgtgtgtaagaaagttttgatgtgttggaaaagttggaagtttgaagaaaaaaattgggaactaaaccaggccaaagataagattctgcgtactggcctgaaggcatatatattgccctctttgtttaggcttataagccaacttataagttgaaaagtctaagccaaaacaaacaagtagctttttcatttggcttttttgaagccataagctattctaacactattaagccaaaagctaggttggagaagcttttttggcttaaatgagatagatgtatgactccactactaaacttaggacattaaatccactggcttataaatcatataagccaataagctgacttaaaagtctaggccaataagcctaagcctaaacaaagagggcaatagccatctgcttggctttcttatataggccgtgtttagattcaaacctccaacttttccgtcacatcaaatgtttagacatatgcatggagcattaaatgtggacgaaaaaaaaccaattacacagtttgcatgtaaatcgcaagacgaatcttttgagcctaattacaccatgatttgacaatgtggtgctacagtaaacatttactctactagtgacggattaattaggtttaatagattcatctcgcagtttacaggcagaatctgtaatttgttttgttattagtctacgtttaatacttcaaatgtgtatccatataattaaaaaaaatttagcacacgaattaaacacagccataatgagtttaaatgttagcacttcaaatcacatgaaaccaaggttacccttatcgatgggtttattgcacagttgccatgcggcaattgcggtaaccacaacaaaccatagaagccatacaaaatttatcaaaatttcagactattttttgaatctatttaattttatttttggtaccctagcaataagcacagttaccgtcagttttataaatcctgcttggaagtattttcaagctgttcattgagagagacaatagaggaatatctcatactcctaccttcttttggaatttcctctgaccaatttcgaatggatagtatccatagttcttctagaacttccattactacacactacactcccattcacgaggtcaggagtccatagatgacgagtgaacatgcgtcactccaagttgaaagtttattttgctattttcttctccggcatgatcgctccatccggcaagttgatacaagcaaaccggccctccgattgtttaatcgtccacacgtcactctcctttgatccgaagctcattgactcaaacgccataaaacaacttcgccacaattcactagcaacaaaccacagccatggacgacgacaccgccggccacgcctccggcggctacacgacgacggcggcggcgcacttcgtgctggtcccgatgatggcgcagggccacgccatccccatgaccgacatggcgcgcctgctggccgagcacggcgcggcgcgggtcagcctcgtcgtcacgccggtcaacgccgccaggatggccgggttcgccgccggcgtggaggaggccggcctgccggtgcagctggtggagctccccttcccggccgccgagttcggcctgccggacggctgcgagaacgtcgacatgctcccgtccaaagacctcttcagcaacttcctcttggcctgcggcgcgctccgggagccgttcgcggcgaggctccggcagcaacggccgccggcgagctgcatcatctccgacatgatacactcgtgggccggtgacatcgccagggagctcggcgtcccatggctcacgttcaacggctcctgcaccttctcctcctttgccaggtaaaaatcgtagcaaaagccactggcatatttctctgcatatgaataagggtatcccgtcatttttacatgtcacttaaaaagtcatcaaaatattttaaaaaaagtttggtaggatagatcaatatgtgatatgtaacttcacgagcatgcaaattcaaattcaacctatacaagtggaaataaaaataataaatttgactatgaataggacgcgcaattcacggtcaaatttgttatttttgtttcgaattgtataagttgaattttaactcgcatgtttgcgaaaagatatatttatatattgatctatcttgataaatttttttataactttttaaacgacatgtaaaaaacgaggggatatctcctcgagggacaaaaatctactttccatatgaacagagaatacttactccctccgtcgtgtccagatttatagctaaaaatgcttatattctgggatagagatagtagaaggagatacttatcaggtatgtgatctaagaactcacagtttggatgtgacctaaggttgtgtttagatccaaagtttggatccaaactttagttcttttccattacatcaacctgtcatacacacacaacttttcagtcacatcaccttcaatttcaaccaaaatacaaactttgcgctgaactaaacacatcctaagaacttggtccaagtttccaactatctcgcagggacatcatttatcgcaaaaatctattggagaacctcacggatgatgagatcgtcaaagtctcagggttccctacgccgctagagttgccaaaagctagatgccctggaacactgtgcgttccaggtctgaagcaaataagtgacaagatttacgaggctgagacgcgaagcgatggcaggatcatgaatagcttccaggagatggaatctctgtacatcgagtcgtttgagcgaaccataggtaagaagatctggacgatcggcccaatgtgcctttgtcacagagacagcaacgccatggctgctagaggaaacaaggcgtcaatggatgatgcgaaatgtttgcaatggcttgattcaaagaagcctggttcagtgatctttgtcagctttggcagcctctccagcaccgaccctcagcagcttgttgagctggggctgggacttgaagcttccaagaaaccattcatctgggtgatcaaagcaggaaaaaagtttccagaagtcgaggaatggcttgcagatgggttcgaggagcgcgtcaaagacagaggcatgatcataaggggctgggcgccacagatgatgatcctgtggcaccaggccattggagggttcatgacgcactgcgggtggaactcgacactagagggcatctccgcgggtgtgccgatgatcacatggccacactgttcagagcagtttgtgaatgagaaattggtggtggatcacctgaaaattggggtggaggttggagtgaaaggagtgacacagtggggaactgaacaaaaagaggttaaggtgacaaggactgctgtggagacagcggtatccatgttgatggatgaaggggaagttgcacaggagattaggatgagagcaaaagattttggcatgaaggcaagaagggctttggaagagggaggttcttcctataacaacataaaactattaattcaagaaatgggaaacaagcaaaatgcatctggttgatacatatggaaataagctttattttttcttaattgtaaatctgtaagcaagaactggaggatcctattgtgcttaccctgattttcatccctcaaactataaagaactgtactctccctctgattccaaatataaatctttttatacttgtgcaatttgtataagaattaataaaaacaactctaatgaatttgttgcccttcatctacagtatactatatcaagaaagataaattatttatttttaagagggatatagcatttatttagcaaccacaaacattgaacaatagtaaaaaaaaattgctaagaagctctgaaacgatatatatttgggtaagaattgagaaagactcaaatgacttacatttggagcccaacagtcccaccagcttctgcagtggacgaggttcccaggaccccttgcggatgagaagagtattctacaaatgatcagtgtatagagtggattagacctggtcttacatcactttcgtaattgctgcttcgattcctctgaatatatgaatgcaaattttgtggtcaaagtcaggcatagacttataaagatcacaaaaggaatttccttgtaccagataatgcagaggccagggagtatctttcgattttaagtacgtactgtattgatagcaactgtggcctctgtggttgcataaagaatggaagaagcttcatgtacgagggatctagccacgagtccatgactagcatgcgtcactgaaactgaagttgccaaagtctagcaatactgttctttttcagcacgagctcgaactggccgagttgatagtagtacaaactgttggcgctgcaatactttcaacccgtcactttcctctgatccgaagtggcaggcaccacatatgcactcctcggttgctgtcaagtgtcaagcttctcatcaactcgagcaggcaagcagcacacgacttctcggttaatgcatacctccaaggctccaactgttcttgtcacactctcactgtccacgcttgtcttggccgcttgactagatacaaccacacagccatgtcttttgccagccacgccggcgccggcgccggcgaccagcagcacaggtgctgctccaggacggtgcacttcgtgctggtcccgatgatggcgcaggggcacaccatccccatgaccgacatggcccgcctgctggccgagcacggcgctcagatcagcctcgtcaccactccggtcaacgccggcaggatggcggggttcgtcgccgccgtggaggaggctggcctgccagtgcagctgctggagctccccttcccggctgctgatttcggcctgccagacgggtgcgagaacattgacatgctccagtgcaaagacgacatgaggaaattcctcgaggcctgtggcgcgctccgggagccactcatggcgaggctccggcagcacgacctgccgccgagctgcatcgtatccgacatgatgcactggtggaccagtgacatcgccagggagctcggtatcccctggcttacctttagtggcttctgtacctttgcctccctcgccaggtaaaaatcacaggccactggcatatttatctctacaagaacaacaaatagttagaattgatcaatagacgaggcaagacatgagaatgatattggttaaaggattttaatcaaaaccacacattaagccttttatctaaaaaatacttcaggtcaggttggcaattggttggcagcactactaactcatttcagaaaatagaaaaacttttcatggtatcttaagaactgccggttggatgtgttttaagagctaagactgctatcttgaagggacattgtttaccgtaacaatctattgcgggacctcactgatgaggaggaggtcgttaagctctcagggttccctacgccgctagagttgccaaaagctagattgcctggaagcttgtgcgttccaggtctggaggaaatccgtgagaagatctatgatgaggagatgcgaagcgacggcaaggtcatgaacagcttcgacgagctggagactttgtacatggagtcctataagcaggtgacagataaggtctggacgatcggcccaatgtgcctgtgtcacagagacagaaacacaatggctgctagaggaaacaaggcgtcattggatgaagtaaaatgtttgcaatggctcgattcaaagaagccaggttccgtgatctttgtcagttttggcacccttgtcagcaccgcgcctcagcagcttgttgagctgggactggggcttgaagcttccaacaaaccgttcatatgggtgatcaaagcaggaaataagtttccagtagtcgagaaatggcttgcagatggattcgaggaacgtgtcatagacagagggatgatcataagaggttgggcaccacagatgatgatcctgtggcaccaggccattggagggttcatgacacattgtgggtggaactcgacaatagagggcatctgcgcgggtgtgcctatgatcacatggccacactttgcagagcaattcttgaatgaaaaactggtagtggatcacctgaaaattgggatggaggttggagtgaaaggagtgacacagtggggaagtgaacaaaaagaggctcaggtgacaaggaattctgtggagacagcagtgtccacattgatgaatgagggggaggctgcacaggggatgagaatgagagcaaaagattttggcataaaggcaaggagggctttggaagagggaggttcttcatataacaacataaggttattgattcaagaaatgggaaacgagcaaaatgcatctggttgatacatatatatgggaataagctttttttattaaaattctagatctgaaagaatgaattggaggatactatcgtacctatatacttgtaaggatgggaggagtccatatttggccctttaactatggtcttgcccggattttcatccctaagaattgtgctcccttcaattccaaatacaagccgtgtaaagacttgtgcataaatatgatttatttattagaaggataacatttatttagtatggaaaatctggaagaatagtaaaaacttctgtattctaaaatgacttgatattgagaaagaatcgtgaagcataaaatggcttacatttgcagcctggcagtccaccagctcctgtagtggaggggatttccaggatccctgcagatgcaaagagggagtattttacaaatgatcagtattattgtatgaggctcgtttgtggcatgattgtttacagtctggattattaaattatatcactttctgtttctgacactcttgcccaagtttcctagttacttctgaatatatgaagataaaaattaggaatagtggtcaagttatgccgtagacttcgaaagaaaaaaaatactgaatagtgagactgcagaggacagggagtatgagtatgtatagcaaccgtggttaacctgaccaaccgcgttgtccggacggctcaaagaatggaataaactcgaggactttggctatgagtccataactataacatgcacaccaaagttgccaaagttcagcgatgctgttatccttttcagcatgagctcaaactggctgatttgataggaggacaagctgctctgcaattatttaattctttttttgaaagaagctgcaattatttgattaatcggcaacattccactttcctccgactccgagatccgaagcatcaggcactactccgtagcacctcaaagcaagtactatgagcatccaagcacaagccccaagatgtcacataggactaaattgtgaggtggaggagagaagaaggatgagagagaaatagtcacctctcatgcaaggggcagcccctacacaaactttaataaacatgtgagagtgttagaaatattagggattgtgtggtagagatgacctattatacatatcacctcttaatttaattatctatgttatgtataaaattagatgcgatagtcacctccaatataaaacttgccctcagactgcttgcagtcatcaactcaaacagcatacgacttctccagagttattgcatacctccgcttgactagatacaaccacagccatgtcctccgccggccacgccgtcgaccagcagcgcaaatccaccacgatgaaggcgcacttcgtgctggtcccgatgatggcgcagggacacatgatccccatgaccggcatggcccgcctgctggccgagcatggcgcgcaggtcagctttgtcaccactccggtgaacgccgccaggatggcaggattcgtcaccgctgtggaggcggctggcctggcagtgcagctggtgaagctccccttcccggccaccgagtttgggttgccggacgggtgcgaaaacctggatatgatccagtccagggatctcagccgaaacttcatggaggctgcggagcgctccgggagccgctcacggcgaggctccgtcagctatgcccacctccaagctgcatcatatctgacatggtgcagtggtggaccggtgaaattgcaaggcagctcggtatcccaaggctaacatttgatggcttctgta

SEQ ID NO: 60212 - DNA, 12392 bp, Oryza sativa
cgcataccaatgagaggataattaggcctgagcggccggtttgcatcaagagatttgagcaccgagctatcggatcccctggaggaaacaatggcagcaggggcaaggccaactttcttggtcaaatcggagaaatggtgcggaaacgcgtgcgcctccacagcctgcatcgaggtgagctcctcgctggccccgtcgacgaacaagaacgtgaatgctctgttcctgcaagtctcagaaggattcgatccatgatgcatcggtaaaaaaaaacccgcagagacacattaagctgttcgatgcggatgggcgaacctgaagtcggcgttcttggaggcgaagatggagaggaactggttgacggagatgccgagctgcagatcccaccacgggacgaggaactccagcttgttgtgcttcttcctgcacacctgcgcctgcacgatcctcaggttgctcggcaccgtcctcccacctcctgcgagcaaatacaaaaaaaacaatctcgttagagatcgaaggaatgatgtggaagcggatgttgggatgagttcgttcgatctgcgtttcttacgggcgcaggggaaccagtggtcgatgtcccacgcgagaggcgaggcggagtcggcgtggaggtagagcacgttgccgtaggcgtcgacgcggaacagcgccgggtcgaacccggcgttgccgaggtggtcgagctgcttccacagcaggttcgcgaacccccgcgggttcgccgtcggcgccgcctccgcgtcggccaccgggaacatctcgttcagatccttcgcccgcatcgcctgcaccaccacccaacacaaccaccccaatcagctcaccaccgcaccagcagccgcgaccatcacctcgacgagcacccattacctcgtgcgggtggaggacgtaggggaggaagccgtgcggcgggccgtggccgtacgggagtccaccgccgccaccgccgccgccgcggcagaggcgcgcgtaggccttggggtagccgagcgagtcatccaccgccttctcctcctccgtgaacgccgtcgccgacatcggctcgcgccggcgccggcgccaactgtttgtttcgggatcagtggcaaatgggcgagagatcgggagagatgggagagaataaaaacagatgcgtgttttttttatttttttttttggtttttttcaggagcgtggcagcaacggtcgagagagccgttgggaaattcaaactcgcgcgcggtgagggacacgtgggttgcgggatgccgttggatttggattgagcggctcgcgatgagtggacgttacgctgggttggggtggactgtggagtggttacaggtgtacaagggattaataaagagatcatttagtaatgaggagttagtaattaattgttgtggggggagcggtggcccaccggcggccggcgggtttgggggccgtggggctcgccgtggataggacggcggccaaggttgatttgaatagactaccgagatgtgagatctactactctcttcgtaaaaaaaataatgaagaaatatgacatattctaacacaacgaaacaaatctgaatagaaatttatagaattaggttgtatcgtatccagtactaggatacgtcatccgctcctaggttagtatattctgagacggagagaggatacgtcatccgctcctaggttactatattctgagacggatagagtattaggttggattttttaggacggagtaaacggtttacgaagtgatgtgaaatcgttgtgatccatttgccagggccctgaaacaaacatggttaatgattgtccttgtcgaaagcattcgaggtcatacacgttcggctaggatgagcggttgtacggagtgccaggtgaaagctgttctactactcccaaatcaacatgaggctcgctaatcatacgaatttgaattccaaaacaacaacaaggctgtgtttagattttaaaaaaatttggcaaaaaacatcgcatcaaatatttagacacatgcatggatcattaaatgtggacgaaaaaaaccaactatacagtttgtatgtaaattgcgagacaaatattttgagcctaattgtgtcctgatttgacaatgtggtgctatagtaaacatttactaatggcagattaatcaagcttaataaatttgtatcgcagtttacaggcggaatctataatttgttttgtcattaatctacgtttaatacttcaaatatgtgtcagtatacataaaaaaaattggccaactaactgaacacggcctaaacttgaaagttcaatccatccaacacatcataccgtgtagacagacaaatcagtctgaggaaaaaaacgagacatattatttacgcatgatcaattccagtattatatttttcctttataaaaataccggggaaatgctgctatctgggtgactggacgggggagcaaaatcgggtgctccccccggccccgctccccgcgcgcggccatgcgcctgcatgccgctggcccaccatgtgtctggcccaccacagtgcctgcccctgcaacaaattaaccatatattttggaaactctctattaagaaaatttggtttatttttttccaccaaaaatatttaacctagtgcactcacaatgtttcactatgtatagatctaatgttgcagtaaactgagatattccattgcaacaaaaaaacccacatattttggaaaccccctattaagggaattcgttttattttttgttccatcgaaaaatgtttcacctagtgtacttataatgtttcactatgtatggatcaaatgttgcagtaaactaaaacattctttcgctatttgctgaaacattgtttttatataaggtgaaacaacacccgatttaaacgagtgaaacattttcgatgtacttagtgagacaatttcgatatacctggtggaacatcgtgcaacatttaaaaaaaggctaagttggttatatagcatcgaaagttcacgtttttggttttatagcaccgaaagttaccggttcactttaatagcatccaaagttcaccttgttcccatttttagcacttccatcaatttttccgtccgtcttaatcgttattgatccagccacacacatgatatgatatttctacccctcattgacatgcattatacttgtacttattaggggtagaaacgtcatatcgtgtgtgtgactggatcaagacggacggaaaacgatcgagaattgacggaagtgttaaaaatgggaacatggtaaactttgggtgctattaaagtgaaccggtaactttcggtgctataaaaccaaaaacgtgaactttcgatgctatataaccaattttgccttaaaagtaattcaataataagctaatttttttcatcggaatatatccatgtgtaatcttgttttgaagatttaattgcaacgaatttaatggtgcaatcggatcatgatttggataagtaatttaaaagaaaaatcagtttaaagtagttttacacgtaaatcggaggcgattttactccgaattgatcgggcgcccgagcctaggctgccccaaaataccgtttaggagtttagcaatttgctaacgaaaaacaagaaaattgtaagtcgtcgttggaggttagaatggggcctaagccgaagtgtcagatttggagcccatctggagaacgccgtgcatgatgggccgcggtctgtcatttatgggcctatctagagcggcccatagccccgataccgggccaggccaaagctgactatgtgggctgcatggcccactcgccgaatttcccccctctctctctctctctctctcacggcccatgtgctcgcaattaccaaaactttgcattgtggcctcgtcctgtaaatgacaagggatcagatcaagcgctgcaacacaggcacatggagtaaaactacttcaatctcaaccaaaatttatgaaaaccggtatttaatatatttttaaaaatataaaaacaggtagtatttgaaatctggagggcaaaaacagagtataaaacctctgatgctttttacttgcaaagtgggaattgatcaagagttatcattgtgaagtggcaactcgtcattcagagatcgatgccaaccaacagctgctgttcccaatggcatccatccactctgcatgcagttgcagtatccctttccaagatttggatcatcaccaagagctcctctgcctatgcctagcttcctcatgtttctactggcccaagaaaagcctttttgcaaatgcagctagagtactttacttgactacctaaagcccctttgaaagcagagtcttcttcttcttcttcttcttcttcttcagttcatcttgtggatggatggatggaatctggattcccatccttgctccaagatgcttctttttcatcttttcccaactccacttttccattgtctttgacatcttcaagcaccttcccttaaaaccctttaaagctcaccacagtccacagcagcagcatagatccccctctaaccttatcccaatgcatgtgttttaattatagtactccctccgtttcaaaatatcaggatttctagtatttagtttttaatactcatataagcattccttctctgatttctacaattcccatcatttcaataattccaaagccaattagatgcttggaaagagaatctatgcaattcaaaatttaaaaattgacaactaaaatgacaaaaaaaattgccctaaacttagtattttctaaacaacctataaatccttaatactccaaactccctttgttttaaacgagacaacaacaacttctgagcctagaagtttattctttctaggacggatggtgtattttggaacagagcgagtagtaagcattttgttttgttttgttttctttagctatacctcttgtttgcagccagccatggcagtatctatctccaaatgattggcttgggtttatgagcccaagcttctgtctcctgcagtccatactctaggttccaagaggcaatgcgacaagtgattggtggcatgaggtaaagagaacagcagtaaggtggtgtttggttggagggactaaagtggggctaaactttaatccctctcacaaaaacaaaaacagtagtaaggatggatggatgcaatgtgtgttcagaaatgacagcagttggactctgaaatttgctgcaaaggtagctagtaggggatactcctatataaagtggtcacagaaagatttgtgccatactactccagtcaatgcagtgcagtactcatcttgtcatggaagttgggacactgcgtagcagctgcaggagtgttcaggtaaaaaggatttgagtcagagttcaggaattgttctcctgctagtagtacagaaactagcaatcctctgaattcgtgtgaagcaataagccaagaaagatctgccaagacaccactgcatatcatgatatttaatctttgcagaaaagaattggagatgaaaacgagcttgcaaaacagaaaagaaaaaagttcttcaatctgaaatgacttgacattgtcacacttcgtcagaattactgtactcacagttccatacttccatggcgatccattggccgatagcccgatatatcttgtgttgcaccgggatgaacaatacattggatggattgttcatggctccttgtggtacggaagaatcgattcgtaaagcctatactcgagaaggctgatctgcagctaggcaaagcatcaaacattgtacagtagaaaacaaatgcagagaaacttgagaacgaatgggttgggttcagaggcagccaagccaaaaacaccttgtagaagcaagagagaatcatgcagtagcatttcaggctttgattaacgtggcttagcatctttgatgtcggggaaaagatgggttgctaatctaatcaatgggattaaaacggtaacgagagtggttgcctggtcaggcaggttctgatttctgaaactttagtttgacaacaggtggcctacttctcgaagatgaccgtggaccagtgtttttttactgctagattactactgtactagattacactaatgtgaatgaggatgaaaaggaaaagttaatctcggaccatatgaggaatgttttactgctaatgcatcattcgttatctttctgaaaaggcagactctgaagaaactcgttctgcatcgaaccaaagtttctgatttgcaagtaatattcagtgttgcaagttgaattttttttagataatgaatgttgcaagttgaatacactaacacagtaatagatgcggataaattatataaaaccgccaaaaaaaatatttgaacctactaaaagagaagacttttaggcagacaaacaagtcagaacaatgcagtgacaagaagactagaaactgttcagagtctcctctgatgcagtttattcacatcggtttttacaaatgcatctgcttatgatgatcagcatctaaaaccgtcatcattatctaaaaaatctaaaaccgtcggagctcaatcgaatctagacctaaaattttcaagtcccagagagagagagagagagagagagagagagagagagagagcaatcatctcctctcttttctttaaccatccatccatttgcaaagcaaacaaagcaaagcaaaggaatgtcaatcgatcatagctaagctaagagctggaggatatgaggaacattcagaacccaaatccgaatcgacccaacaagagatatgatttttttccctaaaggaaattccctctcttttcgatctttccacttgcattttctcagctttgctgctcatcaatcagagaagaagaaacaaagttggatggtgctttactctaagaaccttaaccggtgacaattagcatcccgttggattcctaatgagcaatggccgttccttttctgcatcgctgcccacattgcattattctcctccttagcccccccaagcatatgcatgcaaaaaccgcggaataactaagggagggcccacatgtcagtgcgctctgttgctgtctacactagatacttacacacgcctattatagagacatgtctcgagcacattgtattctcagctgatagtgaatactgtagatctttttttaaaaaataatgggtatttcattgagtgacagaattacgggttgtttggttcgggaccttaggggttgtttggatgagtgccaaattttattgcccttgtagcgcgctttggcgacttaggactagttcggttatcagaagtcgggccatagatgttcaatctctgacaccctcttacaagactaagttattaatctcgctatacctttttaagtcattgatgtttgggatctagctagtttgttatagggtattttgtcgtaactatggctacaaccaaacaaatatttaagttgcttgcttaagctgagacgtggtaaaatatggcaaattatggacacaaaccaaaccgtcctatctttggcctcgtctgtatgcagggatgcacgtatgtaaatataaaagtagtggagtacattgtaaatcctggtgtacatggagttgtaaccatagttctacttttctttcttacttccatgtgatccggaacgattttccaagagaactgacaaaaaacacacacagcaagtagcagtagcactgtcatggatggaaccgaggcaaaattcagaaatccgaatagcaaacaccaccaaaaagtacacactcaacactggagaacaaaaaggaaaaacttgggggtaattaatcaaaacctcggtccatcgatcgatcagatcagaccatggaatttagagcagggcaatgcaggtaattaaattaaattaaccaatcaacaagatccatccatgctgacgatcttgttccagtacactcactgctcattggcccggaggccgaagagaagatgggggcaaagctcgctgggatcatttggtgtggaaaggcgagcgaaaaaaatgggaaaagaaatggcagctctaggactagtatcagctggtggtattgtatgcatgggtcggagagaaatgaaaagaggaggaagacgatgagggaggggaatattcttggcgtcgggccagacaaaagggatattcagaggacgattttggtcagggaaggcaggccaccactgaccaaaccacgcgtgtcacgacgacaaagttgcctcaacggctcaacggttagacccagggtttaacttatcactaatttttcgaagtgaaaacagctccttactgatttgccaaaagctgataaaaaaacaaaaatattcgatcaataccgtacgaaaaccggctaacataaaccgatttttcacaaacgaaaacttagtgcaacatttctatgaatatatacaaaactttctatgagacatctttgaatttccgatcaaatatgagccactatgtatagctttgtcatccttcttgtaaaacatttacagaggcggggctcctattaaaaacgtcagctgtacgaacaaatcattttatcgatggaccgcttaaaaaggtcacatgtatatatcatttccacgcaagattatatccactagcggcttcttgtccacctgtggaaacaaccattttcacatgcctttacttagaggcgggcacaaaacctgcctatagaaatgcattatttagcccgcctaaaaaaacgtttaattccgtatgtgtagggataagtgtacatatcagaacaatttttctaatgctacaaaacatgtaccgcaaattctttaagtgcttgctccgtaacatattataagttgttttggttcttttagtcaaactttttataactttgactaaatttatcgagaaacaagctgacttttgtaataccaaatcagttccattaaatataatattaaatatattttgattgtatgtttggtattgaaaatattgctataatattaaatatgttattgagataccgatgtcatatcttaaactttacaaaattataatggtatggttccaaattaccctatttttaataaatttagtcaagcttacagaagtttgatgaaaaaaataaaactacttagggtgtgtttagttcacgctaaaattgaaagtttgattgaaattggaatgatgtgacggaaaagttagaagtttgtgtgtgtagaaaagttttgatgtgatataaaagttggaagtttgaagaaaaaattgagaactaaaccaggccttataatataaatggagggattacatgcctaaaaacatgtagcgtgagtaagaccaatgaattcatgcatgcatagacaacagatgtgcaagctagtgttcctgtacacacatgcatgtattggtctgtaccttgtacgcgaatattcttgtctctggaccatgcaaatgtatatgcatgcatatatatacttttggggcatgtacatgtacggtgttcaggtacgtagatgatatacgtatatacgtatacatgggctagctatacgttggatatatagcatgcagtacgacgactgcgaccatgccgttcgtacagagagagagagaatccatggaaaaggtagggattggagtcttgtacctcaagattgccccaagaaagcgaccaaccctaattattgcacagggaattcgatgcactaaaacacacacacacacacacacaacacctttctcccacctcttcttgtgtgtatgaactagctagagagagaaatcaagagagagagaatcttcttagcttcctccccaattcctaaaaagccaagagtagtagcagcagggagattctcacattctccttcccttcacccctctcttctctctctctaaaggacaccatgtcttcctttgtggtgtccttttgtgcgtgtgcttcatatccccctccaaagccttaagatattccttgcttgagccatgctgatatattcccttgtgaatgcaaagtgtgccagtcctcctatctatctagctatctctctatctacacacactcactagactaccatatgtgctataacagtgccacaacatgcatatacatgtacataaacacatgcatgtgtgaagaagaagagcacagaagaattttggagcttgtgtgtgaagggatgcagctcaccccttttcaaagcaaagagacctagggcatgcgatcttttttcatatctttggcttgaattatgtgtgatatatgcttttagtactgctttacccatttaattccttcctcctttgattaatcatgtaaagaatcttcacccattagaacatcaaccagtaaagagagagagagagagagagagagagagagagagaaaagaaaagttgattaattggcccttgtctgttggatgtgagaatctatgaatatcggtatcgataattcccggttgaaatttaggtactaatatagatttcttttgattttttgtaatgcaagttggggagttgggagagagagggtggtgtgattcccacagctaggtatatctggtgattatccccattgcaatatgctttaaaacccaatattaggtaaaatgtaaatattccccaagacacctagctgggttctcttagactcttgcaaggttctctttggactactttgagctttgagctcatctttaattcgatcccttgaatcagacgcaccccggcgttaagctttagttttcccctttttccctgctgcatttgcccggtagattcttagatttgttgtaaagttaaacttaccacagaaatgaggcaggcagcatcttgatctgtaaaaaaaaaaaaggattaatggcaaagaaagatacattgagatcatagcagctgatcagctaggctaaaacagtgtaatttgaacaggacaagaagacgtggctaacaaaagtttcagtttttcagtcacgcatgcatgctgaaaaacaaaactgcatgcatgcagtgtacaaacactgatcagagatattcagaaagcaggcagtacatatttgaatggagcagagagaaatctatatatatatatatatatatatatatatatatatatatatatatatatatatatatatatatatagagagagagagagagagagagagagatctagagagagaatgcaatgcatggtgcaatatatgcaatatggacccatctggtcgtaatgttaggagatatgttgattcccctgttggtacgtagtacatgaaacctcctgcatgcagaggaggagcagaattaacctttttctttttgtttttgtttgcctttgatctttgcaagaagttaccatgcctttgctttatccccctatctctctctctctctctctctgatctctcactactgttgctagctagctatagctgtttagctaagtgtatatgtgcaagatcatacaaagctagcttttccttttcctctaaatccaactttattctcctcttccttctcccaaaactctcccttaaaaagaagctgattccccatctgatccctcatcaaaacccttctcacattcgatctcgatcactcacacttacactcgcagtttgcacagctacttcatctcaagtagtagtagtaatatactagctagatcggtcggctatttgctgtagctagctagcgtgagctagcttggtttgtagagcttgtatacttggagggaggagatcgatagccatggcttcttcgtcttctgacctaaccctagacgaccaccaccatctgacggcggtggctgcggcgtcggggcaggcgacgcagaagcttcaggagttcttgtcacgtctcgaggaagagaggctcaagatcgacgccttcaagcgtgagctccctctctgcatgcagcttctcaatcatggtgagtaattgtatgtaacctaagctaaatcgatcgccatggctaaccctagcgaggattggtgtgtgtttgcagctatggaggcgtacaggcagcagctggaggcgtaccagatggggagccagcatagcgccgcggcggcggcggcggcgagggcgccgctggtgctcgaggagttcataccggtgaagaacatcgggatcgacgtcgtggcggcggacaaggcggcggcggcggggggcaacagcgtgtcgtcggagaaggcgagctggatggtgtcggcgcagctgtggaacgcgccggcgtcggcgtcggcggcggacacggcggcgaaggggccccagacgcccaaggagcactcggagcaccacccgctcgacacgagccccaagctgatcaccgcgctcgacggcggcggcggcggcggcggcgcgttcctgcccttctccaaggacaacgcca

SEQ ID NO: 60213 - DNA, 50426 bp, Oryza sativa
cttggggttctaacatggttagagttaggactagggattgcttagccatgcctagttcaactagttcacattggggaaaatcctattaatgattagactgtcggttctaatggttttgttgggttagtgacaccgctttggtgttggttaattaaaatgaatcacatggtgggctgtgggtgcatggttttgctggtcgcacccatggcagttaaggaccggttcgcgggatgccctgaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttggctagagggggttatgtgaagggtcctgtcacggcctctttccggtatgtcgtggtggcatgtcggcacacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaaactggatagttttggtggagggttgggcctgttgcaaagtgggatagcgttggacagtggatagttaatattaattaattattacaactgtttaatctttcaacttctgtttataaatgctcgctttatgcaaatgaaccatttagctcttctttgatgattccctgcatcatgcctctattccggtatgacttgctgagtacagtgggtagtactcagtcttgctctacttttcccaaccccagagttcgagtatgtgtcagatgaaggtttctccgaggagtaggcttcgtccgtgccgtcgaggatgcctgtggagtggtgatcccgctgcggttctagtcaaggcttagctcctgttgtctctctttctttccgctgcatttatgtaagacttttatgatgtttgtaagacgtggatctgaatgtcaacattgtcgtttttgtaccccggctggtcctggacggggattttaatgcacattctgcttgaaattctattcgggaatttctgggcgtgacacaaggtatgggatgactttgaagaattctttgaatcacgcaatagcgcgcaggttcgcatttctgctaaatgcaatcactgcaaaaaaaactttgtctgctcattcatctggtggcactagtcatttgcttagacatctcaagtcatgcaaacctagaactgctagtaatttgtctcagtctatgcttaagtacaatgctgatggtactgttcgtccatgggaatatgatcctgattatgctagatctgagttggttaaattgattgctgtagaggatctgccacttaattttggtcaatctcctgcttttgaggagtacattcagaatgctcataaccctagattccatgctgtctctaggcaaactattagtagagatgtttttaagtactttaacaagagtcgtgctatgcttattgagaggttcaagtctgttaactctgttgctttgacatctaatatatggtctggtaatgctaaggaggattatttaagtgttgttgctcattttgttaattctgattggcaattagagaaaaggattttgggtctggtgctgattgatgtgaagcacactgctgagaatatttctaaacgtgtgctttctgttgttgaagaatatggtttgactgataaggttttttctattactctagacaatgcctcttctaatactaaggcaatggattttctaaaacctaagttgtctgcttatgttggtgatttatatttgcatcagtgctgtgcatgtcatataatcaacttgattgttaagactggtctagaagttttcaaacacatgcttcaagattttagaacagccatctcatttgtgaatgcatctaatcagcacattgctttatacaaaaactggtgtattgctaagggtgttcgacctcgtaagtttggtttggacatggatgttagatggaatgcaacttatctaatgcttaagcatctcttcccacataaggagcttttttcattatttattgaaactcattatcctagggaaaatggtagactattgcttattgatttgcactagacaattgctgaaactgtgcttttattccttgaacaattttatgattcaactgttattttgtctggtgtttattatccaacatctccattaattatgcatcacattcttgagattgctggacatcttaacacttatgagaatgatattaactttagaaatgttgttgttcccatgaaaagtaagttcttggcatactggtctgagattccatttctgtattcatttgcttttatcttggatcctagggctaagatcagaggttttagcaatgttctataaaatatgtcacaaattttgacctctgattactctacttatttaactgaggttagggctgcattgtctgacatttttctaagtatgaaagtaagtttggtgctgtgagattgcaaagaacaaccccaggcagtactgctagtaagaaaaagacagcctggggaaagatttttggtgccagtgatgcacttggacatggtgctggtgccagtccagaacctggacttggtgctggtgccagtccaggttctggacttggtgctggtccattttccaggagaacttctgctactgctttgattcaagctgtttcttctaatgctaacttgaatgcctctgagttgtctgcctatcttgactgtgacattgtcaaccaattcgacgatgacttcaatatcctaaactggtggcatgagcacaaacacacatatcctattatgtccatattagctagagatgtcttgactgttcctgtttctactatatcgtcggagtctgcttttagcttaactggcaggatcatcgaggagcgacgacggcgtctaggtcctaacatggtgcaagctttggcattgatcaaggactaggtgcaggtagacaagaagttgcagcacactgctgagaatgtagagcttataaaatcatttgagaatttgtgtcttgatgatgtaaccagtggcagtgccactggaactggatgattgtattggacttggactttaatatgatagttagatgaaagctgtgggctgcactcttttttcctttctagggttttctgacgaggtgtgagtttttacctagaaaggtttttaatgaggcagccattgcactacacagctactattatttttgaaagtgtttgtgacttgatcacttgagtttgaactgtgatttgtgaactattagacttagtatttgaaagtgttttgtagatttgtgacttgagttgtgaattgtgagacttagtagttgagttagagaattgaattgtgatattgcacatactataacttgtgaattgtgatattgtaatctgagacttgtgatattgtgatatgttaacttgtgaattggatggttttgtgctgatttttgtgatggacattgcattttcgatatgtatgtgcaacactgaagtgaacaagtggcagttagtgtttggcgtgcctgggctagcccgggcacggtgggctcatcgtgccgtcgggccggcacggcccggcacgactgctgtcgggccatgcctgggcctaaggttcagcccgtgggcaggcacggcacggcacgaagtgctaggcgtgccgtgtcggcccgatgcgtgccgggccgtgcctgggcttgaggttcagcccgtgggcaggcatggcacggcacgaagtgccaggcgtgccgtgccggcccgatcgcctcgggccgtgcctaggccgggccaggccgggcgggccatatggccatctataactatagcaactaaattgccctgatatattaggcaattctcaatacaactcacctgctagtgtcacaattcaagaggtacttatgtcgcctattataaaatagagtacacatggcccatgctagaagttatttgtgtctagaccagtagaagtctacgttggctcggtccctaaatacatatacatcgcaaagtgattatttctttattgttaactttcaaaatcaacaatttgtttatgtagcattttaagtgccttgcaaatttcaacgggactgtaactagtaccacttccatacaaaaataagttcactttatatatgaacctggtataggctatatctatatttatgtacaaaattgaagttattgtagaacggggcagtaaatatttttgagctagggttcaactatctctctttgtttttagttaccatgtgtattacatctgaaaaaaaaaataaatactccctccatcactaaaaacaataaatttggacttagttgagttttttttttatggaacatataaagtacctggttatccccaaccgtacgaatgcaaatgtcccaagtaccaattaaaagtaggtaaaattaactccaaagaagtggccaagaactcaaaaaccccgcactcccctaattaagacacaaaatggggatatgagactttctaattaagcaacggacctaatgtagaaaaaggtactactcgaactagaagatgtaaattccttcctctaaaccgtacgtcatccatatatagtgggaattagaaacggagcgctagctgtacaagttttcacaatttgagccttttaaaaaactaattttacaaatgaaccgccgccaaaacttattttaaaaatgatcctttttttcagcgccaaatcatgtggtgttgaacttagacacctcagcgccacatcaactagcgctgaataccgtaccaccgcagatgggaggctaagtcagcgtgccaacgtacattcagcgccacacgatttagcgttgaacagaagggtcagttttgaaataagttttgacggcggtttatttgtaaaaatagttttgcaaagggttaaattgtcaaaatttgtgcgctagctgtgagttaactagccactctatatatttctgagggtgttttttttatacagctttaaaagttctgggtgaaaaataattgctttttgtagttagggagaaaattagtctttgagcaagttagacgtcaaaaatgtactttacccaattaatagcatcaccaacaacattggctaaatttcatctccaaaaatatgaatttgagaatcttaaatgaaatttgatgtgtaaaaatagttatcttctgttaaaaaaattgggtaaaattaacccctaaaaccaaaaggtgggccctatatgaaactaaccaaaaggtgggccctatatgaaactaacataatatcgtacagacgggcacctgttaatcagtactacagttgtacaaactacaacgtaaaatatgacaatgaaagtagatattgaattaaattattgtgatcctatgtatttttcttccaacacctaaattaattaaagtggactatcatcgaagggcaagcatgttgcccgtgtacgttcagattaacggaataagcaccactacgtactaaaacagattcttgcgtaggatcggagacgagagacgttgaaatgttgacatcctatcatgatgatcccccttaatagctcgggctggtggttgccacttgcctgcagccctgctgataaagtcaggatctatctgtaatctgacatccgctcacattaatcccgtgacagagatctgcagacgctcaacactcgcataaaagaaaggcaagaattttgccggcgacttgcattggtgtacgttgatcgagttagttagctgggctacactaattggaaatataattaagcacatgtgggtacactaaacatgcatgtatatcaatagatccatatcatatgtatatgatttatacatgtatacgacagcactgcatgtgaatagatcaacacgaaacatagtcgaaacgtactgatggtttagttctaaaggacgcacaacaccactgctacaaaatacttcatatcttataggaaattgctcgtaggtaaaaccgacacatataaactttttctacatccgtgtgatgaaaaaaatatagaactagcatttttaaacactatagatccacatccgtgatgaaaaaaatatagaactagcatctttaaacactatggatgccagttcttaaaaaaaaaaagggcacttatacttataagtaccgacacatataatcctatgtatatattcttatataattcatctcctccactaaatataattaatgctattctctcttttttcattaagccacatcacctcaattatttttagtctttggatgataggtctatggttcaaattgtctcttttttcttctctcataacactatgcgatctcacttgtttttaggatcaaaattcataaatatcaatttattttagttttaataatcatattgcatcttatttgtatatattatgaaacttaattttccacggtaacgcggcggagtattcatctataccaaaccgagccgagccggtgaaccgagcgccatccttatctactcccatccagcgctcgcgtcctatccatttctctcgtctctctccctcgcgtctctatgcctcccctctctctcgcacatctctcgcctggcgctcgctctctccctcgcccggcgctcgctctctctcgtgtgtctctctgcctcccctctctcttgcagcggctgcccagcgaaggcggtggtggcggcggcggcagtgggctccctaacgccagatccagcgagaggggaggcagcgctctccccttcgccagatccggtgagaggggaggtggtgggtttcccacgtgtgttcctttagttctcttcacacgcattacttaggccatgcttctttcagcttaatattattgtaatctagattattgacccagattactataagttggattataataagctgacatagttgttagctgtttgtttatctggattattagctttttgttagttgttagccacccaataatttaaaaaagcacctttagagtggattactagattatagtaatctggcttatagattgtaataatttattataataagctatatgttcgttgcagcttactcataataatccagattataataatcataagctgaatcaaacaggaccttaattgattagaagagcattaattattttaaggtggtttcacatgcatgcatgtctcccgtgggctaaagacccacgtataatttcatcatatctagacatatgtactataagcattaatttatgtgtagattaatccggctaataaaaacacaaagcaaacaaaaagatacaacacattcatactaaagttacactgttctatattttgcaaacttaggccatatatatttgtgtgcaagttcaagtgattgacagataaaaaaaatagacgactaacaaatagcaaaactgtaatttattttaatatcatcaagacacatcagcaacaacttgtatatatggtcaattaatatgtaataatgtattagtacccggcgtacaagtatatagatacacttgcacatacatcggttggctatatatataaccgatgagtcgatataaaattataaattaactcggctagctagctagatagagctcacggccggtcactactcaccatcgagaggagagcaaaaataattgagtgatagctgttagctaagctacctagcatcatgcagggaggcgccaataataagggcttggtatgcttgatcgccgccgccgccgtggtgttggtattcgccggcagcagcggcattgcggcggcgcaggcggcccgggctgaagaaggggttctacaagaagagctgccccaaggcggaggagatcgcgcagcgggtggtgtggaaccgcgtcgccggcaacccggagctcgccgccaagttcctccgcatgttcttccacgactgcttcgtcagggtacgcacacaaattgaatatatccatatactggccaatcatatatatattcccctctgtagattataggtttgactgattaaagttaaactgcttcaaatttaattaattttgtagacatatatataggatgtgtttttcccctttttcccaactcacatctctcgttttccacgcgcacgcttttcaaactgttaaactgtatgtttttttttacaaaaaaaaatatatacaaaagttgtttaaaaaaatcatattaatctattttttaaaaaatagttaatacttaattaatcatgtaataatacgtgcttcgcttgggaggagaggttcccaaccccttctcccgaacacaaccatagtaatatttacaacaccaaattagtttcattaaatcgataattaaatatatttcttaatatatttgtctaaattagttttagatcgataattgaatatatttttatgatatatttgttttgtgttaaaaatgtttttatttttttttaaacttggccgaatttgaaagtcagaacaagttataatctgaagcagagagagtatatccaaacgatacaccatgcacaattgtattcttgatgtgtgcaaatggatatataatgtacatgaaggggtgtgacgcgtcggtgcttctggactcggctagcaacacggcggagaagaacgcggcgccgaacctgtcgctggcggggttcgaggtgatcgaggaggtgaaggcggcggtggagcgggagtgcgccggggtggtgtcgtgcgcggacatcgtggcgctggcggcgcgggactcggtgtcgtaccagtacaggaggagcctgtgggaggtggagaccgggaggcgtgacggcacggtctccagcgaccaggaggcgctcgccgacatcccggcgcccacctccaccttccccatcctcctcgcaacttctccgccaagggcctcggtctccaggacctcgtcgtcctctcaggtacgtacacaatttcttgcattgcttgcatcgatcactgaagaagtatacgtacggagactaattattttcttagataatgggcagttcattaagactgtgttcggcagtgcaggatgggaacccattttttttacacgcaaaacggagtggtcttttaacatgattaattaagtattagctattttttttaaaaaaagatcaatttgattgcttaaagcaactttcgcaataaattttttttaaaaaaaacacactgtttagtagtttgaaaagtgtgcacgtgaaaaacgagagatttgggttgggaagatggggtgccgaactcagcctaagtacattcatgaaagcatccgttttctgaacaaaactgatgaactcgaccaaaacacaacgacgcacacggaagaagaataaaagaacagtaccggccggtactccccctattacatcttaacttgaacaaactcattagctaagtccaagatggttacgccatccaaaattagaccacaaagcacagggacaactaatcattggggttgatttcttgatttatcacttcagcagtatcaaaattgtttaactagctagggcctattttgtttatttgtatatgcctagtattagcctgtaatatgttttccaagttgtcctagtgacctagttcacgacatttctcaagaaaaattctactttgacatttcttaatgcaaaaagggaaataattttaccatctttgtaaaggtaaaaaagataacatattttcgaattgtaaaatttggtatctactaatatctcaaggtattaaagtttttagtttaaaatcttgatacatttagttactttctcaagtaaagtaaaatttgtaaaaagaaaaagaaaaccgtccatatgaaaggttgcatggatttgaattgaagcatgttgattaaagacaactgttcccgtagtgtgaaaacaaccgcttgattgcaatagcccagctgaaaatgacataattgtcggtgatggggcaaagaattaattaaacttcaccacaggccacatgcacgtccggttaatgcgcatgtgagccaaaacagtatacgaagatgcaaccaccagattggatagatttagcttcaattcggtaggtaaaaaaaaaacaatccttgggaaagtaatcccagtcaagatagcagctttaggaattaaaaaaattcaaatcaaacgtcggataaaaaaaattataccaaacatgaatgtttttttattcatattcaacattattaccacagtccatttttggattgttgtaagacggactactcaccgtactaaagtaggatggatgactgcagtacttaattagaatagacggtaccgcttagatagcagacaatcctcctaatagcatgcgacccatacttagagcgcgtgaaactcatcacatgttatcttgagcggtatgttactagaaagcgtcggtttctcatcagtgttactatcatacagctgttcaacttaaaagctactcgctctgtggttcgcatgggtcgtgccactatctattggacaagacccataaacataaatccttcgaatagaattacacaattttatacatattctctatgttaatataagtccttgtttttcgcaaagtaaatatttgaaaactaatcttaatgaaacaagtcaaatttaattttggaactgatggtacaagagcatgtaaggtggagcaacttagtacatgaatatgtaaaatgattcgttcgatctatatgaacttttttggatcgtgtggatcaagaccaaaacaacgtactatgactaattttgtttagttgaactctgatcgattaatataggcgggcacaccatcggaatcgggcactgcaaccttttcagctctaggctcttcaacttcaccggaaagaacaaccccagcgacgtcgacccgtccctcaacccatcctacgccagattcctccaggtaattaattaacctgttaattagtggagtaatggctaatctctgcagtaatttaatctcatcatgtcttgcaaaattcagaattaagatcagtagctgcaaaaaggaaaaaaaaaagcatagaaaaatatgtactacagcaattgtgtgtgtgtgtgtgcaagtgcaggggcagtgcaggcgtaaccagcaggacccaaacgacaactcgacggtggtgccgatggacccgggcagcagcgtgtcgttcgacagccactacttcgtgaacctcaaggcgcggcaggggatgttcacctccgacgccacgctgctcaccgacggccgcgccgccgcgctcgtcgacaagctgcgggaccccggcgtcttcctcgaccacttcaagaactccatcaagcgcatgggccagatcggcgtgctcaccggcgccgccggccagatcaggaagaggtgcaacgccgtcaactcctagctagccggccgctcgctagcttggcttattatcattctctaagctttttagctcttacgatgaaaacatgcgtcatatccgctgcgcgcacaaccattattagttgttgtatcctaattattgttatgcgtcgaatacagtaaaattaatgcccacgagttaagtacaagaaacataaaaagattacagatatatatattttattggtaaacagaagtactgccagtatatactggtagtacattgtaccgtaaaagttcaacccagccatcccttcaaatttcaaacctacacctctcactaatttcccctccctctagccgtcctacgccctccttgataatccctctcgagtccagacctctccctccacttaccctttcttcggccacccacagcctcaaccccacactagaacccttatcgatggggcttgttagcagttgtcgatagcgctcatacgggttttgatagggttgattagaatccgctcgattggaacggacgtttgcaaaaagcaatttcaaacaaatttcttcttgtacaacgaatgagataccgagatacttgctcccccatcatctagaagctagtattacgttacgaaaatgcttatcatcatacgtccgataaaggaggaaaaattggacacctcaactcaatggagtagtagtatagcacaggtgcatgacaactgacaagtgcaagcagccaatggagcgtgcatgaaaatcacatcgattcaaaatttaaatgatctttctcttaaactatttatcagaattatgaactaattataccattggatttgttataattaactatttataacaagatctcacatgacaatattctgatgatttttatcacataatgttattataatgtttcaatatgtttttactcatatttcactaattcagatgtaatgttgcatgtggtctttttatatgctttatgctttagtaaatgtattttatgtttcaaaaaaagtacaacttgacgcttcaagagtgatataaaattttaacaaaataaaatatttgcaaatatgttgcaccatatatatttttatgtttccctaggtatgacctaatgttttatgtaatggtagttattgttgtagccagtaatttttatatagttattgttacacgtgatctatttatatgtttcagcaaataaaatttttatgtttcaaaaattgcaggttaacgtttcaagaatgatataaaatttaaacaaattaatatttacaaatatgttgcatcatttttttttagtttcagtagtttgggacataatatttcatgtgacggtgcttattgttgcatttagtaatttttataagttacatctctctgggttgagttatccgtacaagtgataaaacaatattatggtgcaacaaaaggttgatttttccaaaacacatataaaatgttgcatggcaatatttcgatatttcaataaatatttttctgacgtttcactagtttatttgtgaatgttgcacgtggtattattggatgtttcagtaagtattttctaatatttcactaattcatttataaatgttgcacgtgttgcttgggatgttgcagttaatattttctaatgtttcaataattataactcgttgtttcacatataatatacaaatgtttcaattagtataggtggaatctaaaccatactccctcaacaataggtggaatctaaaccatacccctcaaccataaaaccgggtaaaaacgactcatccaactatttaaaccagtgcaaaatgactccctaggtggttttgaaggtggttttcgctgacgtggtgcctacatagcacggttgacttggtcttaagctgacgtggtgcttacgtggcattacaatgaaaaaaatgtgagacccacatatcattcacataaaaatttattgtgggacccactgaccatgtgggacccatatatcctcctgtccctcctgccctcctttctccttccactccagtgttaatgaaaaacacgaggcctgggagatcggcttaactccagtgcaggtccaaaactcgccttcgggtatgctagcatgccagttgatttgatcctgcaatcaactagaaataaagacaaagaaaccgtggttaaatccataaacgatagccgatcgactaagtgccgatgacatatcgtttatctttgagccgatgtcatatatgcatcgatcggcagttataaatagataataaagaactaaatctactcgatcggctgtagacattaacaatatataatcgttatgtcgatatatacttaaatcaagtaattgggatagatcggtcgccatgccgagacagtataaatcacttagattgaaatatatactaacaacaagactatatatgttcatagcatacccgatcagatagatctagcatgtatggctaatactccgataccaccctatgttaagatattaaagcaagcagaatataccaaacaaaagcctaatatacttaaatgcaataagattttgacataaagggtagatttaacatgtcaataaagcatataaagcaaatatagttaaatcaggtaagatcggctgaaaccccgatactaccctaatcggcaaccaagaagcaggctagagattgagattctaatcatcactcataagatcaaactcaactgatgcagctataagtatgaaaagaaggacaatatctagataatcaagccattggaagtttcatagagtggtggatatcatatataatctaagccaacatcgatatttaacctaatcggctgccctctattgatagatgttagctgagtgtaggttagatagtgatattgccagagattatataagatatatgataactcgacgaattacataaacaagattagagtatcataaagatggaagcactaatcccaagaacgcaagccgtcataacaagttttacctcttgttgaagatcgaaatcgatgcagctcaacccgaaagcaagaactcgtcgaaataaaactaaagtaaaaaagggtggcgatgcgccgagattgtattgaacgtgtgtgttcctttgattacatagggctcggtgtctatttatacccgagaattatccaacatgtccatatcggacaagactcttatccttgacaaactctaagataccataagtctttgcggcagacttttgccaaacatatctctaaggaatttatataaaatatcctaactaatagatacagtcgccttctcaggactctatccatgcgtggcaatcatcttcaagcatatcaactcgacccgatgtcgtacaccaagtcgtattgtcggaattggctgtatcacctaacccagtctgactcggacttagccgatcccaatcgtagccgattcgaactccagccgattcttactctgtttccacgacgatcctcatctttgattctgcttcgatctaatcttcttccccgatactgatattaccaaatttggtcgttaacacatgccccccaagtccggaatatttggtaatgtttcagatttgccatatatcggctccgagcaagattcgcactctgccgttttctgaccgttattccagcgctttaaatactaaccgttgctcctgaaaaatcttcatcgccgaagacaactttgtcctttctctctccggcgatttctccgacgctcaaggcgatccccaagcgactccatctccggccagatctccgcccacggcaatgtcgtcctccgccagcccgtctaccgcgccgtcggccgaatacgctgaggtaagttttcatcggctagatcttctcctttcgcatcagattgatttcccctttcctcatcttgttttcttcttctctattcttgttcgcatctgtagcatctgtccaatctgtttgcgattccaagtctatcgcatgagggacattatttccttggttcgatccgcaatctagatcgcactgacttcatcattggcgaaaccaatagaatccccttcaaattagccaaccctaatctaggtcactgaaagaacaccttcaagtcttggccgtctctcgagaaaaccacccctgagaagagttggacctcatggtacaagcgtgtatcgaccagcaagcaaacacattgggatgaaattggaatcggccaagcacttgccctcaccatatcaaattcagccaaagatgaacccttaatggccatcgccacctacttctggtccaatactatcaacgcctttctgttcaaccaagggccgatgacaccaactctgatagatattactatgatcactggtctagatgtatcctcatctgctaatcccatgaacctgaacaccaagaaccaatacgatttcaggaccaaaagcataggtggttggtctggttatgtggcagcatatatgggccatagatttgttactcctcgagagcatgtggcatttttactcatgtggctagaaaagtttcttttctgtggatccagttgtggccctacaaccaactggcagtttgcagccaaagctcttgagtcaaaaagagaatttcctctaggcaaaatcctcctcggctacttatacaaaatgttgaacaatgcatcggccaaaatagccgtcggctcggtggttgaagcaggtggaccatggtggctactacaatcttggctcaacttaatggtcatgaaagttgtcaattggccatcagtgacagaagccgaattcccaaggctggagccgatcacagaagatgatggagaagaacgcacccatcgcagatgcatgttatatggagagtatgcatccacaccagccaatgctggagcaaaactatcggctgaactgctcaaggattggttctgcagcttttatgaggactcagcagaccttgagctcccgtcagactttagattttaagatatcaatcataaaagataccaaaagtctagggaagttttctcagttgcaatcagcccatgcatcctttctatcggcattcatcagggaagaaacattcaagtctcttatgaattctatcacccaatgagctcagccagacaacttggaatgggccaactcccaatcggcttatttttcgccgataagatccagtgccgaggggaaatttcatcaaccttgatgatggatcgactgctcaatctccaaggacctcctctgggcagcattgagaatatcgagctggcgggattcaagagcaaaaactttgacatatggtggggtgaatggaagctgcatctattccaccaaccggcctcgatgtacatgacagatctcttccctgatgttgtacctcaggtaaaccttgtcatcattaatctaaacaattgtcagctgattcataacttgactaatcttttgtttctgttttgcaaacaaccgaatcttcccctccacatgaaagcaacagtgacagagacattgaatatgccccaggtctgattcccaatggaggtgggccatctcctcctatcatcggctatcatgcccccaagacttcaactcttctccaaggcctaatcagagaaccagccgatgcaggcaagaagagaagaactaggtcatcggctgtggacacattggctccagccccaaagaagaaggccaaactcaagaagcctaaaccaaccgatgacctgcctgccctagatccatccattgaacaagctctgggtgaagaagaaatcggcgaggatgttgatcaagccacagataagtaagcgatactgaaagaaccccatcggcttcacctaagcaaactcctccaactccttctgccccattccatttttcaaaggtaagcagctttctttttgcaatcccttcacttatagtcgattactcacagattttatggttgcagaagaagaaaattgctataaagaagaagtcggcagcaccaattcccaaaccggctccaccaataagatattcttaattcttttaatagtcgatctcaaccgattttccgtaatacttatctttttgcagcctcctcctcctccttctcctgttcagcaaccatcaagtgatcaaactccatcggctgcaaggggtcatcatgttgaagaagaagtacaaccagctgctcttgccattccagtaagtcttgtttataaaactcttgaatcagccaaataactcatgttgagactcaattttttaaattccttcttgcaggccttagccgatctgttctctttcgatattaaagactatcttgatgaagaaacagaagaagacactactagcaagtctttagctcccttgtctgataatgtgaagaaaacccttgaagacatctctcttcggctagaggcatcatcattagacagcttggtggtaaactgtgggccaattaggactcggtcacacgaggttcaagctctaatcccaaatgagctagtcgatgtccttacaccagctgtctaccttgagcagcatcaattcaagctggagaaagccaaactaagattagccaaacgtcgggagcgcaaggacattgtcacaccctaaaaatcctaaatatgtaaattgttgtttaaatggaattattagaatttatttttttaaaagcctagaagggaagatctaattttaattaataaattccaatataaaatggggccagataaaatttcattaaatactttgcttaattctataattcctagatttttctgggatttatttgagctaaggaagtaattttaataaatgaaattgcatttcatggataatttaaattgaaaaaggtttttaaaaagtctcttttggctttgggccgaaagtcggcccaaaaacctctctctctctccctcggcccaagccggcccagtccgcagccgcagccgcccgcgcgcgcgctcgttgtcgctgacaggtgggtcccacctgtcagtcttcgtcttcctcgcgccgccgccgccgcccgaaccctagcgccgcgccgccgtcgtctccttccaaatccggccgctcctttccttctccggtgaaatcaaaagaggggaaatgtttcccgagatctcctctaccttttcccttttggaaacatcatctatttcggtttggaaatcggtggattcgagatcgaatcggattcctctctctctcccgaacccgaagtttccttcgcgtcgccggtcgccgtgggccttcgccgccgcctccttgcccctttaaaaggatccccaagcccgccgctacccgtcgccaccctcgccttcgtctctcgccgtcggaagagctctagcgccgtgtgacctagcgccgccgtcgttcgccggcgagcatgcgcgcccgagtcgcccgagccgccgccggtggtgacgtcatcgccgacgtcatcgtcgtcgtttctccgtgagccgccgtagacccgatcgatctcggccgtccgttttggatggatcaatctcggccgttcgttcccgtgaaccgccgccgtgcgcccggtccaccgcaaaccctagttgctgacgcagtaaaccccttttccttttcaaaaataactcattattgcgtcataattcaactaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgtttttggtgtttttgctcttttctgtttagattccgacgtttccggagagtccgtttccggaggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagccctttttgttcttgattactttattccttgataccttgggttgttataacttgactagttgggcaatatatatattggttcaactagatgtgttagatataattgcttagccatgcttagaaatattagctcactaatgggatgaatcatatatactacattatttaatgatggcttaatgatagttcacgatggtcaatcgtgattggttaattaatcacttgccaactaaaacctgatgatggtgggttgtgagcacatggttttgagagtcgtgctcatgacaattaaggaccggttcacgagtttcggttgtgaaacattaaccgtgccaaccacaagccagcgtgggcaacggctttaccttttgtatagcatggttcattgtggggcaccagactgagaaatggcggagataagcccacgggggtcgctggggagtccatgccttgtttacaagggggtgattatgatctaggaatggtgcgctgcggtggattgtgttatgcaaggggtattgtcacagctcctttccgaggtaccgtggtggtattgaggcacatggtgacatgatgtggggttgtgtcttgtgggtacagtggtacacctcttatcagagtagaactattcgaatagccgtgcccgcggttatgggtgggtctaacaatgtctttcgtgattagtttcacacttctcaccataataaaagatgctataactggtaataatttgattagctcctggtttggagatagaattgtgcagccgggatggttgttcagaatggttgggcctatgcaacagggtatattgtatagcgttggattaatattgtttaattattacttaactgttttattaaattctgaaatgtttactaaatgctgtttatgcaaatgaaaccctattatgccatcctttgttatcctgtgcacttgcatatttgctgcgtgacttgctgagtatgtcatatactcaccttgcaatcattcatcagaggaagagttctacaatgatgctgatggtgtggaggattaggtgtagccctggtcaagctgcctgtggagtggagccgtctacgccgtttatctttttttttccgctgcttagatctttattgattgagaggaactatctacctctgtaatgacattttattcgcttattaattagagtaataatggtactctattatcaatttgttattgtgtgcctcggctgattcctggacgagggtttacacacatgtaagcgtttggaattttggatagaaattccgggcgtgacagacattgaagccacaatccaagccaatcggcagcttgtgcacgaagagaagtccaagcttgatctgctatccgagggcccgatcaaatccaacgttaatcggctcgaagctcgcaagattgagctcttggcccaacttcaagaatgcaatgccgaactggatctggaacacaaaaagctagccgatctcccgcgagtcgttgaagaacaaaaggcgaagctgaaatcggccatcaaaaatgtcgctgatatgaccaagtccttgaaaatcatccctggaaccgacgctcaagatgcccaagctattgaagaagtagaacaaattaggcaaagagctatatcggctatccagcaatatttgtctcggtgactttctgtgtaatagatcttataaatttttgtaatcggctaagatactctggtactttattgtcttgacaaacctttgtgccgattaatataacttctaaatttgctcaaaaattttcatttttcgtatatatgtgcccccctaattttacaacgtcaaaagcattgacaaaattataaaaacaactaaaggcgatataaccatatcggccatcggtacatcggcaaaccacaaccgattacaatatgaaaaacaactaagggcgatataacaatatcggccattgtacatcggcaaaccacaaccgatttacaatatgaaaaacaactaagggcgatataacaatatcagccatctcaaagcgatgtagacacatcggctgtcatgtatcggcaacatcagccgatcatgcattaacccaaacacttgggtaatatttcttcaaatacttgccatttagtgctcgtccataaacttctccatcgagtccatgcaacatgtaagctcccttagacacaactttgtggatttggaatggtccttcccaattcggcgaccacttgccgaatttgctatctcgagtcccaatcggcaaaatcacttccatacaagctcaccttcagaaaaagtcttgggtaccactttcttgttataatgtcaagcaactcgttccttatccttggtaacccttgcaagggctcttaatctagactgaaccaagtcttccctttcatcggccatgagattataatactcatcaactgttaaatcattttgcaattccgttctccttgagccgattctaacttcccatggtaaaacagcctcatgtccataaacaagcttataaggagggacttggatcgatccatgacaagccatccgataataccacaatgcttcggccaaccgagtatgccactgccgagggtaatcataaatctttctcttaatcaatttgatcaaactcttgttagatgcctcggcctacccattagcttgtgcataatatggtgaagaattcaacaatttgatacccatgctatcggcaaactgaacaaactcatcggacacgaaaattgaaccttgatcggtcgtaatggtttgaggaataccaaatcgatagattatatgctcttgaacaaactgtatagcatcccagaatcaactttctttaaaggaatcgcctcaacccacttggtaaaataattggttgccaccaatataaacttatgccctttactcgatggtggattaatcataccaatcatatcaattccccaacccctgaatggccatggcttaatgataggattaatagccgacgctggtgctctctagatcgccccaaatttctgacaatcttgacatcccttgtaatatttgaaacaatcctctaacattgtcggccaaaaataccctgcgcgtcgaagcaaccacttcatcttatgagccgactgatgagtgccacaaatcccttcattaacttcgccaattgcaaccttagcctgattggcgctcaaacacttaagcaacaccccataaatttttcaataatagagttcatcatccaataaagtatacttcaacaccttatatctcaatttccgagaggccgattgagatggattctgtaaatatcgatgtacatcatatctccaatcatcggctgttattgcagcaacttcaaccttaacatctttgatcatcggcttataccctgacgccccttgggctaaatcattagcttcaatattttgctctcgagatacatgcttcaaagtaaccagccgaaattccttcattagttcttggcacttctcattataaactatcaatgtatcattcttgcactcatattctcctgccaattgactgattactagcaaagaatccccccataatttcaatagcatcggcttcaacttccttgagtaactgcaaccctttaagaactgcctcatactcagcttgattgttggttgcataaggtttgatagtataggcaaactgaaaacttgccccccgaggggaaattataaccaagccgatgccacaaccatgagtgcatactgacctatcaaagaataaagtccatggcatgatctcaaccgagccgattgaatcatcacgatgttctacaataaaattggctatagcttgccctttgaccaccttcggttactcataccgaagatcaaactcagttaaggaaaatatccacttcccaacccttcctttcaaaattggagctgataacatgtatttaacgacatcggctttgcatataacagtgcattcgttggacaatagataatgccttaaccttgtacatgaaaaatacaggcacaagcacaacttctccacaggagaatatctagtctctgcatccaagagtcgatgactcaagtagaatacaacactttctttcccttcaagttcctgaatcaagactgaaccgattgacttctcaccggccaacagatataatctaaaaggtattcctttctgtggaggaatcaaaactggaggagagctaagatattccttaatactatccaaagccttctgttgctctacccccaagtaaactgttgatcggctttcaatcttaacaacggtgtaaaaggttctaaccttctagacaaattagaaataaaccttctaacaaaaattatcttgccgattatctcttgcaactctgtcttgttctctggaggatgaatcttcttgattgcattaacacttctatgagtaatctcaattctcctctcatgaacaagaaattccaaaaattggccagccaatacaccgaaagcacactttgttgggttcattttcaagccatatttcctggttctctcaaaaaccttcctcagatcggctatgtggtcctttatctctttagacttaacaaccacatcatcaatgtagacctcaaccaaccaaccgatcggatcatgatatatataattcatggctctttgatatgtagccccagcacttttcaagccaaaagtcattacaacctactcgaataagccgattgcaccaggacacctaaaagctgtcttatgaatatcttcttcggccataaagatctaattgtaccctgcattactatccataaaacttaaaatcttgtgtcctgaagcagcatcaactagctgattggccactggcattggatattcatcttttagggtagctttattcaagtttcggaaatcaatgcacaccctgaccttgccgttcttcttgataacagtaactatactagaaacccactcggcatatcggcaaggacgaataaaaccagcatcatataaacgtttaatctcagccttgacaggttcaagcatatcggctttgcatcttctcggaggttgttgatgcggtctaacccctggtttgataggtagccgatgttcaacaatcgatcggctgagtcctggcatctcataatactcccaagcaaagcaatctctgaattccttcaatagctctatcaacttggttctaaactccggagataaatttttactaataaatgtcggccttggtcgatcacccagacctatgtcaatttcttccaattcatcagccgacatgaaaccatatccttgcttgtcatcgagatcatctattgtatccttggtgtagacgtttgaaccctccacgacgccctcaaaataatagctttggttctccatcttcaattggccgtatatcagaatcggacacttttagaaaatctccatcccaaacttttccagataaacaatcaagaccatccatctcccaaagagctaaatcggcactggcaacattgactgacctgttggctggcacaatttcaatcttgtcgccttgccactgaatcaagcattaatgcatggttgagggaatacaacaattggcatgaatccaatcccttccaagcaacaagctatagaaacccttcccatcgatgacaaagaacgttgtaggtatagatttgctgccgacggtcagttccatattcaaaactcccttggtttctgatggattgccaccaaaatctttaagcaccatgtttgtcttgatgagaccttcaacatttctgctcaacttcttgaatgtagcgtaaggcatcaaattcactgcagccccaccatcgaccatcatcttggacaccggcttcccattgacatagccatttatatacaatggcttaagatgccgattctctatcccctctggcttctcgaagacttcttgttctggtgataaaatcaacttagccgattcctcttcaacttcatcgacatcggcttgcttgaccccaaactcagcaggcagcgtgaaaaccatattaaccgatgcagtcacaacactttttcctttggccaatctctttgcttcatcggctgcggcctcgtcggctacaggagcttgtttcttaacgcgccactcctgctttggcttcgttttctttagctgatgactgatttcctattagacctcctgaaaacgctcactgttcctcaatctttgaacccttctcttatgattctttgtaaatataccagaaggacatcattgagtcttcctgttttcattgtcctcctggttacaatcttggttcactggacccaatctttgatgaacgggaactctagtctgcattagccgattgcctctattatatgatcggcttgagctttctacaatattaccgcacctaggacagtcctcgatagatggcagcctcacatcctcattccagcaaaatctaaagaactcgcagccccaatgaggatcaaaaacgtcatcaccttcctcataatgcctctcctgctgtttgtcatacttcttctgatatttgttgataatttttgccgaattcacctgaaaacctcttgcacgtcctccatcagctgttcggccagctgtttgcaccatattaacaggaaaaggattgccatcaaccttcatcagcctcttggagtcttcaaattttattttgcctccctcaatagccgcttggatctgctgcctgaaaaccttgcaatcattggtagaatgagacccagaattatgccacttgcaataccttttcttgcccaattcttcagccgatggaatcgtatgaccagcaggaagttgaatctgcttctctcggagtagcaaatcaaagattttatcagccttggtaatatcaaagtcatacctctcctcctttccagaactctttacccattgacacggtataactttcttgcttctaacccattcggctgctgctattccggagtcatcatcatcatcatcatccgatccatacatgtaaggacagacatgattaacttttttaaagttcttccttgcttttgcaaacctctgttcatgcaaggtcaccttctgtgcaagatgtgacaagctatcaaagtcttgagatgagaacttctccctgattggagcaatcataccctgaaaagccaaatcggctaactgggcatcagttaaactcaagctatagcacttatttctcatctctctgaatctctaaatatattcatgcacaggctcatcatgtctctggttgatcactgttatatcggacagttttatctcatataccccactgtagaaatagctgtgaaaatgcttctccaaatcggcccaactgttaattgatccatatggcaaagaagaaaaccaagtgaaagccgatccagacaaagacaaccggaacaacctaacccttaaggcatccacagccgatgcttcaccacactgggccaaaaaccggataatgtgttcataatttgacgtactatcttgcccttagaattttgaaaagtctggaactttgaaccggttaggtagagggactccctcaaaccattcagggtaaggttgccggtacaaatttccagcgtctttcggcctgagcccaaactgctccttcatcacatccgcaatcatatcggcccatggtcgttgctgaggtgctccttgaggttgttgtggcatgagctcgaattgattgtactgaggaacaaattgaggttgagccgatcctccctgctgatattagacttgcggtgaaggaggttgatactgataattcaaattgccccctggtaatcttgaaaatttggttgaatattgcgcaccaaatgctcaggaacaacttgaggtaccaccgtttgattcggttgcacattatggaccaaatgctccggaacaacttgattcgcggcatgctgccttggctgattattaggtgttgcaaacccagccgatgcattcatcgaggcttgttgttgaatcagctgaataacttgttgccttaacagtgtttgctgaattggttgcaaaatctgccgcctaggtggcgtctgctgaattggctgcacaacctgttggattggtggcgtttcttgaatcggctgcacaatctgctgccttggtggtgtttgctgaatcggctgctactgggttgggtcaacagtaggttgaggaggtaagaacatagctacaacctgaccttgcgttagctgattcacattctgtccactatgctgcggttgctctctaaccaacaaccggggattcactaattgacccggcaccgatgatgctgcagcaggtgcaagagctgatactggtgccgtcggctgagccgatggtgcattgggaggaattggttgaacagctggctgattatcagtgactaatggccgataattcgggaacacccctcctggtagataaaccggtcctgtagcctgatattcagccattgaaccatcaacccttgtcttcaccatgtttgacaaagtgttgactaatattccagattgattgatcaaagcatggtgcacggcatagtcaacctgatcctggatgttgttaaactgtaactgtgccgcattgccgtcttgattaaggcctccaccttgaattccttgagagccaacaccctgaactccttgagagccatcaccttgatttccttgaaagccatctgcagcacctttatactcggttgagctgcatcatgtcacgtcccaaaacgaccctaaaatatatcctttaaattatgcctagaataattaaaatccgtgtgaaagcctccaacaattaaaatgtgcaaagtaaaagtcaaataaggcttagaggatttttttatatttcctaaaagcctaaaatgtgtaaataaattttagtggaattttcagagcacaaataataattattaaggaataaacaaagttgaaaaggttttataaaaagaaaaaccctaaaaaccatccttccctctcttgggccggcccggcccacttccctccccctctctcctcttcccccgcggcccactcggcccctccccgcgcccgcgccgttgacgggcgggcccgcccgccaccctcgctgacgggtggggcccacccgtcatgtccttcctcccaccgctcccgccgcctcgcccgcgcctagcgccgccgccgccgcgaatcccgccgcctcccgtcgtccccgcgtgaaatcaataggggggaattactccccgtgatcccctctccctttccccccatttttccctctctctctcgcattcaaacggccggatttgctcccgcaaatctcgccggcgccattgatggcggccggacctcccggccggtttccttccttccccggccaccctctcccccttccaaccctatttaaaccctccccgcgcctccctcgcccgtttccgccccttgccgcactgtctcctcgccagaatcgagctcgcgccgtcgccctctctctcctccgtcgccgacgaccttcggccggctctctccactcgccgggaccgtttcccgccgcggcgtcgcctcctccggcttcgccgcaccgtcgccgtccccgtccaccccctcatcgagctcgccgaccgccggagcgccaccgtccccgtcgaccggagccgcgccgccgccttcctccgctccggccgcctttttcgtcatcgccgtcgacctagggtgagtcgtggaccgccacctcgtttccccctttccctcccctctctcggccgccgctccgccgtgcctatggccgccgccggcgaccataggggcgcgggcgcgccgcctcccgccggctgcgccgacgtggccgccttcgggcacgccgagcggctgccgcgtggggcccagccgtcagccgcctgcgccctcgggtgcggctgacgcgtagggcccacggcgccggccggtgtgagcccgggtgcacccggtccaccgtggaccgtgaggctgccgcgtgggccccactcccgtggacccggtccgcgcgccctctcccctcggctgacgcaataaaccatttttaaattaaaatttaaatgaagaaattcgtaaatattcatttaaagagcatataaacttcaaatggccataacttggccattcgaactcggaattggaccgttcaagtctctaattttctcttaagaagtcaaaaacccatttttgtgctttgttcctgcttgttatatggagtttattagagtaaaagcctttttcctttccgttggtcgtgtagacgctgcagcttcggaagatccgctctacgtggaggttgaagccgacgtttgggaaagcgagcaaggtaagtcacatcattcttgaacatattgaatcccagtttataaaattattttgatttaaattattacattatcgctttatttaaattcccgcgttatcactgttttatttagccatgcctttttacctttgttatgaccttattattattgttattgttattattaccttgttcaccctagaataaacaaaaccccaactagtggatactgtattcatggtaccactagtatgaatttaggtagatgcttcgctgcttaattaggcaacattaggtggttttacaactctagactttaggaatattcttatcacctggacactatggaatggttggattattgtggaattggattcacacctctccctctattcaaaatcctcaaaatggttttagcctgggctcggggtgcatggttttgatagtagcacctcggccacataaggaccggtcttcgggcctctgttgcaaagcactaccgtacttccacatgtctagtgggtaaggcttagtttgtggctcagtctggttataaacaaaagtacacggatggagatggacgaagtcgagggtcgatggacatctctagggcaaatgaaggctacacgagctgcggcccggtagtcgagatgtcatggcacagggctggtgtcctgctgctaggggctcagtcctgcctacctgtcccggaggttccggccgtaggtggggttcggtcggtactcttgtctatggctaggatgggttggaaactatgtcacgtcttccgtccgtataccatggtggtatgtggcacgtggttacacgtgacgaagatgtgtcttgtgggtaaagatgtacacctctgatcagagtataacctattcgaatagccgcgccctcggttatgggcaagcctagcaatgtacccaagttagtgttttaattcttaaaacctgcttaacaactaaaatgtggaatggttggcctgggttggttgggacgagctgggacctagggtcgggttgccagttcagtctgaatcatcgtaggccttgggttaaggcaggttcgtatgggttcacggccttgattaataatattgcatagctctaggatcgtgtttacaaagtagctttgagcaactaagtgacttttaatgatgtttactgcaaaccctaaccccctatattatggctcccttgtactcccttgcatttattttgcacttatgggtgtgtcttgttgagtacggtggttgtactcagtcttgctcaatttttcccaaacccagaagatgagttcctggaagatgaaggctttggtgtctagctcgtgcctgccgtcaagcgcctgtggtcgtcgccctagtcttccgctgttttttgtttgtcttcttgtgtgctgggccttcgctacccatgtaataaattatctatttacgcttccgcttgttaaactctgaattgtatcaacttttggtgtaccttgcctcctgggacaaggaataatacacgcacgtaaggaacgcccgttgggttatttccggtcgtgacacatcatctgaagcttgtttcacttcttcatccttagaagaaccggtcctaggaacatcagcaattacctttactttgtacttctgaaccagtgttcccttgcgggactccgtgaatgagctcaagaactgattccgtgcttgctgcatcattgtatcaaggtctttttgctgctcaggtgtcaatttatccagagtgataggcacaatgttgtcttcatcaatctcagatagacccagcttcaggatcttttctttaacagagctaggaccagcctggacggcgatgctggcaatttctcggccatggggaaaactgctgttgtgattctgacttctgatgggtcccaccaggcgtgccaaaagcgtgttgatgaaaaacacgaggcctggaagatctgcttcacttcagtgcaggtccaaaacacgctttcgggtatgctagcgtgccagttgatttgatcctgcaatcaacaagaaataaagacaaagaaaccgtggttaaatccataaacgatagccgatcggctaagtgccgatgacatatcgtttatctttgagccgatgtcatatatgcatcgatcggcagttataaatagataataaagaactaaatctactcgatcggctgtagacattaacaatatataatcgttatgtcgatatatacttaaatcaagtaattgggatagatcggtcgccatgccgagacagtataaatcacttagattgaaatatatactaacaacaagactatatatgttcatagcatacccgatcagatagatctagcctgtatggctaatactccgataccaccctatgttaagatattaaagcaagcagaatataccaaacaaaagcctaatatacttaaatgcaataagattttgacataaagggtagatttaacatgtcaataaagcatataaagcaaatatagttaaatcaggtaagatcggctgaaaccccgatactaccctaatcggcaaccaagaagcaggctagagattgagattctaatcatcactcataagatcaaactcaactgatgcagctataagtatgaaaagaaggacaatatctagataatcaagccattggaagtttcatagagtggtggatatcatatataatctaagccaacatcgatatttaacctaatcggctgccctctattgatagatgttagccgagtgtaggttagatagtgatattgccagagattatataagatatatgataactcgacgaattacataaacaagattagagtatcataaatatggaagcactaatcccgagaacgcaagccgtcataacaagttttacctcttgttgaagatcgaaaccgatgcagctcaacccgaatgcaagaactcgtcgaaataaaactaaagtaaaaaagggtggcgatgcgccgagattgtattgaacgtgtgtgttcctttgattacatagggctcggggtctatttatacccgagaattatccaacatgtccatatcggacatgactcttatccctaacaaactctaagatatcataagtctttacggcagacttttgcccaaacatatctctaaaaaatttacataaaatatcctaactaatagatacagtcgccttctcaggactctatccatgcgtggcaatcatcttgaaacatatcaactcgacctgatgtcgtacaccaagttgtattgtcggaatcggctgtatcacctaacctagtctgactcgaacttagccgatcccgatcgtagccgattcgaactccagtcgattcttactctgtttccgcgaccatactcatctcttattccgcttcgatctaatcttcttctccgatactgatattaccaaatttggtcgttaacatccagccaccccaccggatccaccaacgcgtcgagctcgttctgcacaaagatggtccccgaatactccttccacggccgcgccatgtacgtcttcgccttctccagatccgggtgcggcgccacaatgcggttgtgcagccccgtccctcccgcgacctgcgccgttaattatgatgttcacttggttccccatcggcttttgcagctggatcaagcagttctggagcaccacctgcatgcatttcatttgcttttctcaatatttgcttattcttcttcgtcgtggtggtggtgttaattgttggatcaaaagaaagagaagaagaagagtttaattatatacttgcctgcgagttgcagtatatgaagtcgatggtgccagacacggagcagtcgcgttagaactgccgctgcgcatgcgggtagagcgtgtcctggtacgtcttcaccttgtccgtgaacttctccaggtccgggtgcagcaccaccatcacgtttggctcgaattcctccggctcggcctcaggccgcggcgcctccagcagcggctgcttcccgccctccgacatccacgtcggcatgccgtcctcggcgagcagccactgcccgatgctgaggctgccgagcgtcgatgagaactggtcgaccacggcgacgatgtcctccatgagctcctgcgagctgttgagcgcgttgggcatcttggcagcggcatcggtggtggtgttgaggaagtcgtcgaggcaggtgccctggtaggtgagtgcggcgctgagccacgtgcggaggtcgtcgacggccttgttgaaattggtcatatcgaagccaccgagcttgtcgaaggacgtgttgaggtcgtctatggcgtacccgagcagctccttgcaattctgcagcgctcccactattaaaaccgctggtgcccttcccggctcctactctacctcgccgtcgtcgccgccgccctctctactgctgctagaaggggaaaggggaggaagaggaagaggaagaggaaggagaaggcaaggagagggagagagaagagggaggaggaagaagaaaaggggagagaggatgacatgtgggcccacatgtcagtgggtcccacaatattttttttacatatgggtccctcttttttttttttaatgccacataagcgacacatcaatgtcaagtgagacgaagactaggtcaactatgccacataggcgccacgtcagcgaaaataaccttcaaaaccagctagggagtcattttgcactggttttagtagttgggggagtcgttttatccggttttgtgattaagggatatgatttagactcaatctatagttgaggaagtcgaattatactttttcctccccactggcccacatcattttagcccagatacaagctagggttgggcctcccagcgaaggccataagatgctgagtaatccagcaacaccaccacacaattaccgtattccttggattataacttcataagcaaactaaagttttgcatggcgattattaaaaaaaaaagctttgcatgacgagaaaggtacacatggcactttcacatattaacaggattttaccctagccatgcaatattatcaatgttgtccctcttccaaactcagcgtgaatgcgtgatgcaaccttccaactgcaagaaattctctgaaagagtcagcttcagtaagtgaaggagacacagcttcagcatcatataaaaaacgatgttgcgcttgtgtaaagttaagcgcctatgaattgatcaagacttttttacacaccagagacaaccataagttacacatgatatatggcagtaaatttaaagggaccaggtgctttgcttccagagatcaacattatgcctaactggctaaatgattcgatcagcagctggtagacttcaggcaccagccaatgactcgatcagcagttggtagccttcaggcaccacgctctggttctttacgcaagcggtgagggcaggaacatctgcttttatgtctaggaaagcagcaaccaggaggagaaggtggaagtccgagatccgcttaacaaatggtagatgcttagcacgatccaggtggctcttgagcgcgctcattgctacagggtttccacggttctcgataggaaagccggttgaaagtggaccctacatacacaaaataaatataggatgttaactgatatatctttatggatagaaggtatatgcatataatcgactaaaatggtataagagcaaatgacacaagctcagttggtggggggtgtgggtatctcttctctattgattcgattccaagctcctctgcatctttcatttttagttttaaaaaacaaaaattaaatgatagcagagtgttgaatcattgccctgttccctgggtggaattatgcaagacatgcgagatgtacagcccttttagaaaacaaatcatttgcttttcttggagagacaatgttaaaaagaagagtcaccatcattttgaaacctcaactatcctgaaatcaggtgtatttcgaaacaaaaggatggtggccatgtttatagtctaaatagaaaaggttcttgattaaacaaattgacaacccacaatgtaatcaccaaagcagtaaatgaagagattgtgcatatgaagattgatctacgccccagaacacaaatctaccagaagtaaaatgcaacgctaccacattcacagttatctgattacgctagtttctattatggacatcaaaagatggaaaaatagtagatttctagctgatcccttccactctaatcactggcccagtacatcatgatgaacaaatataggtggcttgtttaggaaaaatacagatgcagcactgtaatttaacttccataatcaagtgcatgcgaaattgcccaactaattaatgatgaaacacaacagtttcactgaagtatgtagccaggtgcatattggcttgatgcatggactgtacagtccaaattaaacgtattttcgtttgtcagcaaacaagacagaagcttacccccaattttaagtgtttaaagtttaatgtatatgatcatcaaatgcctgatgataagtaaaggtaagttaatatagatgatcttacatgaagctcaagttattccaatagtctaattataaatttctgtaagtgaatacagaagatagattcggatacaggttgtattgtgacattcagtttgccacgttttctttccacatagggaatcaaatactggatataaaggtaatgaattattagaactttttaaagataaaaggtaaatgttcagatggagattcttatattcttttcaaagtagatccatggaatatctgagaaaaagaactgttagtgtattctaggtcagaatatcaggttcccctttattctcaggtaagcttcagacttgttctacacacaactatctgtgtcagtgctaaagcagtacatgccgcatcttgttctatacaaaaagatcagaatagttatctttgatgcactctagcaccatccaaggcctcagaacactgccatagaattcttccctagaagcacaccaatataaaagaaaccttctattcttaggacctataatttttaaaaaaagaaaaaaaaaacttttcacacctagcacatcagatgcatgacatacatgacatcaccctggcctattccatatacacaagaaatggtttacactaaatatactagaagggcacatacacttggtacctcactaactctctctctttttttttggccaggcgaacaatggtatgccggccaaattttattaagaacaaaagagaaaccagtacaaggaaagcaacaataggatcattgaaggcacccaagcttgaatgcttagaatgcttaaaattagcaacaggacccccaagcctaaacatgaactagaacagctagaacaaaagcaaaaggaagaaacaaagttaggcagggcctcagcaaccctgttgttgtttccttgtactattatgccttctattcttaactaaaaagaggctgcatcatataagaactaaaaatcacccattgattctgctcttgaaataaattaaatggaatcacatcaaattcatgatatcagttgcatagatatcaagaatcgtcattcacagattcattctcatctagatcagctctatgaactaggatgcatcactgaaataagatgctcttttctagagtaaatttcacaaacactatagatattttggcatatctatcaaaaaaccacagatctcattgctaagtttgcaacagctacaacattttggcaacacttcctgacaaacacaaggctttgtcctgttccatgccaaataacaaaaatgtgtgctgcatgtcatagaacagggcctttgtgtgtctgcaagtggtttgaacaagtagttaaaaacttgtagttctatggaacataagagtaactatatctttacgttcttgaaacagttacttaaatcagtaggtcttcaataaatgtgccaaaatgcctgaatttttctacacatactccttttcttatatagtggttaattacttctcaaaagtggatctattattactagaattatgaatatttgtggatggctgtttactaacagtctaacactgaacagaactcatatatcatgcccttacacccagagattcagtttttcaagacagtgcaggaggccctctacgaagtttgaatcaaaaaattaacagaaacataatgactttgcagaaaataaatatgtcatgaattaattgcttgcatgcaaataggcactctactatttagtggataacacaaaggctctaattcttctcttgtattgggaaatttttatttctaattcatgcggcatatctaccttgttcgctgaccattatgttgtttcattgtcagttttacatcaaattactaaaacgagcacccactcagatcacctgatgattcaaggtttcaaacatgctgctacccagtcaagtgttaatattgctatgttgtaggaagcaaacttatttagtaaactgtaagttcattatactatgcaacagagtaggaaagaataagaatacctgatgatcagagatcttgacaggcaccaggaagaagtcattgtccacctccatagtatcctttcccccagccaccacctctttccgcatcttggacaggcggggatcgtctttgtccccaatctccgtctccagcacaccatccttgaacagcttcacacaaatctcactcatctggaacgcctcgaagtgcacatcaccggagccatcatcccccacctcgagcttgactatggcggtgacccactccgggatcccgccctccgcctgcagctcggtggcctgaagcacctcgcggttggacatggtgtactcgccagtgtcgctggtcttcctcccgactgcctgcgtgaacaccaggccgacgcggcgcatcccgaggccgtgggcgatggcgtcgacgcgggcctcctcctgcgcgtcccgcatgagctggacaacgtcctcggtgccgacctgcggcggctcgtagatgaaatcgacgaagacctccttggtgtcggcgtcgacgcggccgtagaggaagccggcgcgcttggtagcgaaggcgagcgactcggcgacgtggagctggaaggcgttggcggagtcgcggtcgaaggaggcggcggcgcagagcggggcctcctggcgggtgacgcggatctggcgcgcgatgaggtcgtccatggtcatcttcttgccgaaggagccggcggcggagagggctttggggggaggcggctgggaggagcgggcgtcgggcgggtaggagaggtagacgaaggagccattggagaggcggagggaggagagcggggcggccgggtcggcgagcagggcggcggaggcggaggaggggaggaggagcgccgggtcgagggagaggcgctggagcgggacggggacggtgacgcgcgccgcgatgagacgctgcaggtcgccgacggtggcggcggccgggtccggcacggtgatgcggtccgtgccgtcgcggctgcggatgcggaggatcatcgcggcttgggttgggttggggatctcggtacttggcttgcgcggtggggtttttggttgcggatttatagagcgggggaaggcgagttgggggagatggagtgcgactcgactgcggaatctgtgcgggaggaggaaacgggacggcggcggagaggagaggagaggagaggggaggcgacgagagatggattctcgaagggttggaggctttggggcggtggttgcgtcttcgttggctacggtagtttgggtacacctggcccggtgcggcggaaagacgagctggtttctattctctggttttgctctgtaaaaattggattctatcctatgaccatctgtgattctaatggtgtttgaactttatttataaagataaagataaggattaagtgtctcacgtaagacgaggtggtaataacatgtgattaattaagttttaattattataaacttaaaaaatggactaatctgatattttagaacaactttcatatagaaagttttcacacgaaacatatcgtttagcagtttgaaaaacgtgccatgataattttattgtttgagctgctactccatcaatccttttcaaagtatgagagattttggttggacttctatgaagattcataatactataatgtatcatgtcgaatcaaaatatcttatatcttaagatgaaatgagtaatacttctacttagatatgtcctttattgctaaagagagtaaaaattgagctatccgaatgctatcgacctaactataacctacagaaaactttgaaaaaaaataataataatttagaattagcaatgacataaatataggcatgcatatgctggcctgctagattccaaccgaccgccaaaaggtgattaggtgagtatggaatttcacctccatccatgcatatcctctttgtatgctcttccgaccgagcacaaggccgttgacaccttattgacacacatgaacaatacttttccattattctttccttcttttcttttcaatttagtaacaagcattcacttgtgatctcactggacatgtatgctatgggctaacacaaacatggagaattttctagcatagagaaataaaagaagcattaaaatattaagcattaaacggtttaaaagctaatatctgaaaacaaactacaatgaaaaactaaaattaactctaaatttattaattttcaaaatgagtaaagtgcacggtcagtctctaaacttgttcatacgtgttatacagattccgaaattctcaaaatgtattttgttctcaaacttgttaaggtatgtcattctagtccaaattacaataactcttcggatcctatgttgcacacaaatgttagatttattttctttatattttgtactccctttttcttctcttcttccttcatgttcgtgtgaaaaaaaaaagacaaaataagataaggacaacacagaggggaaggaaaaaaagaaaaattgggactggaatatcagtgtggcatatcgctttagtgactatgtggcatgccatgtaggatactcgaagggtcatggcaatttaagactgaaatgactcactttaataagtttggagacccaaaaatgcattttgagagttagagaacccagatgacacaactgaacaagtttaagaaccaacaataaacttcactcttttttttagaacacgcttcacttttccaaaaattatttatttttagcactcgcgtttatgagctaacaataagttcattcgagcttttaaatagttagcaggtttaaatgatgctttatatatatttcatataatgatactacctcaaaataatctactattcatattttttattctcaccctttctcccttcatctattttacttacagtaatatatttttaacgcatctatgattgtatcatatcttatgtcaaaattttagcattaatattcgtccttaatttataagtaacgctccgaggacttctaccacttgcttgtagagtcagccttttcctccatcaccttcatcatcctcgctaacggtgagaccacaaggaaaaagggacatgtttcttgttcgtttgtaagtaagtttggagagagttctatcatatgtttatggtcttttaggatgtttatgaagttaggcttgtttagagcctcttaatggctactccttttcatgaggtctcttatgaagcctcatttttcactaggctctttttaggatgtttattgacttatttgttgagattattggtgacgaagtcagtagccattttaggtcatggcgccgaattattcaatatcatcagtttgttgttatgtctatgaataaagtcttgctgatatttgtcaatatgatcatgcatatattagagtagtcaacgtgatgtgctcgtctatttgcaattcttacgatgttataatatatagagtatctttgatcttacgatgttagaattatgatgttataatgtatagagtatctttgcatctcctataatgttctaatacatggagtctcttttggtctgtgttacacattttttatttgtctccaatattactcttaaaacaacattatattgccttttttatatatttattactatactagccaaatgcatgtgcgttgcaacagtattgaaaatagcaaaattaagtcatggttgaaaaaaatatatttttaattggttgaaacacaacctttcaactaaaagaaacaaacaaaaatatcatgcttagaaaattaaagatctgcagtctacatagtacaaacaactccccaaaatcctaatatcataggccacacgtaagtgatggtgctggtggtagagtcaccacaaccactactatcttttaatagtagtatagatcatccatggaatccgtggataatcaattggttatcctacttaaaaaagggataattaatttgcatttcacacaaaaacactccgagaaaatcttataaattctgcaccattcgattgctttgagatttgtagagtactctaactctaaccccacctctcccccctcctcactcctaaagtcctagttccatcagcatgcccgtccattactcgacctcgcgcttggctagaagtcgccaatggtaccggcgaccccctgcctcggtgggccttatccgccaccccctcctcctcaagctggcagcaattagatgccctcgcctgttgtcttcctatctccagcagcgggagccatcggatccaccactaccggcctcctaactactctccttgccttgcccctgctaccagtggcccaccaccctccttcatctctacagcttcggtaccatcgtctcgctgacctgcctatgtttaccgcctttcacagtcatccctctaagcatgacgatttccccctcttctgccctcccctccatcctccttctaaagactagcttgttgagccaccgcggtcactaaagctagaggagtagttgcgcacgagtctgcaagcaaatcgactggttcaaaatatataaaaaaaatccccctcgatttttttgtcaaatattatttagcaaattacgagaatgcttcgtctcgaacgttcaatgtgggatgaaatattagatgcatcatcgagtgagtcccaccaccgaaccaatctcctaccttttcctctccactatcaaacctatccccgttcccctctctcgcatctcactctcttcctctccacctttcgctccctggctctcagttgcttcgctgagatgcaatagcaggaggccggctttccaacctccacgaccaccattggtgccttatcactaccgtatcccgtcgaatccaaccacgctaagctccgggcgttagatctgggctggatctagggaaaggggcgcactagtcatgaagggaggagctcggcctcatcttcgtcgccaacggcaacagggatgatggcatatgcaacatggatcaagcttcagcgcaagaaggcaatgggcaatctttatggcattggtaagtagagttgtcaagggatggcatcccgggcgtcaacacgttggcctactactagagaggaggaagaaatagatctagcctactgtttgttttcaatttttgatgtttcagctcaacgtattagatgtttcactagttaggtaaaaaatgttgcagtgattttttgtggtattctttttgccgaaatcattcggatctactgatgtttcagtggtccataaccgatgtgtcatatgttgtaccaaaatgtttcaagtgtaagttgattgtgtttaatcgtttagattgttgatgttcaaaagttgagacatttttgttcgaggaatgaaacctttttttctaaaatgatgaaacatgcggaacactttgcaacaatatgacgcaacaccgtccgacattttacgtctgacggagatggagtgcgactcgattgcggaatctgtgcgggaggaggaaaacggggacggcggcagagaggagaggggaggcgacgagaggtggattctcgaaggattggggggctttggcctttggggcggtggttgcgtctttgttggctatggtagtttgggtacacctgtagtttgggtacacctggcccggtggggtggaaacgtgagctcttcctctggttttgctttggaaaattggattctattctatgaccatctgtgattctaaatcgtcgatctcgggagcttttatcgtttgagccgctactccatcaatcctttcaaaagtacgagagattttggttggatttctacaaagacttatagtactacaatgtatcatatccaatcaaaatatctaatattttaagatgaaatgagtaaaaattgagctatccgaatgctattgacctaactataacctacgaaaactttgaaaaaaattaataataattcggaattagcaatgacataaatataggcatgcaaatgcctgcctgcaggattcgaactgaccaccaaaaggtgattaggtgaggatggaatttcacctccatccatgcatatcccatttgtatgctcttccgaccgagcacaaagccgttgacaccttattgatacacatgaacaatacttttccattattcttttctccttttcttttcaatttagtaacaagcattcacttgtgatctcactggacatgtatgctatgggctaacacaaacatggagaattttctagtatagagaaataaaagaagcaaataaaaataatttctatgtaaaatattaagcattaaacggtttaaaagctaatatctgaaaacaaactacaatgaaaaactaaaattaactctaaatttattaattttcaaaatgagtaaagtgcacggtcaatctctaaacttgtccatatgtgttatacatatttcgaaattctcaaaatgtattttgttctcaaacttgttaaggtatgtcattctagtccaaattactataacccttcagatcctatgttgcacacaaatgttagatttattttctttatattttgtactccctttttcttctcttattccttcatgttcttgtgaaaaaaaaagacaaaataagagaaggacaacacagagggaaagaaaaagaaagaaaaattgggatcagaatgtcagtgtagcatatcgctttagtgactatgtggcatgccatgtaggatcctcgaggggtcatggcaatttaagactgaaatgactcacttcgataagtttggataccaaaaatgcattttgagagtttgagaacccagatgacacaagcgaacaagtttaagaaccaacaacacacttcactctttttttagaacgggcttcactcttccaaaaattatttatttttagcactcgcgtttatgagctaacaataagacggtagtgttaatacgtttgttcgagcttttaaatagttagcatgtttaaatgattgctttatatatatttcatataatgatactacctcaaaataatctactattcattttttttattctcaccctttctccctgttagaataaatgggctaggcccaatttatttttattaaaatctcaaggggccataataaatcctatcttcctatatagtttatacctactaagaagcatttactcctataaagcaagacatgcaagaagccacatcatcaacaattttatgctattagatcatattagtacaaagataataaccattggatcaagaaactacttattcatccaattcaatcatttactagttattgcgcatggaaataatattcatatattatatattatactaacaatgacgcttggaaaaataaggcatgaattgtattgcagtaataacacaaggcatatataaatccacattatcatatattttgtatatacatagagttacacctaaccatttaaaactacaattttgtttgacaataaaactacaaaacccgcggcaaagacgcggggtgccaactagtgttaaagataataataccaccttggagattaaaagtggagtatctcaacttaaagagggagttattgaaggctccctattgaccggttgaggtgggggtcggatagccacgcgcgcgcgcgacaagccaggcgtgggcgtggcgtggcgggcgagcgctgccgctcggctctctctctctctccctccctctctctctctctctccttttgcaacggctgagaattcaattcgcgagattacctttgtgatgggcgggcgaatcaattctgattgatcgcatcattactgcggcaatggatgcgaatcctctctctccctgcgctattaggacgagacaacgacccaattcacgagattacctctgtgatgggtgggcgaatcaattctgattgatcgcatcattactgcggcaacggatgcgaatcctctctctccctgcgctattaggacgagacagcgacacacgaacaggctctccacgaattctctccattgctggttcatcctctgtgctgagaattcaattcacgagattacctctgtgatgggtgggggaatcaattctgattgatcgcatcgttactgcggcaacggatgcgaatcctctctctccttgcgctattaggacgagacagcgacacacgaataggctctccacgaattctctccattgctggttcatcctctgtgcctatgttgcttctgttcttccccggttctaatcgcttgcacgcacaagtgattgggacgagcagggcctccggaaccacacccttgcctgagatctgcacgggtaggcgggtgatcaggtttttggggagtgcttccgcacgactgctcttgctacttcctctgctcatcgtcgtcgtcgctatggcttctactggaggtgcacccggagcaggaggcggcgcttcgatcgacaacaccaacggaggcaattctgcctcacaatccaacggagggatattcactagatcgcttatttctgttaccatttgtttttcgtttcctaaaactattagttgcaatgctattgcgttatattgtcagtgttgatgcttattttactttaagcatgctcatggttatgtttagcttcatcactagatcgcttcacattgtgtatgtcatgtttattgtcttaatattttggattaaaatatgccgatttatgaccatatttccaacactcccttcatctattttacttacagtaataaatttttaacgcatctatgattgtatcatatcttatgtcaaaattttatcattcatgtttgtccttaatttataagtaacgctccgagaacttttgccacttgcttgtagagtcagccttttcctccatcaccttcatcatcctcactaaaggtgaggccacaaggaaaaagggacatgtttcttgttcgtttgtaagtaagtttggagagagttctatcatatgtttatggtcttttaggatgtttatgaagttaggcttgtttagagcctcttaatggctactccttttcatgaggtctcttatgaagcctcatttttcactaggctctttttaggatgtttattgacttatttgttgagattattggtgacgaagtcagtagccattttaggtcatggcgccgaattattcaatatcatcagtttgttgttatgtctatgaataaagtcttgctgatatttgtcaatatgatcatgcatatattagagtagtcaacgtgatgtgctcgtctatttgcaattcttacgatgttataatatatagagtatctttgatcttacgatgttataattatgatattataatgtatagagtatctttgcatctcctataatgttctaatacatggagtctcttttggtctgtgttacacattttttatttgtctccaatattactcttaaaacaacattatattgccttttttatatatttattactatactagccaaatgcatgtgcgttgcaacagtattgaaaatagcaaaattaagtcatggttgaaaaaaatatatttttaattggttgaaacacaacctttcaactaaaagaaacaaacaaaaatatcatgcttagaaaattaaagatctgcagtctacatagtacaaacaactccccaaaatcctaatatcataggccacacgtaagtgatggtgctggtggtagagtcaccacaaccactactatcttttaatagtagtatagatcatccatggaatccgtggataatcaattggttatcctacttaaaaaagggataattaatttgcatttcacacaaaaacactccgagaaaatcttataaattctgcaccattcgattgctttgagatttgtagagtactctaactctaaccccacctctcccccctcctcactcctaaagtcctagttccatcagcatgcccgtccattactcgacctcgcgcttggctagaagtcgccaatggtaccggcgaccccctgcctcggtgggccttatccgccaccccctcctcctcaagctggcagcaattagatgccctcgcctgttgtcttcctatctccagcagcgggagccatcggatccaccactaccggcctcctaactactctccttgccttgcccctgctaccagtggcccaccaccctccttcatctctacagcttcggtaccatcgtctcgctgacctgcctatgtttaccgcctttcacagtcatccctctaagcatgacgatttccccctcttctgccctcccctccatcctccttctaaagactagcttgttgagccaccgcggtcactaaagctagaggagtagttgcgcacgagtctgcaagcaaatcgactggttcaaaatatataaaaaaaatccccctcgatttttttgtcaaatattatttagcaaattacgagaatgcttcgtctcgaacgttcaatgtgggatgaaatattagatgcatcatcgagtgagtcccaccaccgaaccaatctcctaccttttcctctccactatcaaacctatccccgttcccctctctcgcatctcactctcttcctctccacctttcgctccctggctctcagttgcttcgctgagatgcaatagcaggaggccggctttccaacctccacgaccaccattggtgccttatcactaccgtatcccgtcgaatccaaccacgctaagctccgggcgttagatctgggctggatctagggaaaggggcgcactagtcatgaagggaggagctcggcctcatcttcgtcgccaacggcaacagggatgatggcatatgcaacatggatcaagcttcagcgcaagaaggcaatgggcaatctttatggcattggtaagtagagttgtcaagggatggcatcccgggcgtcaacacgttggcctactactagagaggaggaagaaatagatctagcctactgtttgttttcaatttttgatgtttcagctcaacgtattagatgtttcactagttaggtaaaaaatgttgcagtgattttttgtggtattctttttgccgaaatcattcggatctactgatgtttcagtggtccataaccgatgtgtcatatgttgtaccaaaatgtttcaagtgtaagttgattgtgtttaatcgtttagattgttgatgttcaaaagttgagacatttttgttcgaggaatgaaacctttttttctaaaatgatgaaacatgcggaacactttgcaacaatatgacgcaacaccgtccgacattttacgtctgacggagatggagtgcgactcgattgcggaatctgtgcgggaggaggaaaacggggacggcggcagagaggagaggggaggcgacgagaggtggattctcgaaggattggggggctttggcctttggggcggtggttgcgtctttgttggctatggtagtttgggtacacctgtagtttgggtacacctggcccggtggggtggaaacgtgagctcttcctctggttttgctttggaaaattggattctattctatgaccatctgtgattctaaatcgtcgatctcgggagcttttatcgtttgagccgctactccatcaatcctttcaaaagtacgagagattttggttggatttctacaaagacttatagtactacaatgtatcatatccaatcaaaatatctaatattttaagatgaaatgagtaaaaattgagctatccgaatgctattgacctaactataacctacgaaaactttgaaaaaaattaataataattcggaattagcaatgacataaatataggcatgcaaatgcctgcctgcaggattcgaactgaccaccaaaaggtgattaggtgaggatggaatttcacctccatccatgcatatcccatttgtatgctcttccgaccgagcacaaagccgttgacaccttattgatacacatgaacaatacttttccattattcttttctccttttcttttcaatttagtaacaagcattcacttgtgatctcactggacatgtatgctatgggctaacacaaacatggagaattttctagtttagagaaataaaagaagcaaataaaaataatttctatgtaaaatattaagcattaaacgggttaaaaagctatatct

SEQ ID NO: 60214 - DNA, 25192 bp, Oryza sativa
  unsure (1)..(25192): unsure at all n locations
atgcaccatgcaaagctgaaatgtgacaactaattagacatgtcacgtttgaaaacaaatgtgtgcagaaagcgagatggtatgatagagcataccataaaacggtcgcattcctcattatagaacttccctttgttctgtccatactggattttcaactctaaccatggattcttatagcggtctaacttcttcccgatggctctcataatttcatccttccgtgatatcctggcctctcccctttcaatattcttgataattctatcataatctggttggacagtcaataataatgatcagccaataatcttcagttctcaactcaccattcaccacataagaaattagctgtttggtgaagatttatgtactaattaacaatttattaatcatgtatactcaattgaaacacttgcttaccactcagttccttgtatctctccttgaaaactttagcatatcgttgaacttcctcctctgtcttcccctccatttcagcggcaatactcctaatatcatttcgaccatacttctcacatgcacgaataaatgtgttgaagtctctcctcgtccatgttgcaaaaccctatgattttgcaaaccgaaaacaaaaccagagttaaagacaagtatggacaaaagaggcaggtaaggaaatccagaaagcattgccacctacctcttctaacaactgctctttctcttcctgctcctccgcagtcaaaggctccagctgatctgagtatcgtgcaagtattatatacattagcatgattgagctggatgatgttatgcacaattataacttagaaagcgagaatcagcggtaccttcatcttcaccatcaatagtatctttcttctggtttgcttgctggaataatttttctcaagttagcattgggattatcaataataattggcaaacaattaactgagtacgggaacaatgctatttaatcggactggcacattagacacaacatggagtccaagagctagtttctcaacatctagcaaaacaatacaagcattttagctaggaaattaccataaggtaccggacttccttttcatacaattcattgagcctttggttgttgaagaactggaaatcatgtctgacaaacaaaaacaatatgagctgacagtagttctaaagagagcaaacaaggtaatcatgatttttttttcacaaaatgaaagaggcaagagaaaacttacaggtgcggcattcttggaattcgtggttccctaggttttgcaggtgcaccttggcgaagtgcttgcttaaagtattcagactcagagtagctagagtaacaaacaaaattaggtcagtttgagcaccagacgtgtgcatgcacacatagagatagagacttactttctcttcctttctcttctaggtggctctatccagttatcactgaccagtttcttaaaatcaagcttgttttcctccttcaagaaatcaagaatgtaaatggaattaagtaaacttccaaactgacagcagagaaataaagtaagagattgttaccttatcatcatcaaaatcatacaattccgcagctgcataaaaagactaagttagacctgagtgatagaaagaaagagactgcgggagaagggtacatactgtcatccattttaaatttaatagcatcctctgtgaactttttcatttttgcatcaagctcagctgttgtttcctctcctttagctatgatacggtcaatatcctcatctgtaattgtgctgtccttggaactgaataccatttccgcaccaaatcttaccatttgcaacagatcatccttattgacagctgaaagaagaacaaaataaatccatatcttactactgcatgaatgccttcttaaacataaaatacaagcagcaaaaacatactcttctgctctgccagtcggccttgttgaatgaccaaagcatccaatgcaagcttcttgtatgccctctcaatcactttctcctcgatggtatactgaaattaagttttcgtcatcctatcttagatatcaatacaaaagattgttacgtaatattctaaagaaaagattgacaaacctcagtgcaaaatcggaaaacttgaacttctttcttctgacctatcctatgtgcacggtcttgagcttgcagatcagcttgtggattcctgaagacatcaacacattaacactaaatattcaacatacatattcatgggttcagaagaaaacaatttgcacataacagcataccaatcactatcataaagaaccacaacatcagcagtagcaaggttgatgccaaggccaccagccctggttgaaagcaaaaaaacaaacttttcactgcctggtttgttgaaagcttcaatggatgcatcacgatcttctccaccagtatttccatctatccggcaatactgatagcctctgtacataagataatcttccaatatatccaaaagcctggtcatctgtagaatggacataaatgtcaaagtcaaacacaagatttgaagaaaccaaattatgtgtgacgttaacatgcttaggaacaatagagaactcagatcatatccacacatgaattatgtacatgttatacacagctaagtatcataaaatcaatgcacgtagtataaaagccatttgaatctcatgaggatggaatataatcacctgtgagaaaatgagcaccctagaatcacgatccttcagtttgggcagcaatttatctaacagaaccatttttcctacagatattgtgaggagggaaggttaaatattgaactgtacctttggcaacagtacaatggaaattgtgacatgaacataccagcattctcaactagatgttcaccagttgtgtaaggtggaccaggttctgctccttggaataaatatggatggttgcagcacttgcgcaactgcatggctatgttaagcaatcttttgcgttcaccaccagcattaataacctccaaatctttctgaagcagggcacgatagtactgcttttgcatctgagacattccaaccttaaggatagtttcctttttggggggtaatcccttttcaacatcagatttaagccttcgaagaagaaatgggcgaagaaccttcatagaagaatttacatgaatgaactatgcaggttgtcccaaattattagcataatgagccattgagcatgggagttatattactcaccttatgaagctgttgaacaacctcctgctgatcattttcaccagaaatttgaaaccattcatcaaatgtttcagcagagctaaatatttcaggcaacaagaagttgaggagagaccaaagctcatggagattattctgcaaacatcaatcatagcatcaacgaattatcagaataaaagcaaaaaaatgcttgaggatgtaaaccaacataattactttgaccatggctacagtccaaaaaaagagcacagccaggggagacctacctggagtggtgtgcctgtgataaggagacgataattagtattataaatcctcattgtcttggacagaagagaattctcattttttatgcgatgtgcttcatcaataataatgtaacgccagctgaaacgcttcagtgtagttttttctttgattgccatttcaaaactagtgacacacacatcaaattttcctggctgcaataggttctcccttatatggttctgaccaaacagaatgcaaaatgttcagtacaacatcagaagttgttcataagaatggttggagagcggaggctaagtaaactaaccctctcttctggattccctaagaatttcacagcacgtagaatagggcaaaaccgttgaatttcctttatccagttgccaagagtagactttggtgcaacaaccatgtgcggaccagttattcccctgaattcatgcagatagcccagcagcgaaatagtttgaagagttttcccaagaccctgaatgatgattttataagtataagcacagtatcattcaataatatattggggacattttattgactttggcttaggagtacacaactaacataccatttcatcagccaatataccattgataccattctcgtacaaccgtatgagccaattaagcccagctagttggtagtctcgcatcttcccctttatacctgcagagcaaaaaatatattacattttaacaatttattattcaacttatattaacagaatggtggcagcatactcttatgatacagttacaaataattgtgaagggaaaggagctcacatgaaggctgtgaaagcaagcgtgttccccctgaaccagcaagggcatcttcctcttctttaaggtattcttcatcttcctcctcttctgtcatctttgaggcatggcgtcccctacagtttaccaatgttagacaatcaaatcatggaacatcaaaaaagaggcacaagattcctaaaatcaattacatattatgaccctgcacataaatagcaggtgatgtgtcccaaatgcccataagaactataactatgcaaggttaattgtatggctaaacaaatgtattcagaatttccttaatcccacaaattgaagtaataataatatagttaaaataaacattatgttgcattcttaaaatcattaattcacaatttcgtaataccaaccagatgaagagaccaacaattactgatatctacaaacatatcaaacagaaatgtttaccatgtacgtttgaaacaccagtccttcagtatggaattattttaacatattccagcatcaaagtacacattctaaattatatcccagttccagcagcacgacaaacaacagcaaagatctatgcaatttccaggatggttgaacacacaaagtaaagtactatctacacaaacaaaaccagttttaccttccacgcggtttcttctcttttgattggttccctttggcaaaatgtgcaaatatttcagtttgctgcagtaggtacttcaatcgtcctttccctttattgttctgttaaaaaaatattaatcagggcaaaaggcaacatacacaaaggtattcaaagcaggttgaaataaattatgtgcacatgatatgccatatcatgtgctgaaaggcatttgtattgacggattcttataggagcaaaccatgtcagcatcaactgcagcattctgtgtatccaatatttcttgtattttctgcttcttcaatttctgcatttccttgagcctggctttctcacgtttccctactactgcacctccttcagcctgtaatgggaaaagttaggcaggactcgacaattcagaaactaaaccctacttattgctcctaataattttgcgtagaaatacacagaatgacacttaaatgacagctacattgcagcacataatgcaaggaaactcccactgttaacacaaccttaattcactgacaacaaaatagaggcaaagctagaaaaaaaatgcaggcataggaaatggccccccaaactcgtacaatttacagaagcagctcaatatattaccaaaatattataaatctaatgggcaccacccgaatcccggttcgaccacccaaaccctagccccctcagctcacctcatctgcgtcgtcgtcctcccccacgacggcctcgtcgtcctcagtggactgcgactcctcatcgccctccccgggggcggcggcggccgcaccgctttcctcctcttcctcgtcggcgccggcaccggtggtgacggcttcgatctcctcctcatccacctcctcctcttccccaccagccgcctcgccggccgccgccgcgggcgcctcctcctcctcctcatcctcctcctcgccagatccggacccggcgccgtccgactgctcctcctcctcctcgccggaggacgagacctcctcctcctcctcgtcgtacttcaccggcttcgccattggggcggcggtggcgggctagggtttcgtagattcgattcgagcgcggaatgtgtcgacggaggcggtgggggttcgaaggaccgagcgatttgggggaaaagggaggagagcgcagctaatttatacgagtggccttgtatccgcaattttttggcagtttgcattttgccccttttctattgcagtattgcatattaatcttacattcgttctaaaattttgatttttttttttgccaggacataatgcaaactacgtgactttctgaagtattagctatttatttcattctaaattctactagtactgcaaataaaagtaatctctagtggaattcaacataattaagcctcgttgcttctattgagtcctaactgaaaaataactatgtgaactcgtagagaaaatattataaattttaattaagcaaaaaagcacattattgatactaattttcccaaaagttttcgggcttggctacaaaatcctcgaggacagcagcaaaagatatgtctgtctcaaaaagaaatactaccagcggcaaaagtggaagtgccttcatagccgatcggaggctatggaacgaaatactgacgtgtcagggatgcatgtgaaaaaatgcagcacgaaatgaaattctcgggagcacgagcgcgagggattctcccgtgaacgtggtccatggcgagcctttcctcagtgggtcccagcgtcagggtcacagttccggtggcctaccgaagaccacgcgtacgaagcgtatttagcaagagggaagtgggcggggctccgttcccgccaacgaggcggggatgggtttgaggcatcccgcccgccgactttgggttcggatccgtccggaccggacgaaggcggttgggttcgaccaggttttgcattctggtgcgaccgacgaacggcccgagcccacggttggtagctgtgggaccatcctgtatagacacgttcgaagtcatgctgggccagcctttggtattggtagccccgtttttcttttggtattggtattgttttttcttttggtaaacgatcgaaattccttttttttttgttgataggacaaaagttgccgattcactctgataactcctagagttcccttggttcatgttttgtaaaaggaatagttctatcgtataagatttcttattataccctggaaatggatttttgtcctttgaggggacatcctctcattttatgtatggcgttcagaaagttattaaaaaatttattaagatagattaatatatgatatatctttttgtaaacatgcgagttaaaattcgacttatacaatttgaaacaaaaataacaaatttgactgtgaattacgctttctattcatagtcaaatttgttatttttggttttacttgtataagtttaattttaatatgtatatttgtgaagtgacatatcatatattaatctatcctactaaattttttaatgactttttaagtgacatgaaaaagggatatctcttatgggtgtttggcaccctattttcccaaccgatctccctcgttttccgtgcacaagtttttcaaattgctaaacggtgcgtttttttgcaaaaaaatttctatacgaaagttgcttaaaaaatcaaattaatctatttttgaaaaaatagctaatacttaattaatcacgcgctaattgaccgttccgttatccgcgcatatttcggttgggaacatggatgggcgaacacaccctaagggatgatttgagatttccattataccttgttttttacatgtatatagtcttctcaactgttcaccaatgatgatgacggccccatcgtttggctttttctctaataagtcaaaacggggcttattagggaataaaaataaatttgtatataaaatttttatagatgtgttcttggtgacttaaaagtcaatgctgaaaaagaaattacgttgaaaatatctcaaaattaatatcaaaattaagtttgaaaatttaaaatttggctttttttttggctgaataggccatccgatgggagcctgattcttgatgtaaagttgtcaattcctttcgttcttgtagctgttttgtgtttatcttaataaaaatgataaacaggtattgaagtagtccaagaggcaccaaatggcatctctagcatcaaggagattgagatatttttgttgcttggtgggaaaaagatttggcaaccgattaaatttggagagctgtcgccgcgttgaatgcaatcagggagcaagatttggacaagatgtcatcatcatcatcatcgggttggagctccaagaaggtgtgcgtcgtcggcgccgggatggcggggctggcggcggcgcgcgagctgcggcgagagggcctcgacgtgacggtgctcgagcagagcgccgacgtcggcgggcagtggctgtacgacgcggcgaccgacggccgcgacccgctcggcatggccggcgtgcacagcagcatttactcctcgctccgtctcaacagcccgagggaggtctgcggcttctccgacttcccgttccgccccaccaatggcggcggcggcgacgcgcggcggtaccccgtccacggcgagctcctcaggtatatccgggagttctgcgacgtgttcggccttatggacgccgtcaggctcgacacgacggtcgtgcgcgtcgccatggcgccgccacggcgcgacggctcgttgcggtggacggtgaggagcaagcacaacggcgatgcggagacggaggaggtgttcgacgccgtcgtcgtggccaccgggcaatactcccagccaaggcttccaagcatcgacggcatggataagtggaggaggaggcagctgcatagccactcgtaccgcgtcccggactccttcgccggcgaggtcgtcgtcatcgttggttgcaacttgagcggtaaggaagtcgccctggagctcctccgcgtcgccaaggaggtgcacctgagctccaagtcgacgaaggaggccatgacgccgtcgatgtccaagatgctcgccaggtacgacaaccttcacctgcaaccactggtcgaacacctgtgcgaggacggccgggtggtgttcgacgacggctcgttcgtcgtcgccgacgccgtcatctacggaggggaaggtcaccgtcgacgacaaccgcgtcgggccgctgtacgagcacgtgttcccaccggcgctcgcgccgtcgctctccttcgtgggcatcccggtcaaggtgatcctgccgcggttcgccgaggtgcaggcgaggtgggtggcgcaggtgctgtccgggcggaggacgctgccgtcgccgggggagatgctgcgcgccgtcgaggagtacaaccgcgccaaggaggccgccggcttgccgaagcggcagacgcacgacctgttcttggacctggagtactgcgacgagtacggcgagcgccactgcggcttcccgcggacggagcagtggaagaaggagctgatttggtcgtccatctccgacatgtgcgacgacatcgagaacttccgcgacgactaccacgacagcgacatcgtccgcgacggccggcgcctgcacggctgggcttcctctcctcccctcgcgccgcggccgcaggagaaggacgacgaccatgacaaagaagaagacaagcatttgggatttggccctagtaaattcagcttaagataagcaaacgaaattaaatgaactccttattttgttcactttatctaattattattactaccgtagtttactactccctccggtcataaaaaatatttaatgcaatcatttatcttatcaataaaaaatatataatattacttattttgtaataacttattctatcactaaaggtacttaaatttttatttgttccaaaattttttatcagagaatggttaaagtcaactatatcaaacatatggctgaatcaggtgtacttaggacttgtttggatgactactccaacttgccaagccacaagtttggtgaacgatttgagagccacaacttagaccaaaaaacatgtggcaaagtagttcatgagcacataacttcttatggcaagctaatatgtggtaagcaaacaaacaatatgctaactacctgtggcgcgtcaaacttgaggcgccgcaaactgtggcacctatcaaacaggcccttaccaacaccagaagtttcattttatgacactgtcatatgactggcagtatgtatatgtcacatacatacaaacttgtgcttctgagaagcctccccgtggaatccatgcaatttttctgatgcaaatcgtttttcagtttatttctataagggagtttaccatgatgtaaaagaaaacctgtttgatcacgtgatacaagctataagtataagtatttatagaactagaaaatgccccacacattgccacgggacgcaagattacttgtctccaacattagattaaagcaatgcatggtatatatttatttttgtatggttatatgatttttataggaaaagaaatgtattcagtttgaaaggaggatgatcatttgagggtttgcagtagtggacacaaggattttccttcatctgtaccattagtttttttttaatctatatctatactaataaaaaaggagaagttttgcatagcaatcctaccgtgaaatcaaaggaatggcagcccacacatgggatccctgccaccgcaaattcctccacgcgagctaaatcctcagcaaatcgcttcccccaatcacgccgcgcccactatatccctaacatgcacctccactctgagccacggctgcggccttgcgatggcctcatgctccaatccctagctatcccttctcctaccgtctcgccatcgacgaccaccatatcaccctcactatcccctctcccacaactgtgtctaccattgttgtccctgaaggaggaagcgcggaagcgccagcttcacgatagcagtagaccaaggatcccttccattgaacctacatcgatgactgaaaagtcggcccgcttccctccctgttgccgccgcggtccccgctcggcaccgcatcacggtgacagcaacatcagccgccgcgcgccggacccaaaatcagcgatgtccctgttttggtgttgtccatctcgccgttctgtggcactgtgatgtagaggctagggctcatggagcttccttagtcacaccgttgttgcatgaatacaagagcgtgagggtccttccctggtcgcgccatgagcgagcgcgcggtgttgcatgaatcagtcgcctcactgtttttccaccatccctatatctggaggcctcactattttcccaccttcgcactctagagcgtgcaaacgacagaaacaacaaatcgggctcccaatctccctttctcaagctcacatgatatgctttttattgccaacatgtcatgctttcgtgggctcttatatgatagcttccaacaaataatttagttaattttactggcaactctgatattcttcaagttgttaggaatggagattatgaacttatcatgatggacatcacgttgggtttcaatcattaaataatgcttcaactgaataatgtgctatcaaaggttcgtcagtcaaaaaatggtgtttatcctatttgagtgcgaatcttcatcatgctacaagcaaataagcaatgtgctgtgaaagaacccactgtttgtttttacagtatacaattccaatcccatttaattgctaatcttttgcttttgattgagttactgtaacatgaagtagcagatatttatttattatttttaccaggctggtgtctgtttacttttgtcggtgacatgggaccggggatatcttgactagaggtttggggcagccgcggtcacccacgtggcctgaccccctcgggggggtcgggcccgagggtgatgaggccgcccctccctctatctccccgaggggtcgggccgctcccgtttcgtccccgagggctggggcgccccgaccccctgagggtttggcgccacgtgtgtgggttaggtgagcacagcggcgcttacctaaccgcgtttattgcgggttggacgagcgccccacgccgcatttaatgtagtgcagcacactcatccggtccgtgatcggtcacagtgtgtgaccggtcacagaccggtcagatcgcgggttagggggcaacaggcgggctgacacacgccttgccccgttccgttggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgaccggtctgtgactggtctgacgccggtcgcgtcatcggcaaacaaccgtgcttccacgttgcacctgcttccggcggagtggaggttggtatgacccatcccatcggagggtcattcggacaacagccattgcaaatctccgcccattaatgagggaggacagggttatcccggtgtcaggcaaaggtacgagccaagttttggtcaaagtaggatgggtccccacccaaaagaatggtaggtagaaatggtgtatgtggtatccccttgagatataaaaggaggaccatgcctaccaagagaggggacggacaaaaagactggagaagacctgagctcgtagaggggactggggaaaaagagtagggagagggtctctagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaccattccacagatcaagggcttagaacctcacccagcgcccctggccgaaccggcaaaggggggcccgcgcggtctcccggtgaggagccccacgctccgtcaactttgatttcacttgtttcatgttgtgcggtacatggtacccaggtacacacggcaaggccttgggccgtgaagcatggggtgggccgagtgccctaggcccatgcggactgcttggtgattaagaaagggattaaaagacaaggctatagatcttatcgtgtaggcacgcggacaccgcacgatgcacctccccgaatcgtggctgctgcacactactgaacttgtgcaacgccattcgtccaactcattgatcccacggagcatgttgcaccacgcaatgcgaccgggcagctccgcgtcgcgccagcagtgtcgcacgcaacgggccagtccacgctatgccccactgcgccgtttctctcggccgaccccgcaccgctcctctcggccgagctcgagccagcatcgcgctgtgccaccatctttcgcaccaagttgttaacgccaaaatttggtaagcccctaggagaattatcacattatcaatagttggattcctgctatattcggttaagaaaattaatttatcaaatgaagcttatccagaagtgaccgagttcaaggaggatgcggcatgccaagttatctattaattaggaatagtttgttagtttctttttatctttaggaaagtgtgtttagtgtcttataaggactttatgttttccttttatctttagaaaaatttctttcttgtcctataaggactagtatctacccatgggtataaatatgtacacccgaggtcattgtaaatcatctctcgatcaatactactctcggcgcatcgccaccctctttcccgaggtttttacttatcatccggcggaatttggcacctgacgcggggctgcatcggttcagttcaatctccggcgaaggggtaagtcctacgttccgccggccctagtgaatctattggctacgttggtgttgttcaaggctgcatcgcttcgatctcttggatcgctctggtttggttgatatatttgcctacctgatatctcaattctatctctaattgcattatgtttagagacacatcggtttagttggaactgtctcggttaggtctgatcttctgtcttagccgacatatctctacaatcacaatgctgttgtaaatagatttgttctatccatcacattagacagatctattggctcatcgagtattagattatcatatacaatcttgtgctgcatcggttaggttcgacctactagattgttgataatataaatcggttaggttcatgctagtgttttatcaggatactagccgataagttttttggacgttgcattggcttataaggattgcatatacatataagttggatttagccgatgacaacagaggtttcattgatttatctaatctcgtggattttatgatatcggacctctagccgatgtatgctttaaccatcggatcagtacttgttctatgatatcatattgttagccgattggtttttctactggattatattattgttatattgcatcatcatcagccaactgcctttatatcattatctacattggatatattgccaatagctcaaaaccctatcgatatcggctggaattactccattggcttgtcagccgatcggctcattgatctgctatttgtatatcttgtcagttgcagggtcaaattgactggcacgcccgcatcctatcaacctttggactgtactggagctaagcagatctcccaggccagtgtgtgtttttcgcgtcaacacaggtcgaacccgactgtgtgacgtgccaagctgcatcgcccttccccatgtgctgcaccaatcaccacccatatccccctcgctgatgttcttcctttgactccctcgcctcgtcatcgagtctcatccccggccccgctgccacagcacatcactgaccaaacatcaacacaacagatcagcatgccgccactaccgaatatccatctcactgagcagcaccctccgctccgtagaaaaatcaccgcgcctcctcacctcggccggccctgcctcagcattgtgtctcgtcgctggtcccgcatcactgccaccgcgcggacccgctcagccatactgccgctgcgagatcgttgacccaaaacaccacgcgcgacctccttctggcgccgtctcctcctctgcacagaagtctagcgcctctgtcactgttcagccccgcttgaccttgctacagcaccggataagccgactcaacggcgaacaccaagaatcgccatctcgccacaccgtccatcccgccgctcagtgaatctgtggtcgagtagccaaccccctcctcggcgccaatggattgcatcgaacaccaagaagcggacacccaacactccttgttcaccaccacaaccacgccacctcaccatcaatccaatccagaagcttcctatccgtcaccgacaagtggaacccaccgtctcgttgcctccccattccacatcttctcaagcaagccttcgtagcctacaaataccaaattcccaaactctccgtgtctcggcccaaaccgagctcaaactcaagcgagcatccatggtcaccttcctaaccaccaccacctagctgcctcatctctcttttccttcatccacctacaccccaagcttccaaaagaccatcgccacagttgcccaaccttcccttacactagctcggctccaccattctgcgacaagtactggacattctgttgaacacctaattggcatccaggagcatgcagtcctattttttctccaccgccactgtgatcggccacatttcgcccctgcttcaccatggtaaaataactctctcctttagaatccccttcattccctacatttcattattcatgtttcctcgaccgattgcaccatctagaaccatcaccaccctggagcccttcgctcgtgtcgcttcctccctagagcgacacaagaagcgaccgaaaaacaccgccgccgcttctccttcttcctcctcccaccttgccgctgctcgagtggcacgtcggcaaagtcggccgaccatgaggatggcggcatcagggctttcccctctctctcaaggaaggatgaagaggtgatgccgcctagatccaggccctgctcgtcctgatccggcgaggagcggtgagagggcccccatcagatgatttggatggtggccaaggcatccaagcttgaggagggagtggggcatcaatagccaaatctggatcctgcgcagccagacccgatgccctagtcccactggtggatacggaacatccacgctgaatttggccggagttgctggagcggtggagcatcagcagtgggaggcctacacggacgtctacgggggaggccctggcggttggtggcaacgggatgctgtagcagccagtggcaaggaggtcagcacgagcaacaatggcggaagggctgtgacggctggcggcaacggaaggctcacccgactgtggtggtggcggggccttctctctgggcgcatggagatgcgcaggggctgcaaccgcatggcggatgactagcacgcgtggacggcccattaatttcacttgtaaattgctttaaattttaatataaattctaggaatgatttatttaatgatttttaaaccccaaaagaaaattggggtgtgacagagctctcctccatgaggaataagccattcggggcagcggttggcttcgaggaataggcggttgagacactcctcgacatggcaaagcttttgacacaagtggcatggggcggcggtgagcattggacagaggatggcaacaagcgacggagcgaggacgcagcatggggaacacaatatttggtgcggcgagctcgtgaaggtgtgtgtgtggggggggatgtctagtggtcccttttataggcttgaggggccatgaacaaggtgggagctgcggtaaccgtcagtagatgtaggtggcgatgtgggcagggtgtgggctcaagtcagcgcctatttttgtcgggagagagggggatgtgggtgtgaatatggcgatgaccaaatttgcgttgtttgagagtgagggaaggagcggtgctcgtggatcaggtgggtacgtgggagctacagcggtcgtcgacttcggctagtggtaggaaatgagcctgacaggtgggcctcggtcctacctatcattgagaggaggaaaggcaagccaagcatgcccggcgtgggaggtgggaggaaaggctgaatcgggtgtgggtgagatgggctgacaggttggtgaccccaaaaggagggggcgtgctgagttaggagttgggctagcaaataagactgggccatggggaaagagaaacaaagagagatgttgagcgacctgcgactgcgagagagaggggaagaaggaggagcgggtgggccagactactattggtcacgtgcgatgaggagtgggtcggaaatgatggcccacctggaaatgaggacttttaattggtttttcaatttaaatattctctgaaatggactttgtgctattaaaatttgatgttgatctctgaaaattctgagaaaattatattaattattttagggcatggataatacgagaaaaatattcccaatcatgatttattaaaggaaatgttattttctgaattaacttcacttgtaaatttctttttattttaatataaattctagaaataaattattaaatgatttttaaatccctgaaggaaaatcaggcatgacttactcctacctcggagttaggcctctaacagtcaaaaattctatcgcaggtctataaaactaactagatcggatactttgatcccaacataggaaactccgattttaaatggcaagccagactgagaaccaagttcctcccacgaatactcaaatggattagacagtccgatagaggtcggatagtgtgatgttgctaagataaaaatataagaactttttactccagagtttgattttgatgatcttggattccatgtaaaggttggttatagggctatcaaatccatcataaacaattgtccaaagataaatcattttgagaacttaagcaaacacatttgtattcatcttaccagtacaacattcctatactcaatccagattttaattaaaaacaccgagaccggtaaaggatttgaaaaaggatgcttagtttcattatacctttgccttgtgcttcttcttgtggacttagctggacaacgcataccactctgtttagtcacattcatttattatgatgtttggtcacattcatttcttccagccacttgatgcctttcaacttatgacgatatcaatcactgttgatgtggatcaacacatgattcccatgtttcagctcttcatcttgagacatacgtgactgttgatggtcattatcgatcagtttcgaccatcaatattatcaaaataaaggagaactagtgatgcttgcaatacataaatatgttagatattatcaggggaggttgggccgaacctcccttgacgctgttggatccaggttttggctggacggcatggatcactccccaataacggttggagggcaattccgaccattccaactaccacaaccgtcattggcagcctatttaaggagctcctctcctcacttcactcacacacctcaagcaagagctctctcattcctctcaagtttagtttagtagtatctagctggtggaatagaattagaataggaatcaggagtctggaagccttcggaagagttcgggtatggctctagtagctttcctttcctcttttgtaagctttgtactttcattagaatactcttctagatacatttctggtattgaaatattttccgagtatatgagtaccttctttatattatgttcatgttatactgaatatactgctagcttatctgggatatgctttggtgcaggtatagtgtttgcttatgcaattattctatatcatgacgatgatattagagtagtatctggtaatttagacgtggtgtctagattacgggatatcattatttggggttatatattgcggatgagaggtgggccgctgatggtgacagctcagtacgagtattcctccgtgcctatatataatccttagttaatttcctggggagggtattcctctgtatttagccccggttggatggtcatgacgggctgtcgtaaagaactcgacagtcaggggtggcttctcgaagtaccaggaaggcatcggataaatggtattagctagtatatcagttaactagaatgtatgtatactatgtatattagaagtataggaatagattctctttctcttttctttccacctagcttagattatttattatgaggataagtagaaaagcttgtgtgtcactctacccttggattatcataacccctgcttagaatatgattatcacaagtaatatataaattattagttgagttctctctacatgatctttccacgtgataaaataaatacgatacccttggaatactctcgggtgaaatgctataatggtatattcgtgtgcttgcggatgaactctgtaaccataatataccagaagtatttctgcgccattgctgggaattatatttctagtaacgtcgttaagaaataccaacagtgacttgatctcacttgagcatcaacattattttcatttcttggtatctatttctttcattcaactcaataaaactgttagtcccaatgatctggtagtcaacctccacttgttgaccaaccgatcgcatataaaatgatatgaataaattgatgaaaatcaacaacaccacaaatgtcatatactcacacatatacacaaatgtaaagatctcaattaaataaaattgattaacttggatcacacacatgcataataaaatataagatatacttcccccaaaatatatgcatacaaaatatttcgagtgaaataggtgtatgcataatttttgatgaatccatgggagtttatcctatacaagaaaagaaagcatgtgtaaagagagtatagcttgatttcgatgtgtttcatccttattgagattaaagtcaaccatcaatggatacatttctatcccaactcatatgacatccgagaacaacctatttgccaactcatggaaaaaagtaagtcacagtaacctggtttgtcataaatcaccagaacaacatttacacattattgaccatagatcttttgatcatttccgttttggtgttggatgacaatccaatataaaatatgatcatttcctttttggtgatggatgacaatccaatataaaatatttagagttcctcaccctatttgggaaccattagagagataatttagaacacgaggaatttaacacgtacctctcatcatttttatttttcatattaattgagactatgcaaaataaatgtttatatataaaagataatagtatcatataattggatttggcattagtcaccaaaactaatccaattgcacttgaacttacatcgtcgtcgtctgagttaccacgcccgagccgccacggtggtcgagcaactgggggaggcgcttcaccagcactggtatggacttggtggtgatgatgaaggagactcaccagcgctggatccctgtggcggtgtggtcgacgtcgtcgtcaccctccccttcatcatcgccgccgagtcctccacttgctgaggctcaccaaagctgcctgctactgccagatcttgcggtcccgaggcctaccaccgtcaactctgatggtaccgaggctagcccaccaccgtcgttaggatctttcgctggtagatccaccatcctgagctacggggagctgcagtcgttgccggtcatcaccattgcctttacttgcttcctttcaatgtggagagagagagagagagagagagagttcatgaggtagtagtacggtaggcctgtttcaaaataggaagaggagaggaaggagaggcccgccaacacgatgactggctgctgtcgttcgggaggagagtgctggggggagggggggtggtgtcggtgactgagatggggatggagggaggggaaaaggagaagtgaggcaagggaggggctggccaggtttttcttttatttaagttggggttagctagaccggcctaaaagtcatctagaactactcctaatgtgtggaaccattacggataggagatacatctgtaacggctcctacaggagctattacagatgaggtgcaaccatttctaatggctcataatggaaagccattacaatcatgaggggctcgtttgtaacggctcctcaacttaaactgttacaaagttggtagatgacatatgtaacaactccatataactggagtcgttatagatcagtgctaatccctaatggcttgaatgtcactcgttatagacacgtgatatgtagcggcgcacttaagcccatcatagataatagatgtgaggatatgtggtagtgacaattaccgagtgtttttcactatttaattaccatgtgtttcgggcacaagggagagattcccttcttagtgtctgtagttttgatagagatcacgattactgtgtaaaataccatatcatagatggattttacgaaccatagtaattttacattccctgtggaggtaccataagctaccaaaaatttagggtaaaatttggtacctcctagtacctagataccaaaaggtaccaaattacaatagaaaaagtggtacctcctcaagtactataaaattgctcgcaagaatatatatactactctctccgtcctaaaatatatgcatttttagcataatgacaagtcaaacatttttaactttgactattaatagaaaaaaaataaaaaaagatcaaccatgtaaaattgatgttactagatttcttattaaacaaaatatcgtaatatgcaactcttcttatttgaaatattttacttttatagatattgttggtcaaaatagtatctcgaagatcgtgttagtcataaatgcttatattttagaacggatggagtaattcttttgatttatagatgtgagattttgacggaaatagcaaatccaccttttccagagatgatatattgtactaaacacatgcgtacgtggctagctgttattattatatattcataatatatgccagatatgtgcaagcacactttatggagctcgcgtggtatgttcctgtacaatgagatccaaggtcgaactaaagcaggtatgcaatttctagggctaattaagcaagcaaagcatatgatgaaaagatgatcaatatatcgtgtggcggatatatgcttaccatcgatgccattaccctgtagacaagctacttgaagtagaatgtttgccaggggccaattaggcacatatatgcgcacgatgtcactttggcctttcccgcttttggcatctggttcactgccccccggtgggtggctgcctataaatgcggggtgtaccatatacatgcaaccatgcagaaacgaagcggtcgcacgttcttgtgactgcacaacacaccaacacctcgatccctgtcaattctctctagcagcgcgcacggccaaaattcatgggcacgaacggcgcccagggctcaaaaggtgcgtcgtcgaccaccactaacccgacaaacgatgacaagaagaagaagccggctcaggcgcccggcgccgatgccgatgccgatggcggtggcaagaagaacaacagcgactacgtcgacaagacgctgtcgacgacggccaacctggtgaagctcctccccacgggcaccacgctggcgttccaggcgctggcgccgtccttcaccaaccacggcaggtgcctggccatcaaccgctacatctccggcggcctcatcgccttctgctgcgcgatctgcgcgctgctttccttcaccgacagcatcatcgacaggaagggccggccgtactacgggctagccttccccgccgacgaagacaccggcaagggcggcttcgtccccttcaactacgagaagccgcgccgtcccagcaacggcgccgccaccgccgccgccgacgacgacgatagctgggaagtttacttcgtggatttcgacccagaggacactggtggagaaaccctttgtagtcccggttcgtaaccccctttagtcccggtttccaaaccgggagtaccaatccgggactaaagatcgctatctttagtcccgggtgaaataactgggagtaaagatcgatctttagtcccggttggtgtcaccaaccgggactaaagatcgagctgaccttttttttttttgcatggatattggtactcccggttaaaccatgcatatatatgtttcaatacatatatatgcatacatatatatatatgtatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctagctagctacgatttcgacgtagtagtactcgctgctagctcagaagctaaggaccggtgaattgtgtttccgtcgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtgatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgttgatcatgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacaaaggaacttatgacggtacctgtctataagttcgaaaaccttgtcaaacgtagactcttttttatccattgagtcatatacgttgacggtgcaggcctccaggtcgaagagtaaaagcacccagtggaatctgcaatgtgcgtgggatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgtttcttttggatattggtcgagcattgcgacgtttactttccgagggtcgatgaatccagtatcgaaaaccctccgccgtcgggccctttgaatctccattctacaacgataaaagggagtatattattttctatagtctacttatatacaatgacctaattagttaaaggagacgtatagtaagaaatctaactgaacgatatacttacaaaatccagcaactcataatagagacgtcgagggcgtccagctggtatagttcgtagattcccctgaaattgatccagagaatgtcatctccttgcaagaagtccgtgtccctgatcctcgctccgatcatctctctaccggtggcgctcatctccatgtacagctgatggaacttgtacatttgtgtgggtagggactgcagcagctcaggcttgacaagcggtttaccgagttcgtacatgtatttcacttccggcttttcgattggtgcgactcctagcaattgatccgtagttagaccggtgtcaagaataaattgttctatcgtcatttctttaccggtcacccaacggctcgatcttctgggttggttgctctccaaggctgaggacttgtttggactttccaagaaaatcttncttcagcgttcgcttatagtccg

SEQ ID NO: 60215 - DNA, 54414 bp, Oryza sativa
ggcagtatgagtacaagtgagtatttctttttccaatcatactattaagtgtgaatatatataactataattttcaaataactctgcacttgaacaggtacaaaataccattcattgcaaatgatggcacagctagccttgaacttgtgctatttgaaaagaaaggtacagaacttattggtaggactgctgaaactatgaaaaggcaatatgatatcaatcaaacacctccagaaataaaagcatggataggacataaattcacattcatagtgaaggttttgccgaacataactatcaacgctgatgaaccttcatttgaggtgctgacaattaaagaaagatttggaaggcaacattccagccaaggctttaaggcaactaagaatcttcccatcagttcaagttcatctcaacaactacataatttacctccactggtgcctatactatccaagaaaatacaacatgaggtaaaagagtagtactctttcttttattcatttttgtcggtgctacataatctcttactatttcctttcttttctttcttatttactgctcatcatcccagatagaaccaccccaagatattcaaagcatggaagttgaaccatataatttagaaacaagcactttgtcaggaaaaagagcttatgaagatccaaacagtacagatcaggtaaacaactgatcatatttaaattcatttgtttttcattcttcaatcatacaattaacctactaactgtactgtgcacaagcttggcaccatttcaatcaagtgtatttttttagataatggaatgaaatattcaagcaagtgtataccctgtggtcaacaactattctctatttacatgtactattcacatatatggctgacactaggggtctcatacttgccaaacctactgcctgcattgtgctaagtattgcatgagaaagaattgctggttccttagtaatatactttgataaggattctgtttttcttttttaggaaaatgatgaagaagaaagcactgactatggcttcattcagacaaagggcaaaaagaagcgttctacctgataacttctccaatcaagacagcctacttttgctatctatagtccaagatggacacttttgttatcctctcatctactagccaaattacttttggtgtatctagctctgactaagaacctagactgatctactagccagttactctaatacaaagttgacatggagctttattaaaatctttcattatttaagctctagatcaacatctagaggatgatgacgatgacgatgggttgcttggttccggcaaacgattacgaggacgtcggccgggttctcgagaatcctgtcgtcgtctcccgttgttgaagataatatgtcaatactcttcaaatgtctgtcacaaatagccactgtgttttgttcagattatacagtctatatcacactatatgtcacaaaaatcttttaaattttgtagtctactacagcaatcatgattgtgcactgtagtatcatgctataacttgcgcttttttttttagataatacttgcattgttgttaaactgattattctgtctcattagggtcaaatagcatggcccatccagtattgcacgcggctttgccgcgtgtttttttctagtgatgatcctaaagcatttcaatcattaaagagatgagtagataaaagagcaggataatagcttatataagtgccatgaattgaacacctaaactcccatgctctttcccaaaaaaacatcagccaaccttatttagagcatgccaaatggcaattttaggacttaggagtattactcaaaggtcagcggtataataataatcacaatgcaggtggaagatgctatgtacgcggtgtggccgcgtcgatcaggggcctcagtagcgtgtgctacgcgtggtatcctaactctcatcacaataattcatttcataaccaaaaaaaagaaaagaaataatcctttttaagacctggaaatccatatgatctaagatcctctataaaatgtcaaagtaaaaaccaaaaggatagattatgcactgcaatatctgagaatgggtcaatccaagcaaacagaacagtcccatgcaaacacgcatcagtgcagtggcggagacagcgtgggggctggggggtctatagaccccctaccccctaatagatcattagagcccccattaagaccccccctaaaatttaaatccatatatctattaaagggggctaaaatagactttatctgagattgttagaaggcccaaaagtctgaggagcccccactataattttatcctggctccgccactgcatcagtgtacatcagctaataagctaactatctaagtggaaagcaaaacaaatatctatctatccaaactagcagtgagaaaaaggaagaggaaataagaaatagtggcaactacatacatctgccttgtgatccaacaaaatcttcagtgtcttatccttgccattgttagcagcatgaaagagtggtgttccaaggccacagtctatgtcaacaggtatcccttttgaaagcaagaactctgttaccttacagcatcctgcagtgaatgagatgggccataaatcatggggaaacaaatactatataaattgagttatttgaataaacagttagtaccagtataatggacaaatcacaatagattacatgtgagatgtgaccgagtataaacagagcaaacctatacaactttgagtggtgatatataaactaaaagtatctagattagcaacacaataaaagataactgtgacgacatggttgaattaaatgtaatctattaatagtaatgcagtatcgtagaatcttgtacaacaatataattggtaatataacaaggaattggatagtgttcatatcaagggagacctgtgccagcagcatggtggagaactgtgcatcctctaacatctgcttttgttacatcaccaccatgatcaagaaaatactgcaccgtaggaacatcaccagactcagcagcggccataaacggtgttatatctgtaataaacagcacatcagtacacttggcacattatactgccaaaacatagacatggcagccgccaatttcatgaaaggatggtagagttagataataaccttcttttccagcaatattcacgtcaccccccaattcctccaccaagaacttgcaaacattcagatggccctggcatgccacggcgtgcagcatcccaatcccatgcttgttaagagctaagactgcatactgggtctttcctttctcgatcccaaggctctttaaaataccttctcgcaaataagaacaaaaagaagtcatcacagtgaggaagataatctgcgaatgaacagattaactaggtagaactcgaaaaagcgacgaatacgtgcaacgtgcaagaacctcactgagtcatgtgaacctatacttcatacttgcgacttgaaaaacatttttgtagagtactacctgctactcatcacacattagcacttggagaggtaactgtaatagaaagatgatcacaacgttgtcgcatttatccaacgcaaggacttgctacgataaaagcctcagatcttgcaatttctagataagatggcatgcatctccagtaatccatagacctggctgttaattccttcacgcagggtcaaaaatccatgcaacatataaacattaccgaaaataaattgtgggaaattcccaaaggcaacgagtgctagatacagaatttgcattccaaaattccatggccaaatcaattaacagtacagccatcgccaagcgctccacacaaggacacacatgcatcacccaaacctaagggaggaaaagcacgcaacacaggcgcatgcaaagggggggcaatgcatacacgcatcgatcgggggggatcgacgcggcggagaagaaggagaggaggaggaggaggaggaggagaggaagcaaacctacctttgaggcgtccgaggttcccgtcgaaggccgccctcaggagagcgctctcacctgcgaacaaaccgagaaatcgccattagaccacatggccgaggagctagcaagccgatcgagctaggaggagatgcggagaggtggggggaggctggacgaactggtgccgtcgtcggtggggcggcagtagacgaacggcgccgccatggccgcgaggagggaggaagcttgcaggaggaggaggacgaggagcggagtgggtgggggtggggggttttggtttggttttggtgcactggacccggtgcactcgtgggactcgtggacaaggtgcacggagccgttttgctacactacctctcgctgtctcgcagatagatggtctatgagtatgacatgggtggcccattgcaggggtctaggccctgtttagtttctggaaaaaaaatcgcgctgttacattgaatgtttggacatatgtataaaacattaaatgtaggcaaaaaaaaaatcaattacacatattacatgtaaattgcgagacgaatcttttaagcctaattgcgccatgatttgataagtggtgctacaataaacatttgctgatgacggattaattaggcttaataaattcatcccgcagtttttctgacggaatctgtaatttattttgtcattatactacgtttaatacttcagatgtgtgtccatatatccaatgtgataaccaaacccaaaaacttttcccaactaaatagggccttagtttcgggaaagacggactcccctgacagtaacataagagagagaagcgggttgtctatgtcggactctcttaggttagtctctttttgtttagaagggatggagtataccagtacagatcttatttatgtgcatccctcgctatgactaatcttgtctacaaacctacggtggattggagttctgtagcccctcccctgtcacgcactgaaacttgtccccttttaccccatctctttgcttgcatacatttgatcccaaatgcagcatatcagagagagaaagaaatcagatccttcaatctaaatagctatcaagaactccataatacccaaataacactacccatgttttggggcaaacaaaatgccaagccattcgagtttagaaacgaatcaaacccttaactagttgcctccaaagtgtagaaaagagactcacattgtcagtgacgactatatatatggccatctcatcgacggtgtcaacctcccgtctcatcgacagtgtcaacctcccgtgggtgtcttggtggattcagaaggaatgcactaggatattatcttttcgcttatacttattagtcaaattttaaaattttaaccttaaatttagagctaattttaagggttttttttatcaaactttattttttagcctttacttttagattgataagaacacatatataaaagttttatttagaaattactttttgtttgtaaatatacagtttcgtttactccgtagagtagagtagctggagcggagagacaaaacagggttcaatctatgcaaaatggcgaccccggataaagcaccaatcttaaacttagatgaacggtcaggaattcggctggtaaacaaaaaaaagacaatcaatcggacagtatcaccccgtatctgtatagggttgcaacgaagaacgagccaactttccccgggccgaaaactgatcgggtggtgcggcctctctcgcctttgatttaccctttcgcgcaccaaacaccaaaccctcgccgccgccggcgccgccatgcggatccccacggagacggagacggagacggggacgggggcacggattcccagccacaggcggcgcaagggatcgtccgacggttcgcgggccgtacaccggcgcaaaccaacgccgaccaaggagacggagattcccggcggccacgggcggccgaagcggtcctcctcagccctgtcgttggacggcgccggcgactccaacccaacctgggtgatcctgaatcgggtcggtgcccggagggattccttccgcggcgaccgcaccacgtcggtggcctcccgcacctccggcggcaaggagatctccgtctcgttcgagctcgcgccgccgccggagacctccctcctcaccctcgactggccgcaagggccccgcccgtcggaggggaccacatcctacccttacgtcatcgcggcgcacggcaacgtcgtgctgctcgagatcatctccaccgccaagtgccctcgccccatcgacatcgactacttcgtctacaaggccaagcccaacggggaaccctccttgacgcggctgcccgtttgctactggaagggggcttcgggcagagacaatcctcggccacgcatcatgagtagggtggccatgggtgtcctgtcctgcagcaaggattcgttcgttgtggccgagatggagagaaggtcataccaaccttctgcagctaacatctacatgtttttctccggctccgacggctggagagtcttcagggatgtgcggattgaccatatcaatggtgccggctggtggtcaactgatgcagtgttatcctaccgccgtcgctacttgatctgggtggactacttgagagggatgattgttgccaaattggcacatccaggaggaggagacccacaggagcctgctctatggtatgtaccgcttccggtcgatccggttatggggaacccttatgacagtgagcgtgggcgaggatgccctgaagcttcccgtaatgtgtgtgccacccaccatggcatcaagttcgtcaatatcatcaaccaatgtggtggcagttttagcataaccctgtggtcgtggtgcgaggacggaacatggagagaagatgcgacactggatgctgcccaactttgggacctcgattgtgaaaaccgccttccaaatgtccaaccagaattccctattgttgacatggaaaacccttacaccgtttgcttcttgttgaacgagggcaactacattgtccctgaagccacaacatggatgatcaaggtccacatgaagaagaagattctactaggttgtactagttattctaaaaatggaagcttgtctcatcagaacaccacctacatgactgccagaaggatgtctgagagactctcctttatctccagtgaaatgccatattacctgtctggacaaaccatgaaaaggtaataatttcatgtctagtttgccaaatgcatgccatactgttcttttggttgcatgttgtacagaattttcctagtttgaagtgaattgttctgcccatttatgtttagacagcattgacgttgtggtagcttgatcagtcaagagcatgattttagatgaatataattgtggctaggatttagctatttagcagcaccaacgtttcttgctccctttaattacttggtcctgaatccctctataactcatcctatagtttatacaaaatcgatgtttgtttgcatgtttttatttcgtcttctcgacactttttctaaaaatatcactgaaccatttctgaatcttaatttcaagcaggaagttgataaactaggaatataactggagatcgaggaattgtcttaccagtttgaagattggatccatcaaacactgtgtttgcaagagcaagttcccaacactcccctctcgttttccacgcgcacgctttttaaactgctaaacaatatgtttttttaaaaaaaagtttctatacgaaagttgttttttaaaaaaatcatattgatctatttttggaaaaaaatagctaaaatacttaattaatcacacgctaatagattactccgttttccgtgcgcactgtgcatgttcccatccttccctaggatgtgagctcctgcgtctgcgtgctacagtaagttataggcaaaattggttcgatgctatataaccaattttgtcaataataaaaaggctaaaagtttatgccatagcaaacgaaacatgaagtgctactccccacatctgatttgccatgcaattttacaatcgaacagaacaatcaaggagcaacatttcacaggctagagaacatcgtaaaatccagttgcttctgtttactccatgcacaatgtgacaactgacaagcatatcatatcatacggccgccgatctcctgctacagtgcgatgtataggaaagtaggaatgtatgaggaagtgctatatatgcctatcgtatacccatccgacagtaagccgaaattctttagcactcggaccagttttctgtatctccacacctgggctgaacggcttttgtatgcgcctgcatgatggagatcaacatttgtcaaactcaaatatataaaaaagataaagggatgccatgaaatgcgcttaacgcaagagaattttgaatttgcacgtgaactctgccatttttcaggcagaaagtacaacaaatcgtgcgtggtatttgatcttccgtaaaaaagaaagagctcgatatttcaacaagcctggctagtagtgacgctgatagaagagttagagagcaaattgtaaggccacgcattgtatcatctcatctctaatcccgtgcacattcggcgcaatattgttcatgccaatagtttacctgcgggtgcctttcttcacggtggttgaaagttctgtgctttagctctccacggttagttgtcagctcatctaatatctcggcatcgtcacggctgccacagctttctgaatcagatgcaccatcctcctgtgtggaacaaaagattcagattaacaacagacgtggggcatcggagaattaaagagtgaaacacaatcatcactgacaagtaaataatccaagaatgggagataaatttataccagcgtgtgatcgtggtggacaccttcaagctcttcatactcagctgcatccaattcccgaaggtcatttggctcaaaaaactttgggaggacatgctgcctgataagaatcataaggaagaatggcaacgggaacaggatccctgctattggtatccatgttatgccgaagcatatcaagaggtaaaccaactggaagatcgtgaagacagtaattgtttttgaaggcactgactccatgaaagacgcatggggaccctccaaaaccctgcaaatgttgaagcatagtgtgagctgttaatcactgttttgacaaaaaatggattatcttacgattaatccaaaaggaggcacataggctgcaccgcaagtagtcaagcatgcaatttcattgttcaaatggggtaaacagatgcagatagagatattacttgtagcgtcggcttgatgggatgaatataagtcttattctttcccaaaactggttgccaggtagactgtcaatggccatataagcaaagtaaccccagaggaccgatgtcggtatcatcttgatgactggcatagctccaacacaagcaccaactaataaggattgcagcaagttacttagtctctgctcattcactcgaacaggcaaatgtgcttcaatatgttttatagggtcaaattcttcagccaatgtcccttctttatcaccttcttgcagcatagcatccttcaagctctttaactccttgtcaacagaatcagtctgcaggacaatttttgacctataagttgatttacttgaacattttccatacaagactaacagtggcatctacattttgaatagttactgaaagaaaaccaaaagtatggggactcctcgtaaggtgaaaagtaaggtgttcaggcaattacatgagcttaggactaattttcttgacaactgatgtagtaattttgacaggaactggcattgacaatagaagtaaaatgcaacaaataaatggaagaggaaattatatggtaacatacatcagtaatgaagagtacatactcacatttttttcacagtccatctcaatgaaaaccccttgcatcttgccatagatttccaaactgctagcacgattcatcaggccttcgttggcagtttgaaccatctttttgcgtagcagctaagcaaacagaggaagaagatgggtgagctgatgagcaaatatggatattgtagcaaacaaaacacttcggtctgaagttcaccaacctgccccttaaggacagcaaggcttcttgtatgcatcggggactgaggaagtactccattagatggagggatgccaatcaaaccacaaagcaggacctgcatcatttttatactactatatgagaagaggagcatgtcacagctttggtctattacaccacaaagcagaatcagtgtccaatactcctatcaaccatcaccttgtagattgcagtagtgccaggttataatcacgcaaaaaagaatataagatattatggatgttggattttcaatcatacccattcaattgttgtaacaaataccaactctactttaaaatatatgagaatatttcttattcattttttttgaacggaaatatttcatattcataagactatactaaaagattttggctagttttaggctagaagtgatagagaaatgaaatgttcactgaggaccaaaagatgttaggttcctagttagccgagaaaaaaaaacttaagaagggccgccataagcagataatttttttagacgggtataagcagataaatttatcatagaaccatggcacacaccatgaatccgaggaccaaaatgtcataatggtaagcagagggcttcttcaagttaaactccttttgttgcgccaattgtgaagccacgctatgatcaaagaagtaaagtcctgcaatcatcaaagctggcagaatggcagcaaatatgtatgctgggggaacagaaaacaggtcctggaaataaaaaaaaaacccaaagatattatcaatgatgccatgcaaaataagctataccaaaattctaaacctgaagaccataaatattcacatctccagtatcccaagcaagtttgatttattacctttgctatggtccagtgatgcagtgaacttgactcccagggaagtggactgaacagcctcctaggaactcctgaaggaacatcctttggtaatgcgtacgataatgctgtccaaacaatcaccataagtgggacaccataatcagaaatgaagcctctgagccaccctgcaagtgtcaactcaaacgcacaatgatcagttcatgtacatgtgcttctcaatggttataaaatgtcatcatggagtcatttgcatgctgatgtagcatacatagtagtaatttcttctctttttacttgaaagatggcaaaagctttgcgtatttaatagagaagatagtagtaatttcttgtttttgtttctaaatgttaaaaatttcaaagagggaaaaacactgtgcagaataagaatctgtcgatatgggctactaaacaccatctcaagccaagccatccactcaataaggaaaaaaaaggagtccatatggtttgccccaaagctgacaggctgacacaacacaagcttgcagcccagcccaaccaacgcctgatctaaagtaggcccagtccaaacttcaaaacagcaaaagaaatgtttggcataaatctaacggttggatggatgactaatggaacagctattgctaatttgatgacccagagctcaacttgccccctaaattggacacaatgagataaaagtaagatgaaaacgtgaccaaccttgaccatacacccatgaccttgcccttcttgaccttaatgcagtgtataacagcccaattgaaaagattacaccaagtaggccgttgacatacaaccactggaatcgatatataggtgaactatggtcgacacctccaggtaccttgaattcttctataattccctgcaataagtaggcaccgttctaaatattttcttccaagatacaaagcactgagctcgctagaaatagcatactttaatagcttgttgcaggaacagaacagtgatcaacatcccgaaaagttctcctgcaacccttgtaaacctgctaataacattagaagcattgaacattgccagaagaaacaacatgatcgcagtccagatgcagaccctgtcaacagtaagcaaatcaggagagcattaacttttttttctgaaaagctaacgtgatagtattcagtttcagttgttaccatccagcccatgctaaatacagtcgttcccccagagcttgctggttcttggcaaagttgtagagatacgtgtacatgattatagttggctctgcaactccaactatcaacagaggctgccctccaagaatggaatggatgatgccacatattgcagtagatgccagtgtttctactgtggtgagtataccatctgaaatgaaccactttccctttgttagagatgtaattaaagcctaaggacagcaattccaaaaagagcacaactgtagtatggctcatagtggcaagagggtaggtatttacttgtttctctgctcagttgcgttccgaaggctatgactgggagggcagaggcaaaaaatatatacatagtaggtgccaatatcctgacgatacatccagaggcaacatgaataattaaggaatgaaactgacagcaacaagaggagtgaaaacacacacagtgatctactgcaaaattaattgttcgaaacaaaattaacctgaagccagagtggaatccctcaagccaatcatgcttgtaccaagctgctcggccttcgatatcagcgacgacacccttaaagggaatctttagtagttccatcagctgaattccactcaatactaaccagaagctgcaacagtacttacaattcagaaatggtacatatatattacatacgtagtattttgaagacacacatattggcatacacacatcctagaagcccccatgttacaaaatttacaaactcaggttaaggtgtcaagctacccagatgagtcaaatggagagaaaccacggaccaaacttgcaatcatcacaaaatgcacgcttggtgctaatacgtatgcaaagtttgcagtatacgtaattaatttgcgcttactgcattgcaacatatttggtgtaccataattagcatttgtaatttgtaattcgaacttctgcatgacgaggagacaaatttgcatttctgcatacaatttctaggaagtttatactatacaaattacttggtcacttgctgagctaaacatcatgcataaaagcactaaaataaaaccagcttgctgggttctttcaaaaataaaagcactaaaaaattgtcgtcaggtaaccgcggcaagtgtccaacacttcctctcctctcatgccgtcatgcgtggggttcagtcataacagcaaacaacacatacatgttactccaatattattacttagtggtaaaaaaaatcagaaaacagcaaaaagaaaaaaaaatcaagcagtagagacccaaatcacgaaatatttacagataacttgttagatccatatgcaagcattccacatcccgacatctacatgcgcacgcaaccaccgcacttgcgaaacgaacaagcgccgcgtttctccatcacctcgaacaaaaaacccacaaacttttaccaccgaaatcgatcaaaaaaaaaactatgaaaaaacccaagcaaatctccccacaagtaggaagagaaatcagccgcaaacaccagcatgcaacacaagacttcacagtccgaaagggaacgcacgcacaccgtgactgcaaaacctccaaaaacccatcgctcactcaacatcggccgagcaatcgaggcagcggcgagaggacccgtacctccggcgggcaatgctgacggcggaggggaaccctagacgtggaggtggcggaggagacgacgcggccgcggcggggcggcgcggggcggggttggctcctcaaacctcaaggcccccgtgatgtgcggctatttataatcgagggcgaatcgaatggacgctgccgagaagaaggggagaaaagaaaaaaaaaaaagccgccgcggctgcctctggaaggctggaaaacaaaggagacgagaacccgtttacctaggagtattttttttgaaaaataaatcggagttgttagaaatatgacgccatatactacagtcgattttttcagccatttatatagtagttacacctcacttacatatgtaattagtatgtaatttttgaatttacatatgtaattttattacttacatatgtaattttgagatttacactgtaaatacactaaaattacatatatatatatatatatatatttaggaacttacaatgtaaatacatgccgactattttttatgaaaaatattgtgttataaatatagctacacccaaataaattccaaaggattttttttctttttgtctactctctcatcggcgtcactctctgacaagtgggccccaggagctgacaccagtggggctcaccggtgatactaggggctctgccgcatggcagccgtgacgacgactccctgaggttgaagggtcagcgccaaagatactctactcctacatataccctccgttctaaaaaaataacttctacgaatgaatctgactaatacttatctagattcattcacagaagttaattttctgtgggatggagggagtacctacattctaagataaaattcgtttcaaattagatatggttaaaataaataaaattaaatgggacaagtttatgattgattgagaaataaagttatgaaaaaaattaaataatgaaggattatgattggttggaaaagaaatattgatgaagaaaaaaaaataaaagatttaattattatattatatgatagagatagtacggtatggctgtatggccttgtttagttaaaaaaaaacttttcacttatcatcttgtgtatgaagtattaaatgtgaaaaataaatcaattacacagtttgcgtgtaaattacgagacgaatcttttaatcctaattacgctatgatatgataatgtggtgctacagtaaacacttgctaatgatggattaattagacttaataaattcgtctagcagtttcctagcggaacatatattttattttatattatattacgtttaatactttaaatatgtgcttgtatatattcgatgtgataaccaaacctaaaaattaattttaaggccggggtgatggtgacgtgtaccgatcgttgcgtcatcgtcagcttccccctgccacccaggcatccactgctgcagggcaccgccacgtacgccgcgcggccgaaggcacggccatcaccaccaccagcagcagcagcaggcacggccgatgtgggtttctcgtccaaccaacaagctaagcgcaacgaacagctgctactaacgagcctacgatgccaaaatgaaaagaagttgtggaggagtaaattgcaggagctttttgttgagatgctgacacatttgccacgctgtattgatgagaaacagtaagttgtgatttagttttatagcgaaaggtgtaatttagttttgagacgtttacattaatgtaaaagatgtcgtactctaacagatgatcggttaaaatgaaacttattaaagggggacaatagtgggtcagtagattccctgtatctataaatattatgtatgtgtgagtccgtttttaataaaaatttacgggtattcagagtcagggctatgctgaaaataactatatgtatgataaaattgataaaatcttgttatgatcctgccttgcatgattaacgattgggccattaaaacattatattggagctcatgtttgttgcatgcactagtttcatagaagcaacattagcaagaaattttatcatatgtatagtagggcttgggctatgcggcggtttttatctcttcaaaacgtgtgttttggagcaaactggcaggtgagtgagtgagtggtatgtgtgcacatacgtgttgtgtgtaataaaaaaatatataatttatttatggttatttagatgaggttctacttctaatggccaaaatattttagttttattccgtttccgtaagttgtatagctctatggtgaaatggtgacatcatatatttttatgtattggagtattactgtattctttgtgtagtcgtacgtgtaagactcctccatcgtgtttaaatcatgtgtaattcctaatacacataaataaccatgagttagcgtaaattaagggtgagaaatacccctttctttcaaaactggaaagtattttccctacacctggccaggcgtcactgaaactactcacggatgtgttgttgcattcaatggaaaaaaacacccaagaaatgctcgcagctgctaggaacgtaacgtgaacctgacggcaacctcatcaccacaacctcttcttttgtctctaccaaataaggagaatgtaggacctctcaagccaagaaagagaaaaaaacgaatctctaaaatttaaattttatgagacaaggacttctcatatgttccctgataaaaacttaaaagagacaaggacttttcatgctcttgagtgtacttcaaagttttttgtgtggccggtgagttcttggagtcttagatcttatttatacctattagccaaagtttaaatttttaaccttaaatatagagtagattttaagtttttttttcatcgttgtttatttttcttagatcgttaagaatacatgtataaaagttttatttatagatttttttttgaaaatatatcgtttcactttttactctaatatacctaacgattgggctgttaataataaggcgcaacgtagcaactgcatgctgccttctttgggggttttcagtttggatcctgcagattgcagctgcagcgacgtctcgaattgttatgatctgaacagaaaaacggaatggtagcctcttggtcaggaagcaacaagcgtggctgcgtgggtgtggctaacaatttgtttgccgctccttaggccgtgtttatttccttgttaattttttttatgtatacggacaaacatttgaaacatttgaagtattgaacgtaaactatttacaaaacaaattacagattccgcatgtaaactatgagacgaatctattaaacctaattaatccatcattagcaaatgtttactatatttttttttacaaaaaacattgtatatatgaattcatgaaaaaaaacaattaaaatatatttcttaactttatagtatttaatacattcgtttgtgctatcaaataattgtaaaaaaaaaagaatcattcagtcattgagccttaaaaagcagaccctagtagctaaaatatctgcattttgtgtatagcagtacttacattgtactcccttttacctatgcgtaacaaaatcgtactactaagtacagttataatgttcaaaaaaaatacagttattgtgtacaagaaaaatcgtagccttcacaagatatttgttggtactttgcttggtataaatcttaaacaggacgtgctaatactttactgtctcgtacaattaattcggagagcgctacgtgtcggacgtacggcgcgagacgaaaaatcagacgcctccgcaaccgtccgatccatgcacagatgcaccatccatccatcatgcatgtatcaaacgaattttaaactattttttctctcaaaatatttatccaaatcatgatccgattgcaccattaaattcgttgcaattaaatctttaaaacaagaccacacatgaatataatccgatgaaaaaaaattttagcttattattgaattatttttaaatgttgcacgcagttgcaccaagtatatcggacttgttccactaggtagatcgaaaatgttttattggacgccgtttcgccttatatgaaaataatgttttagcgaatagcgaaatgatgtttcaactcactgcaatagttgattcatacatagtgaaacattatgagtacattaggtgaaacatttttaaattaaaaaaacggatggtcaaatgttgcagttgaccaacaagtaaaacatcatgttatatatatggtgaaacaaaaaagtcagcaactggaacatttaaatattttatgaaacatagtgaagatacatgttgaaacatgttgctgttacacatgaaacaacaagtattaactgattgaaacacatgtttttcttttatgaaaatataatcaagcgatatcttgttgtaaagatttaattacaacgaatataatggtgtgatcggttcttagattgaataggtaatttaagagaaaaattattttgaagcttgctaaaatacatgtatgtatgcatgcatgaggtggagagagagtagtagtaggtagtttcaggaattttgtgaaacacacttaaaacacatattgaaacatatcactatcacgtatgaaacattttgttttaacggtttgaaacatacgtttttcttttgacataatataatcatgtgatatcttgttgtaaagatttaattgcaacgaatacaacggtgtgatcggtttatagatcagataagtaatttagaagaaaaaatatttaaagagatgagaaaagaatgaaaagaaacaactatgtatatgcatgtatgttacagtacgacagtaccaggctgctgatctacaacattttgttgacgtcaataaagagaaagaagaaattagcaagcaaggactgagctgaccgtaggcgttcgatgtttttcatctgatcggacgttcgaagagaagcattttcgaattaattctgctgtaaaatacacacaaaaaaagatatgataatcgtgatctaagcgatgacggcgcctatagagtccagattcgctcatcaaggcagtgaaggcactggctatatgaagatgacaacgagactgactgtatgagaatatgagaggccatgttgaattatcgatgcaaaaatattgattaagaaaaatgagttttggagggagagacgtccctccaaatatttttttatcgaacatgagattttatggttaaaatcacacgctacttaccactgcactatcaagtacatctcgtaaaaatgttgattagtctcaataaagtttgatgctgccaggaatgtttcaaagggatgtctgtatttttttaaacgaagttctattgatagagtagaaaaaaattacaatttaggatcataactagaaaaaaggaatgcctgtaaattaaatttgatgagtcactgggtcaagatcacttttattttttacatttaccatttagcatgcggccatgcaaagcaatacaaataatgccccctacacccctccgtcattctctttccgttccactaaataagacatgatgaaatttaacacaatctttaaaactaatttttaactttaaatttctcatatacacaatgtttgtagcaagaaaataaaaaagaacaagtttcaatatcagtcaattgaatcgattgattattcttatcaaataaataattaatcctgaagattttaaacgatatgtacacacactaaatccattacattaaattaatctacactagctcctccttctgtttataagttgctttaactattctaaagtcaacattttaagtttatagaaatgtacaacaatattaatatttatagtaccaaattaattttattaaatataacattaaatatattttgatagtttattttatattaaaaatgttactatattttcttataaatttgatcaaaactaaaagaaaagtttaacttgaaaaaaatcaaaagcggaggtgtagctccaaagtccaaatgcaattctcagaccaggcaggcagctgacggatgaaacaaaaggataaaatgcgaatcatctgaaacatggctcaggtttaacctccagaatgttctcgctgattaaaaagtctgggcgaattaaccagctgacacgtacacgcacgtttctgattatattatcagctggtttattatactaatctcgatcggatcatgcagcataaatgtccaattgtctggtcgcctaatatgcagaggagggttgataattacttcctttgttttatactccgacttgatatgtttgaccattcatcgtgttaaaacatcaatactataaatttgcagaaatactactcatgcataaaaagcgtttttaatgataaaacaaaccacacgaaaataaataataattagtacatactcatcgaaaatatcattattttaatatgacgaaggtcaaatacaatattaatcgaaaaccaccattttaaaaacagaggaagtaatgtttaaaaaaacagaggaagtattacgcagtcactttcactagctcaggtagcgtttagttagtcgtacggatcaggtggtcggcaagatcaagattgtgattagaacatagtacagtatataagttggccatgtgttcgctgttcaggggtacaaagcagaataggcagctgccgttgcttgtgaggagttagcactaattatttgtactttgtcacgagtaagcatcgtcgaatgcactccctccgttcttaaaaacaacactgaggacaacaacaatatatatgacaaaagtagtccataaaactagaacccacatatataaactttaactattataaatttcacaatgtatatggatagcaaatagtattagtagaagagaagagatagagacaaataatatattttattctctataggcaggccatatgtttatgagtagcttttgttatttctttcctatgggctagtttcacaatgttgctaggtggctgaatcaaatattatattgcttatggaccatttttggagtacattgtggatgcccttaatcgaagtaaagatgtaatttcttctagcacaatgaatctgactcactctctatccagattcattgtactagacagactgtttaaatttattataaaaaaagattacatcttcttgtaggttttttttaatggagggaggagcacgtactccagttaattggtcggtgggaagtttcttttctctggatcgataagggaaattttcaatggcaatagaacgtactaatccgtagttaagtacgaactcgagacatgtacagggatatgtatgagtatgacgttgggatcaatatcacagtgtcatatagatgatcggtaggagagtatagctagtaccgacatagggaaaagtattatttcttgaccgatgatatacatagcattggttgtaaacgaaaatttaactatttgccacttctagaataaacaattatctagatgtcattcttatatttgcacttatttttttgcaaatatttttacccctctaaggtgatgacttctttaactatttaccatttttatccatgtgacataccaatgtgacaactcggggtgaaaaacggtgtggaacccactagtcaaactctccacttcccttatctctctctcagctagttgaccaggccgcgacagcatgcggagaggcccaggcggcactggagtggaggttgacggccgtgacggccctctccccggcacgcacccatcgaccttcatggcatcgatcaaattccacgatgacgaccattgatgcggggcaacgtaccaatcgggatgctcaggctgcctttccagtccgatctctctaccagcggtgactcgcgtgagcgctcttcggttcgttgtctccaccatctcctcctctagcccactgccccagcctcccattctccatctccgtccgcgtcaatgtcgggcccctcggctcccatgcctgcgccgcacgcccttctctctcaccgccgagttcaacctcgtcttcggcaaccccgtcttccccgtcttcttcctcttcctcaagctacggctcggtgttaatttagtgggaaaaagacatatatgccttgcatatttgcctttgttttgagggtgttgtgtttttgccatatttgtgccagcgtatcttgcatatggcgatggatattgcgcgcgcgcgcgcatatatatatatatatatatatatatatatatatatatatatatatatatatatacacacacacacacactcagcctcatcggttgtccatattttcgaatatgttaaaacagtttattaggaaacaaaaattaatttacagtaaaacttttgtatatatatttctggcaacttaagccaatataaaaaaaactatgttaaaaatattttaaatttaacatcaaaattaagtttgaaaattcaaatttgataaatcaaaccgatagaaccctcaaaatgttaactaaaagacaaatcttcacacgattgtatgtgaaggtgaggagaaaagaggtgcgacgggcgaggttggcggcgaggcaagcagaagcgggggaggcgacaattagagcaggtacaatagcagaatattagccagctacaaatatattttaatgagataaaagatgagagagaagagcagcgggatacagatctgtagctagctgcagcacggactccaagatgcaatgtatgtatgacagtgggaccatatactattagtatagtaaacaactattgtataaattggctattagattagctatagatgaattagagctagtagttggctatactattaaccttgctcttatagcgtgcacgatggctgcgacgacattgggcgcgttaggcggcgacgacgttggctgggtgctagggtgggcggcgatggcagagcggtggcgatgaagtgccgacgcatgcggttgctgggagcctgcctgcctggagactcggggaggagatgcggtttccgagaggaatcagggagggagaagcgtgataggcagagccgagtggggaggtcagggatgggacgttagatcgaaagatccaacggtcacaaaatatacgtgcggagtcatgggtctatgcggggtctggtgttacggaattttgttggatcctaggattgcacaactgcactactcgatttaatatcaaccctctgcaaagtggaacaactttttgtccatatgtcagtttatcgtttcgtggtgcaaaattattatattatattcgttccaaaataagtgtagccataagtacctttgaccgtttatcttatttaaaaaacttattaaaaagttgaaaaagtgcatcaacttagctaatcatatgctaggtgagttttttttttcacgatgtcaatatgccattacatagaaatcctaaggatattatctttaaaaattatactacacatccaattacctttaagaatttttgttttcttcaccttcccaaatctcaaccgaaatataataatttctacatccagcttaattgactttcagttattagttattaggataaaaatataaatatgcttatatacaaatccacactagtatattgccaaaataagtacttaaaaattgaatatgtataaaaaaaagtgctccaaataattaagttgtcgcataacttcttaacttattatatcaaaattgtacgtatcttgcaagttcttatgcgatcacttataaagttcttgtactaaattacacttacctaccaagttgttgcactagaacgctcatttcacaagtttttacaccaatttacacccacctgccaagttgatacattgtgggtgcaatttacttaaatattaatctaaaaaaaattaaatcagacaaatggccaaacttggacatgaccatcttgggagtccatccacttactttttgcacgagtgttttctatataaataaaacgctaaaagcttatgccagatcaaacgaaacatcaagtgctactgcattgaaagcccaaactccacatctatattccatattgattgccatgcaattttacaatcaaacagaacaatctaggagcaacaattcacaggctagagaacattgaaatctacatgtcacacagccttacagaccttcagtaaaatccagttgcttctgtttactgcatgcacaatgtgacaagttgacaacgtacaagcatgtcatatcgtacggccgatctccagctacagtacgatgtatatgaaagtatgaatgtattatgtatataatacaacggaccgctgcttgaggaagtgctatatacgcctataatatactcatccgacagaataagcagaaattcattagcactcggacaagttttcagtatctccacacctgggttgaatggcgtttgaatgcacctgcacgatggagacgaaacatttgtgaaactcaaataggtaaaataaaaaaaaggatgccatgaaatgcgcttaactgaagagaatttactctatgccattttaggtccaaagtacaatagatcgtgagtggtatttcaacagactggctagtagcctagtagttgaccacagcagaaggttagagagcaaattgttaattaagcccacaccctctatcatctcatctctaatcctgtgcacattcgctgcaatattgttcatttgcaaataatttaattacctgcaggtgcctttcttcacggtggctggaagttctgtgctttagctctccacggttagttgtcagctcatcaaatatctcagcgtcgtcacggctgccacagcttcctgaatcagattcaccatcctcctgtgaggaaccaaacttcagattaacaacagatgtggggcatcggagcattgaagaatgaaacacaaaatcgtcactacaagcaaataatccaagaaggtgaggtaaatgtataccagcgtgtgatcgtggtggacaccttcaagctcttcatactcagctgcgtccaattcccgaaggtcatttggctcaaaaaactttgggaggacatgctgcctgataagaatcataaggaagaatggcagcgggaacaggatccctgctattggtatccacgtaatgccgaagcatatcaagaggtaaaccaactggaagatcgtgaagacagtaattgtttttgaaggcactgattccatgaaagaggcatggggaccctcaagaaccctgcaaatgatgaagcatagtgtaagctgttaatcacttttctaacaaaaaaaatggattatcttttgattaatccaaaggaggcacataggctgcaccgcaagtagtcaagcatgcaatttcattgttcaattggggtaaacagatgcagatagagatattacttgtagcgtcggcttgatgggatgaatataagtcttaacctttcccaaaactggttgccaggtagactgtcaatagccatataagcaaagtaaccccagaggaccgatgtcggtatcatcttgatgactggcatagctccaacacaagcaccaactaataaggattgcagcaagttacttagtctctgctcattcactcgaacaggcaaatgtgcttcaatatgttttatagggtcaaattcttcagccaatgtcccttctttatcaacttcttgcagaatagcatccttcaagctctttaactccttgtcaacagaatcagtctgcaggacaatttttgacctataagttgatttgcttgaacattttccatacaagactaacagtggcatcaacatttcgaatagttggtgaaagaaaagcaaaagtatgaacccttaatcgttaggtgaaaagtaaggggttcaggcaattacatggagcaggactaagtttcttgacaactagtaattttgacaggaaccagcattcacaatagaagtaaaatgcagcagataaattaaagaggaaattatatggtaacatacttcagtaatgaagagtaaatacctacatttttttcgcagtccatctcgatgaaaaccccttgaatcttgccatagatttccaaactgctagcacgattcatcaggccttcgttggcagtttgaaccatctttttgcgtagcagctaagcaaacaaaggaacaagacggatgagctgatgagcaaatatggctaccgtagcaaacaaaacacttcggtctaaagttcaccaacctgccccttaaggactgcaaggcttcttgtatgcatcggagactgaggaagtactccattagatggagggatgccgatcaaaccacaaagcaggacctgtatcatttatgtactactatgagaaaaggagcatgccacaattttggactgataatgaagtcagaacacaggatagatgcagggtgtacattagaccagaaagcagaatctgtatcctatctgccattgccttgtagattgcagtagtgccataatcacgcaaaaaaaattcagatattacggatgttggaatttaattttctaagaaatgcaggtgtattttcaatcatacccattcaattggtgtaacaaatacaaactctactttaaaatatataagaacatttcttattcaaaagactatactaagagaaacttaagaagggtcgccataagcagataaattgtatcataaaaacatgccacacaccatgaatccgaggaccaaaatgtcataatggtaggcagagggtttcttcaagttaaactctttttgttgcgccaattgtgaagccacgctatgatcaaagaagtaaagtcctgcaaccatcaaagccggcagaatggcagcaaatatgtatgctggaggaactgaaaacagatcctgaaaataaaaaaagagaagatattattaatgatgccatgcaaaataagctgtgcgaaacttctaaaattgaagaccataaatattcacatctccagtatcacaagcaagtttgactaattacttttgctaccgtccaatgttgcagtgaactcgactcccagggaagtggactgaacagcctcctaggaactcctgaaggaacatcctttggtaacgtgtacgagaatgctgtccaaacaatcaccataagtgggacaccataatcagcaatgaagcctctgagccaccctgcaagtgtcaactcaaacgcacaatgatcagtgcacatacatgtgcttctcaatggttacaaattataatcatggagccatttacatactgatgtagcatacatagtagtttttttttttttttgaaataaagcaaaagctttgccatgtatatattagtagagaagatagtagtaatttcttgtttttgtttctaaatgttaaaactttcaaagagaaaaaaaactgtgcagcaactatccacataatataaaggaataagaatctgtcaatataagttcattaaaaaaaagaatctgtcaatataaaggctacaaaacaccatctcaagccaagccgtctactcaagaaggaaaaaaggagcccatatggtctggtccaaagctgagaggctcacaacacaagcttgtagcccagcacaacctaagcctgatctaaagcaggcccagtccaaacttcaacacagctaaagaaatgtttggcataaatctaacggttggatggatgattaatggaacagttgttgctaatttgattacccagagttcggtttgctctcaaaattggattcatgagataaaaataagatgaaaaagtgaccaaccttgaccatacacccatgaccttgcccttcttgaccttaatgcagtgtataacagcccaattgaaaagataacaccaagcaggccgttgacatacagccactggaattgatatataggtgaactatggtctgcatctctaggcaccttgaattcctctataattccctgcaatagataggccctggtctaaatattttcttccaagatagaaagaactgagcttattagatatagcatactttaatggcttgttgcaggaacagaacagtaatcaacatcccaaaaagttctcctgcaacccttgtaaacctgctaataacattagaagcattgaacattgccagaagaaacaacatgagcgcagtccagatgcagaccctgtcaacagtaggcaaatcaggagagcattaactttttttctgaaaagctaacgtgatagtattcagattcagttgttaccatccagcccatgctaaatacagtcgttcccccagagcttgctggttcttggcaaagttgtagagatacgtgtacatgattatagttggctctgcaactccaactatcaacagaggctgccctccaagaattgaatgtatgatgccacataatgcagtagatgccagtgtttctactgtggtgagtataccatctgaaatgaaccacttttcttttattagaaatgtgattaaatactaagaacaataactcaagaaatagcacgactgtagcatagactcatagtggtaagaaggtaagcatttacttgtttctctgctcagttgcgctccgaaggcgatgactgggagggcagaggcaaagaagatatacatggtaggtgccaatatcctaacaatgcatcaacataagcaattcagaaatgaaattaacaagcaacaaaagcagggaatacacactcaatgaattaactgtttgaaacaaaaatcaacctgaagccagagcggaatccagcaacccagtcatgcttgtaccaagctactcggccttcgatatcagcgacgactcccttaaagggagtccttagtagatccatcagctgtacttagctcgagactaaacagaagctgcaatagtaattaaaattcagaaacagtacataaatattacatggattttcaagacacatatttttttgactgaattcaagacacacatattggcatataaaaacatcagaagccccatgtcgtctacaaaatttgcaaactcgggtcaaggcgtcaagctacctcaagacgagtcaaatcgagagaaacctcgaaacaaacttatagccatcaaaatatcagacgtgtgcttaattgcttggtgtgttacttatataacatgcacggtttgaagtataaatatttattttgcgtgtactacgtacaccgcaacataattttccgaacttttgtattcggaggagacgaatatagattttcaacatacactttctacgaagattttaccaaggtgcaaactagttcgacacttgcagcacaactttttagcgtcagtgccacaaaccacttcaaaattgtcgtcaggtaaggtaaccgcggctagctagcttacaaacatgtccgagtacaaccgtacgatccaacacctcctctcatccctcatgcgtggtggggctcggtttaagccagatacatggaaaaccaatggcacgcagtaaaaaaaaaaaaaagcgcaacgctacacctactaattttttcttactaaaattttgatcatttgatttaggtagatagaagttaaaaaaaattaaatgcacacatagcatgacacaaccgtgttactaagagtttagtaagaaaaagttagtgaatatagcctttttcgaaaagaaaattcgaaacacaagttactcatcaattaataggcgataaaaaaattcagaaaacagaaaaaaaaactcgagaagcagacatccaaactgcaaactcgcaaagttttgacagaacaacttgtagtagatccatttgcaagcaaccccacaaaccacatcccggcagccgccgcaccttgcgaacaaacaaacgtagcgttcctcgaagaaatttgccaccgaaatcgatcaaaaaaaaaaacagccatggaaaaaacccaaacaaatcccccccaaacccagcgcaaacaccggcaggcatgcaacgcacagccaccaccaccagtccaccaccaccaccaacgcgaccaaaacccaaacccaaacccaaacctcgcagttcagttcagttcgaaatagagcggacacagtgcgaaactccaaacaccatcactcacatcagtcgtcgagcaaatcgatggcgcgcgtggcggcggcggcggcaatgctggccgctcgacggcgcgggagcgaaaccctagagttggagggtggtggcggagacgcgggtttctgcgccgccgcggcgggggagggggtatttataatcgagggcgaatcgaatggacgccgcggagaagaagagaggaggagaagccgcggcggccaggaaaacgaacacgtttacctagaataaaaataataaataaataaataaattcctccattattttctagtactacgtcgtcactctctgacatgtgggcccatgtctgacatgtggaggaccacaaagagatacgcgtggggcccactagcgatgacgtggcggggatgggaggctctgccgcgcatggtagcagtagccgtgacaaggttgaagggtcagcggcttgtggcccgggggtgtatgtgtggctgcaggtggggccggatggtggtgacgcgtcatcgtccacccaggcatccactgttgcagggcgccgccacgtacgccgcggcccaagggacacaccaccgccagccaccgcgcatgtggttctcggtttctcgtcaaattaactgatgacaagctaaattggaagttttcaaaaacatgcaaagttttttcttgagtaaagtgtatagccggtccctaaacttatacgactgtgttatttgagtccccaaactctcaaaatgtatattcaaatcccaaaacttgttaaattgtgtcaatccgatcccaaactaccatgacacctccaggatcctacatggcatgccacccggacaatgatgtggcagcatcacaaattctacaccaactgacaagtgggccccaataaaaaactttttttaatatccttttttgttcattcccatcatgtcctttcttcgtttctcctcttttcttcctactgcattgaccgtagccatggcctctggtcgagctgtctttttgatggcatgaacagaggtgcgtccgtgggcaagaaggcaccggcgcagcagccgcgtcgacggaggcgctgcaacgtgtgggtagcggcgccagcgcagtgatggacgcggttatgtcctgggcatcgaggagactctggccgggagcggcgcgactgcgtgtggctcggcacgtttaccggtgaggccgaggcggggcatgcctacgatgttgcggcacagtagttccgcagccgtgacgcagtcgccaacttccgcccctcgtcaagtctgacccgaaggctgccgtcgagctctgtttcttcgcctcccggtcaaaggccgaggtcatcgacatgctccgcaagcacacctacctcaaggagctcgttgttgaaacaagtgtgccttcacctccatctctcatcacctgttcgacaagacaatgatcccgaagcaaccaaaccccgaagaggccgcgtcgccgcctgccgccgccgtcggtactggtgttgcgcatggtacacggcctgctcaagaacggcggcagtggcgttgtcatcgccgcgagggtggcgaggttggtttgccgttgcgctcgtcggcagcggagccgttctggccgaagcttagggttattgccgctgacttagacttcggaattcgtcgccatcgtcgatccttgtccaaaattgaggtcttcctcatcttctctatgccaaactccccccttcccctctcctccccgagccgtcctgctatcggagctcaccagcaaggtacccgtgtgctgcggtgccgcctacctgtttggccgccattgtgtcagcacggtgcaccgccgctgggcgtccctgcccaagccgagaacacctccggctccaagtcgacgccctgatgctcctaggcagccgtgcccagtcggaagctcaccggagcgccgctacttcgcatgcccccgccgcttgtacaacaaaaaaaaaagagaagagaaaggacaaaaaagtgaaaggagaaagagaaaagggaggaaaaaagagtttttaagtgggtcctatttgtcagtcaatgtagaggtattgatgaggccacatcagtgtccgtgtggcatgccacatcagcgccgtgtaggatgctggaatggtggtggctatgttggaccgaaatgacatactttagcaagttttatgacttgaatctgtattttttgagttcggggacccagatgggacgacgtcacaagtttagagaccgggagtgtagtttactctttttttatttagaaaaaatattggaaaataaaatttatttgaactttttaaagaatatttctatataattttttttttattaaaaaacttatcctaaactaatttaggaagcgtgcttatgacaaagcagcttagcgaagattatgtttaaaacacatcctaatcaaacaactggtacgataaattctgacactggtggagaaaccatctttcgtcggtcggccgaattccacaatagtcccggatgcaataaaaatcggggctaaagatgatctttagtcccggttcaaaagggtaacgggcatatttgatcttaacaccaaccgggactaaagatgatctttagtcccggttcaaatgctgtcagggcctgtcaggccccccgggatctttagtcccggttggtagatcgtaactttagtcccggttggtaataccaaccgggactaaagtctcacccctatatatatgtcttcttcctcctccagctgcctgagcaagcttcaaaatttcttcaaaaaagaggggaggtcatgctaaaatttctagtgaatttattttggtgattacatacaaatcggaggtgcctaaaaggtttgcaacttcatcctccaatatttttttgtcatattacatttgcagctatgttttgcatacttttttgtctccaaaaattagttgtaagttgatgagggagaaaatttgtgtggggaagaaagaatatatagaaatttagttgatttgctaaagaaagttttataaaatagttgagaaggaaaactatagtgaaaattaatcttgaatactagaaaacaaactaaaatgaaaattaaaagaagtaaaacacattaaaattagtttaaaactttagaaatagtaaataagaattatttggtgtaatattttatgatttttgtatgaataaagatatgtcattattgtatgactgttgaaacagtttgtaattatcttataattattgtatgactgttattattgtaagaataattatttttgtatgattttttttcgactcatgtagatggatcggcaatggatgtacgctgaccggcggtccaaagagtttattgatggcgtgcactattttttgagagtggccgaagctaacaggcaaaggggttttatttgttgtccatgcaataagtgtaagaatcagaaggagtattctgcatccaggactattcatttccacttgtttgagtcgggggttcatgccaagctataactgttggacatcccacggagagcaaggtgttgaaatggaagaagatgaagtggaagacgacaatattccgaactttgctcagtacgttggatttgaaggaaatcaaacgggcgaggaggaaagggatgctgatggtaacgacgttgcggatgattttggtcagatgttgcaggacgccaaggaggactgcgaaagtgaaaagggggcccataaattggacaagatgttagaggaccacagaacttcgttgtacccaggttgcgagcaggggcacaaaaagttggataccactctggagttcttgcaatggaaggcaaaaaatggggttagtgacaaggcattttgcgatttattgaaactcgtcaagaacattcttccgaagggaaacaaattgcccgagacaacgtacgaggctaagaagatagtctgcccgctaggactggaagttcagaagattcacgcatgtccgaatgattgtatcctatatcgtggtgaggagtatgagaacctagaagcatgccctgtttgcaaagcactacgatacaagattagacgagacgatccaggagaagttgacgggcagctaacaaagaagacaattcctgctaaggtgatgtggtatttccctataataccacggctaaggcgtttgttcaggaacaaggggaatgctagaatgatgcgatggcacgctgaagagcgtcaacaggacgggatgctgagacaccccgccgatggttcgcaatggcgaaacatcgacagaaaatttaaagaatttggaaaggacgcacgaaacatacggtttggtttgagtacggatggcatgaatccttttggagagatgagcagcggccatagcacttggcccgttacgatgtgtatctccaatctcccccctggctatgcatgaagaggaagtacataatgatgccgattattattcaaggccccaagcaacctggtaacgacatcgatgtgtacctaagaccactggtcgaagatcttaagctgttgtggaagaaggaaggtgtccccgtatgggacgaggacaaacaggaggagtttaacatacgagcgctgctgttcgtaaccatcaatgattggcctgcacttagcaacctatccggacagtccaacaaggggtacaaggcttgcacacactgtatggatgaaacagaaagtacgtatcttaagcactgtaggaaggttgtatacatgggtcatcgtcgattcctcgcagcaaaccacccggtacggaagaaaggcaagcacttcgaacataaggctaaccaccgtatgaagcctaaacatcgcagcgggaaaacaatgtttgctatggttaaagatcttaaagtagtgttcggaaaggggcctagaagccagcctatagagagcgaagatggtcacgcggcgatgtggaaaaagaactctatattttgggagttaccctattaggaattcttggacgtacgccacgcacatcggtcccatgatccccagccgaccattcctcctgcaatggtgagcccgtcaggaaaccgtagcagctgcgcctcaacggggcaggtaggatcacagagcatggacgccatacaaacccaggacgaatccacctgccctgttgatgacatcactcagcggacaccatgtgagctgcatattcctttcaagaacttatcaataaaggtaagctcgtagtttatatattttagatttggccattccgctagttgctgcttatatatgttgattactaataaataacctctcaccacatgatggtggcatcgggcatggccatcccaacggacccttcaggtacttaccactgcaggccgattccagcaggatactccaaggtcgaagttgagttggtcgaaggcgcgtacgaggacctcgagctggattaccctggaggagacagtgatacgcatctatgagacacaagccatgccattattctatggcgcaggcggtacatcatcctccctgggcgacaagcggcgtctcgtgcaccatctcctccggctccgccatctcctcctcaggatcctgcaccgtctcctcctcatgctccaacaccgtctccacctcagactcctgcaccgactcctcctcaggctcctgcaccgactcctcctcgggctcctacaccgactcctccgcaagctcctcttccggcaccttcaaagtcaagggccccccaagctccaccgcctgcccacacaagggcaacgaagaaggcgaaagttgacgccgccaagaacaaggacccagggtacgattgcacgcaagaggagcttgacgcttacgtggcatcagaagtcaagagacaattcaagcctcgaagtccagaaaagaagattcctatagacccgagtgtcaggaagttctttaggggtatgtctgcacctgccaaggaggccattaagctatcggactatgagcgaacgctgaagaaagcatcttctggaaagtccaaaccagtccctcagcttggagagcaaccaaaccaggagatcgagccgttggtgaccggtgaagaaatgacgatagaagaatttattactgacaccagtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaagggaatctacgaactataccagctggacgctctcgacgtctctattatgagttgctggattttgtaagtatatcgttcagttagatttcttactacgtctcctttaattaattaggtccttgtatataagtagactatagaaaataatatattctcttttatcgttgtagaatggagattcaaagggcccgacggcggggggttttcgatactggattcatcgaccctcggaaagtaaacatcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtacgaacttgctaagtgtttcatatgtaatgcatcccacgcacattgcagattccactgggtgcttttactcttcgacctgtcggcctacaccgtcaacgtatatgactcaatggataaaaaaagagtctacgtttgacaaggttttcgaacttatggacaggtattgtcataagttcctctgttaattaagaaaatcttgttatgttaattgctactacgaatcatagctttaaactccatgtagggcttggtatcggttccgtcatttggtccgcggcaaatggagagaaagacttaggcggaagtttaaatttcctgtgagtacacatgctctacatttatattgctccgattcaaatatatacaagtgtatattaattagatctctcgtcgtttgtcatttatttgtagtgcggaaagcaaaagcagggaactaacttgtgctgctattacgtgtgtgagtattgccactgccttgcagaccaaatcatcaccacaagagagctcgatgtacgtacaaataaattcaaaatttcattacgtatcgatttcttgtttaattactaatcaatttcatacattcatatagtttattcgtatgagggataacctgaccacacacaaggaatttatcgtggcggttcaagaacaacttatgggattcatcaacgaacaagtccttgatcccaagggtgaattctactacgacggaaacacaattcataggtccttagcttctgagctagcgactactacgtcgaaatcgtagctagctaggacatataatggattgtaattaatacatgactacatatgtttctatatgcatgtgtacacattttctataatgtaaatatattttggtcacacacacacatatatatatatatatgtatacatatatatatatatgtatacatatatatatatacatatatgtatacatatatatatatatatatatatatatatatatatatatgtatatatatatatatatatatgtatatatatatatatatatatgcatatatatatataaaccctacagcaacagagccatgaaaaaaaaggtcagctcgatttttagtcccggttggtatatctttagtcccagttatttcatccgggactaaagatagcgatctttagtcccggattggtagtcccggtttgaaaaccgggactacaaagggtttctccaccagtgtgaagtccaaccaatatccactttcggtcttgctatgagcttgacgaataaaattttaatatatacttttatttttaacgttttgcttttatatacatgcatagaaaagagttgtgaaaatatatctctaccctagaatggagatgcgggatcaaggcagtgcttcccgcgcagcgtccgcgtggcaccgttgctcccgcggaacgtccgtgcggaaccgtcgttcccgcacgcaattcctcgctcccgcgcgaccggcgcggtccagcgcgctcatgacgcgcggccggtgcggcaaacaagcacatatgcatggatgtgcatatgttgcatacatgcatgcattcacgttgcatgcagcgatgacggcgcggcggttccgcgtttccaggctgcgggatcgataggttccgcactgctgttttgcgcgaccgctggttccacaacccttatgcggtagagatatatttgtgcaaaatttcatcgcattggtatataaacacaaaataacgaagaaaaagatatattgtgaaattttttcctgggcttgaccaccatagacaaacggtgaatctatgccgaatgcgcttacttagctgcttccacgaaagttgccacatgatgccaatttttagcaacccagccaaagactaagaacttgtttggagtgaagctaattattttccaaccaaaattttagcggcctaaatagtattgcattgatgtttagtttgcttttttttccctcactaatataaatttatggtaccaaattttgtagtcgcagaaattatcaagattttagcaccatcaaaaaaatattaacaggggaaaatttagctccaaatcaaacaagtgaaaaaaaaaactttgtgccacactaccacacccctacagtgagagtgtgttcttagttcagcatcacctctacaacgtattctctccgtccataaataatcaatctaatttcaaatatgatatatcatattactacgaatctggataaaaatatactccctccttccctaaatatttgacgccgttgatttttttaaatatgtttgaccgttcgtcttattcaaaaacttttgtaaaatgtgtaaaactatatgtatacataaaagtatatttaacaataaataaaatgatagaaaaagaattaacaattacttaaattttttgaataagacgaacggtcaaatatttttaaaaaagtcaacggcgtcaaatattttaggatggaggtagtatgatactagcttgattttttttatgagtcaagtcaaaggaagtacttgtatttggaataaccccgagcggtagctgatttgaacacggaaagctgtgaaggtcaattagaagaaggccctatgtgcttgtctcggcagaataagattcacttgtccccatctccagatgacctgatcttcgcttggttgttccaaccgaaatccttgcagccaatcaaatgcccagaaaaaaactgggatattattaccgggaccgtcaaaacttcccagaagatagtattgtattcttaacccaagaacgatcggagtggccggcacaaattactgtagtggaattccggaagcttatgttgacacattgtcaatttgttgataacaaacaattactaggttttaatatattttttggaagatgtaaaacggctgtggattgatgcagaggtccaaaaatatcattctcgtttttcaaaaccggaaagtatttttctacccatcgagacgtcactgaaaataactactcaaatgtatggttgcaatcaaccaaaaaaacacccaagaaatgctaacttcggctatagggacttgatatcccacggtatccacaccctatagaggatcttagctatagcaactagctcatcatcttaagaccacaaccttttttttcctctgctattatctaaaattctaaaatttttgtttttgaaggatcacattttgatactttctggtagaagtgaacgaaggacttcaagccaagaaaaatgaagtgacctctaaaattgaagggacaagacttgctcctgaattgtactttatgtttttttttctttctgtggccggtaatcacttgtaattcaagcctgtaataaggcacaagagagcaactgcgtgctggccttttgtgaggttttcagttcgaattttgcatatttcagcgacagctagctggagttgtcagttaccattcgccagtaactattgtcagtcaccattcgccagtaacggctcaaattgcaaactatactctgattaattgtatatctaatgactgattaattgtgtaccttctctggactttctggtccctcgatgaatattcagtgggtacgaaagctctccccgcccggttatcctttcaggaaaagaatgtcatcgggtggacaaatcaaaacctaacctcttcgatcggatgaaaccttagccaaatgttttgttggccacaccttagctgattagctgagatcgaaaaaaaatctattacctatacctatactaatcaaacttcctgagagctcccggttaaaagaatatatgatcgttaatttgatgggtcgtataggttggcgactagttataacaatacatgaaaagtatggcataatataaccttgacaataaaacaaatctttcggaggtaattttttttgagtcacaagaccgcgggtagattattcaatttcagctaatttttatcctgttaattaatatatcagtcaataattagataatcagtatgtatagaaccccgtaatttttggaatatgtccgccgtttcatgagggtgagttcgtgcgtgttacaagcgtatgcatttataccgtgtttctaaaaagtttcttttaaaagtttgataatattttggcaaacgataataatggaccagacaaatcttacaaaatcagatgagaaacaaaatactcttccgcgatactcctatacgactatctcgtcagtttggtggaggtatgaaaacatgaaatgtgcatcagtttcttttatttttctttttaatttttaggaactgtgtaccagttgttgatgcgctataggtaaaatatctggttgttgtggatactcctatatggctatatagcagtactttacatagtgcggagtattacgcagacataacaaaagcgtacaaagtacaccgtctgtgacttaaattaggctctgttcggcaggagggattgggaacccctctcggcacgtaaaacgatgtttgtattaacgcgtaattaattaattaatagctatttttttaaaaaatagattaatatgatttttttaaacaactttcgtatagaaactttttgaaaaaaaaacacaccgtttagtagtttgaaaaacgtgcgcgtggaaaacgggggtgaagagctaggaacctggggatcgaacagagccttagtagagcgagtacaataaaatcaaagatcctttcccttaagaaaagtcgtgtgttctgctttgatcttcaatacggatatttggtcatagatacgtgacatggatgttgttttttctttttctaagtataacctttcagaactgtagacttatattttatttctactctatcaatacaaaacgtcacactatcttgtgcgtattatttaaaaaataaaattacatgagcgtgctatacaagttatcacatcaccagtgacgtatatagaaattttatatgggtgatccaacttatataaacttttttaaacaccctaaatgtaaccaagttagaaatataaattggtcaaatatgcataataatatatcaataaaaaaaactttttaaaagttttttttcacatgtgtatatatatatgcattggattaggattttttttccaagtgagcactaggatcacccctagattcgcacacgcacatcacatttgtgattacatggagaagagatgagagagaagaaaaacgtgctacagattcgtaaccagctacaacacattctgtaataaactatctgagatcgaatgaattaggtattaatgatgcagtatatatatatatatagctaataattatatgaatggattattaaataagttgcagatgatattttaattttgagtaaagtccatcaccagtccctaaacttgtacccctgtgtcatcccggtccctaaactcgcaaatcgaccgttcagatcctcaaacttgttcgactgtatcatcccgctccctaaacttgcagatcactcgtttaaatcctccaacttgttcagctgtatcacccagtccctaaacttggatttgaatatcatctgtgtcaaataggacggtgtaaagactttatatttaaaaataattcataacttttatgtgaactctaataaagacaaactttatatcaaacttgtagccctcgacacgatctacaactttgtagttgaattttttttattttaagtcatttttgttccaaaatgtaattttaaaattaaaatttcaaaatctataaatatgcaacaatattttgggaccctaaacagttttaattcaaaaaattttcaactacaaagttgtaggtcgcgtcgagggctacaattttgatataaagtttgtcttcattagagttcacatgaaaaagttatgaattattttttgatataaagtttttagaccgtcctgtttagggactggggtgatacaactgaacaagttggaggacctaaacgagtgatctgtaaggaccgggatgacacagtcgaataagtttgaggacctgaacgatcgatttgcgagtttagggaccgggatgatacaacggtacaagtttagggaccggtgatggactttactctttagttttttataaagttagtagttgattatattattaaaattgctcgtggtatactaagaaaagtaggagccttttacacgatatttgcgtggtactttgctgcgataatattttactgtcccgtgcaattaattattctgtgaacaattaaacaggaagtatatatgcatgagctaagcggtgacgtacggtacatccatctgttgaagttataagcacatgatgattcgagtactcgctaggcaaggcataaacagattgatcgtcctgagaattatcacaggccatatgcttgaattattgatgcaaaaagattgatcagtctgtggctctgtgcaatgagtgcggcacatgacattttctatgctgtcagtcaagaatctttcgaagagatacatgtagatctcattagtcaagatcacaatgttttacgtttttccgtttagcatgcaggagtagtagatatttgtaatgcaatacaaaattaatggccaaacgaatgagtggtcggctgtatgatctcacaaatcatgggtttttttgttctttttgcccctcaagagtaggccctgctcgtagtgctgcggattataatccggaatcattttgaatttttatggattggttttatggtttctttttatcaactttcattactgtcccgctctgcttttatgattgccgaaaagattgttattaaaaactaagaatttagaatcattatatactataaacactatataaacaaactaaacgtaaattaatcatcttcaccagccggcttgcatgtataaattcatcatgtacttcaaaacatatttaagaagtttaagattataagaaatagctgattcgtgtagtagtaagtttctgagaatttttttaaaaaaatgtgtttcttagattttgatttctagtttattttatggattctataattatagtttttttaatctaaactgtttggagagcttctgattatagaagttgtagtagtctggaaatcaagccggcactgtcttttattgagctgtgattgaaaataattttattacaatttattacatttttttaaagccaaattttaataacgagctagcgagtccaaatgaagcaaacacaactttcatgcaaaattttatcattttagttttatataagaaaaaaacatatcacttgacaaaattttgacttgtgcaccaatctcactaactgggccgatcgacagaaaagctatctcatcctctttttacggcccaatctcactaactgggccgctccacgcatacacgtcccagcccaaaaccctccctgcgtaaataggccgggcctaatcactttaagtgggccgggcctccctctcctgccgcttcgtcctcgccacctccgccacttggcgcgagattcctatcgcgcgcagacgcgccggctagctaagtcgcgagcgttttcggcccatatcctcgcgcacggcccactagctacatccttctttttctattttttcgcaacgaagtgcgcaggacttttagaaaaaatcgtatacgtaattagttatcgataattatggtatattaagctaaccattctttttttctcagcaaaaaaaattgaaaattttgaaaacttttaagtcgaattttgaacttttaagttaaaatttaaaaacttttatctcaaatttaaaaaaatttaacccgaatttaaaaactttcgacctaaattttaaaaacttttaactcgaatattcaaatcttttgaccgaaatttcaaaaactttcaactcagatttgaagactttcaactcaaatttaaaactttcaacttaaatttgaaatttcaagtcaaattagaaaactttcaacttaaaatttaaaaactttcaattcaaatttgataactttcaaatcaaaattaaaaactttcaattctatatttgtaaagagatatgccaaagattaaaaaaatcggaaaagaaacaccgaaaaagataaagaaaaaggcacccgtaagcaccaaaatcggaaaaaaaaaagtgcaaaaaaaaaagacaagggagctatagggtggggcagctggcgtgcgcgccagcaatttagctggcgcgtatgcgcgcagtagccaccccccacgtggcggatcatgtccgtcaggtcggcgtgcgacgacccgccttcctccaccgccgccctcgccgtcgcggcgagctccctggcgcgcgccctcctcgccacgccgtccgcgccgccgtccatcagctcggccaccgccttctccacgccggcgccggtgacctgcacgccctcggcctcggcggggaggtacatgggcggcgccgtgacgcccgaccggacgccgacgccgagcacgtcgacgagcagccgctcgctgctgaactggtcgaggatggtcggccatgtcagcgccggcacgccgcgggcgatggcctccagcgcggcgttccacccgcagtgggtcaggaacccgccggtggccgggtgcgagaggatgctcacctgcggcgcccacccgcgcaccaggacgcccctgtccttgacgcgctcctcgtatccctcgccgtcgagccactccctcacggcggcggcggcggccttggcctccttgatggtccagacgaacggccgccccgacgcctcgacgccgcgggcgagctcgatgacctgcttcgccgccaggtgcgagatgctgccgaagctgatgtacagcacggacgccggcggtcatgcgtcgagccaggagaggatacgcccggcgtcgacgtcggcgcggttgccccggttggccctcgcgtcggcgtccgtgctggcggcggcggcggcgcacgtcggcccgatggcccacgccctccggccgagcgccgccgcgtagccgtcgacgaaggcgccctcgatgtcgcggaacgtgttgatgacgaagccatcggcggtgcgctcggcctcgaccgcgtcgcgctcctcctcctccaggccaggccactggaagaagcggcggaacgtggccgtgtagacgacggcacgcaccgggaagtccggcacctcgaacggctccagctcgccgtcaccggcggcgagcgcgaggcggccgtacacgccgtgcttgctcaggttgtgggtggcgaggaggaagtacgccgacgggcagtgcatgacgacgcgagcgatgccgaggcggtcgcagacgggcgccgtccacgggttgcagtagtcggcgacgaggcagtccgggcggcgaggcagcgcccggacgagccgctcgagccgcgccgccatggcccagatggccctctgcagggacaggtacatgccggggtcggcgtccgccagctggtccatgttctccagcccctccggcacgccgaactccgggccggggaaggcgacctcggcgaggtcgacggcgaggccgtcgcggcgggcggcctccacggcggccccgttgcgcgcggcgttgacgggcgtggtgacgacggtggcgcgcgcgccgcgggcggcgaggaggcgcgccacctccaccatggggatgatgtggccctgcgctatcagcggcaccaccaagaaatggagctccgccgccatcccgccgccgatgagtgtgaggaagcaagcaagttgcagtgtgcgtatacaagtcgacgcgacgaggacgacgcctgtgtcgaggcgccgcgccgcggcggcagaagcctcctggaaaagtcgggagggaggggtgatgacgtatgcgcctagcgaagcttcgtcgtcgcccgcctcgtagtcttcacagctgcctctgtcacgtggactcgtggctcccaagtccaatttcaacaagaaagttttttttaaatgcaacaaacaagaaggtaattaattgagttttaattatttcaaatttaaacaaggatttctttgatattttagagcagtttttatacagaaagttttcacacgaaacgtactgtttagttgtttgaaaagtgtgttaacaaaaacaaggtgtgtttagttcacgctaaaattgaaattttgattgaaattggaacgatgtgacggaaaagttggaagtttgtgtgtaagaaagttttgatgtgttggaaaagttggaagtttgaagaaaaaaattgggaactaaaccaggccaaagataagattctgcgtactggcctgaaggcatatatattgccctctttgtttaggcttataagccaacttataagttgaaaagtctaagccaaaacaaacaagtagctttttcatttggcttttttgaagccataagctattctaacactattaagccaaaagctaggttggagaagcttttttggcttaaatgagatagatgtatgactccactactaaacttaggacattaaatccactggcttataaatcatataagccaataagctgacttaaaagtctaggccaataagcctaagcctaaacaaagagggcaatagccatctgcttggctttcttatataggccgtgtttagattcaaacctccaacttttccgtcacatcaaatgtttagacatatgcatggagcattaaatgtggacgaaaaaaaaccaattacacagtttgcatgtaaatcgcaagacgaatcttttgagcctaattacaccatgatttgacaatgtggtgctacagtaaacatttactctactagtgacggattaattaggtttaatagattcatctcgcagtttacaggcagaatctgtaatttgttttgttattagtctacgtttaatacttcaaatgtgtatccatataattaaaaaaaatttagcacacgaattaaacacagccataatgagtttaaatgttagcacttcaaatcacatgaaaccaaggttacccttatcgatgggtttattgcacagttgccatgcggcaattgcggtaaccacaacaaaccatagaagccatacaaaatttatcaaaatttcagactattttttgaatctatttaattttatttttggtaccctagcaataagcacagttaccgtcagttttataaatcctgcttggaagtattttcaagctgttcattgagagagacaatagaggaatatctcatactcctaccttcttttggaatttcctctgaccaatttcgaatggatagtatccatagttcttctagaacttccattactacacactacactcccattcacgaggtcaggagtccatagatgacgagtgaacatgcgtcactccaagttgaaagtttattttgctattttcttctccggcatgatcgctccatccggcaagttgatacaagcaaaccggccctccgattgtttaatcgtccacacgtcactctcctttgatccgaagctcattgactcaaacgccataaaacaacttcgccacaattcactagcaacaaaccacagccatggacgacgacaccgccggccacgcctccggcggctacacgacgacggcggcggcgcacttcgtgctggtcccgatgatggcgcagggccacgccatccccatgaccgacatggcgcgcctgctggccgagcacggcgcggcgcgggtcagcctcgtcgtcacgccggtcaacgccgccaggatggccgggttcgccgccggcgtggaggaggccggcctgccggtgcagctggtggagctccccttcccggccgccgagttcggcctgccggacggctgcgagaacgtcgacatgctcccgtccaaagacctcttcagcaacttcctcttggcctgcggcgcgctccgggagccgttcgcggcgaggctccggcagcaacggccgccggcgagctgcatcatctccgacatgatacactcgtgggccggtgacatcgccagggagctcggcgtcccatggctcacgttcaacggctcctgcaccttctcctcctttgccaggtaaaaatcgtagcaaaagccactggcatatttctctgcatatgaataagggtatcccgtcatttttacatgtcacttaaaaagtcatcaaaatattttaaaaaaagtttggtaggatagatcaatatgtgatatgtaacttcacgagcatgcaaattcaaattcaacctatacaagtggaaataaaaataataaatttgactatgaataggacgcgcaattcacggtcaaatttgttatttttgtttcgaattgtataagttgaattttaactcgcatgtttgcgaaaagatatatttatatattgatctatcttgataaatttttttataactttttaaacgacatgtaaaaaacgaggggatatctcctcgagggacaaaaatctactttccatatgaacagagaatacttactccctccgtcgtgtccagatttatagctaaaaatgcttatattctgggatagagatagtagaaggagatacttatcaggtatgtgatctaagaactcacagtttggatgtgacctaaggttgtgtttagatccaaagtttggatccaaactttagttcttttccattacatcaacctgtcatacacacacaacttttcagtcacatcaccttcaatttcaaccaaaatacaaactttgcgctgaactaaacacatcctaagaacttggtccaagtttccaactatctcgcagggacatcatttatcgcaaaaatctattggagaacctcacggatgatgagatcgtcaaagtctcagggttccctacgccgctagagttgccaaaagctagatgccctggaacactgtgcgttccaggtctgaagcaaataagtgacaagatttacgaggctgagacgcgaagcgatggcaggatcatgaatagcttccaggagatggaatctctgtacatcgagtcgtttgagcgaaccataggtaagaagatctggacgatcggcccaatgtgcctttgtcacagagacagcaacgccatggctgctagaggaaacaaggcgtcaatggatgatgcgaaatgtttgcaatggcttgattcaaagaagcctggttcagtgatctttgtcagctttggcagcctctccagcaccgaccctcagcagcttgttgagctggggctgggacttgaagcttccaagaaaccattcatctgggtgatcaaagcaggaaaaaagtttccagaagtcgaggaatggcttgcagatgggttcgaggagcgcgtcaaagacagaggcatgatcataaggggctgggcgccacagatgatgatcctgtggcaccaggccattggagggttcatgacgcactgcgggtggaactcgacactagagggcatctccgcgggtgtgccgatgatcacatggccacactgttcagagcagtttgtgaatgagaaattggtggtggatcacctgaaaattggggtggaggttggagtgaaaggagtgacacagtggggaactgaacaaaaagaggttaaggtgacaaggactgctgtggagacagcggtatccatgttgatggatgaaggggaagttgcacaggagattaggatgagagcaaaagattttggcatgaaggcaagaagggctttggaagagggaggttcttcctataacaacataaaactattaattcaagaaatgggaaacaagcaaaatgcatctggttgatacatatggaaataagctttattttttcttaattgtaaatctgtaagcaagaactggaggatcctattgtgcttaccctgattttcatccctcaaactataaagaactgtactctccctctgattccaaatataaatctttttatacttgtgcaatttgtataagaattaataaaaacaactctaatgaatttgttgcccttcatctacagtatactatatcaagaaagataaattatttatttttaagagggatatagcatttatttagcaaccacaaacattgaacaatagtaaaaaaaaattgctaagaagctctgaaacgatatatatttgggtaagaattgagaaagactcaaatgacttacatttggagcccaacagtcccaccagcttctgcagtggacgaggttcccaggaccccttgcggatgagaagagtattctacaaatgatcagtgtatagagtggattagacctggtcttacatcactttcgtaattgctgcttcgattcctctgaatatatgaatgcaaattttgtggtcaaagtcaggcatagacttataaagatcacaaaaggaatttccttgtaccagataatgcagaggccagggagtatctttcgattttaagtacgtactgtattgatagcaactgtggcctctgtggttgcataaagaatggaagaagcttcatgtacgagggatctagccacgagtccatgactagcatgcgtcactgaaactgaagttgccaaagtctagcaatactgttctttttcagcacgagctcgaactggccgagttgatagtagtacaaactgttggcgctgcaatactttcaacccgtcactttcctctgatccgaagtggcaggcaccacatatgcactcctcggttgctgtcaagtgtcaagcttctcatcaactcgagcaggcaagcagcacacgacttctcggttaatgcatacctccaaggctccaactgttcttgtcacactctcactgtccacgcttgtcttggccgcttgactagatacaaccacacagccatgtcttttgccagccacgccggcgccggcgccggcgaccagcagcacaggtgctgctccaggacggtgcacttcgtgctggtcccgatgatggcgcaggggcacaccatccccatgaccgacatggcccgcctgctggccgagcacggcgctcagatcagcctcgtcaccactccggtcaacgccggcaggatggcggggttcgtcgccgccgtggaggaggctggcctgccagtgcagctgctggagctccccttcccggctgctgatttcggcctgccagacgggtgcgagaacattgacatgctccagtgcaaagacgacatgaggaaattcctcgaggcctgtggcgcgctccgggagccactcatggcgaggctccggcagcacgacctgccgccgagctgcatcgtatccgacatgatgcactggtggaccagtgacatcgccagggagctcggtatcccctggcttacctttagtggcttctgtacctttgcctccctcgccaggtaaaaatcacaggccactggcatatttatctctacaagaacaacaaatagttagaattgatcaatagacgaggcaagacatgagaatgatattggttaaaggattttaatcaaaaccacacattaagccttttatctaaaaaatacttcaggtcaggttggcaattggttggcagcactactaactcatttcagaaaatagaaaaacttttcatggtatcttaagaactgccggttggatgtgttttaagagctaagactgctatcttgaagggacattgtttaccgtaacaatctattgcgggacctcactgatgaggaggaggtcgttaagctctcagggttccctacgccgctagagttgccaaaagctagattgcctggaagcttgtgcgttccaggtctggaggaaatccgtgagaagatctatgatgaggagatgcgaagcgacggcaaggtcatgaacagcttcgacgagctggagactttgtacatggagtcctataagcaggtgacagataaggtctggacgatcggcccaatgtgcctgtgtcacagagacagaaacacaatggctgctagaggaaacaaggcgtcattggatgaagtaaaatgtttgcaatggctcgattcaaagaagccaggttccgtgatctttgtcagttttggcacccttgtcagcaccgcgcctcagcagcttgttgagctgggactggggcttgaagcttccaacaaaccgttcatatgggtgatcaaagcaggaaataagtttccagtagtcgagaaatggcttgcagatggattcgaggaacgtgtcatagacagagggatgatcataagaggttgggcaccacagatgatgatcctgtggcaccaggccattggagggttcatgacacattgtgggtggaactcgacaatagagggcatctgcgcgggtgtgcctatgatcacatggccacactttgcagagcaattcttgaatgaaaaactggtagtggatcacctgaaaattgggatggaggttggagtgaaaggagtgacacagtggggaagtgaacaaaaagaggctcaggtgacaaggaattctgtggagacagcagtgtccacattgatgaatgagggggaggctgcacaggggatgagaatgagagcaaaagattttggcataaaggcaaggagggctttggaagagggaggttcttcatataacaacataaggttattgattcaagaaatgggaaacgagcaaaatgcatctggttgatacatatatatgggaataagctttttttattaaaattctagatctgaaagaatgaattggaggatactatcgtacctatatacttgtaaggatgggaggagtccatatttggccctttaactatggtcttgcccggattttcatccctaagaattgtgctcccttcaattccaaatacaagccgtgtaaagacttgtgcataaatatgatttatttattagaaggataacatttatttagtatggaaaatctggaagaatagtaaaaacttctgtattctaaaatgacttgatattgagaaagaatcgtgaagcataaaatggcttacatttgcagcctggcagtccaccagctcctgtagtggaggggatttccaggatccctgcagatgcaaagagggagtattttacaaatgatcagtattattgtatgaggctcgtttgtggcatgattgtttacagtctggattattaaattatatcactttctgtttctgacactcttgcccaagtttcctagttacttctgaatatatgaagataaaaattaggaatagtggtcaagttatgccgtagacttcgaaagaaaaaaaatactgaatagtgagactgcagaggacagggagtatgagtatgtatagcaaccgtggttaacctgaccaaccgcgttgtccggacggctcaaagaatggaataaactcgaggactttggctatgagtccataactataacatgcacaccaaagttgccaaagttcagcgatgctgttatccttttcagcatgagctcaaactggctgatttgataggaggacaagctgctctgcaattatttaattctttttttgaaagaagctgcaattatttgattaatcggcaacattccactttcctccgactccgagatccgaagcatcaggcactactccgtagcacctcaaagcaagtactatgagcatccaagcacaagccccaagatgtcacataggactaaattgtgaggtggaggagagaagaaggatgagagagaaatagtcacctctcatgcaaggggcagcccctacacaaactttaataaacatgtgagagtgttagaaatattagggattgtgtggtagagatgacctattatacatatcacctcttaatttaattatctatgttatgtataaaattagatgcgatagtcacctccaatataaaacttgccctcagactgcttgcagtcatcaactcaaacagcatacgacttctccagagttattgcatacctccgcttgactagatacaaccacagccatgtc

SEQ ID NO: 60216 - DNA, 26592 bp, Oryza sativa
gcaacagagagaggggctatttttgccagaaaaggaggaatcgttttcatcccaagtacttccaatggtttcatgcccccatttggatctcctctctatatctacagcctttctggttaagctagccctcttgtctccatgcatccagatgctgcaggttcagtagtgacagagacacagagtgagtgagtgagtgagtggagcctagagaaaaccagcttacaattgcatgcatgcatgaagggaattgatgctgtgcatgcaacagtccaatgccagtatgccactgtgctagtgtgcatgcatatgtggctctcattgcatatgcatgcaaaaatcataaccaaattgtatctcaggtgttgatctttcagtttcctatagcaatgcgtgatatttgaagtattgttagtcttagaaatttcaggatggctagtgtcatgaggatggattctaatctctcgggtggacatccactcgtttcttgcatgtcacctaaatgattatgaaaaaatttcaaaaaaaaacacaagatagtttaatatgtaatatatcacttcacaaacatgcaagttgagagtcgatttgtacacgtgggaaccgaaataacacatcagactctagctactatacgtatatccacagttaaatttattgtttttgctacaacttgtaacgttcaattctggacatgcttgacagggaagtcctttctcacatattaacctatcatatcaatttttttgaaattttttcataaccatttagatgacatgcaagaaacgggtggacatccacccgagtgtttaaaacagtttcccctagtgtcattgattagttgggtggtcaaaaggggagcaagaaccaccagattttgattgctcatgagacatgtgcattagaatctataaaattctcacgcatgcttgcttacattttgggggtcacggttcaggtgtgccacactcacactggtttggttgaactatgatgtgcaattgtgcatgcatgcatgccaactgagagcaccagccaacaccaggtagatgaaaggatataaacacgggtaagcaaaattatcaaggaagcctatgactaggcagacaagtatttaatttgagcaaagttcagcatgatccctagctgtatttactgaattatttagcagtttttcaccccacgtatatgtgagaggcaaatggccatctctgaatttttagattgtttttttggtttgtgaataaggctatatagtacattgcacaatgtacttatgatctgctagtgtgtgttggtagatgagagggttcttcgatgggatttaaccacatatgctgctgtgaagaggtaaagacaaacatagcaggacaaggatataaagtaaaaaaggagattaccacaccatgctgcttcagaagttcagacacgctctggctgctgcatttttcctgggccaatccaaacttcagtttagctcacctagctttcagtgttatacagaattacagtttactgcacgaagaaccttcatgtattcactgcacataggaggtttctaccctgcagtaatagtagtactaagtactgtaactttggttagtcagagtgtcagatgctcatgccaatcgatcttcatcatgttcatggcatgcacattgctctctttgcccacccctgctgaacatgatagagaaattcatcacttaccgtgctgccatttgacagaaaatatctcttcagctgatcagctcgccaggaaaaaaaaatctgagttgatttgctactgaactgcacagcactgtaatgataaattacacggtctctttgcttatagccttaatactgcagtactaggagtaacaacaactatatgcactccagttactacaagatcgaaccagtaatccggtataccgccaaaatcgccacgtttcacttcgggatttcgaaattgctctgaattcctgcgaatgagagaaccatttggcaatttttaacttgtaagcaggagcaaacgaacatatatgcaggaacaaaacatcacgactcaaaaaatgaaagatggtaaaagcctgaaatgtaatcagaaattgttctcttttctacttttctcttcagaagttcagaggaagtctctctctctctctctctctctctctcacacacacacacacacacacacaccaaatcatgtcaggaaaaaaacaaagcacattcccaactgcttgtccctgaactcccggttgatttgattctcctttcctcctcctgctccacctgcacctaggtttcctgggattacgcaggaatttactctgctcccgggggaagagaagagaattttacagctactccagtctccaggcttgcagcatctgatctgatgactgtctgtgagctgcagttcatccggcgtctcagtccaaatcgatccaatcaatctcattctcgtggctgttcttggtggtgatgattgggcgggaggaaattctcggcgccgcagccttcctcctcctgcttggaacgccgcgaaaggcgtcggcgccatgacgtctgcttcgtcagaatcgcaatggagagagagagagagagagtcgtcggctagctccatggatcgacgccgccacgcggactgcggcaggaaccctcgcttcgccggccggctccccgccgccggcctgaggaaaagttaggttttttttttggaaaaataatggattcttaagccttctacttttattttttttctaatcaaacttctttaaattaaaaaaatgacaacgcatacaacaccaaattaattttactaaacctaatatttaatattttgtgtggaattttttatatttttctataaacttattcaaacttaaaaaatatgaaaaaaaaaaaaaacgacttatatgaaacacttaggctgctttcgttgctgggagattgagagagaaaacacatctttttcgcgcagacgctttccgaactactaaatggtatatttttttggaaaacttttctatagaaaagttgttttaaaaaatcatatcaatccatttttaactttaaaataattaatacttaattaatcatataccaataacttacctcgttttacgtatctcttttccattttcctcaaacacagcttagggcttgtttggggagctttagattctgagaagcagttgtttggtagccagcttctgagaatctggaaaagctctgaaaccccgtttctccagcttctggcttcttaattcatttttcagaatatgtaactacagattctcagaagctgtgaactgtttggggcagcttctagcagaagcagcttttgggaaaagctgcagctgggataagctcccccaaacagggccttaggctcctcttgattcaatggtatgcactatgcaggtatattttcagcgcactcgaaacaagaaaactcagtagcacataattaattaagtattaactattataaaattgaaacatagatttatgtgattcttttaaacaatttctacatagaaacttttagtaaaagcacactatttagtagttcgaaaagcgagaaagttaaagtttggagatgagaaaaggtactaaggcctaggtactctataggcttaaatacgctaaataggcttaacatgttagcccagcccaagatgtttcctgcaagaaacggtgggcctgaacagagcggccatgttagtccgagaccatttgcgaattaatgggcttctctgaaactctgaactttttccttccttttttttttttttgcggggactgaaactctgagcttttgatgtgcttcttttcttctcgtatcctatcatcagttcagagaagttcaggtgcgtgtatcaaacgaagaagaacaggatcaccgtccttttctggtcgttccatcacacattcacattgccaagaagacattttcatcgcttgtgaactctgaagcctgaacatttactagtactacacgggcgaggcgatggttttggtttttgtattgttttctgcaggcagaaaacaggtctgaacttttcctgtcacgcactcacacgggaatactcctggatatatactttcagagtcaaagaaatacgagtatttgcaagtttgagccagtagtaaaatgatgaaaactgagacaagacccagcttcagccgataagcagtagaaaaagcaaattacaaacttggctctgattgtttgaaagctcgtgccggaaaacatgcctccgattgtttgatttgagactaataaaccctagaaaatgagtaatccatatgtaaaacttttatatatatatatatatttttaaacggtttaaaatccaacattaaaaggactcaaaatcaactttaaaactaggttctactgtaaacttcaaatttggctatgctgattagataactaactactccctccgtactaaaatataagagatttagggatgagactttttctaatactatgaatttggacatgctctttgtctaaattcgtagtattgtaaagtgtcacatttatctaaaatctcttatattataggacggagggagtatcacaagctaaaaaaaaatcctaaaggccattttggtttgatactaaaaacataccctaccaatttgttggcaaattaaatagtatatatgtattagtttggattgagactaaatgtttgttagtgcccctatcatatttagtcatattctaaaagtttctcaactataccgtgagaatttagctttatattggtagcgatctaaatgctagctaaataattttaccctaccaatattagaatttagctttatattggtagcgatctaaatgctagctaaataattttaccctaccaatattagaatttagctttatattggtagcgatctaaatgctagctaaataattttaccctattaatattttggtagtgccaaagtttaccaataaattggtagagtaaagaaccaaacaaaccctaaaatcaactctaaaattgtcagcactaaaattaagtttgaagattttttttcttttttgataagctgactagtctaggccctattgtttagattccaacttttttcttcaaacttataacttttctgtcacatcgaaattttctacacataaactttcaacttttccgttatatcgttccaatttctttaaacgtctaattttagcgtgtaactaaacacagcccctatgtctgatttggtgggcgttattagctgatgccttgatgagctgattaactagcattgtcacatcaaacctctaagcacagtgaggtcaggccggtcagtggggtgctcaactgcagcagcagcagctgaaccaaaaccaaaacagcccaaaggttcgtcagtattcgtactcttcctctagagagttcagttcacacgcccaagaagtacagtacaccatttgactgcaaaaatctactgctagtaggagtgtggtacttgctagtacttctacggctgtgttcgcatgtggatgatgggaacatagtgtctccgcacggaaaacggagcgatctattagcacgtaattaattaagtattagctaatttcttttttaaaaataaattaatttgatttttaagcaacttttgtatagaaactttttgtaaaaaatacaccgtttagcagtttgaaaaacatgcatgtgaaaaactagtgatttgggttgggaacctggaggtccgaacacacccgtaatgatgatgaattttgggaaatttcagcactcacaaaacactcgaaggctggaaattaggctgcctttggcagtgagctttcccaacttttacccatgttttccccgtgcgagttttttaatcggttaaaaggtgtgtatttttttttgaaaaaatctatagaaaagctacttttaaaatcatattactttattttttttaagttagctttagttaatccttaattaattatatgctaatgagctgtttcgtttttttatgttggagggaaaggttcccaactcagggcaaccctatgtttatgactttggccgtgtttagttccattttaatttttttaaagtacaaggacacacatttgaagaattaaatgtaactaataacaaaacaaattatagattccgcctgtaaactgcgagacgaatctattaagcctaattaattcgtcattagcaaatgtttactgtagcaccacattgtcaaatcatggcgtaattaggctaaaaaattcgtctcgcaatttacatgtaaactgtgcgattggtttttttcatccacaattaatgctccatgcatgtgtccaaacatttaaagtgacggaaaagttagaagtttaaaagtaactaaacacaacatttgttcaggaggatgtcaaaatcaacattattaaattttttattcttaaatgtttggcacattttaacggtaccaaatttcgataatgttggataagtttagttgatagcctgatcaaaatttggtagtattttttataggaaaaagtttttgaaaataccaaaatttactaaggtgtcaatgataataaattatttaatttgttactttaccaaattttgtgacacggagccacggatgcagtgcactactccctccgttccagaaaaagacaaaccctaagtttccatgtccaacgtttggctatccgtcttatatgaattttttttataattagtaattttattattgttagatgataaaacatgattaatactttatgcgtgacttgtctttttaatttttttcatagtttttttaaaataagacggatggtcaacgacacaaaaatgtagggtttgtctttatatatatatatatatatatatatatatatatacacacacacacacactaaggaagtaagtacgagtgctacacttgcctccattgaggatgagagctcgaggtggctagtagtcccagtgaggcgcatttctccaaatcctccaggatcacaagtggaacgctaagggcccctttgttgacgaaaaaaaaatcgaacacaccggtctgggagatctgcttagcttctgtgtaggtccaaagattgatgagatgcgggcgtgccagtcagtttgatcctgcaactgacaagatatgtaaacagcagatcaaaacagccgatcggctgacaagccgatggagtagttccagccggtagccaataatagccgatgccgataccagccgatagcgatagggtttaagcaatcggctatatgtccaatgtagataacgatataaaggcaatcggctgatgatgatgcaataaaataataatataatccagtataaaccaatcggctagcaatgatatgataaataagcatcgatccgaaggttaaagcacacatcggctggaggtccgatgtcatgaaatctacaagattagattaaacagtgaaacctttgttgtcatcggcgaaatccaacttatatgtatgtgtaatccttatgagccgatgcaacgtccagataactcaccggctgaaaccccgatgaaacccttattggcaatcaagaagcaggctagagattatggttctaagcacgacttagtagatcaaacttaaccgatgcagcactaagtatgaaaagaaacataatatctagatttttaggatggtaaatgtctgagctaatctaatctagcaacgcgatttagctgatatcggcagaaaccctaaaacgagaagcagccgatagagctaaattgatatgctaggactagattaatagagacatatgataaataggtaggcaaatatatcatccaaactagagcaatccaagaggtcgaatgtgctgatgcagccttgaatgacgccgatgtagatgagacaattgcctgggccgacggaacattggacttatcccttcgtcggagatcgaagacgatgcagccccgcgtcgggtgccaagttccgccggaacataaaaaacaaaagtagaagtaaaaagggtagcgatgcaccaaattgtattgatcgtagagatagattacatagaccccgggtgtacatatttatacccatgggttgatacaagtccttgtcggataagaaagaaactaacctaaagataaaaggaaaatataaagtccttatcggacactaaacacactttcctaaagataaaaggaaactaacaaactattcttaattaatagataaactgccatgccgcatcctttttaaactcgttcaattagggataagcttcctttagtagattgatttccttaaccgaatatagcaggaatccgactattggcgacttgataactcccatcggctgattccgagatgctgcagccgataatgattctaagccgatgacgtctttgccgattaccaaatttcactgttaacaccctttgaatcacagggtagaaaaaacagaggaataggaaaaacacaggattctgacaggaattaaaatgtaaaacaaaggattgcaaaacacataaaaaaacaggaatggtcgtttgattggagcgcagtaaaaacgcaggaatcggatgagagagatagactcaaaagaatttttccaagaggttggagctcttgctaaatttcctccaaaatccacatgcaatgtgccattccataggaatttcataggatttggaaagcttcaatcctttgaatcaaataaccaaataggaaaattttctatataatttaaatcctataaaattcctatataaattctttgatttaaagcggtcctaagtaagggtggggaggttgctagctccatgtcgaacagaaagaagcaagagtctcgagtctcccactaggcgagggaaggagacacaggtggcacccctggtggccgcggaatgacggttgtgcccctggtggcgaggggtggcgtggggggcaggacggtaaatctgcagtggagggggaggcgactgggcggtgagctgatgagggaggggggcagactggtcgctgacacgtcgtcggcgagcgcattgaccgttcctcccctgccacccgccacgtggcccgtcgcctgtcacgatgtcacatgccccgccctactgtcctctcctgccctgccctaccggtacgtgctccgtctgtcccttaaaaaaattccatgatattttgagacaaatgaatactccctccgtatcaaatgtttgacattgttgactttttagcacatgtttaaccgttcatcttattcaaaagaatctgtgaaatatgtaaaactatgtgtgtacatgaaaatatatttaataatgaatcaaacgatgtgaaaagaataaataattacttaaattttttaaataagacgaatggtcaaacacgtactaaaaagtcaacggtgtcaaacattatgaaatggatggagtagtatttacgcttttaatcttaaaataaaccaagtcttgtatatgaaaataatactgatagatattatcttcgttccaaataggtactccctccgtactcatcaagatagtaacacagtctccaaaacacaactttgacttattgtttctataaaaatatttattgaaaaatgatatatgtatacttttatgaaagtatttttcaagacaaatctattcatatattttttacatttttaaactcaacaacttaagagttattcatgatttatatttctaaggtttgacttaaacattgtcctaaacgacttcctttgcgagtacggagggaatatccttttaggattcaatttttttccaaaatatttgtactctaaaatattacctctgtttcaggttataagaacggaggaactatttatcctatccatcttcttatattaaatttctccttgttataccctccaattgccactccgattctaaccatatcatttacagaaaagagaatattgagaagatacgcaaaacgatgtgagccattagtgcatgattagttgagtattaactattttaaacttcaaaaatggataaatatgactttttaaaacaactttcttatataaatttttttataaaaatacacgtcgtttaatagtttgggtagcgtgcgcgcgaaaaacaagttgttttctctctcgatctcccagcaaggaacgcaaccttagtgaagagtagtatagtattttaacttaaaccttaatttatgctaaactaacaaaaaaaaacaattattttgggatgaagggagtataacctaacggagatcctctgcagggtagtgctactcactgggcacaagggtttatgccttatagatccacgtgtcagtgaacagtactgcagagaatcctctttcaatataaccttattctactaagataagcatattatactgctgatgttggtcatcggagatgatcagcaaacatttactaaagtttcaaagaaggaaaagaataataaagctttaatactactactacacatttggtcctggatgaatggggaaattagggcttatttgaattaaaggatttttatgatgaggaaaaaaatggaggaatccaattcaaaagaaattctcctactatatgagcagtttagtttggatcatacgattgtttcaaagggatttcaagggataggaaaagtctctccacatcttcgaggaattctagcatggggtctaacctcgttgtttcgaattcttttgtgatttttaaggcatgttctctcctcctctctctagcaaattaaacatgtaatctcaattttctctcacccgttcgatatatccaaacacttgtgtttgaatgattcctgtagtttgattgcttggaggatttttcatgtcgtgacatttcaatcctaagttttcctcttcctgtattttgagtcatgttccaaaggaacccttaaagtggacttataactttcatcaatacatatttggtaactcatggtaaggagattggaaatttagagtaataagctaatgaagggattgatcctgtaagtttcatttttaatctctgtcgtttgataggagatatgagaattatgatgaatttgagtgagaaatgaattttaagtgatgatatactaacttatttttttctctcagttacctgcctctacccaaatattgaaaagacgagagttcgctcttaaaactcctcacccctcaaacttccatcatcttcaaacattccccctccctcctaaccaaacactccctcagcgttctgaatgcaacgtgctattcaattaatcacagaatataactttgactgacttacaaacttagtaccagaaggggataagaagtgaaatccgagtagaaatagggagattcaaaatcacatataggaaagtaagaataaccaacaccttcactcttggataaacgttgtcacaaaatacgtaccgtcaaattttaaaaccttaaatggccaattaataaaaacatcaaagttttacacaatgatgaaatatgtctgttatacctattgatagtgagacatctacatgattttctttattaaagatatgttggtgcaatctctgaaggtgctctatgcacaagtgtacatataagtgcatgcatctgtcatgtgttaaaaaaaagctcagagatgatgagatatgttcattacattaccaaaacaaagcataacaatgaattaagtaccagataaatcttggcaattgggctcttgaaaacctggtgcacagtctcatcatctctactgttctacagaatcacctcccttatcttacctgcatgacaaatgcctcgagaaaaaaaatatagccacgatggcagtagcgaaatatcgtgcaaaaggaggggcagtttcgaccgaggagctacagtgagccgcaagtacgcttttttctgcaggctcatcaatccatgcacactcattattagccctagaactgtagcatcatttcacatttattttctttctctctctctcggccttaatcgcatataacgataattgatatggataattggattggattatatgcagctgtatcacaaattcacaatcccacaatctcattttcttttttactcggtgaaccactaaaacagtgtgaaatgggcagctgtttggcgttttcaagaaagaaaatattgttaaactgaccttttttgacagtcatcttcagttttttttttttgtttaagcccttcctctcctcactcacactgccctgttcatctctttcttttttattcgattcctctattccattccacacgcattgccgctggtagtagaagtatagtatctctccgcgaccgaagattttaaaaaggaagcaatttgcctcttttttttttttggcgcacctcgattagtagtagattttagaggcgaatgtgagcggtcaaatccttcttttttagcttgtgcgcgttgtgttttgtgctctccttttgtcagttcctgaggcgctctctcctgtgcctttgtgtttagcgtgcgtgaccgcgagcgaggtcgaggagtgagagggagtgaggcggcggcggcggcggccatggcgcagcagcagcagcagcagagtgcgtgggaagcggagaagatgtgagctttctcctatctctcttctgttcttcgttgcttcatcattccttagtttgttattgcgatcagattggtttgatgttcttcgcacattcttttttcccttttttttatgttggtgaaatgttctccgttttgtcttgagatttttttgtcattccatttggttctcttggtgtccgcatggttatctttccccaagattagtttcttgttttcctctgggaggggtttcggattcgtttcttggcggtttagatcgtctttttttctggtgatttttgcaagaatcttgtccttcatcttcccttgttgttgtatttcagagggctgcagacgcttgagattctgtttgagttccctgaaatttctgcattttccgttctgcattttggtttctccttttgcaaaagccatgcctcttttttttttcttgttcctcttgttccttttatttttctcggatacagtactagtttggtttattgcttgctagcttttcaactgccttttccttttaccttgcattgcaactgccttttcatttctcgaaatttatttgctctttcacactttaatctgcattttacctttttattttctcatgaaaactttcgatcccctccttcctgttgctgctgtgcttgcatgcaaacccccatgtttccttttttacttattatatatccccgcactgaacttatccatgtctgttcttggaagcaggttggacgtgtacatccatgattatcttttgaagaggaacctgcagagcactgccaaggcattccaagcagaaggcagcgtgtcttccgatcctgttggtcagtgcatcaatttctgaattttgtcatactactgtagtttgcaatctttgctctttctgcattaggaccagatagtttgttcctcagactgccattgttcttgggccaataggatggttacaaattgatcatttgattagcttgattagtactacacttacatttgtgcatgtgcgagacacgagtattattagctactcgtaccgggcagatacaaaggaacaatactacagccacattgttttgtctgatttatgcatgccagtctctgatgtttctgcattgtaatgaatgcgattttaatcttcttgtactgaaagatgtcagcttttgttttgcaaaaaaagcaattgatgccccagggggtttcctcttggagtggtggtctgtcttctgggacatcttcattgcaaggacgaacgagaagcactctgatgttgctgcttcgtacattgaggttcttgtagcacatgcatcttggttattacttgtccttgttgtttgcttgcactcacttggtacagtggtttactgcttatcttacaataaacatgtgtaaatgcttgaattgtgtcagtcatagagatcatgttcactgtaaaaggatttagttttttgcctaaagcaaatggatttaaattccacacaaacattgaaaaccaaattcaagaactttccatgtcactcttgaaaaaaaagaagaaaatgcctaattcatctatgtaggaaaaacttgttatggtggatatttttttttaaaaaaaaaatcaaatgtttccccatatttccaaacaaaacatgctgcatcatatcacacaattatagaagaacatgtgtcttaatcattttagaaggtacagaatgcaaaacactttctcgtagaatacatactatgttgtctccagctattatcatctttaaaattcaagtaaaatttcaaagtcaacattttattatcaatatgattaattactttgaaggcaatggtcccttccctttgtagtaggccgtagctaatacctgttcattttctggtgattactcatttgaaactagccatttcttggtatatgatgcgtcaatcttattgcaaaatgctattttcatgttcctgatgttgttacacataaattttgtaacccagacacagtcaattaaagctcgagagcagcagccatcacagctgcagcagcaagaggctcattcccagcagtcatcacagcagatccaaatgcaacaactcctactacagaggcatgcacagcagcagcagcagcagcagagtcagcaacaaccacagcaacaacgccgccagcagaagcaacaacagcgtagtgaaagcagtcatttgccgacaagtgcacataatggtttggtttctgctgatcctccaacacgacaaagcacttcagctgcaagttctttgtctgcaaagatgtacgaggagagggtgaagaattctgttcaaagggacaccttagatgaagcacctgcaaaggtagtttcttcatggcaatgtgtattgttgctttcatgatctaaactctcataatatgaaatgcatatctttatactgcagcaaaggtttacagaaaatattggacaactgctggaatcaaactcatcatctatgctgaagtccgttgcaataacagctcaggcttcagggtaccaactgctcaataatgcttgctaatcatttacttctcttttttttttttttgggggggggggggagtgtggggtggggatgggaggtttggagcgcaaaataaataccatatcagtcttaaatacagcctataatgtgtgatctaataggatttcctaccatgcttgaattgtgtttaccgcctttgtttttacctaactattttgcggtcttcaaattgcaactttgaccattaattcttattgtacactaaaatgtgctaataaaaactattatattactttcatattattcacaataaatctatccagcatgtagtagctgtttgactaaatttccgtaatcaatgctatcttgatggttcatactgtaatggctgtttaacggcaattatctctagcttctgttttcctgttagcgtgtgtgtattgatttgctttgatcaattgtttttaggcaaattttccatggatcaactggtggcgtgtcaggtactttgcaacaggttcaggcccggaaccaacaactccaggcatcaacacaggtagtcttatttcagatgtataatctcatgcattattgtctataactagacgagtcaaatttgtttcaggaaataaaggtagacacaaatgctgctgtacacatgagagctgcaggggcagatggatcattaattggagtaccaggtttttttgctttgaactctactaatttttgttgtttctggctgctaactggaaattcttagacctgctgtactgtttattcatgtacttagtgccattgtttgataccctgttgtctggcaggcgctaacccagcagggaacaatttgacgttgaaagggtggcctcttactgtgagttcttcacatcattccttaactggcattctaagctataaattaggagcaagtttgaatacagcaccttctttttttttttgtttttatgatgttttaccatttgattataacttttcagggcttagaccagcttagatctgggtttctccaacagaaatcttttatgcagtctccccaaccattgcaccatctacaatttctcactccacaacaacagcagcttctgcttcaagcacaacaaaatatgacatcttcacctggagagatggacagcagaaggcttcggatgcttttgagtagccgaaacattgttcctgggagggatggtcaatcaaatgcctacacggaagttattcctagtgttggcccttcattgcaaaatatgtgctcacctgtgcagcgcatggagacagatatgctgatgaaggtaagtttcacttgtatgttttactatattcatgcatttatttatttgcgaggatacattggatgtaagtaatagtaccttgtaaaccaccgggttatgcataattttgttctcaattgatatcttatatgtacatagattatattgtttaattcttgtcagtgatcagtaatagaatttcatttaaatttatcatgcttgttcttgttatgttatgttgccaagtttgcataacacagtaccatttactttctactatagcatagtgattaaatcatgaaaatatcggtcttggtccttgtgtaatataatcttttgaacagaggaactcatactatttggatttcataatgatctagctgctattaatacatgctcacatgttttctgaagctacctttttcaagataacttctacatctttggttttcgaccttaacacctcgtcattatatgtagtagaagatagcagctatacagcagcaccagcaaagcagcaatcagcaacagctccttcagcattctttacttagccagcaaccaccaatctctaatcaccttccaggccagcaggaaaaaatgggagctggaagtgttactattgatggaagcctgtctaattcattccgtggaagtgaacaggtttcacttccttctacatatattcaacattaccaccttgatttgttactgtgcctatccttttgttaagacttgtatccatcataaatatattgttttgcaggtttccaagaatcaaaatgggcgaaaacgcaaacagccaatctcatcgtctggtccagccaatagttctggcactggaaacaccgcggtcccctcctcagaaccctcaactccttcatcgcaaagcccaggagacacaatttcaatgccctcgctgcaccacaatgctagcttatcaaaggctttagttgtttacggtaccagtacagcagggacaatgggatcaccatcaaatcaacttgtaagttacaactggttctaaatccaaacagctatggccctattacgtggatatattatgcatgcaacatagtttggaaatgtttcattgcactgatggtctgtttgatgcctgacttctgaacatctgataactcacactgcaggctgacatggatcgttttgtggaggatggctgcttggaagatcatgtggattcgttcctgtcgcatgatgatgcagatcgaagagatggcagtcgtatggaatctactaaaggtgtgataaggctaactgttttgtaacttatggctagttgaagttgaatggttggctttgacatattaacatcattggcagtggttaccctggccagtttagtcttgaatgtaattatggctggtgtaaatagtaccaacaagctgaactcacttaggtgaatttagcttggaaattgagcagttggtgcggttcaggctatggtcctgtgagaggggaaattatctaatatgtcatgtggtaacatatattggttcagtgggttagatttatgatgtattttgtagggaagtctaacatgaatttgtgttctgtagagctttgattctgtttatatgtcttaagcaggattcatcttccgagaggtctcttctgtacaagcaagcacgaacaaggttgtatgctgccacttctcatcagatggaaagctacttgctactgggggtcatgataagaaggtaagtgcacatgcctgggcttgttaagatgctcagcctagttgatactcttggaagtgggcaggcatatctttgacttcatggtgatattgaaatagatacttgcaatgtttcaatgcaggtggtattgtggcatgctgaaactttaaaacagaagtcagtattggaggaacattctcttttgataactgatgtacgattcagtccaagcattccacgccttgctacctcctcatttgataaaactgtcagggtctgggatgctgacaatgtaagtacataactgtttagttcttttttcctaccatctatttgcctcggtgattgcctctgtgttatgttgcaaaaacctgccaactagcactgaaaccatatcaaattgccatttgtatatttagccagatttttttaccttttgaactgccctttatgtagaaacaacatcataaagttaagtaggctataaattctcaaagaatacagtaagcaatgtccatctcaaggtcatatgtcgtgaatgatctacaacatcaattttgagattcataggcatggcatggattcattttgtagaagtggaacttgtttgttctctaggggatataagcatgatacttctgaactttcagattcctgggtaatgtcagtacttgtaatgttaaagctgcaagggcagcaaagtactgttgtgttttactgctcatcatattctaatgctgtcattgtacttttgcagcaaggctattcaattcgaacgttcactgggcactcagcatctgttatgtcactggatttccacccaaacaaggatgacctcatttgttcttgtgatggggataatgaaattcgattctggagtatcaacaatggaaacatcgtccggatatttaaggttactcagtttttcttattcagcattctgtcaatctggaagtgctgctttattgtgaacaatcctaacatttccttgacaaagcactccaacgtatacttgtagacttttctctttatagaaaatgtgcatgatgaatgtcaatctgttgaaaacatcctaaaattacgtaaaagaaaacatcctagatgttttccatacctacttgttaattggtttcaatcactgtcataacccctttgtagttaatgggctgttattaggtgtctccatccataatcaacaactggtctcaaaaggagatgccttgtaggatacactgtttcttgatttatttgtttccaatccctttgtagggaggatcaagccagctgagatttcaaccacgtcatgggggatatcttgcagtagcttcggagaatgctgtctctatacttgatgtggagactcaagcttgccttaggagatttgaggtttgtagagactttctaccttgcagttggcacgtgcattctgatcttctaaattcactgaggttccagtaacatatataccgaccaacaaatctatgtgcaaggatgtatttacttttcaaatctcgtttttagagtgagttttggatactgcaaatctatctatttattttgtaattagctttgtggtgttcatttcccttgatggttagttgtccttgcttggttgtttacatattttcaaagtcgcatcgtgctagctgtagccagtgttcacttccatgttaatctttagagtttccgagtgatggtaaccaatcactttaatctgtcctctttattgggaactgcagggccacacaaagcatgtcgattcagtatgctgggatcccagtggcgaatatgttgtatctgtcagtgaagacacggtgaaggtgtggtctgtgaatgctgggagcgatgatcgctgcgtgcaagagcttagctgtaccgggagcaagtttcactcgtgtgctttccacccttcatattcatctatgcttatcattggttgttaccaggcaagtactttatattcgtggatctcttttatgctcatgcgtcacgattcattcaaaactaatctgcactgatcatcctaattcctaagtagctggttaaaaatgactttttctagatcaactcatgactactcactcacactgaggatcattccacaacttgaatttcagtacatcattacacatatatcaagttcctcaaatattccttcatgatacacatgcaattattttgaagatttactgcaatgaaatacttttcctatttaagaacaagcattcggccatagagaccacttatgttttcaccgcggttcatgtttacaatgcctgtagtacgcttacctctggttttgtgtttgaatgccgcagtctcttgagctgtgggacatgtcggagaacagaacgatgacgctcgcagctcatgacagcctcatcacagccctggcgtcgtcaagctccggtttggtcgcttccacgagccacgacaagttcgtcaagctgtggaaatgatgtgctttcaagctagccgcgccctctaaccctcttctaaggatgggcctttttcttcctcattttttggtcacaccatcagctctgaagagctattgtgtgatgatggtataaacactctatatggtataatatcccccacaaagtagctggctactgaatgactgatgaaaatattgctatcctagtataccttttgctgaccctgggaaagtagcattttgtacagaacatgaactatgctttagtattaatcatagtctatctgaactactgaagtgtttatggtctgaattctaagaagttattctgctgcatctctgctatgaatatgaagaatgtgatgaatgtggcattctcgtaggaatttcaagggactttttttgtaagaagtatgctcaattccagcaagaaattggaaattttcttactgaattttacaaacgtggtttcgtcacggatgcttggtgtctggggaaagcaatgaatcggcatctctggcctgcaataaacgaatgtatttgccctgtttgcatgttcagtctttgcacggctcttagattccccagcctgtccaaaaatacccatgacacggtttgatcgatcgattgcaacacaaatctgtgaacagatcattggttcctgatcagagatgttcagttacttctctgaacattgatttttcttcttatcagatagggaatgtgcatctttctctctgatcttcagtttggaagaacactgcatcctgtagggctttcacaatgatagctacacctacatgggaatttttgagaagagtcatatgcatcttcatcagaatgatcagaggtaaatacaatgcttagttgttgcaaccatcatcacaggtttaacaggttctcagattctgttttgtttagtttaccacttgactttataggtttataacctggagaaaaatgtatttctcgttcataaagtgaggaggataaaatgccgtccgagtagatggaaaatactggtttagtaatccaaaataatctagaggttctaaccgtttctaaaacaggctgggtggaatgtcatctaatccaactttacaagaactttttatcggttttgagtagcggaaatgcctatccgtataattatcaggaggaaagcggcaaattccactctacattatttaagatcttgaaggtgtttggtacatcgctctagctaataaaatcttggagtagtagtgccaaactgttcttaggcggcattcgggaggaggggttgtgaacccttcatcctcaacaggcaaaacgaaaaatacgtattattgtatgattaattaagtattaacttttttttaaaaatgattaatatgattttttaaaacagctttcttatataattttttttaaaatacactgtttagcagtttgaaaagcgtgcgcgtggagaacgggagaggtgagttgggtatactggggaagaacacagactttgcaaaaaaaaaagtccccggtgtaattgggaaaaaaaatcattagggatagatggatgtatcattttgtttcacatatttatccctggttactattataagccgtgttgatattttatagccaatcctttttgagtttgatcaagtttataaaaaaatatagcaacattttcaaaacaaaacaaatatattatcataatatattaaatattagttttagtgaaactaatttggttttctttataaacttaatcaaacttaatgaaacttgattagaaaaaaacaaaatataatatcaaacaaagaagtactccctccgtcctataatataaggaattttgagtttttgctcgtagtgtttgaccactcgttttattaaaaaaatttatgtaaatataaaaaacgaaaagttgtgcttaaagtactttggataataatgtaaatcaaaaaaataaataatagttctaaaattttttgaataagatgagtggttaaacagtgcaagtaaaatcttaaaatcctttatattatgggacagaggggtagtatttgtgccttttctgaaagaaaatctaaaaacaagacaataaatgcgccggcaaaagccaaactaacccccgtgtttaaatcgcctcccgtacaagtctcctgcccctaccaataccaacttaacccctcttcttccatctctaatctaatcactcctcccctcttccaccctccccccacctcgtcgcctcgccgtctccacccccaaaaccctagccgccgccgcgctcctcctcctccgccgccgcccggcgccgcccgcggccatggatctcctccgctcgcacctccacaaggtccgcatcccggagcccggcagccgcatccacaaggacgagtgctgcgtctccttcgacaccccggtaaaccaaccaaccacccacccacccacccacgccttgtcccccccttcgctctggtttcctagggttagggttttgacgccgatttcgccgtgcagaggtcggagggtgggctgtacgtcgacatgacctcgttcctggggttcgggagggagcacgtggcgtggaactacgagaagagtgggaaccccgtgtacctccacatcgtgcagcgccggaagccggagcccgacgacgaggcggatcgcccgctgaagaagcccacgctactcgccatcggtatgagtgacagcgctttcccactgatcaccatcgtgtatttcatactgttaaaattgtgaacgcatgaatcgcgttagggtatgtgattgtgtttggatgatgtgatcgttttcctattgcgacttgtttttaccctatgatcaacatcgtatttcatactgttgaaaatctgtatccccattatctgttcccctttgtggtagagacttaccaaactatggtagttatcatatatcttgtgttctgtttgatctgttgagctactgtgctgtagagaaaaaatatggtagtgcattgctttgtttgctaatctggaaacagagaccaacatatggtggccatgttggtgaattgtttgttatgtgatatctgtatgctagttatttgtaattagaatagttgcctatgtcctggatttagatctatatagttgtattttctctgttctgtattcccatgatggcaaatagatgaatgcgttgaccatctttactaatccgggttttctacaatttataggagtggagggaggtttcactgatcaagaacccgaatacgatgaggcttttgaaattgttatcttgcctgaatttacttctctcccttttccatcaattgacttgccagagaaggtaactgtgcttgacataagagattgtacttacttactacatagtagttacttactactctacaactccacaggttaggattgcagttgacaaagttatacttgccgaaagtgctgatcgaaaacaacaattggcttcttgggttgctgacaagaaaaaagtcagtgcacatgctatggatctgaagcagctagacaatggtgtcattgtgccacctacaggatggaagtgcagcaagtgtgataaaactgagaatctctggttaaatttaactgatggcatgatcctatgtgggaggcggctttgggatggaagtggggggaataatcatgctattgaacactacgaacagactaaatatcctcttgcggtaaagcttggaacaattactgctgatttagaagcagcaggtaatgctactcgtggaccttttacatatttaggcttcctcttctattatcgaatacaacttacggtgacattgggttgtcgcctgtgaaaaattgaactaaaccccttttaacctctcacaaactgtatcctttgtaatatctaaattaaaagtgtcatatatatgatgctcaacttggaatgcacttttagaatactatactccctctagttttaaatatacaaaacggtggaccttttaaattcgtttgactatttgtcttctctagaaatatttgtgcaaataaacaaacatataaggcactcttaaagtacatttgatgaccactttacttaactaagtaattgaataaacattgttggtcaacgtttgagaaaagaagtggatggtgtcatatatttaaaaccagaggtaatacttaaatagcttttagagatatgtttgttataaatacttgtctttattcagaggcacaaaaagttggaaaatgttaatgattttgtgattggagggagtatattgcaattattattgaatattcactttaatcagtaagactcgttcttaaattccagagttgttccctggatacatactgctcgtacttcataatttataacacacagcccaattagctactataaaagtaatttacactgatattttaaccttccattgaaatattttgctttcgtcttattttagttttaacaaagaatattcttaaagtcctaaagcaaccttcctatcaagggcatgtgctgctgaagttactgttgttttatatttaaatatacctattcatacaagcttttctgtgacagctcagacgttttctcatacccagaagatgatagcgttgaagatccactattagcgcagcatttgtcacattttggtattgatttttcttcactccaaaaggtgagtagtatcattttcgatgacatttatgagcgataatttagctctgctcaatatgacttgctttttttattgggatagtaacagaatagtactttttcatgggaataatatattctgtagcatctcatgctcatactgggttttcccctttttatgcttgtctatctgtctaagttaaaagctatttgatgtgaccctttgttgtgcagaccgagatgactactgctgaaagaaagcttgatcacaacacaaattatgactggaatagaatacaagaaagtggcaaagatgccgaacttttataccggccctggttatactggccttgtaaatcttggaaataggtagctttggttcattggttgacgtcatgaattttcttttgtaataatttctcttatgtaatgcatgcgtttccttctttgcagttgctatatggcctcagtaatgcaagttatgttttcaactcatccttttatatcacggttggttctactttctcaattgatacttcagcacttcttgtctagagttgcattttttcctttttagtagcacatgctcttgcatttatttcttgcatcatttcagctactttgagaagcagagcttgaaagctgcatttgcaattgccccagctgatccaacattggacttgaacatgcaaatgtaagtgtacaccagctgatctgtgtttttgcgtgtattggtattggattagtcactattctgaggtagttggtgtgagatgcagtgttaccttcttctaatgctaaatgtaaggataatacataaagcagttttttggccatttatcctgtatggttgtatgtgaagaaaccgtaattcgggtacaattacttttttaaacacttgcaatcacaaacaaagtgattctttctaggatctttttttttttggtgaatcagcactttcttgtttctttgctcgcgcttggtagctgctggagggaattcatcctgggtgctgtagtggtccagtgtgttagactcatagcaaatgctgtaatcaaacatatatcatgctgtccaagtgtccattgaaggctttgcattttgtttctaagtgaacgttttcctcaattcagtgctactgtggtatgataaaagaaatctagaaagaatctatttttatggaagaagttttagtaaaaaatatttccgctcttatactcatcacttgacattttcaggacaaagttggctcatggaatgctctctggcaaatactctgtgccaaatcaggaggtaagaatttgtttgtatatttgcctgttgttacgctttgtgttgttggtagttacctacttaccttagcaattttgtttgtttcagtaatggttcaatcttcgagtagactgctttcttgttttattttggatatgtgcacaaattacagcttcttaattctctgacaaat

SEQ ID NO: 60217 - DNA, 37295 bp, Oryza sativa
ggacccagctagagatcagcaatcagtgggggtgggttggtgaagtgggtgggagtgggtttttggtttttggttggtttggtgtgggaatggccgaattggaattgccgctggagaagtttgatgaatctttgccgttcagggggtgacgcagcgggtcgtggaatcgtcatacttttctccgctccgtctcacgtctctaattgttcagtgcgcgtgcgctacatacaagacggtgcgcacggtacaggggttggatgaaacaagcgaaaatctcttgtccgttcctcgttgaaataagcttttttaagtacacaatgcaatcgcaaaaatatcgttcgttttattaaaaaaaaccgtgattctaagtactacgtagacccttttctaccatcggaaactaatagtgtaagggtatgatgaacatattggcgaagccaggattttacaaattggggtgccaaccaggagatgtgagaactgactttagctcaggtggacattggtggcatcatgtcatggcaattagaataagaatcaaaatctacaagttacgattcgcattagcatcttgacagctcggctcctactgagagtggcagctcgtactcacccagatgccctcgttcagactaatatatctaattgcgtgtataaatttgatatgcccaaacactcctctataattgtttgtactaatatatgcataaaatgatggttgatatagttttgaatgtatttcaacacattctttgtttatgtttatatgtctccgtatggataacaaaatataaaaagcagtttattacataacaccaattcaattgagtaattcatatataagattacatccattcatctagccaccacattgcttagttaattatggaccaaataatgtaaaacctgttagccagggtggctagctatctggtttgtttgcgtctatcaactcttagactgtcaattggtcgacatctacgcttatcatttctccctctactattgctgacgccaccaacgcccatgtgaacaccgaagaaggagaaagcgatggcttagcatgtagggcgccgcactgccggagttggtgtcgtggttggggaaaagggataaatgaagggaggaggaggagaagagaagacgctagtatgtaggacatatgtctcttttttattttatttagtgatggggctaccacgtggacaccacgtcagcaaatactgccaatactgctctgagagtctttttaaccggtgtcaagaattggagttgttattatatccggttttgtggttgagggatactcactcctttccaaatttatcatcatataatggaatccaaaatttctcaaattgatcatcatataatcacatggacacgaatttcatcggaataatgcatcatgggagaatgtgtgcatgctaaggtgtaattagtatggtgttttaatcgatacatgtattgcgggagaatatgtgcatgatgtattaattgatgcgatttaaattatctttggtcttgatgtataaacttatatgatgatcattttggatggagggagtatagaagtatgaattagatggacatatatttgagagagttaaagtggactttattctccctgacgcttcggcacgaattacctacaatgggctgtgacgtgctagcctgggtcggcccaagtcccacctctggcttacgcaatgctccctccctagtccgatgtccgatctcccctcggcctcggcctcccgtctcctcggctcctcgcccacttcgtccgccgcctgcgctgcgccgagacgccgccgatccccatcccgcgagcggcggggccggcctccatcccgtgaccgcgagcaggagcgccggcgcggggcacgtgctgctgcttccaccaatatcatcgccggtgagggcacccggtacggaaatcctcttcctcatttatctctacccacacgctctctctttgcccttaaccttggcttctcttgtagatctggaagcctttttctctttgccctaaccaatagaagttcgtttccaaatcaagattttgggggttcaagtaaacccccatgcccaacgtaaggtccgcccctaaattaccatgaccgcatattttcactgttttgcatttgtacctatagcctgtggttttctatttacattactttcttttttttacaaatttgcagaacttgttaagccataggctctggttccatatgagagaagatccatatgctcttttgagatagtttggaaaatggcatcaaagaaagtataagtgggttatgtcaagaaggcctgtgattttctagaatcaatttggtgagccgaatgatggagtgcaacaaagaagaggccctcaaggccagggatattgctgcaaagaagatggaaagcaaagactttgttggtgccaaaaggatcgcgcttaaagctcaaaggatttttccagagcttgagaacatatcccagatgttaactgtctgtgaagtacattgtgcggcagaagcaaagatgaatggactattggacttctatggagttctccaagtggatgtaatggcggatgaagcaaccattaaaaagcaattccgcaagcttgctttttcgcttcaccctgataaaaacggtttcgctggcgctgaagctgctttcaaattagttgcagaagctcagtcaacattgtctgatcgaacaaaacggcgtgcatatgacatcaaatggagaattgcatcaaagcaggctacgcaaccaaagcagggtgcccaaccagcgcaggctgcccaaccaaaacagtgtacacaaccaccgctggctacaaaacgaaatcagagtgcacaaccaacgcataatacacagcagagtgcacagccaaagcagagtacacaaccgatgcaggctactcaaccgaagcatgctactgaaccaatggagaaaacagatgcaaatagagctagtaatgctaaggaaggatatggatcatcagttcgaccacccagtgctggagaagcattctggacaatgtgtgttaactgtaaaactaaatatcagtactactccaatgttctgaatcataaactccgttgtcagaactgcaaaaaagattttcgagcagttatgctaaatgaacaggatgtgccttctgtattctcatcaagtgcagccaaaagtgcaggacaacattgtgacgttcccaaacaagaggactgttctacgaagttctcttctgcagcgaatagagatgcaaagcccatggtgaatggaggacaacatgatgaacaaatgaaaaacagtgccagtgtcagagcaggtggtgaggggacagttaaccatacagagtcaatcagaaaagggggacttgaattttcaacactgcatgtatcttctgcagcaaatgttggtagtaaggcagggggaaagatgacatcgtgccctactccagatgttgctggtagacaaaaccctggtaatagggtaaatacatcagcagagacaggtgtgatgaatattcctaatccacggagatcggctaggaggaaggaaaatgctgatgccagcatcatccaggatacgcctagcaaaaagaggcgaaccatattagattggttttcaaatcctgactcaagtcgtaagaaagtggctgatgataatgttgtccgtgctgatggacaagcttgtgaacctcatgtctccagcgaagcacacaaccaccagaaaggaactactagcaatgaaggaaaccaggaaaaaaggaaagatgttgcacatgatacaaatgctcagaagaaatctggcattcctgggaacttttcctatcctgacccagaattttttgacttcgataggtgcagggatgttagtatgtttgcagttgatcagatctgggcactttatgatgaccgtgatggcatgccacgatattatgctcgtataagacgcattgatacaaccaacttcagagttcagttcacttggctggagcatgatgcaaagaatgaggaagaggacaaatggactgatgaagaattgcctgtggcttgtgggaactttttcttaggaaaaacagtggtgtcacaagatgccctcatgttttctcatattgtgtcatgggtgaaaggtagaaaaaggagctcatacgaaatatatcctaggaagggtgaggtatgggctctatataagggttggagtatgcagtggagctcagatgcagataagcatagagcctatgagtatgaagctgtggagatcttgtcaaatttcacagtggaagctggtgctgctgttggccctttggtaaagattaaaggttttgtgagtctctttgcaaaagtaaaggagaaaccatcattcgttataccaccaagcgaaatgctacggttctctcacagtatcccattttttagaacaaagggagatgagaaggtaggtgttgctggtgggtttcttgaactagatactgcatcacttcctagtaacttggacgtagcctttccatcggttactcttgattcttgcatgcctgtctgcaagacaatgaacagtggatttaatgatttcactggatatgagcaaggtgcgctgaaagaaaatttgatgaacgaaggtaaacgtaaagatcattcccttgaacgaaccccagtgcatcaacagagtgctgcctattcctcccccagtacttttgattacccaaactctgaatttcataactttgaagaatatcgatcatatagtaagtttgaacgtggccagatatgggctctttacagtgatcttgatcaatttccaaagtactatggttgggtgaccaaagttgatacagatccgttcagagtgcatttgacttggctcgaagtctgccctcagctggagcaggagaatatgtggttagagcagaatattcctgtgagctgtgggacttttaaaatccgcaactggaggataaagttagacacgaatgatgctttctctcatttagtagaaactagccaagttggttggaaacgatactttgaaattcatccacaagtaggggaaatttgggccatctacaataattgggcacctggttgggttccttccagcaaggatactttcgagtacacaattggtgaaattactgactgcactgaagctagcacaaaagtcttacttttgacccgagtagatggctacagagctgtgttcaagcctgacagtgtaaggggcactctggagatacctacaaatgaaaacataaggttttctcacctgataccttctttccggctgacaaaagaaaacggtggcaaactctgtggcttttatgagctggatccagcttctgttcctgatactttcctgttccggagcggccgctgattggcaaatgttgatgctgactgtcctggagatagtaaggatctggtctcttgtatgctcttctagtagggtgttcatacaccacgcagctgtggtgcaaaccaaaccatgctatcttttctaatgttgaggcctctgtgctcattcagttagttattaggttaaaattgcatgttgcattggcatttggcatgtgatgcagtgattatctggttgtcaatttctcttgaggcgttgccctgagagcaaatgggaaatgtcatgcatactgcaatttttctggagccaagcttcttttctggccagtggtgtcatgggcctgtgctcaaagaagtattgcaacctgtaacatataggttgcttcttgctgtgctttaatatatttgtgccctttcatttggtaggatgcttctgtgttgtgttcatgctatgtctttctagatacaatattgctaatgtgatggtcaatggttatatgattggaaaacaataatgcaaccttagggcttaggtagaaaaagataggggaatcctttttttgagggctgaggtgaatgagatggttttgtctatctgtttggttaaaggaatgggatgacccggatcctggaggcccaatatggtagtatttgcttggggggattagatgggacatgaactagaaaatactagctctaactgactaggctagagaaaaaaattggaaaagtatgtactaaagtgatttagttatcattaattaaccaacttaatttcattagtactattgatgatgtgctaatattccttgttgataattatcatgtacttcctccgtttcacaatgtaagtcattctagcattttccacattcatatctagatttattaacatcaatatgaatgtggaaaatactagaatgacttacattgtgaaacggagggagtagtatataaacaaaccttgcactaatagtaggctagtagctgcttccatgtgatcgccaacagcaaataaacctgacagaggatgagaaccatggatgactgagaatggaacagctggttcatgatgatgcagaggagaatggcatgtgtcttttccaattggcttgcttcgatccttcaatcatttccttggtattcatatgaacacagggactgccagatgatgctaaggtccatgtggaggcacccttttttttcagcagttcctttttggtgttacaaataacaactcatcctgtttgctcctctgtaatgcaggtctcccaagaccagggagtcttgacacagatgctgagatggagagaagagtttagaaccaacacatgccaagcaattagctaaaagatttggtgattatacaagcctgaattttcgcaggtgccgtttactgatgtgatatatggtgttgaaataaattttactgtttctagccatctttcttctactttattagtaactgtaaaattaaattctttttataagcttttttgtgtttttatgcacacgtcatttcttggacagagaaggccgtggctacaaaatggctgttactgtagattcttcgtcacattttgctaggatgagaagtgaggtgttctggaattctttgggcacagttttttggaagataggactcgtgtctacatgatatgcaatattctgctgacatggatgaggagagaaatttcatgcacaagatatggtcaaattgtatcaatctgttgtatggtatatagtttcgaacggtcttcatttcggctacagggaccaaagaaaaatgtttctgtccaaagattgaattttttttttggttaaatgattctggagttggaaaatgtttgtatacgagtattggtgatgatggaggcggaggcgtactccagccgtttttgttagttactcatccgtttcacaatataagtcattttagcatttcccacattcatattgatgttaatgacttacattgtgaaacggaggaagtatatattaacccttgtttggatgactggttctgcaacctttgtggttctgttgatgatggttttagcaaggaatggtccgtactgaaagttttgtactgattgtaaatttcactcggttgaattcacttccagtgttcaatttcagtgaaacataatggcattgttcacttttcagggttgaatggcattgcactataagaaatcaagcagagtaattttttagccacaatctgtagggaaaatctgatagtactgatgcacgtgcaggacaacatcaattcagaccatcatagaataagtgtataatataaaaaaaaatcagaccatcgcataaattcagagcattgctatatcttgttgcatcattgaacataagtattgatctatttcatatctaagttcatgtctcaaagttggacttgtagttttcctactccttgtcattggtccagaattaccaggtgatccaatttgttcatgtcctaaagtaggacttgcaactgctctactcctcatcattggtccagaactaggtagtgaagtagttggtggactgcagggtggcagttttagcccttcctgatgcaaccgaagttccagaaacttcaattattatatacatttaaaatcaaagtcctcttttacataaaggttgaataaaattttttaactaagcaggaaataaatataacacataaaatcttacaaactcacatgtaaaagtgttaaaacttagataaaaaaaaaggaagcaacaccatatacaagtacaacatattctattatatactaaaaatccattagactttttacaaatgctctcaagctgccacgtgacattctacaaacgctctcatgatgccatgtggcgctctaataaattagagaaaatataagaaattctggaaaaaaaaatctagccattgatttatgcgcaaacatatggagccattatttttagccattagattagatttgttaaaatctctctctcctaaaaaccggctaatgtaacaaatctaatctaatctaatggctaaaaggaaagaaaaaaatctgtccgtacgaatctacggtccattattcatatgttaatgggtatatacggaggcgacgagactgtcacgaaccaacgagtcggatcggaattatctcctgtagtgaacaaaaaacaaccaccaaaacacaaattaagtctagcacccagcagtccagcacgtgattagtgtacgtttgatcagttggatagttgagaagagtattagaatgatatatatattgacacatctaaatatctcgaataaatgatagatatatactaaatatttattaccgtataattttgattagttgtctatataacataatcgtttaatggaaccctacattctgtattttacaatacaactacgtaggacccggccgtctggtagttttctctttccttcgatctctaagttatttttcaaactgtgcatatgtaccaaaagtactcctacgaggtcgagaagaagccacaccacggcggcgcctcacgttatccattgctctgctttcttaccgtcgatctatctattatatactaaaagtccattaaacatactataaacgctcctaaactgccatatggcactatataaacgctcttagtccgccatgtgacaggaaacattcaaactctctattttcatttaaatcggtgaacccattattttagaccattagattagatcttttaaaaatccaccactcctaatcttcttccgtgtatgtactaggttgtatacaacgacgaaaaaaaaaacctccctcctaatctactgcacgtgcaggtatgacacaattatgtgtgtgtgaacttctctttttgaacaatttttatgcacgagaagttttgtaggagttggtcttagcaagatggacaagcctagctaccttctgaatatcttctgaatatctgatacatataacaatttagcacgacacacaatccatacattaatttgtacaccaattgaaaagcatccatccatatgtccatacgtgtatgtacgacgacaagaaaaatacgtgcaaattgttcgccggataaaagccgaaaaaatgcatacatacgtaggacacaccattctcccaaaaaaacatacataatacctacatatacaagatcgggcaaaaaatcaattctcccctctcgatactcagattaaatgttgttatgttcgtatgcttatgatctgtccgcctaaacttacatacgtagtacaagctattcgctgaaaaaaaacatacatgctacctagggatgtaatattgcacgggaaaaaatttaaaaaagttcagatataatacaagaaagaaatattgaaacccactaacccctgtgttagtgagagattgttactcaagcaaatgtttttttcacatggttcttagaagtgttagccggtctcacatgttagagagacattcaagtttaattttaattgtactaccctattaattggtaggaatagcttaagaatatctacagatagatttggacataagatagagaattatgtgtgaagtgttcgtgattattttattgtattacttatgtgttagactctttttatggtactaatacaattccatttatgaaaagggacccaactttcaagacaataataatctgtagtggtgataggtgagtttatatctaagcatggactaagagatttttgtttgaaatttgagagacattataatttagtatatcaaagtatatgatctatttcacggcatgagtattttttcttctattttagttaccattataagaaaatttaccatctcttatggtgaatttataagatgaatatggtaagataatactacttttagtattctcattattattaaaaaataaaatgcccacgcatcaccgcgggcttccttccttgttgcagttaaaatgaaataaaattgcacattgtatttgtatagcattgcaatttaggattagctatgtgccattttaggtgactggaaacttaaaattttcaggtgcatccaacaattagctattcatatactccatccgtcccataatatagcaacctaggaccggatgagacattttataggacaacgaatctagacagatgcataggttactatattatgggacggagggagtacgtagattttcttatagccctgttatatagctcacgtttatgtagacgggctactggttccattaacaatagtctgcaagcttacaaaatcaataaggaattagatgatgcctcacgttttactgcgggatatatgttagatattggagaaatgatgaaattatttggattgaaatattatgaaatgatttgtgaatgatgatttatcatgtgtagcatgaataaattgtagatataattactatatatttgtatgttgagctttgtgtgttcattgggttgatgtgacatgcttgtatgtagattttagaaatctatgctgagttttaggtatttagtggcattaactttttagaaagaagggttttctgagttgataggaacaaaaccctggtttctgttgttcaatttatttcattttacttgtgatgctcctgggacagaacaacgggagaccacactgaagcatatatactgtatcatttagggagcctgcaaattattcactgactcaaaatcgagattttgggatggaagtagtattattctgtctgttttacaatttctgttatttcctttcaagaaagaagctggtctatgcgtggcagaataaggagaatggagtactcctgaacacgtgttgacagagaaacacaaatcacttgcgcctgaacacatgcggtgaacagagacatttgcctgaattgacaatggaagatgaacgatacatctgcaggctgcatcctctacacataaatacataataatgtacccaggcaagagtacagcaaaaaactaaaacatccagtagagggtgtgccgcctttatcttttcattggtcatctttgtcaagattgtcaagattaacatatataactattatgctttggttctgatcgtttaagccgacaatccataaaaaaatgaatgaagcaagataacaatttatggtaaaactttttcatatatgtgttgttaatgatttaaaagccaatagtgaaaaatatactacgttgacaagactacaaaattaactccaaaattaagtttcaaaattcaaaatttggcagtggcaaataagctaagaagctaataaatcaggattgaaaatttgtgtaatattcagttttgtcccacatggtcttaggtttattgcgcattgctgaattttgttcgttctttttcttgatagttattccctttttctaatgatagagaatatatgatggattggctctgaggtccttctaccggaagaaaatacttcattgaagcttatattggttaacaggtgctacaaaaacagtagttatatgcacgtcttactgtgtttgaaaacaaaatcaaaattaaggccttactccctccgttttttaatagatgacgccgttgactttttctcacatgtttgaccattcgtcttattcaaaaaatttatgcaaatatataagatataaatcacacttaaagtactatgagtgataaaacaactcataacaaaataaattataattatataaattttttgaataggacgaatggtcaaacatgtgagaaaaattcaacggcgtcatctattaaaaaacggaggttgtattttgtaacagaataagttcactttaggtcctttatgagcttgaattgcatcattgaaccgcaataccaaatataatatgtcccttatctttcaaaaccaatataactacggttctaaaagcagtattgaaggttattttggctaacatgacattgatgtagcaccagaagcaaaaattaaaaagaaaaacatatgagacccacatgaaagtgaaacaacatcttcttccttcttatctatctatcggatgcgattgcaagatggacagcaaggaggaggtgaacagggagcattggtgggggagagtacaatgcgaaggacagacgcaacggggacattggggaggagcgccacgaggagaagcggtgggagtggaggaggagcgagaacgggggagggtggccatgtccaagcacgaccgcgggtcactcgttgatgctggtggtggcggttgagcagcgcggtgatatcatgctccatggacctccctgctctcctcgccgagctcgtgcttccctcgtcgcattgttgatgacgattactcctagcttccctctctctcctttatccccctatcaccctctttgttctctcctatcttcccaacgtcgctgcccttctccctaccgaccaccggccatccttctccctattgggcgcacgcttggaggcctggatagagatagggaagaaagtggagggggggggaagactgggccactaacatattgggcctagccagtgcctcaacccgtatcgccgctccctactactgcctcaacccgtatggctgctccctaatcttcatgcgggccctcactcttcgcgccgtacatgtgactggggctcatccccggtcaatggcgtcctttgggcaaggtcgacacagaccctcggtgtgtgttgtagtccgcgacaagggagtgggaggaggagccgcgatgatggggagggtacgccaagacatgtcgaggggctctcttttatgccctgcaagtcggtactgctcgattctgcacgaccaagctggattaactacttcggtaggtggctacgatgatggctgtcacgtgggataggcggggaggaggtaggccttgtccaccactccactccacgctctccaatcctagatcccaatccaccatgctccaaacccttgttggcgccgcgaccatggcgcaaccgcgacgcaatgaggaggatgtgctcgtgggcttcaccgttgacgagatactgcgacggaccgagggacagatggacgctaggatgctggactccaacattggcatgatctctatggtcgtgcactacttcgtcctgctaccgcttgttgacactagcctcctcacctatgcattgaaagcgagccgtggcagcttcaaccgcatcagcagcctccccgatgtgcacttgcatgacatcgtgtcccacctccccgccaaggactcgcccctaacaaaggttaggtgagctcgccggctgccttccccaccgcccgcctttcgccctcaccttcgatccccacccctcactgggcatcgtggtccacacgtaggcgggcacaccaccccccatgttaggtcgctcctcaactgcactatccatcagctctccaagctgcacctgcgcgctgcttgctcctctcgagagttggagagaaaaggggataagagatggagaagaaagggggaggagtagagtgaggatgacacgtggggctcattttttccccacgtaaacgtctagtcataaaaaaaacagccatctatactgccggaggatctgattttaacgattttaataagttagggggtgaagatttctcgtattgcggtttagagttgccgattaaactcgacggaaagaggaggacgcaatgtggactagttccttcctcttgtaacagaagggtacttacgtggcagcccaatagccaccacgaccctccgattttacggtcggcccagcccattactgagcggaaccacgcgcagccgccagctaaaaccctagctcatctccctccaacgcctccttcctctttcctcctcctcccctcctcggcccttccttcccttcttccctcggcggcggcggcggcggctagcaatcgcgaggaggagaagatggtgaagaagagcaagaagagcaagagcaagcgcgtgacgctgcggcagaagcacaaggtgctccgcaaggtgaaggagcaccaccgcaagaagcgcaaggaggccaagaaggaagggaagagccacaggaagaaggtcgagaaggaccccgggatccccaacgagtggcccttcaaggagcaggagctcaaggccctcgaggcccgccgcgcgcaggcgctccaggagctcgagctcaagaaggaggcgcgcaaggaaagggtgagccgggcaccgcctttctccctctttgtctttctttctatccttgctgctgctaaagttgttttgccagggtcgatttctctggtttcctttcgattggcgattctagtcgttgaatgaaattcttggattagatgttttaactgaacgggtaactgttactgtaagcaaggtgtttttgggggtagatttcatgccatatgtcattgtctggggcgctaatttttattcctgtaaaaaaaaaacgatgattgtgaaattttgggacatctgttcagaagtgtgttgaatgcacatatgaatggcactgaactttatgagatttcattagaatgttgtatgcaaacactacacattcagtgccttaacatggacttgtgtgagtaacacatacctgcactgggaagagaggattaaatatttctgcaccttatttagtttcatttgtattatacatcttgcttgtactgtttgaccaatggtagaatattgtgaccacttctgttcaggctaggaagagaaagcttggattgcttgaggacgaggacattgctaatttggcctctgcagcttctgctcagggcagcgagtttgcagagaaggatgcagcaaaggagaatgcctctttagacgtggttaagagccaaggtgaggttcaatgttcctacttgtcatgctttgctgacttactgtttgcagttacgttattcctaaatctgctggttgtatctccagatcattcagagagagccttctacaaggagcttgttaaagttattgaagcgtctgatgtcattcttgaggttctcgatgccagagatccactgggcactcgttgcattgacatggaaaagatggtcaggaaggctgatcccagtaaacggattgtgctacttctcaacaagataggtacaattcaagttttctttgagttcggacttcactcgtgttatgtctactttcttgtaacatctcaatttcaattcgtggcatccagatcttgttcccaaggagtcagtagagaaatggcttacgtacctaagagaggaaatgcctactgtcgcatttaagtgcaatacccaagagcagaggacaaaactgggatggaaatcatcaaagattgataaatcaagcaatatcccacaaagcagtgattgtcttggtgctgagaacctgatcaaattactcaagaattattccaggagtcatgaggtaactgatcaacgttcacatgtgtatcataacttcagtgggcagtgtaaatggattgttgttagagtctgcttgttgaaataatctgtagtaattgttaaaattgccatcttagcaaacagtacctttgatacctcacctggcatgaaaatattgaatttccattccgtttgttctgtgtactgctttatgcaaaccatattaacattgatgataacatcaagtagtaataattttctaatctcaagaatggcctaccttaatttgttatatgggcacagttgaatttgttgttccaagtagttctctttcattttgtcatgtttgtacagtggtaccgtcgctagggaattcatgagcttttaattctcattttgcacactctgacctgtagcgatgcatatgagttttttttttcttttctgctttatgttgcccttttagataatttttattatttatatgttacagctcaaactggcaattactgtgggtattgttggtcttcctaatgttggcaagagcagtctgattaacagtttgaagaggtcccgtgtggttaatgttgggtccactccaggagttactagatcaatgcaagaagttcagttagacaagaaggtgaagctgctagattgtcctggtgttgtgatgctgaaatcttccaatagtggtgtatctgtggcccttcgcaactgcaaacgagttgagaagatggaagatccaatcagtcctggtaagtgttgaaaaatagcttgcatcattttggtgctattcagatagttttgctgaaatcttcatttaattagctatatatgtttttattatgtgtatactaatactatctcattcaacaatatgcattaaatgttgctggaagtgcactgtattataacttgttccatttttcttcactttacatcctctcagtaaaggaaattctcgatctatgcccgcacgagaagctgctatccctttacagggttccaacatttacttcagtggacgatttccttcagaaagttgccacactccgggggaaattgaaaaaaggtggtatagtggatgttgaagctgctgcaagaattgtacttcatgactggaatgagggtatggtcgatgattcctcctgtactgatttttctttactcttattccgtttctgagtcatgtgacactgttattttttaggtaaaataccctattttacggtaccacctaaaagggatgctgtagacgactccgatgcagtaattatttcagagactgggaaagaatttaacattgatgaaatttacaaagctgagtcatcatatattggtggtctgaaatcactggaggagttccgtcacattgagattccatctaatgccccaccgcagattgacgaagagatgctagaggtattactatggttttcgtcccattgaaaataatctctattctttatgggtgtgatttgcatgacatttgtgctaggaataggattgccatagttggcatcatcgatgagtcatgacactgcaattagataatgtacttgtcttgtgcttgatataggatggcaagaagcagaatgaacctgcgcaggaaaaccatgatgagtcgatgtccgatgcaaatgagcgtgaaggagccaagacggccagcgcgagcacacagaatgacaagctgtacacagcagagggaatacttgatcctcgcaagaggaaagccgagaagaagaggcgcaaggcaaacaagttcagcgtgctgaccgacatggatgcagactacgatttcaaggtggattatcagatgaaggatgccctggccgaagagggcaacgatggtggagatgaggagcccaaggaagctgaccctatgactggtgtcgatgatgcgtgaactgatggaactcggcagattgagaatacgaagtagatcatataattataatatgatggtggactgccatcccaagttttgtaccctattagttgaatgagagaagataatggacgctgcttgattcacatagccactgagctggaatcagaattttttgcccatatgcatgcaatggttgcaaaattgcaaaccatcttccagcgatcactctattgtttgggctggtggagagccgtgcctatcagtctcgcatgatatctccgcgactgtcctctgttggggctagcgaaaaattcacaggtaatgtttgacatatcctagttacctcttctacattaagtaaataaactcacctaaacttcatttttaagatcaactcatgggtttctcgctcctatcctatgttttttaaatagattctctacttaagtgaactaaatttcactcctaagatcattccatgaatctcttgcgctcggcgtggagtgcagcctaataaataaatgaaacttccttaaatcctagtagagatattttgtattaaacataaagcatcaagttatacttgttgaactatcaaaagttcacaaaataggtttaggtcggccttttcctctattatggtgatcagatctgagccctctatactctccttcctcgctttgttctggattctagggtgttcggtgtaaatttaggacctccacataaattttttaaaaagagagctaatataaaaagtatcaaggggctgaaatataaaattaaatctactcctagagtcacttgtactatgaaaaacttagatcttatatccattgccgtagcctacgtgacgtgacattactgtgaacgccaaaaacttaactaaccacatgcatgaacctcaaagccaatataatccacatgccattttgccgctcaacgtgaggattcaaagcgagagtaaattagatctccactgatcaacgctacaccacgttgaacatgtccaaccaacccacctgaactatagtgcattgggtcgatttattaggggtgagactaatcatggtcaatgtggtcgatcgcccataaccgcgggcacggctattcgaatagttttactctggccagaggtatacgactgtacccagaagacacaatccaccggcatgtcaccgtgtcatcatgcacccatgatgaaaacgtcaccatgtcgagtggttgtgacaagacccttcatataactccctctgaccaatcgcaccacacctcaggtttcacccccacttctcgcaaggcagccgacagttccctctcgtgccacggtgaatccggaagccgatcaaccgaacaccccggccaacccaactccatcacgcccacccttgcctgggaacgtcagttagatgaaagctatacttcaagtcaggcagttacacattcccgcctgtggcaagcgttgtatgtcttccagtgcatcccgtgaactgatctttaattgccatgggtgcgactagcaaaaccatgcatccacagcccaccattcagtcgtattttagttgaataattacggccaatgaaacatggccggatgtctcgagcacacagctcgttctgctactaaaaaggtctaatactgcaattattccatcaactgagctagtggcaattaagcatggctaagcatatagttctagctaggtcacataagtaacatgagctagtcgatttattacccaaggttgacaaatgacatatattaagtaaacatggcacaagcaagcagataggtaaaccctgatcctatgtaattagcaaaacatgcacatttatttgcaaacgataaaacatttatcaattgggatcaacatgctcaagaggaatgtgtgacttgccttgcttcttcacaacaatcttctgaactcttttcctcgcgaccgcgatcttccaaaatgacggattctacacgctggcacgcaaaagaggaaaaaactctaataaacaccaagaaaacagtacataaaaagtaaacaaacaggtagagctcaattttagatgaattttgcaagttgaatgacccaatttgaagttcgtatgaattagatatgaattttagaagttttgagccatttaaataaatttctataattattaatgatttattgcgcaattattaatggattatgacgtcaccaaggggaataggtggcaccgacaagcgggtcccacctatcggtggctcaaagggatgggcgcacggtggactcggtccacgcgcgcgatgccggcgggcgcaccacgtggtggccacgcgggacggggaggacgaggtggtgccgacgtgatgccacaggggcggcgacgccgagcggctcggggagggccacgtggacggcccatatccacccggggtgaatcgggcggccacgggcgagcgggaattggctcaccggccggccggccggccggggggcggcgaccaccggcgcggcggcacagccgggaggtagcagggggaggcgaggggttggaggggagatgcccaccgagcggcggccggcggaaggggcggccggcggcaaggaacaacggcggcggggctcctcgggaagacggcaagacggagctccggcgacgggcggcactcgggaaggggcggacgggctcggcctcgatctaaggaagataaaggaggggttagggaggtgaaagggcgaccggagcggctagaaacaacggccggcggcgacaacacgagttggagctcaccttgggctgaggaagcggggttccagcgacctttggcgaatgaaaaggggcggccgggctgcacacgattgctgcggtgctgaggaaggcgagacgcagcacggggtggaccgggacggcggcgagaggtgactggaggcggctgctatggtggcggttcgggtggtgtggtggcggtggggtttcggtggcggattaggggagtggagcggcggacggcgtgcagctcggagtggcgaagctagcggtggcggcgacgcagtgcggaggtggctagagcggtggtgaggggcggctggagatcgccggggagcagcggcgcacaggagcagcgtggggagagcaatggagggcacggcgggctcgggtaaatgggggaaacgagcgaggggagtgcggggaggagttttatagcgctcgggggcgacggggaggccggggcgaggtggatttggggcggcaaccaccggcggcgtgggtggcatcgtgggggagttggcggccggtttttgcgagcgcgagagggggagaagagcggggacgtgggcggcgaggtcccacggacgagcgtgcgcgcggggggtggaggaggtgggcggggtggcgcggaaaaggcggcggggcgtgggatggtttcggcggccatggcaattgctgtggggtggctggaggtaggagatgacaggtagggtccatgggtcccacctgtcggggagagagggagagagagttggaagggggaggcagaacagacttgagggagagagagagccgagcgggccgagggaggggaggacttgggccgagcccgaaaaggaggaagggggagttatatttgtttcctttttattttaattgataaaatgaactttgtattgttaaaattatttcttgagctccgaaaattcacaggaaattccaaagagttcattaaggcacagataatattacaaaatattctcggccaatgattttttaaaggaaattttaatttcctctattatttcacttgattaatttgctttcaattttatttaatttctagaaatgctttatttaatgatttttaatcccgaacgaaaaccggggcgttacaatggaggacaagtattgccacggtaggtggtcgcatctggctcaggcgaccaacggagagtattatccaattaaaggattacacttctttatctactaactccagacttgctgttttacaccgtttatgtttaacgtttgaccgtccatcttatttgaatttttttatgattagtatttttattgtcattagatgataaaacataagcaatattttatgtgtgactatttttttaattttttcataaatttttcaaataagacggacaatcaaacgttggacaaaaacccacgactacacttaaattgggacgaaggttatagttgtgaaggtctgtttagagaaccagtttcttcgggatgcactcattaataggcctgtttgagacagctgaattgatggatggatggattatctgatttcttcgtagcaatttgagggtataaacaaataaattaactactacaaaattggaaaaaagttgctttcaaagagtagtccagaaagttttatagaaaattttgctcgatatccatcgtctagaagcttgggaaacgttcaaatgaaaatccaaaatccaaaatcctaaaaaaaagaaacaaagctaagttgtgcctaaactgttttttacaggtgtgttcgttaaggattatatagatatgcaatactataatagaaacagttcaattctcactagaaatttccagctgttctcatttctgacctctctcactagcaagttatcagcagtgcaaacgtgcaataccacaaaaaggacccaaaaaggattgtcgatctacataaccttgtaatcgtaagatcttaagcatggtaaatgtagcaccaaaatgttgcctggctagtcttcccagggacacgccagttggaggaaaaacttccaattggtgacatcatagaacaataagtgcatccactagaaagaacacatcgtatgctcttaaacacatcaaagtgatggatgagtaactaaattagaacaagaaaacgattgtcccctgcaaaaggcttgaaccatacaatctaaaatagtgtcttttccaagtaataagtcgagtttggtggtccaaacgtagacaattaaatcccagtaggttcatcctttaacaaaatatcagaaacagctttgttgctaccaggtaacttccgatttccccttcccgaaagcacagaccttttatatacacatgacacatgtacaggtagtttgcttgcaatcagatgagactttattgaggtgctgttaactgctgagatccttgttggggaatcggtttgttatcaacctctatctcgcgaaggccctcaacaggttgcctgcatattgggcatttgttggtctgatattttaaaacttgagcacactccctgcacaggcactgcaaaaatggcacatgctatctttaattgattttcataaaactgaactgatcagcaaaattaaaggatataatcgttatttctctatcatcatccctagctacttaacatggtgcaatctattcacgaagttcttaccatggcataaaaaatgaaatagcacaaatgcatagctgctgagaaaaagaacagaagggtaaatatttgggcacaaaatgctacagccattcagaagtacataaacttattgtcattgcttcaataatcagtacagtgccaggggggttgcaagtgctaatacctaatagtggagcagtggatgttactgcatatcagacctttgatgtgctttaagaaaggtctgtctttcactttctggaagagagtaaagcactagcaattttttttcttacgtttaatataagccatgaactttggcatagaaaactaggaaagaagttaagagaaaatggcaagatagttggcatactcactgaaagaaaaaatgggttttaatctaaatatctatgcccgctaagcaggttccttaatatgctggacagtgactgcctttatttattattaaagtgggatttgacgaatatcctactcctttatcttagcggttcaactatccctcttccagcctccaatggcacactccaaaccatatagcagtagacacaatccaaaccttttcatattctcttccagtttaaagcaaatcaaagatggaaaatgcccgaagaatgcaacttcaaaattatctgataagttgaaagaatgctaggagaaaatccataactattttttttccaactctatctccataataatatatgtatgcttaaacagataagtcttatggcaaaatcgtgattctttcaagaatacttagtaagaaagtaacttaccatatgcctgcatggaagaacagcagtatctcttggttcagaaaggcaaaccacacattctttcccggaatcatcctcatgagcattcttatcagctgtgttcccaataccatatatttcctgcaagacatatctgattccatttacccaaaggatctgctgcacaacatgaactccatattcagcattgtctttcttcacaaatatagcatatttaacaagatatttcgattgttcggtctcatgtgccccttctgattcttggttgcctgacacatccatttgtactttgaatgctacagggaatacaccaccttccccaacattagttagctcagattcctcaaaacgagagacatcgattcccgacccacttggttgcttgaactcctgacctcgaccttccttaaaaggcacggtcacaggttgaagcaaattttcctttgcggtcttcaaggcacacttatcttcttgtgcaaagaagcagacagttatgctgtttgcatgatgaataggtcttttagttaaacataacacatgacaatcttacaaaaaaaaaaaagaagtgatgacaacaaggaaagccagtaaacgttcaattctttaaaaaggttcaaggagatagccatactaattgtgaaggtcccagaaaattggaaatttggaaacagtacaactctattttcaaacaataaattaataaatcaaagagcatctaagtttgagctttctgcaaaaaagaaaggctattctgaaaaaaatgatgcacatatataaaatactaccaaattggagaagtctgcaattggaaatacacctaaggatgatatcatcctaatcaaggtatagaaggtttcctttcaatgtttatcatggattggaattccacaaaacatggaacaagagacatatgaagttgtgatcagttcagtttcaaattgtaaatctagtatgacctggtctgcataaggcataacttttgaaaacagagttacactcaatatgcgcaacacaaactggattggttacaactcctaatgtctcatcttctgtttgttagttccattcaatctgccagaagagtgaacaggagatttcttttaaacctttcagaatacatgggttaggtggagaataccaatacgtgcccaaataaccacatactccttaagtttagatatcttgcacatcaggacagacaatatatgcagaatgaatccaataagccatgattttttttggcggatattaaatgctctagatcacacattgttccatcagttgaaagtagaaatgaataactcgatactcttttcaagtacacaagtcattttatgatagaccttcataattggtatggatctttatgagttctgcagccacaacttcacgagtgctatcttaccatgtcttaatctttgttgggaagatgaaagatgtgccaaggataaaatactattaagcatggaacattttgagggcgtaaaaatagcttaaacatcagaagagactgaaccatgtaggattagtaacagaagtcacaggaattaggagaatctcaactaatatgatttggcaatggtgacaatagaaatgagagtagcaggaatttggagaatctcaattactataacatggcaatggtgacaataaaatgaaagtagacatccaaaatcattaagataaatcaagctctgattctgacaagtctggagtacggtgagtcccatgtcactacctaaacaaatctaattcttagtaagaattatagattgattcttgctactttcttcaacttcatttttcacactcaataccaagttatgtgaacgattttattttacatttctagtatatatatattcaagtaagaaacatttgctttagcaagaagaatcaagcagtatgcatctgatctggtactaagtttaattgaattctacattgaagcattcttacatttggacaggtaatcacgacattatgccaaacacaagatgggccaattttgtaccccaaaaaaaaaagagaagaagaaagcagtacacaatcgaaagcatcacgattgcaacaacatttgtttgtgctgagctctctggcagaaattttagtaatgtagtataccaatgttactacgatctaaagatcctaaatcaaagctatagcaacgaaattaccacagcgtctaatcaagaaacccacttagcccggtataaataggtgagaggggaaaaagaagaaggagcgggaccttccggggccatcggcgtcgaaggagaaggcgaggagtaggctgcggccatcgtcgtcgtcgtcgtcgggcaccagccgcagggtgtcccccttgacgttgacgccgacgctgaccgccacggccctgtgccgctccacgtgcgcaggcaccggcaccggcggcggcgcggcggcgccggggggcggacgagggtagctgtggtagtacgggggcggcaccccgtgtctataggcttcgagatgcggcggcggcggacgtgggctagcgccgccgctgctcgcgatgttgcccattgggaagccctcgcctctggagtctggaagtctgggtggaagtctgacctcggcgcccgttgctacgctgctttagcccgttccgctttttgttttttttttgttctttttttttctctcgtagctgaaacagttgaacaggcttttatttttgtcatagttgaacgataagtagggtttccaaaccgccggggccggggttactgtgccccggcggtaagcacggttaccgcgcggtaaccgtgaaaaaccgtacaaaaccatgtaaaatttataaaaaattcaaattatttttaaaatttatttgaatttaaggaggttaccgcggtatttatattaccgtacctccgcggtaagctcggtaactgcggtaaccgcgcggttaccggcggtaagggaaaccctggttacaactcttgcaaacagacctacctaaaacataaacaaagacaataaaataataatttacatttaaaacttttataattgtgtttattattaaatttgagttacaatgaggccctaatacttaaacccttttacgtacatgggacatgtgaactgatatgtctcatgtgcgacttctctttacggttacgcttatagaatacatatgatggtattcagttcgtcagttttttttattgagttcagctcatcgctactttttttctcagcatagtagtgcaagagttacttgaaaacttctaccaaactcttgctaagattagtaagggcctttacaatgcggtgagctgttattcagttcggtcttttcacgtcagagattcggtgtcaatctttgccacgtttgtgggcaggcctaccaaattaaagcccgcatgatcttctttgatcacctgttcttggcgaggggagataaggctacagacgcgttaggagggcgaggcttcgttccactttttctacatgcaccatggacctttgtggcttttctaggtcttaaatcttgatggcctcttgcgccaatcctatacgtgacctgtattgtaaaggccctaacaatgcagatacatggtgtttggcctcgcagtgaacacgtaagaaaaacgcgtacacgtctatgtgagtcgaattcccagttggttgtccggcccttcacagggatgacctgcacctcgcctgcgtccaagatcagatgtccacgcgacacgactccacgcccgtattagatgcgtgatctcatcatatgcctttttaactctatgctcatctgaagctatagacattcgcttgccgctatgcgctgtaggaggtgtagccataattatttgctctttgcatatttgacacataaatacacgcatctaagtagcttgcaatgccctaacaagatctcggtcattcgattcaaccagttggtggttatgaaaaatcaagacgccgtcatagtgtgctactttactttttctaaagtgggataaaattaacaatccttttatctttggtggcaaattaataaatataaagctaaggaaattgcttaaaaaaactatcacaaagttttttttataaaaactttcaaatgtaactatatcaaagtaatagtgaaagtaatagtgtaacttagtaactacattgtaattacgcattgttacattttaacgacactgatagtataattacaatgtaacaatattagtaaactatataacttacgtataaaattgtattatgttttaatcctatatatctataaagttcattcccactaaatgtagttaatgctaattctctcttctctcatgaagccacatcatctcaattgtttttagcctttggatgattcatcaagggtgtaaattccttcttttcacattacctcaatttattttagtatttggatgattcatcaagggtgcaaattgcatctctttcccccaaaaggcacaccatacaacccaatcatttataacttttggataattgataaaggtacaaaaatatataaaaacatgaaaaaaattataaagtaggtaggaaagaaaattttagaactcatatctattgtattatcacacaattctcccgcagcaatgcgcggggtatgcatcttgtatatagtatatattttagttgcgctatggttatgatataattatagtactccccccgtttaatattataagtcttttgactttttttagttatttttttacatttgactaaatttatagaaaaaattactaacatttacgatatcaaattagtttcataaaatttaatattaaatatattttgatgcaatgtttattttgtattgaaaatgtttactatattttgttacaagtttgatcaaactttaagcagggcatgtaacctaatggttgcagtgagtagtaccctatggtcctgagtttaaacttttatagcagtgaattttagattgggttgtttgcgaggctaaatttcctatttcaatagccgtatatatccagttagatgtagagacagggtaaaaaaaacccatctctaaaagaaaagaagtttgactaagataaaagtcaaacctcgacaattctagcggcgctgagtgatagcacgcatacagacgcgcatagcaatagcaagctcattttgcgagcccggcatctaccccgtcggatctcatgtgcgttcatcttggcctgcttttcctcttcctccccgtcacaagcggagcgagatttccaccatggctccgcgcgccaccaaatcgcctatcctctagcctcgttattcttctcttccgttttcccgcatcgtgaaaactctgctgtgtgccaaatcactggccccccgctccagattcatccggtgaggcgttatttctgatcgatatgacaactctcaccgagggtaggtgaagccggtagtcaaggaggaatctgtttcgatctggactcattctctgccttttttgctcgtcttctccggtgcttgattcgttgggtttggggtttgattccagcaattcctctctgctgatgcatatgctttctggacggagtccctcttccaattggtttatgattaattgttatttgttgttttggcaatactatgttaagattcttaagtcgattcttattgtcagatcattaagcatagcgtggatattttgggcatgatcagggctaagatagagtgaagcttttatgatttttgtgatgttcgagcatccggacagcatgtacatctacggacagtgctcgttggtgaaaaattcagacgacgagaggacaaagactttttatacgtagtactatatggacaaactactcatattcatatcacaccataaaatagccacaagaatagaacacacttttgattaatatgcgtatggaggaattgattatttggttaataagatacaatcaacacaggagcctatctattatgctaattggctttagtattagctgtaaaataaaatagagtttgttatagctggctgactatactattaattaaccatgctctaacgcggcgtgctcgccccgcgaccgctatctcccactaaaatttagcgactgagtcgcatgcaggcctgcaaatttctagcggctttgccacaggcaaatcattacctcttgtactaagagttaattatgttaattacagtacaagaggtagtgactaggttaaaaaaaatcttatatcactactggagaaaccatctttacacggtcggctaaaaaccacaatagtctcggttacaataaaaaccaggactaaagatggtttttagtcccggtttataagcagaacaggactatgtgatatttagtcctggttcacatgctgtcagggttctccgggatctttagtcccaggtctcggtttgtattatcaaccgagactaaagatcaaaacgcactatataatccctaggacttatcatcttctctcgtccacacacaaactcctctctcttttcctctctaatccttatctctttccttagagcatcttcaacagtctctccatcccactctccaagccaaattttagccattttagccaaaaaaaaaaaagctccaatagcctctagccatccggcatccggctggccaaaacccccctccactagccaaatttggccaactagaaatcactggccaaccatgggccccacatagattcctccccccatctccttcggctcttctccacgatggcgcaggcggccacgtccttgacgccgccgccgacgcaagcgccgtgcaccgccgcgagcaccggcttccatgcgccgcctgcatctccacgatggtgtggtggagccccttggccacgggcgctgggccgctgccgcccagtgaggagggagccatggcggggttcttggggatccaagctcgatgcggcgcagaagtgcaggccggcggcggagagcacgacggtgcgcatcacggcgagcgtcttgaacccacgctggagcgccaccattgtcgacgaggtcgccagccgctgtcgccgtcatctgcaccgtcgccagtcgtcgccatccactgtcgtcgtccccgaggttgccgttgccgttgtcgacggggtggcttgacggcgcatgagtccttcggcgtcggccatcagcggcatgacaagggcgacggggcggctcgatggcgagggaggaacgagaaaggctggcgaggagcggatcccgtcgttgcctcatgcacccgtcgtcgtcgtcgtcgtctggcggcctggcgctggccatcgtcgcgtgaaaacggtgtcgtcgtcgccggctccccatccacgcgccccctcgcctcacgccgccgcctcctcatccgctaggtgggttggagatgggagggaatgcggtggcggcgttgctcgacggcgaggttgagggagacgaggcggccggtgagatgggagacgaggcggccggtgagagctcggccaaaggggcaccggcggacggagcccgagcgtcggcggtgagcgaatggggagagtgagatttagagggactgttggagatgctcttactcttagcttatctctttcctcccttcacttcacaggaagagcgagcgtaggaggagggcgggccgggcgggcggcgaccggggaggaggggaggcggcagcggctgagcctgccgtgggcacgagaggagggcgagctggcggatgggagggcggcggcggccggcggccggtagcgccctctcctgcagggacttttgtcctttcttttcttttttttgaagaatttgtgattcattgtatggattgagatgaaggatttgtgattcattgtatggattgagatgtataatttcgtttttgagaatttgtgattcattgcatagatctgagatgtataatctgtgatgtatttgatttgtgatcattgcatagatctgagatgtataatttgtgatgtatttgatttgtggtcattgcatacatatgagatgtataatctatgatatatttgatttgtggtatttgtgatgttactttgatttggggatatgtatcccacttgatttgggagaaaatagttagggattaagtagtaagtagcaacagaaacaatgaaaaaaaaagaaaaggaaactaaccgggactgccgctgccctaagatcgatctttagtcctgggtatttgaaccgggactaaagatagcgatatttagtctcggattcatagtcctggttgaaaaaccaagactacaaggggttacaaaccaggagtaaaaacgatttctccaccaatgtataagaataagcgaaggacatcttaaccgtgaaaaattaatccagtgtaacacaatgtatagcgctgggaattaaaatagccaagatagcaagggtgtgtgtttataaagaaagacgtcgtaatacccgatccactgaaaaaaaacattatttagttatattcgtaaattgaataacaaaaattccaaacttacatgatagaacgaaatgactaacaattacaagatgacaaaatgccttcttccttttcagccaaacaaggaaataaaataaactaaaccactaaatcaatgaacaaaataaacaaatttccgcctgcttgtgtttgcattttccttgaaccacggtcgttagcactctggcatgtttggaggacgaggtagcatctgagcctgcggcgtcttgccatccttcacgatgaacatagtgtccatcccccacaccacgtgacgatcaaaatggcaatgcatgaaccacacacctgatcaatgaacaatcaaaataaacacaaaaagaatatttaaaactgtacatgaagagctataatccgaaattaatctgaataattgatctcacctggattgtctgctcggaagcggattgcggcccagctggacttgggcacggagacagtgttctggaatggtgggtcgatgaggttgtaggtggctgggtccctgcgctcgtcgaaggttccggaccctcgtcccacgacgtagaaggtgaagccgtgcaggtgcatagggtggttctcgatggacaagtcctggaacaccacctccaccacagtgccatattccagcaccttcaccttggtgccacgcttcgttagcaagggcccgccgccgttgatgtcgccggtggggttgacgatgaccgtcagcttgttggggaagttctcctcgtacacgccgcggccggagccgtagtagtaggcgtcgaggacgtcgatagccgggttctggaagctaacattattgaggctcgccgcgaaccggttgccttggggtccctcgcacaatttatttgtcgcattgttagcgtcgcaagggagaaagttgatgtcaatgtcgatgagcatgtgctcgtccacctgctttggtacgtgcaccgggtggtcctggttgcctaatgacctgagctgcttgacgaacgccatcgccgcgtcctcgtccttgatggccggcagcaggacggggaattctggtggcccgaccggcctcgccacggcactgtccgtgtactccacgatggccgtggcggtgctattgttgaaacggatggtatcaaccggtaacgtgataaacgtcctcgcggccatgtaataccggctgttggatcccaaggtgcggttggccttgaggagcacgtccatggtctggcctggcgcgatcatgatgtagtcgacggtgatcggcttggtgtagcgggcgtcgatgccgaccacggtgagacggtgccccgcgatggcgaagaacatgtcgttggtgagccccgcgttgatgaccctaagcaggtacgtgttgccctgctgcacggccaccttgaacgtgtcgtccctggagcagagggggaacatgtccccgggctggccgttgatggtgttcgtgtcggacggctccacgtctccgccgatgcgcttcgccttgtcgagcacgtgctcaacgtcgtcattccaccactcacatgcacaacatcatatcatcataaacgattaaacgatggttcagatcaaaacacgtacttacgaagcattgcatcgcatcgcattgcaggatggaactaacattgttaaacaaaattgattaccgaggatgacgggtatctccttgtctagcttcctgaagaggaaggtggtgccgcgcttggggtggatgacgatggcgccgtggacggttgcgcggtcgaagtcgctgtgagcgtgccaccatagcgtgccttcctcctcgaacaggatcacctggtaggtgaagttgccgcccggccggatcgggcactgtgtgatgaactccggcccgtcagaccacgggttccgaggctggtccacaccgtgcctgcgccacagtaaaatcatccagaacgtacatcgtaagtttaatttcgagccaaggatcgatatataatgctcttcttctctgcagcaggtggggcaacggaccagtggatggtgatgtttttgttgccgttgttgtggacgttgacgatgatgaagtcgcccttgcgcgcgtagatggtcggcccggggaactgcccgttcacggtgaggatgctcttctcgtggcagagcctcgtgtagttggtctccgtaatctgcagatagcatcacgcatggttaaaagttaaaacttcgtgcattcatgctgcctgtacatcaacatatccatcacgctagaattcaagtagataatcacttacgaagaaatcgtagtggcgagtcttggctccatgagcggggttcactgcaagtgctaacaccaggcctgctagtaggaaccaaagcaatgcaggtatcttggctgttcccatctcgccgaacgcatacaattcaatcgccaacccaagcgtaagaacacacacagctaattgagattcgtgtgcgcagtgccgtaagctgctgctttgcctgagctgagatggccatctggccaatgtatttataggaaacgcatgcatgcatgaatatggtagttgtatgtatgcattgcatgctgctgtggcgatggtgtccagcctttggaccagccacggaaactgacgacgacatcttgaagttcaaagtatctctccagtctttcccggacatgcgcatccgtttcctgccctgcgtatttacataatcatcattagatgagttggttaacttaattaattgggcatatggagtagtcgaggttgttaacgaactgactaattaatcaacgcggaacgaaattgaccttgagcagagcaggcactcatccgtgtttcgtcgtaccctgaagcactcgattaaaggtctcactaggcacgtttgcatgcattcggcggctaggaagattgtcgattcgattatcatatattgagtaggtggttgtcgtgatttcgtcgtagcctagcgaggtaagtaattaagcatgcactcgatcaaagtctcaaagggcatggtttgcatgcgttcggtggccaggaagcttcttttttttaaaaaaaaaaaattaaagaaggcccgccaggaagattttgaaatagactatatcaaacacagaggcccttcttttgacacatctctggatcttaaaattgagtattcttaacttcaaaattacatggatgtatatttatgattacgtcaataatgtatggataaatcattgtttacattttaggtgcattttaaaattttaaatcactattgtcgacgtttgatgtcgtcattctggtatttgcatagtatggggatcgtcggtgctaggatatacgcgagactgagataaaagagatggagataaggatttttatataggttcgggcccctgagttgtcaggtaataaccctacatcctgttggtcggagccgatgatgctctttattcaccataatcacacccctacaatatgtagggtagcctatctaactgttgtcgacatggcggtctgaaggtctgactcgtattcgacaacagggtagccttcctcctcgaatccgtgtccggcgagatcagagatagcgctttcgtatctcctgacggtatccggagacaccgtaggggaatagccatgcttatccctgaagtcgatatccggcggcgtgtcttggcgtatgtaggcttgtatgttgattgtgttgggtgttgatgaggtggtcgtcccgatagtggtgatcgtgttgatcgtctcatggtgagtgtgtgtcctcctgtcctcctaggggggcttgtatttatacccataggttcccccttgtccaagtataactagggaaactaatatggatacaatccgagtagtccttgtcgtttccatgtagaactctggttctttcctcatcggaactcctcctatatccgaaggttgtttccgtataggacatggtatgtggtgggtcctgccgagatttagtcaactactattaggtatgtggtatccataaccatgacaactataatttaatatacaaactttaaatttatcgtggttttgagatttgaagttgtgccaaacaagatttaaatatctttctcatatttatttacaagttattggaaggaagttttcaaattgatctagtgcaaaagtgaagatacacaacaatacaaacgcaagattttttttatcaatatatttatgttactataatattatattaaaaaataattcaaattttcaacacgcgtttacacttacactaaaaaatcgtttcttgcacagtgaacaaatcaaaagccctgaaaattaactgtaatccactaaaaatatgtcaacgcaattttagtttttcctcacaaataaacaccgaaatttctatacatctatcgcaagattttttctttagagatcttgcaatttttttgaccattggatttttattgagattcatgctaggaacctcccagaaaaatgcaaacgcacgagagaagggagtcaacctcataacctcaaggtcacacgggttgttttcgtcggatttctcccgagttacagttaccagcacgggctctcgctcactactaggagaacgtttttccctactgtcaaatccgatttttgtgtgcaggtgggcggtccgcacccacccaggggtctgcgaaaattgtaatttttgtgtgcggcaacaaaaatccagaaaaaatgaaaaaaaaaaaatgaaaacctagaattcggcggtggcgccgccgcctcttccttgtcgtcgtcctcctcctcgtcatcctcgtctttggccgaggacgccactcccgtcctcgtcatcgtgggtggcggcctccgcaccgcccgccatcggctccgcgctcccctccggctgcaccgccgctgacgcccctcccctccaccggatctaggaaggggaggggaggggaggggagcgcttgcccgatcccgcgtgggggagagcggccggccgccaaatccgtgctcccgctggcctccgggctccccttcgaccgcaccgccgtcgacgcccctcccctccgccggatctggggagggaaggaagaggaggcgaggggagcc

SEQ ID NO: 60218 - DNA, 52315 bp, Oryza sativa
  unsure (1)..(52315): unsure at all n locations
gatattgtgtcacaattaaaactgtgtgatgatgatgccgtgcgtttgcttcattcgctttcttgtgcaaagtataagattctcaacaaagagcctagcaacagagtgatttctccagaggacgagtttgagttcaattccaaattaccgataggatgcgaaggattaaggtgccatttctaactatttacccattcccccctggtttttcgagctaactaaacgtaattttttttttgtgtgcaggtaccacttcctcaaatcgatgagaagaaaaaggttgtcgatgatgtcaacaaggacaggaggttcgcaattgatgcatctcttgtgcgcatcatgaaaagccgcaaagttctgggccatcagcaacttgtagcggaatgcgtggagcagctcagccgcatgtttaaggtacacggcagaacacatacatgtcgattctgctaacctactttttgaacattctgccaatttgtgtaaagctttcagtcatctgtggtgagaagggagagaaaatccatgttttcttaagacttgtgttgtcagatattgacaatggggatttgttctcactcttgtgcagcctgacatcaagatcatcaagaggaggatcgaggatcttatcagcagggagtacttggagcgtgattcggagaatgcccagacctacaaatacttggcttgatgattggtcctgaggcgacttgctgactgtttgtctgtttactcaccctctggattcctagggcagtgccctgatgttgccaccagtagtctctgtttacttacatccacgcatcagggttgtacactcttttcctgctcaagtgaatgattagaggaaaaacagattaggagaagcagctatggctcggctgtgactgtgaaccacatttacatgtttagctttgacgccctttgctctaccttttgagtttctataatttttgttgattactttcttcttgccgatcattgtgttaaatcgcaactcatcatggagaaagaactttattgcagagtcactggcactttacctgcctagtgcctagcattagcatatgtggtttattaagctcgttattattaaatctaaatacatgtcgatgacacgccctgcattaattgttctgcaggcctaataaacgacctagtactgtataaaataaaataaaaaatgttgggggtaataagcagtttatatctaaactagacgtagtagatcatgccgacttcgataaggctgatgtgcgggatgttgagcacgaggccggggcctctgcaattcttgcggaggaaagcgtaggcgacgttgacggcgaacttcttgaacaccgacgagctcttcctcgccttgatgtacgagtggcccatgatgtaggcgacgccggcgtgcttggcctccaccagcgcgctcagctcctccttcaccctggggtccgtgtgctggttcgccacctcgaaccgcacgcgccgccggctcgcgaaccccggcgactccgcctcgtgcatcgtgtgcatcgagtggatgagcgactccggcttggcggccgcggcggcgcgcgccaccacgctctcctcctcgccgggctcccgcatgaggagccccgtcctggcaaggtcgctgggccgcgggaccacggccatgcggccctccacctccacggaggcgacgaccccatcgtcgctgatgctgcagcgctggtcgaagtcggcctccatctgcacgaactcggcgatccgcagcacgaggtcgttctcgaagtcggtgtcctcggcgagcacgtccttgtagccgtgccgaacgacgcagcggtacatgcggaactcccgcgggccgatgcggccgacgaggtggcgctcctcgtcgcggacgtgcggcaccggcacggccttgacgcagatgaagacgagcacctggtggaacgccggcaggttggtgacgaagtgcgagaagatggccggcacgccggtggccagctcggagtagatgatgccgatccccgggacgcgcacgatgcccaggctggggccgagcgcgtggatccacctgagcgacaccttgttctgcacgtcgaactggtgcttccgccgcgtgccgtagtgccacacgtacatgacggcgacgaacaccagcgacagcaccagcggcagccacccgccctggggcaccttcatcagcgccgccgacaggtacaccgcctcgacgacgccgaacgccaccaggaagagcgccgccaccaggcagctgtactgccagacgaagacgatgacgagcgccatgagcagcgtggtgaccagcatcacccccgcgcacgccatcccgtaggcgttgccgatgagggtggtgtcgcggagccccatggtgacggcgatgcacagcagcatcaggatccagttgatctccgggctgtagatctgcccgtggatccgccgcgacgtgtgcacgatcttcacgcgcgggaagcagcccagcgccgtgcactgccgcacgatggagaaggtcgccgatatcaccgcctggctgcccacgatcgccgccagcgtcgcgatcaccagcaccggccagaagatgcccgctgcaaaatgcgacatttcattcggatcgatgtcgtcgtatcacgattcatgtcacctcaccaccagtgattagcagtagattagaggagtactccacttacttggaatggactcgaagaatacgaagtggatgtcgcagtggggtgatttggacaggaaggccgcctgccccatgtactgcagcaccaagcacgggtagatgagccccacgaacgcaacctgtcaacaagtgtacgtacgtacgtgtcaaacaaatgtcaagatatttaacctgctcttaaaatcaatctgcattatattaaacgagacgcagtactgcactatcagtgctctgacagcaagcataaacagacacatatacccttatggatgcagctgtgaagtggccaagatccgcatacatggcttcggtccctgcacatacatacatatatatattattataaaatatgtagttgatgagtcgcagtgcagcgagcaaaataaggtttgtttgcctgtcatggagaggagaattcccccgagggagatccagccgtccttgccggtgtgctggaagaacctgacgaggtagtaaggggagagggcgcgcagcaccctggggttccacaccacgatgttgtagacgccgagcgccccgaggaggaggagccagacgatgaccaccggcgcgaacaggaacgccaccctgtgcgtgccccagtgctgcaccatgaacaggcacaccagcaccgtgcacgacaggatctccacctccccgctcgtcagcgcggtcgagtgcacttgcagcccagagaaggacgacagcactgcccagccagcagccaggacaaaagatcgatcatcgatcacatcagcaacccaaaccacacaccaagtagtagtagtattacggtacgcgcgctcaccggacatgggcggcgtgaggacgccgtcgccgatgacgagggaggcgccgaagaggacggtgacgaggaggaaggtgcgggacttgcggtggttctcgaggaaccgacggagcgcggtgaggatgggggtcttccttggggggccgtcagntcctgngnngtgccccgtgactaacgcctaatgggccctgggggtggccccccaaaaaagagggggggcgccctcgggggggggcgcccctttttctggggggggggccccaaaaaaacggggggggtccccccccttaacttccgtaaccgataaccgggagacccggaaggcctnccctttccttcccttggggggggggggctcccaccaggccacttttcttttctttccccggcaccgtttttttttccgcactttttttggggggggggggggggacctatttggaagngccntgnanacanttggcgtggcgccacccatgcagcgagtagagcgcgaacgtgccgccctcgccgttgtcgtcggcggcgagcacgatgaagacgtacttgaggagcgggatgagggtcagcgtccagaacactagggagaagacgccgaacacgatctcctcgtcctggaaccgccggagcgacccgatgatgaaggtgctcttgtacacgtacagcggcgacgtgctcaggtcgccgtacaccacgccgcagctctggtacgccagcagcagcacatgcctgtagtagctcctccagtgaccctgtacccgtaattaattctactgattatttattattttatcagattattactttcattcttcgtattatggccctgtttagttcccaaaaactttttcctaaaaacatcgcattgaatcttttgacacatacatggagaattaagtatagataaatcaaaaaactaattgcacagttagagggaaatcgcgagacgaatcttttgagtctaattagtccatgattagccataaatgctacagtaacccacatgtgctaatgacggattaattaggctcaaaagattcgtctcgcggtttccaggtgagttatgaaattagttttttttattcgtgtccgaaaaccccttccgacatccggtcaaacgtctgatgtgacacccaaaaattttcttttcgcgaactaaacaggcccaatatatggagaaatacgtgcttatttaatttagggaagattgcaaaaatcaccctaaatatatcatcctaagttcgagatttcttcatgtaaaacgacttgttacaaattccatgtcttaactcaccttgtttcgatatatattcctcccaattaccattgtttgcgcgttttttctcctcgtgtcttacttggtttagtgtattttttgatggacatgacccaaccacatcttttgcacaatgtaagggcatgtttggttcaatactaaacttaaccataccaaatacttggcattactcaaaaactgtcatccatttgttttatatccaaataatttgtcatgccaaattatttggtttttggcatacttcataggtagcaaataaaacacataccaaaacattagcatccctttgtggtaacaaaccaaattcaaagcctagccaaaaacatttggtaacaatccaagcactttgcagaaaaataaataaataaaaaaaatgaggcaatgatcaaatcttgccatgccaaataaattggcaaggccaacaatggccaagaaccaaacatgtcctaagtttttttttttaatctggttcggctgaggagagacaaaatcggtaggaaaaaaaagctgtccattttccttccatcattggtcgcactaaagtgatacacattgcaaaattatttaactagcgtcagtattcttcatggattggtaatactgtatactactgatgccctctgtgctcacactgtctgactcggtcacaagctatttttaggacggtgttagtaactagtggtgtaaaataacaatgagctactcctactgcatgccactcttaatgtaaatgttctccttgcatgatccactcttggaaaaaaaaacaaacaaatcactctgttattgtcaaataattcagtcaagaataacattttagttgggatcgttcttcctgattaggtactagtaatatattcttccataagtatggtcagagataagatgcagggtacattaatcaacaccatttcctactacacctcagtaacataaaggaggaaataaagagaaaaggaaaaaaaagggtcagattccgttgatggaccagcaccgatgttggtttaggtaacagaaatgcaaaaaattgcaaacggtaggggtgcacatcatgtccgtatgcttacacaatatcacaaattcatcacaagaggcaaataaataaattatttggaaaatgcgatttcaatgcacgccagagcaaggggaaatgtatagctcaccgggttcccgtttgcggcacctgcaccggtgacatctgccggcgagagaccgctttcgcagtcggccaccggcattttattttattggaagatgaaaggagagggaggaagatggccgggatggagtcaccaattgcggacatgcgcactctctctcactgcgtgcttcttctccgattcgccgtcccctaaatctgttgttttatttgggttaatgagcactcgtcggtattcttggggttatgtggatgagtttgtattcatcgaggcaaatgtagaggggagagagagagagagggggagagcccccggtttataatgaggtgttaacagttgtggccatggagtcatgcaaagatgaagcattagaggagtagtagcgtatagtactctaattttgtagctgtgccgctttttaagatattttactttccttggaaaagtactggtacgtattaaaatttacactaaaaaatttgacaccacgaaataccaaatatctagaggtaccaaatttatattatcatcttcgggtacatttttaagaacagtaaaattactcatagtccatgctgtttgtactttttattcgggattgttattaatacttaatagtgtcaaagaccgttacaagtaataacaatgtgttgaggcgttgagcgaatccatttagtttttaacttaaaaatagcacttcctccgtttatgtaagtttggccaggctttaattttttctaagttaacaattcttataacaccaaatttcattaaatccaacagtcaatatattttgatggaatatttgttcggtgttgttcttttataaacttagtcttaagaagtttgacttaaaaaaagttaaactatattatagagtgcattatttatttagggaaaagtccgaattacacccctcaactattggatgagtatgaattatccccctaaacctaaaaaccagacatctttaacccacaactatcaatatggatgaaaaaccccctaacttgactcagtgcgaatttggatcatacgtggcggtccagtcagcttaaaaaatggtgggacccacctgccagctcttcctcttcttcctcgttgccactgcttaaaaaaagctatgtcgagggtgaggcggtgacaagcgacacgggaggagccagtgaaggaagctggggggcagggctggcgcatctcgccgcaccagtagaggggggcgactgacatcgacaccgggctcagatatgatgattttgatttgggggagtcggtcgagaatttgagagcaatggcggagaaagtgagccaggggagcacggtaggggaatgatggcgtcctccggggtcgccgtcaccatgaccaccgtgcccatgacggaggagcacatcgatgccttcactcaccaggtccgcctctgcttggtccccctcaaggatgtggctgggccaccgctgacgtcgccctggcaccgaggcggaaggcgatgacgaccaccactggggaggagcgcgtggcggtggcggccgtcaagaaggagtgcaactgggggcggtgggactcgagtggcggaggtggaggagctcgagcgacactagctggaggcgatggccggaaagggaatcggcggcgatgtacaggtcggtgatgttcatagggagctccacgcagcaggccggcatgagctttggcggcgagcacgcacaacagcagccgtgcccccccaccgccgttcttggctccccctccgccactccgagctggctccatcgtccccgcctgttgccgctgcttcgaggtgccttccccgtccctgcccgctaccactgtcctcagctccccttccgccactgagctgcctccctcgatgatgcccgccatcgccatccttgactcctcctcggccggttgctcggtgatagagagagggggagtcgagaagagaaagagaaagagaaagagagaggtgaggggaaagagagagaggatgagactaaaaggtgggacctatcgatttaaagaaaaagaattgctgactggattgccacgtaggacaaaaactgctccgagtttgagttagggggtaattcgtccggtattgatagttaagggtgaaagatatctggttttcgggtttagggggggggtaattcgtactcacccaatagttaggggtgtaattcagacttttcccatttatttatcggctccatgttgacaggctaggtttgatcaaatgatgtcaaatcatttcaacgtaccagaacactgcatataaggggcagatgactcggtatggcgagctgtggcgctcgccataccttgatctgctagtgagacccccccggggcgcgtcctccttcctaggacgccgcgccgcaccggcacgatcgagagagggagagtgagaacatggcgcgatcgagagagagagagagagagagagagagagaatgggcctaattagttggcctggttcatcctttatgtgcgaaggcttgacgagttcaaagtttgtcatgatttagcaagcctagcaaaaaagatggctgaacttgagagacacattgtatttccattggtatattgtctcattgagttagtattgcttttactggtggcgactagatcagttgagagggccttctaggtaatgaagattatcaagacggagctacgcaacaagatgtccgatggttggctcaatgacttgatggtgtgctacatcgattcaaaggacttgattttcaaaaaaaatcaaaaaaagtatttcagaaaaagaaaagtaggcaaatgcaattgcctaaatctcctagacctctaagcaattaaataaatgtttggtataccttcacattttattccaatcattgctctttatgttatcaatcttaagtatatagtatactaattaatctttgcaatttgttttgcagtttctatatgtctatctatcctcactagtctctagttcttatatgtgatgcattgctgacagctggaatcttagaggtattatttacaattttggcaaatggatgatgaatgtgaacctatggctagtgcttgttgccatgtttgagattgcgtcatgatcggataatgttgcgtcatataatatagtgcattaagattgtttttttttctttgtgctagtccatgggccacaccggcgacaccgtcacacctaattttttttcccgtcctccaccactgtgcatatataaagataagcagcattattaatttgaaggtgcctctaggaaaaaaacagaacaacaattttctacggcgagtgcccgagcggaacgccacaccacacaaagataagcatgcgagatttaggcacaatgctattcttagtgccacaatgcagcaccgacacctgccaagcctaaccgtgaatcccttcttaactcccgccatggcgctcctctccaactcgaggaggacacgcacgttgccaccacaggctacgcaaaattctctcccttcctcctccaccacctccactccgacgatcctcctcctgatcctgtgccggccggcgatggcgtaccggttgctggagctcacgctggtctccgcgagcgacctcaagaaggtcactctcttctcgcgcatgcatgtctacgccgtcgcctccatctccgggagcaacgtccccatgcccatgcacggcacccacgccgaccgcaacggcggcagcaaccccgcgtggaacaccgtgctccacttccccgtccccgcccgcttcgacacccgcggcctcgccctccacgtccagctccgcgcccggcgctccttcggcggccaccgcgacgtcggggacgtgttcgtgcccctcgacgacctcctcgccggcgcgcacgacggcggcgagccgaggccggctagctaccaggtgcgccgccccatgtccgcccgcgcgcacggcacgctctacttctgctacaggttcaccgacgtcaagcatcccgccctcgaagccatcgaggccgcgaccgcgaccgcgacgagcagcgccaccaaacaagggcagtacgtgcccatgtacgcgcaggactctgatgagaaggcgacggagaagagcgtgtcgtcgccggtcaccgcctacccgccgccgtcgaacgccgtggtagcgcacccgccggtcgtgccgtacggcgcgccgtacggaggagggtacccaccgcatcagcagcagtacggttacgcgggtcagccgccgtacgcgtacaacgccggcccaccgccgccggcgacgtacagctacgcggcggcacaacagccggcggcgaggaaaggtggacgaatgggcatgggcctcggactcgggctcctcggcggcgcggtcggcgggatgatgctcggggaaatggtcggcgacatggaggctgacgccgcctacgacgccgggttcaacgacgcactggaattttaggtcttttgtcgtgttttcctgtgtacatgggcaatgcacctgtataaatttgtcacgtgcataagaaatttcacgatccaacaatgggaaacgcgatgtcaggccacaagggtaagcagatcctaaatcaacgctatatatatatatatatcatccagtacgtacaaccacacatctctactccttaaaaaattcaaattggtgttggtgatagtgaagccaaagcagatataggatctaacatacaaagcagacatgcgatccaacatacaaaccatcgacacgtttggagcgacaaaaataaaagaagacgtacacgcgatccggaacaaaaaaaaaaatcgtaaaaaacagaaacgccccgcaacctgcgccccctcctccgcgcgcctccatcgccgccccgcaccctcccatcgcctctcctccgcgctgcccctccaccagcaggcggcgcggtccatcgccgccccgcgccctcccctcgcctctcctccgcgccgcccctccaccagcagccatctccacaccgcgccggcgcccctctcctctccacccgcgccgccgccgcccctcgcctccccaccgcgcctctacccctagccggagaggcgccgcccctccacctccaccagaagccgtccccacaccgcgccggcgaccctcgcctccccaccgcgcctccacccctagccggagaggcgccgcccctccacctccaccagaagccgtccccacaccgcgccggctaccctcgtctctccacccgtgccgccctcgacctgcgccgcctcctcgccgccgtcgaacgccgacgcccctcgacgccctcgaccgccgctgcctcctcgccgccctcgaccgccgacgccccgcgccgccaggccgcagccacctccgccggtcacgatcgccgtcatctgaaggtatgtatcccctgacgatatggccgcaacatgttccagtaagaagctcaatccgtggtgtgattttgagccagctgttacgattaacctggctctaggacatctgctgataatatttattttctaaatcatctatgtgatgacgtcgaccattcctgtgcacctgtccaactcctgttttctactccttgatttccatgtatatacagcttgagatggtttgattttcttttttgatcaagctatctgaatcgtcttgttctcgaaacatccctataatgtggtttattttttttaccgtgtattaaaccaaatgttaggtgtaggcaatgagctcaagtgttcatttatcatcagttcatgtttcaagctttgtgaatcccttctttcatcacaaatacattaagtaataatttttgcaatcaagtagtaatatcccattttttatgactacgtggtttgtcatgtcatgctcataagtaagaatattaagtttctttgatttgtgattgttgaatgactatgtggtttgtcatgtcatgctcataagtaagaatattaagtttctttgatttgtgaatgttgaatgactatgattctgaacgtttacatcaaccgatgagaaaaaaacaaccatcagcagcactgagattctgccttatggtttgtactggattgaactctaataaatttggacttgtgcatttcagggttccaatggatgatgctaaattaattcttcaggtctatgatgctaaattggttagtccatgttttgcactgatattatcactgatctgtaattgttcttgcagaactcttaaggatcatctgaagattgaatttgaaagagcagtggactgatgtgctacttcattttattactttgcatgctctgagatcaacaatctctcatgatagatagcatattacgtaatgctggagacgtggatagagattagtacattcattacatatgatagatagcatatcccatttttgatgactatgtggtttgtcatgtcatgcacataagtaagaatattaggttgctttgatttgtgaatgttcaatgactatgattctgaaggtttaatcaaatggtacctttttttttctaaagggtttcagcaatccatattattatccatttactgttagtgccactaatcatggttgctgctctttcaaatatgatgctgtgcagcatggaaacaaaaattggtttctctttcatgttaacagaagctatgaaccatcctaatactaatttatcaatggctattatgcatctgttcaatagtgactcgatcagttatgtgatctacatcagtgagataaccgagatcaaattattatgtgcatgtgtgacaaaatatttgctgtttaattttccttccacccactatagcatacatcagtgatataattgaaatcaaattattaatgtgcatgtgtgacaaaaaaaagaagttattatctgcatgtgtttctcaaatttagatagcaggcctaatcttttatcgagctaggagaagccctgagtgccctggttaggaacaacctggagctatggttgatgaatcatgagtaaagagttttcggttctgtcagaatgaaaaatgcctgaccatagctctgaagatgagtacatcttttgcaagtcttgatctgtgcacctcttcagctgactgccagcatgaaaaaaatatgattatgattaggctttttgcaaaacttggatttgtgcacctttttaattagggatggatggcaatatgccaatatgattgctgtatagtagcttgaggctttgaggttgatgaagggtacagtgcttcttcctgactttttttttgtttcaaaatagctttctcggtgcctttttgtttgcttatgaatttatagcatttgtgtagagttaatgattttatatgtcattataaatcagttctttcatgacccaaataaaaatctaactctaaagctacaattttattatcgttttttgtgaacctaaatatacaattacccacagatttgtatcaggagaaacaatctcattatccttaaaattatctaggtattcaatatgaattttatatgtgagcatgatcatatgttcagattgatttcgtttaagtttacatactgatattaatttgatgatctactaagttcgaatgccttagaagaaaataattatgccttttatttattcttctgacacagtccaagtctgtttggagaaggaaacaggctaggaaaaaaagtgtgatcatggtccgctgcaagaaaagaggtgcatttcgtactatacttcttttctctattggatcatttagtgtgaaaatccaacatttttttggctctaagtgaacagatgtttttttaaagggctcgggtcatgaaaattgaactgtaattatacaatggttattgttattactgttgcaaccggacgccatttgatgttatgcttggacggatgaacacattcagatttattattacttggagacaagatgccaaatatatgttctggtcatccatgggaaccgtttgggagggttgtgtttgcacacgcttttgcttgtacataaagatttatgttctagaaaccagtggaaatcatttttggtcggcaattgactgtcgtaagctgaatcatttttggcaatgggaatgagatcaatttgcacacatttaattataggtatttgctgtgtagcatgcattggtttgtacttgtgcattaatcttgaagttcactggtctacgagggaaacttcgttggagggcggcaactgtcatggttcatggatgcatacgaggtgaccctcctaatccagtggattggccaccattattggttaatattgattttgattcctgatttccttgcagcacaacgccacctggtggctgacaagccggcaagtacgagtatgtcgattagttgtgcatctttattccatgccgctatcatatttctgtgcattctaggaaccattgaccagtggcactctgccaggaaagtggctaataatgtatcttgttgctacttatccagatctacatataatctctttggtagtaattttggactaatccctgctgcatcctcggtttattgaattgcattttaggaaaagcaacaatgggaatctggagcacaagtcatcaatggcgatctgcagaagataaatcaaacctgtgatctgaatgaagctcatagtttttcccaactccttagtactactacttgctagctgattctgattagatataattgttgatggtttcgaattaatttctaaacaatatgatattttgaacttttccttaaaaatatttgaaatatgacattcatcaaattaaagctcaattggactatatctgtgaaaattaatttgactaacatttcttatgaaatttcagactttggtgcgtcttatagtcacaatgtagcaagacttgttcagtctggattgtaaactctggaaaatggtttggggtggttacctgctgttaattcattctataattaaaattttaattatcttcaatttcctttttatgagtcttatatctataactctttccatgcttgcttgccaaaacatataatgccttttgtttgttcatgttactaacatccaaaatttgtaattattttgcgtgctatattaagttttctattccaagaaatttacactcattgattatttaacatcatttgacccatagtgattttaaatttatgtataatttttcccgttgcaacgcacgggcacccaactagtaggagtactacatatataacttaatatcaacttggtatatatttgtaattaaactcatattttggaagttttaaatcatgaaaaatgttataatcaagattccaaaccaagcacaaattggtagttaacatttaacaaagggaaaaggaagaacaaaaatagtagaataattttgacgattgttttccctcaaaatttgctctcaaatctatcctaaaccggattaaattgtatttacaaatgtcataaaccaacttggattggaagttccagtctctaattcgaaaattccaatatgataagaaagtccaaattcctcaattctcaagctctctgtttaattaaaatattttggatgaaaggtcctatttttcatcgggaaagtatcatacatttcgtccttatccaaaactccaagctatctcctccaccacacattcccttccttattttttttcttttcctcttactctctatagtctcaaagacactgcattgccaccattgccgggtgtagtggcagagacagaaattaacaaatcatagagttgggtagggctcaactaatgaagttttttttttcaaaaaattacatggtgaattaagagaatttaagcatgattatgaaggcaagcctacggctcaagcccaagcttccctaggcttgcctctacttctgccgggtgttatgagagaggccaaagctattgttgtcggtggctacacgtattgcagtggtaggcggtgttgatggcagtgttggacttggcaaccgatagggaccggatgcggacactgctggtcctagctaaggttgcctgcctcgtgccactactcatctatgtcattccctagacatcacctcctgctgccgcatcagccacttagtagtttcggcggttggagtatgagaagaagacggtagtggttttattttgttagagttttagcgatgttgcagtctattgtttatcttattgcactttattgtatcaaggtgtttcattttgttttgaatcgatgttgcatctactgattcttcgtgttgtagtcagtatgtttaaaatgttgatttagttgaaacactttcgttcaagtgatgaaacattttttcccgattgataaaatatatgaaacatttttcatcgagtaatgcaacatgtgaaacattttgcaacaatatagtgtaacaccttctggtgttttaatgaatattggacgtctgatttgtagcgctctccagagttcagttctggtatgaaacccagtgttttaaatcgccggctaagacatttagcaattggtcttctcaaatagctaatagcgggctaaatggggctagagcatctaaattatacatgagagcaaatagctagatcctcaaacaactatatccagagatagcggaatggctctatgtcggtgtgttgtggtggaggcaaagtagcttgccaggggtggtttcttggttattttggttgtctcgtttatggtttgatcataggaagttggagcttctctttgggcttgacaatgatgagttgtgtttgagcttcaattatgctgccgcaagtgtatagttagttctttgtgtggttttctttgccagttttacccaattacctgtgcatttatgaggtttttgttcctggtttaccctaaaacatgagtcccatcatcttttaaggtttatcctaaaaatgacgactggattgttttggccattggatatgtttgtgtttcctaatcgcttctgcttcagaaaggagatacaaaaagagagtgagaagcatgggctgggctgcgccttgtcaaacttcaccaccccaagcctctcaaagcctagctacgccatctactgcttcataccattgctagctaccactgttgtcgccacacagtgtagccaccaccaccatgggctgcgctaatgcttacctcttctctgctttcttgtctgctcgctgttgctgtttttgctggccaataacagggaaaggggtaaggaagggagagaagaagaaaaggaaaattaggggattttgtggaattataggattggtaccaatgtggtactcaagtttatgacaaactacttgttgtgataaatggactagtttgctctatttattttctttcattttccttaacttatgcattaatgctaccattctagttatatatgcaagtttcaagttgatattaatgtaaatgatgctcttattgttttatgattctatattctcaatttggttatgtaattcaagtgccataggtaaccatgatggcgccatttggttatttattcagaatccttgagtaagcattggtgatcttgcccatttcttgtggtagtttgttatatgaaagagaaaaataatgtttttaggtcattccttatcagtagttgtcatggttacgaataaggcataccctctattctactagtcatggaatatacggatatggcataccttcgtatgtatgataaagctccgtatgcgataaggacatcgacaagagattatggaaataatcctcatgggcaagtgcatgacagagtactactcggaaaggattctgatatatcatatcgtgcagtgtctggggtctctgagttctacttggagaccaagagaattcacaatataaatacataccccctgagggtccaaggcatcgaatcataacaccaataacccgtcaccatagaagtaatccagaagacttgaagcctgctcgccagtagatcttgtcgagaatctcttgacaaggatcttgcttgtaatcttgtaatcagttgttctctattgtactatgtggtttccatatcaatctcataaaaccggattagagctattaccttacaagggatctgaactagtataatccttgtctctttgtttgcttgacgtcaaatcgtgtagatcctcgtatcaacataccccaatactctcatcatccgttctacaggtatcccccgtcgatagtggagtgccaggtaggggaacttggtgcacaaggttctaccgagatgatttcaagcttccccgacgtctgcatcagcactagcttcggcccaggagatccaacccagacgtcgctagtgtggactcaagttggatccatcgtctttccggtctacgctgcaaaaccaatctcgtatgccctagtgtttgtcgagattgagaatggtgcagcaaagaaaacgagaaacgacatcacttcagccgcacctcccgtctcgacagaaaagagggcgccgactacgacaacactcaggaagaagcctcaagcggccaaatctcgttctttttctgcgaaacaggctctgacggactacaaggtggtacaacacatgaaggctaaactcgaagcttgcaaataacgagatattcaacgcgtctcaccaaccagattcacctggtgtagtccaatcaataagtcaagaaaacatgacctttcaaactgcaaggttttccttgacgccactatacctccacacccccagatccaacaacgacaagttcaatctcaacatgttgcagaggaacaaagcgtggaaggatctccagatcgcttcgtgggatccgtcggcattgacccccacaaacccttagttctacatagcatggaggatcaagaatcttcagcatctaatactacacgtgatgtgaacgttatcgaaggagacgctccaagcaatgcaaacccatgtgatccacctcatcgcgaggctacagatcctgtccgtactcatgcataacatctcaccgcaatcgacttgctattgagagagtcctttcgatccggttctgtaccctgaagcagatcactggttggaagaatacgatctacaatatccaacctcaacagtgcctttacagcaacagctggaccagcaactcagggaccctcttgtcttccggcacaaggagaagaggtgcatgccgatgggaacgtcgatgctaccgaaatcctttgcgagcacccgagtcgagattaggccggaacctttggaacgcctcaccaagacgacaaagtcagcagaccctatcgccccgagatgatcgcgaccttcgcgaccacttgaacgggtgtaggcgggaacgataggagcaggatgacgtctgccatcaccagcgacgttctccacatcgacaacgcaataacaacggtaaccgaggaggctgtgacaataacgccaaagccaccatgatgaaaacagcttgtcaaagagaagaaaaagcaacgccatgattttttgcttctgcaacgagcgcctgatgcagagcattgacattgtttggaggttctcagagctggctatcccatttattggaaatgcagacatgctaataacaagctgcaaagctggacaacagcaagcacactatggtatgttcccacttccgaagccgaaatccggtggcatgccggccatcaccttctgcaccgtcggcctggccagcagcgcctcccaccacgccttcacgtgcgggtacgcgtcgaccacgccggcgtactccgtcgccatgaagtagcgcatgttggagaagtggctgaggtccgcgaggctgatgcggtcgccggcgaggtacctggagcccgacagcctcgcctcgtacaccccgagcaccttctccagcttccggacgctctcgtccacgacgccctggtcgcggtcgcggccctcgaacttgttgatgatgcagtgccacaggatgggcctcacggcggcctcgtgctggtgggcttccacgtccagccacacgtccaccattgccgactcctccaggcttccaccttctccgagtcccaggaactctggtttgtacttgcgaaagatgtacctagcgattgctcgcgattctgacaagaaaaatacaaacgattttagtttcttcttttgggcatagtgtgttatatagtatgtgtatccgtgatcttgaataaagaattactgaatctctactattaattgaacagttattcagagaacaacaagtattagttttgattggaataattcagagaagcaaatagaattcaatcgacgaaaacaagaatacaagtcaagcttgcttacgatagagcgtcaggtcgccatcctccagtactggaatctcaccgaacggctgcataattgatatacagaaaacaactttaataagcaggaattgaaatgttcttagcaggagaaattaagtttggaaacaacaactcgtgggcaaaaagcgcatccaaataaccgagtattcatgacaattcggatcctaacgtctattgccaacatatagtctactattgggcaatcgaagtgcaggtattccatgaatcagcctgcactgtaggtcgctctgaccctttggactaatttgcgtaacatgcgaagaagatatagtgcgagaattatgagaggctcacgtacgtttctggcgaggtgctccggccggcggtggtcgccgccggacctgctcatcggaacgacctcgtactcggcgccggcctcctccagggccaccagcacccgcgccatccatggcgataccacccacccgtacactttcatcggcgccattggtccttcttgcagctgaatttgccctgcactttgttggtacatatatagttgctgctcatcggcccattttgttgctaccctgggcgtctattattgtacaatgttgaccgtagtgtgggggatttggtgatataagcgttgtttcttttgtgatttatatattggctgcggaactgtgggtctgtggctgctattgccttgcgtcattgcttacgcgagggccatttgtttgttctttccacgcaggcacgtgcacctctggttctatggaagtgtgaattcaccattcttgagagctacaggggagctacttttttccaaagaaaaaaaatggtatatctcggcatctttttaaggcctataaattttctctcatcagtggtagttgcaaagtttgaatgttatatttacgtgtttctccttacatttttatacattttaactgaagttgacagaagcctagctaacggtaataacataaaggaagaaaaatagttgtgtgatgcaactcacgtaatctatggcaattcttaggatcaatcgttggtcattggcaaaagatagaatatctgtgagaatgttattgtttcattacatatttgaccgttttgactgatttaattgagtaccaaaatatgaaacaaaattatgaaaaaatatttcatagaaggctatttcatagaatgtgagaaactttgtagaaatttatttgagcataagtgatttgtcatttttaattatatgcatgcaaatacaatgcataaaaaaaaaccaagaataagccacaaataatctgtcagggttatggataccatatacctaatagtagttgactaaatcttggcagaacccaccacataccatgtcttatacggatactgacctctgatatggagggagttccggatagagaaagacaaccataattctgcatggaaacgacaatgactactcggattgtatccatattggtttccctagttctacttagacaagggaacacctatgggtataaatacaagaccccataggaggagaggggacacggagcaatagatcaagatacaacatacaagccaacatacgccaagacaagacaagatgccggatattgacttcagagataagcatggctagtccctacggtgtctacggatactgtcaggagagacatagcgctgtctttgatctcgccggatgtggattcgaggaggaaggctaccctgttgtcgactacgagtcagcacttcagaccgccaagtcgacaacagttagataggctaccttaaatattgtactggtgtgatcatggtgaataagagcaatgaccggcttcggccaacaggagtagggttattacctgacgattcaggggctcgaacctgtataaaattcctcgtccccatctcttttattaaaatctcgcatatatcctagtaccaacgatccccatactatgcaaataccggaatcgcgacatcaaacgtcgacacaatcaaattagcaaaacaagatctgtttgttgatgagtgtgagtggtttccacaacttggctcctacaatgtcacattagttaccaagcaatttggccaaattagcttattcagatgaattacggagttgggaattttttttaggatatacaaagtccatccactaatcttgaagtttttattcgatcctggagcgattttatgagctatgtgttctgtaaatttgtcacatttttatcattttgaaggctaggaagatcattagtttagtttttattataattcaaagtgttgacctagttggctcaactaaagttaattagtggatgtaagtttttgtaatctatactaccaatagtggcggtggcagttagtctgtgtccaccactaccaagtgatttgtgggaaccaacgatggtaagagaagtttcctagttcaaagggtgtatgagttgtgtgcatgcagtaagcacacgggctgaagtggcccatctgaatgtaactttcttttttccgtgtggtttcaggatggatctgctatacgtcataagattttttaggtctaaaattatattttaatacaatatatgttgtataacaaatctatctatctatgatatactaaaaatccattaaatttcctacaaacgctctcaagctgccatgtggcatcctataaacgctctcgagtcaccatgtggtactctaataaaatagataaatttgacaatcgattttcatttaaattggtagactcattattttagatcgttagatttatctttacaggaaaataaaaataaaatccccctccgtgcgcgcctcagggctttcacggacgtacataggaatgatccatcccatctcagtgcctttccttttttttaaccccgtgataattaaaattaaaaactcttttacgtgccttaaaaggccatagataaacaccaaccaactctcatctattctctactaataaatagtccattaaacatcatataaatatttctaaacatttgtatagtaatcttaaattagaaaaaaaatacattcggccatcaatttacattattttaggtcatcatatctatctttttctttaaaaaacatccaaaacctccctccacactcccatgcagtgttaaagcccattaatcatcttttaaatgttttcaaaccaatccgtgacacttctaaattagataaaatcataaaaaaaattagaacaaagcatccaaccattgggttgtgttaacagtgaaatttagtaagcccgaagtagtcatcggcttagagtcagcatcggctttgaaatcctgagattagcctatgagagttgccaagtcgtcagttgttggattcttgctatattcggttaaggaaattgatctactaaaggaagcttatccagaagagaccgagttcaaagagaatgcggcatggcaagttatctattaattagtaatagtttgttagtttccttttatctttaggaaagtgtatttagtgtcctataaggactttatcttttccttttatctttaggaaagtttctttcttgttcgacaaggacttgtatcaacccatgggtataaatatgtacacccggggtctatgtaatgtaacacacacgttcaatacaatctcggcgcatcaccaccctttttgctttagttttgtttcgacgagttcttgctttcgggttgagctgcatcggtttcgatcttcaacaagaggtaaaacttgttatgacggcttgtgttttcgggattagtgcttccatctttatgatactctaatcttatttatgtaattcgtcgagttatcatatattttatataatctctggcaatattgctatctaacctacaatcggctaacatctatcagtagagggcagtcgattaggttaaatatcaacgctggcttagattatatacgatatccaccactctatgaaacttccaatggcttgattgtctagatattgtccttcttttcacacttatagctgcatcagttgtttgatcttatgagtcgtgattagaatatcaatctctagcctgcttattggttgctgattagggtagtatcagggtttcaaccgatcttacctgatttaactatacttgctttatatgctttattgacatgttaaatctgccctttatgttaagatcttattgcatttaagtatattaggctttcgtttgatatattctgcttactttaatatcttaatatagagttgtatctgagtactagccgatacatgctagatctatctgatcagctatgctataaacatatatagtcttgttgttggtatatatttcaatttaagtgatttatactgtcttggcatggcgactgatctatcccaatcacttgatttaagtatatatcgacataaggattatatattgttaatatctacagccgatcgagtagatttagtcctttattatctaattataactgccgatcgatgtatatatgacatcggctcaaagataaatgatatgtcatcggcacttagccgatcggctatcgtttatggatttaaccacggtttctttgtttctatttcttgttgattgcaggatcaaatcaactggtacgctagcatacccgaaggtgagttttggacctgcactggagttaagcagatctctcaggcctcgtgtttttcatcaacacgcaattggcacgcccggtgggatcacgaattttatatccacaagtctgaagaagaagtcaatgccaagatcatggtcacggtggagaatttaacggaggaacaacaatattggctcggggggcaagcgcatcagtttcaacatggtggagcacatcagtatcggctcatgaaagccgattacaagaagcaaaggaagattggttttggagttatcaagacaagaaattttgaagcatgaattctcgtactccaaaactagggggggatgtgttaatggtgaaatttggtaagctcggagtagtcatcggcttagagtcagcatcggctttgaagtcctgagattagccgatgagagttgccaagtcgtcagttgttggattcttgctatattcggttaaggaaattgatctactaaaggaagcttatccaaaagagaccgagttcaaagagaatgcggcatggcaagttatctattaattaggaatagtttgttagtttccttttatctttaggaaagtttttttcttgtccgacaaggacttgtatcaactcatgggtataaatatgtacacccggggtctatgtaatctatcttcatgatcaatacaattcggcgcattgccaccttttaccttttctactttgttttatcgtccggcgggacttggcacctgacgtggagctgcatcggtgttcgatctccggcgaagggataagtccaatgttccgccggtccaggcaattgtatcgtctacgtcggcgtcgttcaaggctgcatcaggacattcgacctcttggattactctggtttggatgatatatttgcctacctatttatcatatgtctatgttaatctagtcttagcatatcaatttagctctatcggctgcttctcattttagggtttctgccggtatcggctaaatcgcgttgctagattagactaacttagacatctaccaccctgaaaactcagtcaacggcttgattgtctagatattatgtttcttttcatacttagtgctgcatcagttaagtttgatctactaagttgtgcttagaaccataatctttagcctacttcttgattgccaataagggtttcatcggggtttcagccggtgagttatttggacgttgcatcggctcataaggattgcatatacatataagttggatttagccgatgacaacaaaggtttcactgtttaatctaatcttgtggatttcatgacatcggacctccagccgatgtgtgctttaaccttcggatcgatgcttatttatcatatcattatttgccgattggtttatactggattatattgttattttattacatcatcatcagccgattgcctttatatcatcatctacattggacatatagccgattgcttaaaccctatcgctatcggctggtattggcattggctattatcggctatcggctgaagctactccatcggcttgtcagctgattggctgttttgatctactatttgcatatcttgtcagttgcaggatcaaactgactggctcgcccgcatctcaacaacctttggacctgcattggagccaagcagatctcccaggccggtgtgttcgattttttcgtcaacaggttgttattatatttttttaaaaaaatccctattttttaataaagctggtagacctatacttatatatcctgatagacatataacgacttcctgtcaagttaattaatttctctcaacatgtatatgggggctatttacctatacaatttgatcttcatgcatttatcaataaatgatctttttaggagataaataaataatcttaaaatgatcatagcatctaaattatatatatgatctatgaagacactaataaattaaagaaaaaatctttaaatgatatcatttttttacgtcataatgtgtaccccatcttgcctaaatttcatatagacaacatgttgaatatataaacatgatcagttgaacaccatactaattgtatcagcatagaacaatatagaaacatgaatttattgtatgagctctactttactgacatttattgtattgcaataaccactgcataataattactttagataattggaacaactctaataggtttgaaaaattatctaagcctgacaattattgtattgcaataaccattgcataataattaccttagataattggaacaactctaataggtttgaaaaattatctaagcaatgccaaaaagaaaatttatgaaacaaatagttcttttgaagcatggcatgcaaatgttactcagttaatattccgcttcaataagtttctcaaatacaacttacgatacatgcccactcattcgcgtgggctacctttcttgttagaataaaaacatccttcttaaattccattgcaacgcatgggtatttagttagtgttataaatggtcttatcaaatttcaaagttccaatatttcaaatagcaaaaagaattcggataaactattttatcaaattttctatttatttcttggagagtgattgtgcgatgttatgtctgtgataaccctagttagattagttatacagaagggaacaaaagtgaaatttcatttgggcactcaaattgaaaatcatgaactgtggctgtttagagcttaaccgttgattatatatgttgctttgtatcaagtcgcctaaatcggagctcaggccaacaagatgatctctgcacctgtagattttctaatgtacaaaatatgcttaacctaaagatcacaataatgcggaatttaaattatggatcgttacttgaagccatcatgcttggtgtgattccccccccttccgccggcctcccccttccctcctccggccagatctaggagggaggggggaggggagccgccgccgccgccccgcgcgtgccgttgccgccgtcgtcgtcgccgcccccacgccccaccgccctccccaggcctccctccggccggatctgggaggggaggggagccaccgcgccgcaccaggagctagccgcgtcgtcgtcgccatccacgccgccgccgccctgcgcgcgccgtcgtcgtcaccgccgccgccgagccatcgtcgtcgccgccccgtgcctcactgccctcccaggtctccctccggccggatttgggaggggaggggaggggagccgccgcgccgcacagggagctagctgcgtcaacgtcgtcgccgtccacgccgccgccgccggtagagggagggaggggaggggaaagtgttgagggagagagagagctgagcgagggaaatgagtggtgggaagggggtggaggagaagataagacttagaattttttggggtaggtacgattttcgcaggcgcgggttgagtggtccgcctgcgaaaatgattttcgcaggcggcgcttaagtggtccgcctgcgaaaatagacagcgaacttcaccccgatttatatttttataggcggtcatttggctttaagggtcatgtccgtctgcgaaaatcagacccgtacgtcgggaaaaatgtattttctagtagtgatcgctcgtgatctcatgtgaggtagcggcctcgcgtttggatctccacctgcactggccaaagatcacactatgaacaccctctagtgcttagattaggttgcccaggaacatatatgccatatcaatatttataagatatttcaattgattgttttcataggtattagtggtttatatactacgttttgggttatgtacttctgtcaagtcatcatttcaggtcacacaacttaattgcaagcagtggtgtttcccctttataattcattgcttctggctttgtccaccagttataagttttgaatgatgtcatattttaatctactaatttcatgtcacgatgtgatctggtttagttttgacatgcttaattagcaaaatacatatttgttctctacttcaattagtttcttccaactgttacctatttattgcgttttatttattcatacatatggcatagaaatatatagctaactattcacactttttacaatatattacaacctatgggaaaactaataaaacattattaagaacctgccagtgtcaaagcaccaaaatatttattagagtgagctttgcaaatcagaaactcaacggctgtgtctatgctagaaaaaaaaactcttttacagtgcttggtaggtacctgaggtacctccttaacgaattgttatccaccgttaatcttcaaaggataatttaggaacaaaaatttttacactgcacaaatccattcaccaggaaggcaaagggtactgggtactcgagcaggtcgatcatgtacattgacgagacaatcaaaatcgatcgaacatcttgaatgatcgcactaacagcaaggcggtcaatctcatctcaggttcggatcatcaaattgatcagaagtttcagaagcacaagggcctcaggctgtcaggcagccgagatcacagctacaggatacgaaagaaaaacgacaccaaccgaccaactagtgatgaagcgatcaagcaaacaattcaatcctgcagatagattgactagattgatcaccggagatctcaactcaattgatgccgccctaatcagaacacctccttccgcaccatggcgatcatggcaacgaggtccaccgctcttgccctttaccgaaaaataattttatgaaagtcaattactattttacccttccaccttctatacctggctcaccattttaataccttttttctagtttcttctctctatccgttagattattactgatcaagcgttctaattaatttcaagcattgaagatctcttaaaatatgtgcaccacatggatgttctagtttggctgggtcgagttaagatttgggtgaacggatacaaagcaacatagctctacacatccactgttcatgattttcaatatgagttttcacatgcaatttcacttttgccccgttctttataaattatggaacgtgggtttactaaaatgcacctattctcatcaggtgcatgatattcgtgttccgattctttttgttgagtatgtatggataacctgtggcaggaacaataggtaattccccgcgttttgctatgtaagttcctaagtaacttttatttttttaataatcaagctaaaaataaaaaatatattagttattaacaacaaattaaattaaataaaattggtttgtcaaactatgttaaaagagacatatagttagtagactatgtatgagattgtagatgaaatattaatatatcccgcacatagataagtatatgttaaatattataaaaatgatggatatatatgtgtgttaaaaattaaacagcagtgaggtggaatttagttaggttgttactttgtgttcaaaacattacatttgcagaaataatgaaccaggttgcattcatttggacctttctgagattggtctgtcgattggaagatgctagcattaagcactagcacagagtgcttggcgttactagcttacaaactgatatgggacaatggactaccaaacaattgcgatgaaagagtcagtagtcatccataaattactgattgatgtgaaaattaaaaaaataaatccacatacatcattatcatccataaattacttgattgatgtgaaaaaaaaacccacatacatcattatcgatcctttctctggcagataatactacctccgtcccaaaataagcgtaaccataagtttccgtgcccaactttaattgcctgtcttatttgattttttttatgattattattattattattattattatattataaaatatgaatggtaatttatgcgtgacttatttttcttagtttttttaaaaaaatttaaataaaacgaacaattaaatgttttttttataatgaacgattaaagttggatacgaaaacttatggctgtatttattttggaaggaagggagtatatctgaaagtgctagctgttgcactcctatggtgttaggattaatatattatagtggcggcactggggcatgcttcacctgggtaacttagtagcgttgactgtttttcttttctcattacagaataaacaaatcatggttaagtgaatagaaccaggaggggatggcgattcattaaggccttgtttagttttaaacttttttcttcaaacttccaacttttctatcacataaaacttttctacacatataaacttccaattttttcatcacatcgtttcaatttcaaccaaacttccaattttagcgtgaactaaatacacccttagtttttaaacttaccagatgattggggcgaactaaagaaattattgttggactaatgtattggtgttgttctcgtcgagaatctgattcttcgtcgccaaccttgatggggaagcgcagtggaggaggcggtggtggttgggacggggatgtggaaggatggacgcaacaattgataggggcggatggcggcagaactagctgtggtggaggtcgtaatgggtgcgggggtgtggcggcggcagaagtggtgggtggtggtgatggggaggtgtagtggaagatgtaacggtgaaaacaacgggaattggggcggcaacgaaaaggttgggaggcatttgagatttgtttttcgctcttggcctcatgagcgttttacattcgcgaggcttctcctgttctccaacagtgccgcacacacacggtgtaggcgcagccgccaccacagctagcttggcaaacatgcccagtgaatttgtagctgcattcgactgtcacttttaatccgatgatgtggcacattctaatggtcaaaaagtttagtattttcactacttagatattagaccctgtcggagaatgaacacctccaccagggaaccgtgaggcccccttttgtgagttcggccgggggcagcgggtgagattcgaggattcggtgagcgaagatgtgtgatcttgagggggttcaatcccctaaagacgatgagacaaatggggtttatacagtttcgggccgctaagaagcgtaataccctactcctgtgtttgggattatggtcgagtgtagaacacaagtgcctggggttgctagactcaagcgccagttcgctcggaagtccccccctccaccactaggcctggacttccttttatacctcaaggggttaccacatgggcccaacaacctaacctagctccggtggagaagtattataatctttgcattaaatgcatgtcttgtctcttgatttgggaagccaagcgcacgtcgtcttgatgatggggcctgtcaaaccttgccgcctgacacggggggtgcccctgtcagtcaccatttaatgggtgaagacttctgggctcctattacaccgggaaacgagagccttgctttgaccagagcgggaggaccgactccggctgggataagaggatgagaacctctcaccatcattatttgatgggatatgtcgggctgcacgtcgcctgacacacgcgatggtgcgcctgacatcctgggtcccatcagtcattcgaccggtcacagaccggttgagtgcactgcacaccgcattaaatgcggcgtggcgcgaccgctcgggttgccattaatgtgggtaggtgggcacctggaggcggacacctaacccaccgtacgtggtgacctagagagggggtcgggggagcccgacccctagtcatgggagggggcggtcgccgtccgacctcgggcccgatcccccctcgggagagggccacgtggcgcctggggcagccttctccctctagtctcggccagggagtggctgccgccctacctcgggtccgatccctctcgggggagggccacgtggcattggggggcagcctcctccgtccaatctctgggagggagtggccgccaccccaccttgggcctgactcccctcgggggagggccacgtggcattagggggcagcctcctccgactagtctatgtaagagtggctgccaccccacctcgggcccgactcccctcgggggagggccacgtggcattggggagcagcctcctccaactagtctatgtaggagtggccgccaccccacctcgggcctgactcccctcgggggagggccacgtggcattggggggcagcctcctctgactagtctatgtaggagtggccgccaacctcacctcgggcctgactccgtctttgggaaggagtggccgccaccccaccttgggcctcactcccctcgggggagggccacgtggccttggggggcagcctcctccctctaaacatgatacccccgggcccatatcaccgacatacccctagtaaattttattctagattaggccagcagtgggtggagttggcgatgggtggcaacgagatatgaggttagcaggtggtggtcggacggcgacaaagactagaaaaaaggtggtgcaggggaatggtgttgccgttggcttagtgaggaagtgagggagggaggtggggagggggagaagggataagcccattcccaacccaagacactagacatagtttctataaactccacatcgtcaagaaactagtactagacactactcttccaatgcaaacaccactattccatacttaaatttaatgctacttatctcacatgatgtcttcgatattgtgtagaaaccatgtctcatgcaatactctctccgtcccacaatataaggaattttgagtttttgcttgtaatatttgaccattcattttattcaaattttttttacaaatataaaaaacgaaaagttgtgcttaaagtacggtagataataaagtaagtcacaaataaaataaataataattttaaaaaatttgaataagacgagtggtcaaacgttgcaagcaaaaactcaaaatcccttatattatgggatggagggagtatatagattccttttatttcctcatttattcacttgccacatcatttttcattctaggtggcaacttatttaatactatgaacactatcctagtcattgggttggaaatggcctaatgcttactattgcgcatgaatcccgatgcatgtcttagacgtaaaaaatttggctcaaatttatgatatttttggacacctgaaaactaaaaaaattcataataaaatcaagtacttattttgagtaagtcgtttttatactagtatagtacacacggtacaagctgaggttcacaccacaaatgtccaagctagatgcatgcaagtgcccagcatggtagcacgagcatctggtcggtctttgggacggaagaactcaacgagttgctagttctgaattctgatcatccagaaacgggtagtccgtgtagcccaccacaggatcagaggtatagaacgtgctcctgtcatacttgttcagacctgccttcctcctgaacctctccggcaggtcagggttggccaggaacagccgcccgtacgccaccaggtcggcgtagccgtcggcgaccgccttgtcgccttcgtcccggtcgtacccaccgttcaccatgaacgtgccccggaacgccttcctgaacggaagcaggcggccgtgcgcgatcaccggcttgctgccgtcctcgccggcgccgacgcacattctcggctcgatcatgtggcagtagaggacgccgaggttgttcatgaggccgatcacgcgcagcgcgaggacctccgggtcggagtcgtggcagtccatgtagtcggcgaacggggagaggcgcacccccaggcggtgcgcgccgatctcgccggccaccgccgtgatcacctccgcggcgaagcggcaccggttctctatgccgccgccgtacgcgtcggtccggtcgttgacgctgtccttcatgaactggtcgatcaggtaaccattggcgccgtggatctcaaccccgtcgaaacctttgttagaaaatgagtagcattgttaagctgtggttactgataccgaagactcttaacacttgaggacgtagtatctggttaatatcgactaagtgtaaaaaaaaaacaatgtttcgtccattgacttttaatgttgttgcaatgattaaaaaaagaaaaaaagaaaaagaaaatatgtgtgggtcgatcaaaccatttccaaacactttactcgttgcaacagaccgaatcagcaattgcaacaaaatttcaacattatcgatacataacatgtttacggcggatatgtccgagttgtgtttattaccggcctcgatggcatttctggcagcaatacgaaagtcgtcgacgatgtttgggatctcctctgttttcagtcttcgaggaggagcgaattccagaacttggccatcatggctgacctgtggggtcacttgcttgtccgtgcttgagatgggtgcttgcccattaggctggaactctgaaaaaaaagaggatatatgattgtccatccttaaaatcaccagcggactgattgcatccatcttgcggccaactggacttaacaaagtgtcgagcgagcaaattcccaggagatacgaaaagatactcagctgatttggacttgacttcatgactaatttaaggaggagggggttgtcactttcattttagtggtctatttcaggaccataagaagataaggatatataaatatctgtctaaaattattattaaaaatatatcacaacaaatcaaaatcgttttggatgacaatacaaagtagagccaagcatgaatgagagagaaaaaaaggtagccaacaaatcacaaaacagcaccagttcattatcttaaaaaaaaagcacgagtttcaccagcgtcgatcagtgacaaatcatcagcagtgttgggttgcaaaaatttctgaaatgaaactgccgaggtgttgcttagatcaaactataaactaagaactacgaaacgcaaacaatatactttagataattagataaacttttagcgcatggtactatggcaaactgcagaaagatgaatcaaaccaaaaaacttaaaaaaaaacataaaaggacgacttggagaagaactaatcaagtatagatggccatgtgggccgcccggcacggcacggcctaggcccggccgtgcctgggccgaggcttgtcgggccggcacggcccgaccgacgcaccgggccgtgccgtgccagctcacgtgctgcactcacagcccaggcacggcccaacacgcctcgggccgtgccgggccggcccgaaggcacgatgggccatcgtgcttttcctcagaataagtctaaattttctccctcctattgggctgtgacattgtatagctaaaaaaagtctattttacctccctcttctttgtgctgtggtatataaatagctaaaataagtctatttaaggtccctattctttagacattgacatttatatgtctatttttagtccctatactttgtgtaccgggcctagccagccagcccatcgtgccgggccggcccgaccgtgccgggccagcccagcgtgctggtggggaggcccaggcacggcccgacagtcgggccgggccggcacgggcccgacccaagtcgggccgtgccgtgcttgggccgggcaaaaaggcgtgccgtgggccgggccttcgggcctcgggccttatggccaactatataatcaagcgagcgagcgtcaccctgcctgtcggggagacgcggcccgtgtgccatatctggcagaagaagacggcgcccttggcgtgcacgccacgcccccacctgctccgcgctccaaatcccgggcacgtcggggtaccctctcgccgtctccgacaccgcgcaggcttccgccaccagcagcgcgccccgcgccgcccgctgcgcgtagtacgcggcgttgtgcggcccgggcacgttcccgtaggaccggcaccgcgtcaacggcgcaagaacgaccctgcatcagtacgcgcgcgcgcgcacacacaaggcagaagcaaattgaagggatttgcatgaaacgtgcacaggagaacccgatcgatcgacgagaacaatagcatggacacgaacctgtgagcgagatcaaactggcccatcttgtaaggggtcagaagaggggtcgacgcctccattattgtgacagcttcgaccgatggttggattgttttgtttgtgcaagaaatgatgaaaaagaaggctgcgaggcgctgagctgagcttgttctgccgctgaaccttttataggcagagggaagttgcgtcactgtagtagtgtgttctgctttcgcgcgcgcggcagagtagtggtgtcctagttgactttgcccggccgaaatggttcgctagctgggatattatagtcttctttggcaatggcgtgtgcttgtctgcccggctaacggaaggggacgggcaggtcctgtcattgtggcattgtgccaatcagcggtcgatctaatcttgtatgaattaattactagtaatagactagctggtagtaccaagcaatgaacacaaggagatagacgtacataagtttctttttttttttctattgtaggtcacgcaggttccatagtcatagtgtagattattgcatctatgtgggccacaacacataaatcgatgaattgggacgaaagcgacttcacttttccttatattatatcacatcaaactgaacgaaagtgacagtttctgagaaaaaaactcccttcatccctcccaacataaattcatttttttatccatattacacatattaatataaaactaaaaatactataatattcctactttatcaaatcttaatgcaactagttctcactttatctatttccaacatagttacttcataatttcacaaaccctgatggaatgattattaaaaatgaaattatttcgagagagaagtcaaaatcttgtataaattaattactagtaatagattcgccggtagtaccatacaatgaacatatggaggtagacctgagtttctagtgtaggtcacgcgagttacatactttaagttgtcgcatctctgtgggccacaacattataaattgatgaattgggacgaaagcaacttctcttcttttattatatcacatcaactggaacaatagcaatggtttgtggggcgaaaaaaaaagtaatgagattgttcaggccttgagggtcacgtcttagtactactcacagattgtgacggagcgcacactatagttttgtttttttcagctcattgttttcttcatttcagacaataagttatcgtgaggcgcaaataaaaaaaaaagctatataggcatgtgtaaaaaaaaccatagacttggcagatttttttttcccacaaaactgtatatatctagttgtttggatggcacaatctacatttgccacaagacacgaaactattggagaaatgagcatgacatattttatggtgaacgagacttgtgcccatgaaggtggcaaaatacggcaagaaattaaaataatatgaaccaagcgtttgccttggttggtcaaatttggcttccacaagtgtggtaaatttgggtagccaaccaactaaataatccagctagaatccaaataacataaaattgtaaatttagctctcttttttttttttgaaatagcatgggcacatgaatatatatgaggtggtgaaggaaatgggatgtgtattccatcctacccacccaacctgaagctcgcgaggaggaaatgggcaagaaacatggagacccggtactatccgagttcaaattagcctgaatccgcacaaactatgagttagggataaaggaagagttctatctaaccgtatgtcctatattataaaaaatttatataaatctattaggaatccaagtagctacaaacatgataaaatattggttaatcactattttacaagttcataactaatatagcataaattcttacttatgtatctttttaacactctaattgcctccctagatttaatatctatgaattagtgatacaaataaatatccattcccaaatctaattccgagaaaaaaaaatgagataggatacatgatatctatgtcaaccagaagaacaggtggactaggggttcatgatatagaaaaccagaatcaatatttactaattaaatggttgtttaaactgattgatgaagaaggactttgacaagatcttttgaggagaaaatacttgaaaattgctcaattattcaagctggatggaaacaagtagattcccattttttattaggtcttatggttaaagatagattcttaaatttgggtccttgaatggttaataatggcactaaactaagattctaggaagacaaatgggtaggaaattattcctttcagaatagatacccatccctttataatatcgttcaaaggaggattgtttcaatcgcaatagttatgagttatgttccacttaatgtttcttttagaaggacgttggttgatcagaacttagataattggcacaatttagttgtgttgattttacatactaatatgaatgatagcaaagatagctttacagggaatctcatcaaaatggttagttttctattagatcaatgtacttatctttgattaacaatggtcattgttggtgaaatgggaactagggtatccctttccccagtgacccgagcttacattcttattccgtagaagaaaaaccttatttagtcgcaactaaagacgaccgcatgtcagggtaggggacccaggacccgccctacttcgggtcccaagggctcctatgttattctatgttatacatctctatctctctctccataggagtgtagatacatataaaatctatatctaagatttggatctataaattagcaaggcggagagcccggggccgcctttgaccgggtcctagtgctctacttgcccttctaggtcacacattcctccttgagaggagtgtggagacctataagatttacatcctaagataataagccaggggaagcctaggacctaacctagactaggtcaaatggcattccttacctttctagaccacacattcctcttttagaggagtgtcgagacttataagatttatatctgtggatttggaagccatgaggagcctgggactcaccctattccaggaacaaggacccctcaggctcttcttagttcgtactctcctttacgtggagagagcatggagacatgtaagatctacatcccgtggatgtggacttagtgtcctaaactcattcataatgtcttcgagaagctcgtcttaaataacaagactacctactaaggagcatcggggtgtgcccgagaacgagagggtccatgggtccagcccccaactagctatttgctagtatgtgaaagtccatgaaacgggttcacagctggatttccaagttttctagaggtgaaaagacatggaaaatatggcactgctgagtcacctgggacaataggagtgaagccgcgcgtcaaacatgcccaacgacacccagtagcgccagtcggcagaaaagtggagatgtgacattatctcggcaaggcttgggccctctgggcccaccacttggcgcgtggcgagctaaacaatggcccagttggcctcggtcatcaccgggggagcctagggtaatccaaagacaagatcttcaccagctggcctcggtcatcaccgggggagcctgggcaatccaatgacaagatcttcagtaggtcttgcattaagaggccaaagaaccaccaagcagcgacaagacaactcaaagccaaagtccctagcctacagcagaattgcaagcccctctttgaactataaaaggagagggagatgccacttagaggaggatgcacattatctagttcaagaatagttaaatcttgtattttctccatatcaagatagcaaaaaaaaaaaaaaacaaacacaggagtaggggattacaccttcgggtggcctgaacctatataatccgcgtgttcatttggattttcacagttcttaacaatttcagtcaatgcaacttcatctgtagttaaccccctggccgaatcttcactcggggagaggtctgcacctcccccactgttggttgatcgctcctccgacagtcatattgagataaataagtttatatagaaactaaaaatgtcaattaaaatcaagatttttatgtgtgatttctgttcaaaggactaattctaacctataataatttagcaaaaagaaattagaatggtagtaaaagatgctattttttatgagatatgagactatatattcaacatttttttattgtcatattagaaatttcgttggagagtagtttatattttctttgaactaaaacctcttaatagtatttctaatatacctaggaattggctttgtggtatcgattcaagaacaaagaaacttattttttttaggagcgtccacattatgtgggttcaatggttgtgtagaaatgatgtggtttttaataaatcttaaaaaaacttatggtgcaggtacttttaaaggcaacacactgattctagtttagggcattgtttcaaaagtgtgaacagaacaaggagctaatacatgttgcatgccaaaacttggaggttacagttatgcagattttcatcattttccgttggagatttacaaataaacttcaataattgtattatccttaagtgttagtgtatgttagtcaaactttttttggttgcctggattattgctctctttgagagaattatgtaacaagtgggtgtagcttctctgaagcaaatgccatattttattctattattaaagaaaaagaggtgcattacgtatgataaataaacaggagatcaaattaaaaacagaaaaaagagtttctttataccaccctcagcctctctgtgactttgcccctgatataggcttcttgcaaaatgctacatatacaaagtagcgtaacatgcatgtccaccactccattttattcgtaaggtcgaccacaaactagctttaatttattgctgacttgcaccaactttgaccatagtatcaacagatgggtcagtcgaatcaatcaaacagctagaggctgctcaagaaacgggtagtccgtgtagcccaccacaggatcaggcgtgtagaaggtgctcctgtcatacgcgttcagagccgccttctgcctgaacctctccggcaggtcggggttggccaggaacaatctcccgtacgacaccaggtcggcgtagccgtcgccgaccgccttgtccccttcctcccggtcgtaccctccgttcacaatgaacgtgccgtggaacgcccttctgaacgggagcaggcggtgcgggacgttgcggcgcgcgcggtgctcctcgatgctgctcacgcatgcacctcggctcgatcacgtggcagtagaggacgccgaggccgttcatgacgccgatcaggtgcagcgcgacctcctccgggtcggtgccttcctcgcggcagtggtccgcgaacggggagaggcgcacgccgacgcggtcggcgccgatctcctctgcgacggcggacatggcatccacggtgatgcggcagcggttctccacgctgccgccgtactcgtcggtgcggtcgtttacgctagccttcatgaactggtgaagcaggtgcccgttggccgcatggatctccacgccgtcgaaaccttcgtcaaagcgtaagactaacggtatcaataacttggtaagatctctagtagttagatggtgaaatattaccagctttgatggcatttctagcggccacacggaagtcctcgacgatctggactatctcccctgtttccagcctttgaggtgccgccggtgccaggtcatcggtatttccaaaatagctgacttgaggtgttactggattatctgtgtttgaattcggggcatgaagggaagtttatgtgaaacaataagagcatatataccgtaaaatgttctctttccaatactcccttcctagagaaaaaaaagagttgtaataaagaattaaacatgttaagtatacccgttgaaaacacgcgaccgttgtgccagatttggcagaagaagagtgcgcccttggcgtgcacggcatcaacgatcggccgccaggcctcgatttgctcctggttccaaagtccaggcgcgtctagggacgacggaagcgtgtagtggctttcttcagcaccaccagcattcccgctctcgtttaggcgtgacatgaaccaccattttgacaggttattccggtcatttacccctgattcagttgctttgacaccatctgtagctgaattatagtctgttaagttcgtgccgaaaagaaagccagggggacctggacgctggcggtggattggaccgttcgcagcgtcgtccttggatcgtcccaacgcagcgtaggagactgcgctggcctctgcaatgaggagggcgcccggcgtcgccctctgcgcgtagtagaggagattgtgtggctggggcatgctcccatatgatctgaaccttgataccggtgcatgtacaatcctgtaaccaccgccgtaagtttccgtaatgaattttagtaattttttcacggatttgctagaaaacttcccccaacagcctgtttggcaagagaagggaagatgaatgggagtttcaaggagggagttggtggtatgattggttatgggagttacatttttagttcccatcccttgtttgcgctgtgtttagttcagcgcaaagtttgggttttgattgaaattgaagatgatgtgactgaaaaattgtgtgtgtatgacaggttgatgtgatgaaaaaagactgaaatttagatctaaactttgaatctaaacacagccttagtcgaatcccaccaagtttcacgaattaataggcctcccccaggtaagagatttgtaggaattggacctcttaattccccatctcaaacactctcaaatcccaagtcttccaaccaaactacaaccaaactacagacttaaacttccagatatcataaactcccattccccatcaccatctccctccaaccaaacaggctgcaagttcttttcccccaaaaacactcagatttgtgaccatcgtatcacctcgagatttgtgcacgaatgaaaaaaattgctagaaagaaaatttcacacatatcacatgtcccagtgctagctaatcaaaccatagttgaatggaagttttatataagttatattatggttgcaacgcagttacattgcagtcataatgtaattataatgtaattgcactttaattatactgtagttacatataaaagtttctgcctcaaaaaatttgctgcatttatttttacatactcccaatttcagagcttgtaaaagtacatttcttaaaagaaaaattgtgcaaaagtacaatcacgtgtcccgtatatatgaaagtaacacattgtttgtaccaaagaaaagacatctcaactttcaggaaattttataggtggggtggaccgtggacgaactaatcaagttctttacttgagagtaactagttcataactgacctgtgtgccaggttgagctggcccatcttgtagggtgtcaggagatgagtgtcctccatgtgtgtttgtatgcttttgacagcccgatctatataacgcacctctgttcctttcgaggctatttcggctcgcttctacatcttctagcttggcatcttgagtacttatagtggaagaagaggtgtagttaattagtcatatcaaattacgaatcgtatatatgcatgttaatggctatgtgcttttctggtagcactcaacacgtactgcttaacaaccggagcgcgcgagccgcgaggattcgtattgatccggcagagttgacttgggaatgagaggattcgtgttgatctggctgttgacttcggagttgggaggggtttgcacgctatatacatcggtagtagctagacgctagatgcatggagtacgctagctagctagccccgacgccgcaccggcgattacacgaacccttttgtttctgtgtttgttttagtcccagaccatgaaatctatctattatattaatggaattaaaaaataagaaatattagaagagaagactaaagtccatatagaaatacaattagaaaataactgaaatttagaattaaaaataaggaacattagaagtttagaagtagagtatagagttcatatagaaatacaattaggaaataatagaaatttgaaattaaaaataaggaatattagaagtagactatagagtccatatacaaatacaattaagaaaaaaatagaaattcggaagtaaaaaataaggaatattagaagtagagtatagagtccatataggaatttaaaactaactaaaattcagattaaacataataaaatgaaaagtagtgtttagagtccgtataaaaatacaatttacaaataactaaaattcgaaatttagaaaaacatgggaataagagtttaaaatcaatataggaatacaatttagaagtaactgaaatttaaaatttaaaattaaagaatattttttttatcaagaggcgtgaaagcctctcatttccattactagaaatgatagagtttacaggaattttttttatttttaattttttttattaaaagttttacaaaaataattttccattttgaaaattgacataagtggtcgcctaccgccctctgggagggcgatttttaaaaatcgccatcccagagggcggcgaaagtgacgtggcagacggccgttcgctctcgggcgacggccgtcaacgaaatttgcaggcggcccccttgccgccctccgctagggcgattttgtactgtgcggggggccgcctgcaaatgggcggcggggggcctggaattttgcaggcggcccccttgccgccctgggggagggcgattttatactgtgctttatatttttgtataaatatcaatagttatcaaatctttttatattgaaaactatacaagattaaaatctccaagactggtaaaatacaattttattattttttagggcctatttggaatgttaccgtacaaatattttgttagtgccaaaatataagcaagttttggcactaccaaatatttggtaaggtaaaattgcatttgatcatatttggtttgctgccaaaatgtaaaattgtagtgaagaatgttctacataatctcaaatctagattacgtattaccaatgaataggcttcaatcgaaatcaaacacaagtactattcaaattaccaaaatattggtagggcatgtttttggtagcaatccaaataggcccttagtcttacgcatacaaaaaatcaccaccataattaaacattgtaatgataagatagataagaagtgccatcgatacacggtacaaatttgtcgatcccgacgaatcaagcatgcggtaacctatcggccccttctaggtcggtcagaatgcattgtattctcgtggtccttcaatcgttgatactctacttgtgtttctgactctgttatcttctggccatgatatgatggagtgacattgtcgatccatcgagtaaatccacccatccttggattgccctgtaaaaatagtaatgttattcagtttgggtagtaattttgtgcaaatcatagcggattttgtaaatggttagacatacaacgaaatcgttgtctacattggggcagacaaaatatctccttcgaaatgtttgttcagcaaaggatgtagccacatgccagcgatctctgcacccacactttggacgctcggaccatttaggtaaccctaatggattgttcctccagtctaagcttgcaatttccacccgacgttcgtactccatccaagcatgaatgaactgtatggtcggttcaggttgcgttatcggcccgccacttgaagtaactctgactgtgtcaatccattgtacgaattgacatttccttacatcctcctatgtacatccattttgggatagttaagttaatgatagtactgaggagtgatgaaaagaatagttgtaattaccacgaaatcatcgtcgacaatgtttggacacacgaaacacctttgtcctcgagttcggtgccttacggaccttatgacctgacaacggtcaccacaacgacactccggacgctcacgccacgtggggagtcctaggggatttacgtgccattctaaagcctcagcagcaattcgacgttcatgctcatccttccgccttaggtagtccgatcttgtttcactacgtgggtaagcacgggttccgtcgttttgtgggttctccatgtctacccactcgatgaagttgcacattggacgatatgtctgcgtaagatgttacaattgtgtacgaagaagttagtttttttatccatttgaacttcgaatagatgaagcataactgatcaaagttcgcgcattggaagaatctccggccccgagtttgtatcatgagggaagacttgagtatgcatccatccccacaatcgcacaaaggacggtcacaccatggtagaaaccaaccagcaaaaggatcgcttcgccagttgagacgctcaaggaatggcgcttccattttcgtgtgttgtgtgctagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgacaactcgagctgccgcttttcatgtgtgttgttatggactgtgcgcgctactggatctgacactaccgtgaagcgccgaaagtgtgttgttgtgagcataagttgttctagcaccatatgaatgaaaagaactatgtagacgagacaaacacaagtagtactgcagtagtaatagcaaaagtagtactgctttacaagtttgtaagccaaaagaaacggtcacataaggacagaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacacgcccgaagaggtggcgaacgcccctgcggagctcgcggaagcgccggtcgtgcctgcgaacgcgctcgaaggcagacgaggtcctgcgatgaagaaacgtgccgttaaaacatggtgacatattcgtgcaaaagctgaaacaaaaatgaactaatctctgggctgaactgtaccgtgcgaaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaacaggtaccgtaggtcgaggtgctgctccgacggtaggcgcgcgaggccgtggttgtaccggaccagctggaggtacgacgtccacggtgctgcgacaggagaagacgcgcatgaccgcacgcatcttctcctgcatccagtcgaaggtcaccctctgctcaacgtcagtcaagtgcaaacctctgttcaacctcacttggactgcggtgatatcggcactgatatcccgtgcggcatcagcctatgcaagatggaaataaaaaattcagtagttgtcctatattatgcaagataaatgaaataattgtaagaactaatacaaattcgacgtacccccacgaagtagtctcggtcacggtgcgtgggatacgcgtccgtcacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacaatccgaactcacgagtggtcggcagggaggacggtcggctgcacgttgcccggaaacacctgcctaagtccgaactgtctcatcacatgctgcgggcagtgaggctcaacgaaaatgtcgaacaccatcggcaggatggtgagccagtaagcctggtcgcgtgtgcacaacgacgaaagtcctagcggtgctctcgcagcgacggcctcttctgtgtacggctcccagatgacgtcgctcggctggagacggtcaaactcgaacacgaagtccgggtaacctcgtctcacctggacgtgagcgtaacgacgctgcaataaacatgatcggaattagacatgttatgtgaagaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctcttggctgcccaaagctgaagcaacatagggcagccagcgatgatcgctcccgcgtcagtcttcgtgcacggcagaaccccagctccactgcggcacgtcctgtggctgagcatccacgatggaccgtgcgtagtggaccagccggaagtccacagcgtgcccgtgggtgctagtgaacatcacccacccgaacaaccacaacaggtacgcctcaagggagcgtcggaccgagttatcatcagcgtcagggtgcagaaggtccgcctacaattaagaatgaaatgttagtacaaaacactatgttgatcgcaaataagcatgtatgataataacaacttatttacttacagtgaactggagcaaccaagccttgctaggcccgactgtagagtacggaggaagggtgttggccggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctgaggtctccagcggtctaccagagcggcaaggagtgaccggtctgcatcccaccgcttcgctgggtcacggtcgtccgccgccgcctcaacaagcttacaaagtggtagaaggcctgccgcacgcaacctgtatagaacaaacttcaaacataagtacaacataaagcaaagttgagttgaaatgtgaacatacgcgtaccaaggaacgtgacgggggtcgacacgcaaccacgcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattactaacacatattaaacaagagtacaaacaaacaaaagtgtcaccatacggaatatttctgattacaacaataactgcagttacacgatatgagtacttagtccgaacactcatcacgataacattatgatacaacaccgaatagttcgcaatactactagtacaacaatagtcagaggtactcattacaacaacattcaattgaaattacacgatagaagtatttagtccgaacactcatcacatcacaacagcattttatttcctaaatcgatagcattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatctggaatataaaaaacttgggcactcaacgttgtgtaagatcctgagatcccgaacccatatatctcctcactccatgtatgaaagattgcttctttcctgaaataatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaatttttttgtatcgatccctaaagtacgcttgcgtgccgtgaaggatgaattcaacaatagcaaccaatggaagtacccgaactcctcgcattacccagttgtacacctctgccaaattggttgtcattatgccataccgggatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacaga

SEQ ID NO: 60219 - DNA, 13300 bp, Oryza sativa
atcatactgcaaccaggttctttcttgattcctttctccattattatctgcctaatccgtcggacatctttccatctattagattttgcatacatgtttgacaacaagatgtacgctgtgctgttatctggatccaactcaaggagacgctccgctgccaattcacctatttctgaattaccataaaccctacaggatgccagcagggttccccaaatagtggagttgggcttcatgggcattttgtctattgtatccaatgcttcctttaatttcccagctcggcctaagacatcgattaagcatccgtaatgcaccacagtaggggaaatattatatgcctctgtcatgctgaggaagaactctcggcctttgtcaaccaagccagcatgagtgcaggcagtgagaacaccaacgaaggtcacctcatctggagtttgtaaagccctgagcattctatagaacatgtcaatagcctcctccccacggccattcactgcgagaccaagtataatggcagtccaggtaaacttatctctgttgtgcatatctttgaatacatccaatgcgcgctcaatgctcccacactttgagtacatgtctatgagtgcattcccgacaaaaacatccatcttgatcccaagtcttcccatgtaaatccttgcccattcccctgtctccagagcacctagctgggcacaggcagtgaccacactgaccatggtgaactcatctgctctcaccttgcaaatctgcatgtaacggaatgtctccaatgcgtccctgaacctgccaacctgtacatagccatcgatcatcgcggtccatgcgatggtgtctctttcaggcatatgatcaaacaggtccctggcacgatcaacctggcctgacctcacaaggccagaaattaccgacgtccaggacgccatgctcctcatctgcatgccctcgaacaacacccaggccgcgtccatgtcgccgcactcggcgtacatatcaaccagagcgttctccaccctctgatcaggcaacaccccgctctcgaggacgcgcttgtgcacctgcatccccagcagcaggtccttccctttcccgcaagccgagagcaccgagacgtaggtgaccgcggtggccatggcgctggctctgaccatgtccacgaaggagcagcaggacagctcgaaccgcccgctcctgttatggccagagatgagcgcgttccacatgaccggcgctccccctcccgtggcgaggcacgccgcctccagcaccgcgcgcgccgcggcgccgtctcccctggccgcgtacatgacgatcagggagctcgccgcgtgagcgttcgactccatcccgaacttaaccacgtgcgcgtggatggcaccgccaactgatgccgccgccacggccgcgccccgcgccgccgccgccgccttgagcaaggacgggaacgtgtacgcgtcgggcctggccccgccagccagcatgcggacgtatcccgcaacagcctcctccgcgccatggccggacacggacgaactcgcagcacgcccccgccggtggggaattccgtcgagcaggctgcgggcacgtgacagggcgcggaccatccgcctcacctcctctcctcaggcctcccccacgcggtccccgccattctattgacggaataaccgccggcggttaccgcgccgcctccccgcggaatcccggggaagacgaaatttccgcggcgagacagcgggccggcggcgagtgcttcgccttctcttagtcgctcggtgtttttttttctttttttttctgaagccaaaggcacggtaaagcatcaggtaaaataatgaaaaatatttttattattatacggttattattcaatttgtactagtatacgacgggtatacgtacatgtacagatgtacaggtataatgaaggatttttgttgtatctagcaacgtcgatgtcaccgtacatatgtacgcacatgtattattgtacgtatacgcacgaataggacccggaggtgcagagagatttttcttttcagataatagagagaattttgtttgtcacctttacgccatgtttgtttggagtcctcgttaattgctctggaatgtaaacaatatatggtacacggatattaattgcattctgttttgagttctcataaaagaacaaaggtcttctgtttttttttctctttgttaatctctttgccgttttgcaggcaaagttggttgttttcatccctttttccatcttcgtctaattcaggtagagcccttgcttattttcttagaaaacatggtaatatggtgcttcggattgtatcttcacatctttagaataaaagccagcgtttgtttcttgcgataattgaatccatgtcattacaactttacctaattaaaaaatatcaccactgttcatgatatcgattgggtgccatcaatattttttgaaatttgaatcatgtcatcatcgtcacgttttccgtccttttttatacatataaatgaattaaatatactaataaaattgaaaatatatgcttctagaaaaagtatgtttaggagcttgaaaaacgtgcctattcattctattgatcgagatcgagtgcaaaggaagaggatatgatgttgtactcatatttatatccatgaaaaatggtaagagtctcgggcagtgtttagtttccttcaaactttcgaaaattccgtcacatcaaatatttagacacatatatggagcattaaatgtggataaaaagaaaaaccaattgcatagtttgcatgtaaattgtaagacgaatcttttgggtctaattacgctattatttaacaatgtagtgctacagtaaatatttgttaatgatagattaattaggcttaacaaatttgtctcgcggtttacaggcagtctttgtaatttgttttattattagtctacgtttaatactttaaatgtgtgtctgtatattttaaaaaaattggcacacgaactaaacctgggctcaatttaaggaaaaaatgtgcacttgaaataatgatgaggctaactttgggttcgttgaagacatgacatgacagcaatttttgtaacctcttcacgtgagctataaactgaattacaatgactaacctagatgctactactagtacatctcagcaaaaaggactaataataacctattgatggctagagaaacttttaacaacgttcgtgctacataggcaagcttaacttgcgttgcacttgtacggatataatgcgcacacatgtatataggtatagttctaaaaagaaaaaagtaaagttggtatgcaatgcactgtatatggccaacgatgctcgtggtccattcgaccatatgggctttggtcccataaaaacgtagtactacattttattgaattcattatcaaatacattttgatagtatatttgtttagtgtcggaaataatgcttagattttttgtaaatttaatcatactttaaaaagctgacttaggaaaaacttatttaaaaaccttattatatgaaactgatgtagtaatggtcaaagtcacctattcttagtcgaaaggatatttccgctcacttggtttatcaattaagcttttgcaaagtcaaggtaaatacacatacaacatatatgcatgacaccatgtacaaccatatatagatgaacaggagtatacatacctacgttgcttaggtagcaccttgatttaatcaaatgctagctagttgatgccaggtggcacactgcggacggatttgtttgtcagtttccctgcattacacattgtacaggagtgtactacatccacatacaatgaacagtagtagtagcagcagctatatactccagttgcctagtcgtacacaaagtataattaatcacaaaattttcattttatcatggaaaataagtaggcattcataatgcacgtacactccgcacccatacaatgaacagtagtagtagctactagatagttgcctagttgtacacgcagcataattaatcacaagattttcatttttcctaaaaaaaaacaagcagacgtataatgcgcgcacactcatcctacctttaatgagtatcttcagaagattgagcctgttgtcgtcgagaggtacagggtatgtcatctatcactcaaagaataactagtcgtaaatacgagtaccgggttgctgtcaaggggtataggttacgttggctatctcttaaagaataatttgccgtaaatgcgaataccatcaagcctaagacttgcatccatataggctagttacaccacaaaacctaacgtgttaagctacgctccctccacacaaaattttcatttttacccagcaaaaataaatgaatactgaagcatgcagcgctgtacacgagcttcttgtttatcattgcgtatttgtcatcatctaaaaaaaattgcgtatttgtacgcgtacatgcacgtttccatccacaatttcacatccatacgcgggtgacatatattatgcagctctcgtgggcatagctcgccagccaagaacgagctgaagctctcgtgcgcggcgcggccatgaaggcgtcgtcgtcgtcgcaggggcagagcccgaggacgccgtcgccgcgcgccacctccgccaccgccgagcacacgcggtcctcctcggagccgtggctcgtggcggcggcggtggcgagcacctgcgacgactcgtgcgtcaacgacgtcgagaacttcgcgcgcaccgtcgccgccgccaagtctaggcagctggtgggctcgtcggcggcgtcgcgccccgacatgctcgcgtccgtgctgtcccactacgccgccaagtggctccccgacgtggtggccgcgtcgtcgtcgtcctcgtcgccggcgacgtcggcgtcggggcggttcctgcccccggagagccccaccgccacgtggctcaagaagcggctcctcctggagtccctcgtcgccgcgctcccgcctgacccgccggctcccgccggcggcggaggagcggccgacgacggcatcacgtgcgacttcctgctcaagctgctccgggcggggagcatggtgggcgccgacgcggcgctgctgcaggagctggagtccagggcggcgcggcggctggaccaggcgacgctgggcgccgtgatgataccggcgttcgggcacgggtacgcgtgcgggacgctgctcgacgtgccgctggtgctgcgcctggtgcgcggcttcctcaaggacgccggcgccggcgggggcggcgccgccaaggcaggcggtggcggaggcgccgccgccgcgagggtggcgaggctggtcgacgcctacctcgccgaggcggcgctcgaggccgggctgcggccggccgagttcgaggagctcgcgcgcgccgtgcccgcgcacgcgcgccccgccgacgacgcgctctaccgcgccgtcgatacctacctcaaggtcacccacacgtactcctccttccatctccactaattttacgtttccgtttactactaaaaaaaaaagctaccaatgtagctttgcatattgtgtctcgatataccgataaggtcttttttacaccttatggacaaatttgatgtcgcaatcttttcggtttcaaaaaattgatatcaccatcttctacatatcgtcaaaacaattgtgaattattttgggaccagctagctacattttaatattcatggcgttacaatttaagaaaaaattgtcaaaattttattacactgtaaattacatatacttacattataacatttttaaaacctacactgtaatttaaatttgcagtacacgtacaatataataataataataataataataataataataataataataataataataataataataataataataataataataataataataataataataataataacaacaacaacaacaacaacaacaacaataacaataacctacctagaactaaaatgggataggagagagaaacatattgaaagtagccgtaaaaaatatggtgtcataattttagcaaacacgaattatttcattcagaatattttataactatgtaactaatatgcacaacatttagtaaaaagaaggttttgaatttttttactcgcaaaatagaatattttgatttgactgttatggtgaaattcttgtttttctttcacaagaaattaaattccagctgacatggtagctagtggtgtgttgggtttgcactagtagcagctagcatatgcaaagtatgcaaccatgcaaatgtgttggccgatgtgccaacgttggatgcatcatgcatgttcaatataaatgtactgaaccaaatggggagttttgttctttggtcaatcgccacgagacagcctgaaaatttgtgaggcgtctactgcatctgtttttgtgtttgaccactgaaattgcatcggacaatgcactaacagcatagcatattctacatactccgtttggtagtacgggtgctcacttttctctgtcgaagagaatcttgtgtgtcatctactcactaaacatccttttggttttttgcaagtataagtataaagtttagtgtagggtgcacaatcaaaataaaccaattagatataggcttggaactttggaagaaacaaaatttgtgtaatattgtatatcaacaggaggagaatcaggacaactgataagacctgttattttctcccttgggtttgttttgtcttgttagcttgtgaactgaatgattgatatcagtagttgcttctcccacttcactaatatataaaactaaaatagctcattaaggccattaagatccttctttgtgtttgttctgttggtgtttactgtagtgtccaaactataaagttactaatatctgaagattgttcagccaaatcacttgtagtttttttttctgaaaaaaaaataaatcgtaactcggagtacttctatgaagtagggtaagaacaaagcgtagggaagagatcacgtgagctccaaactgctaaagaacaaaggtttacctgtatttacacatgggaataggtgctttgtggatatcaaatccttcttgtcccttagcttgctgcctgctgttctcatcaacacttgtgctttgtcctggtgcgagtgactaacaagcagttttactgtagctgcgcgtttcaacaaacaaaaaaaaccacatttgtacttaattatttttagttgtttcattcaattttatcaaccgagcaaacgagtgtccaaagagtactaagagagaagatcatactcctaggcctggtttagattcaaagtttgaacccaaatatgtcacatcgaacttttctacacacacaaactttcaactttttttcgtcacatcgtttcaatttcaatgaaacttccgattttgacgtgtaactaaacacaccttagtactctaaaaacgtgtggatgattgaaattgccagataaacatgcaagtatcagagatcttgcaggcatgaacagtcatgcaggtggtacttattaacagtctttaacaaccatcgtaccagactactgtataacagagccaggagattcatctttcaatttcatggctctacatgtcaggacttgacagtgctgagagtttcagatccaaatgacaccaaacaaaaatcatgtggaattctgtttctgctgttctctgcgcttttacagatcccctgttcatcagaaatgccagcaactcagcattgttgctgctgtctgcaaatgaaagattctcaatgtcaaaaccaatcatatgttaggcagttaggccatgcaagttcatgccaatggcactatgccaaatatcaagatgccatcttttgttcagttctgttcttcaaaattttttgtctagaataaatttacactttgttgagcaaaaagtgctgtgaaatcatgggagaaatgatttttcaagtgcaaaaaatattttttaaaaagaaaaaaaggccgtttgtggttcgctgttggcgccacttgttttgggggccttttgggagtataggattttaaacccctcaacctccctagcgataggagtttttccctcttagtagctagtactccctccgtattttaatgtataacgctgttgactttttgaccaacgtttgaccactcgtcttattcaaaatttttatgcaaatataaaaatacttatgtcttgcttaaagaatatttgatgataaatcaagtcacaataaaataaattataattacataaattttttgaataaaacgaaaggtcaaacgtttataaaaaagacaacgacgtcatacattaaaatacggaaggagtaacatttttgtttgttacttgttttcggttcttctatccttgtccactgacaacagccttctgctgcttgtgttgtgtaattaaactttacttttcttcttcttctattttacttttcttcttcttctattatattgatatgtaatcattttgcgcattagtgaaaaaagaaaaataatctatctattatattattaaaacagtcttgaaaggaggcaccacgttcgctgtggaagctagaaattctcacattaatcggagaaaaagaaaaggagagtccaagtagaaatacaattcaaaaatagctgaaattcggaattaaaaataagcgatattgaaagatgtgtccatataagaacccaatacaaaattaatcaaaattcgaaataaaaataaaataaaatccgaaattagaaaataaaataaaagttcaagtaggaatacaatttaaaattaactgaaattcggaattaaaaataaggaacattgagagaagagtacatataagaacccaatacgagattagttaatattcggaataaaaataaaaataaaatccgaaattagcaaaaagaaaataagagttcaagtaggaatacaatttaaaattaactgaaattcggaattaaaaataagcaatattaaaagaaggatccatataataacccaatacgagattaattaaaattcagaataaagaaataaaataatatccaaaattagaaaaactaaaagagagttcaagtaagaatacaattttgaaacaactaaaattcaaaaataaaaaataaaaatattaaaagaatgctatatggtattaaataatttttttaaaaaataaattctaaaataagaaaaataaaaaatatttcaattaggaatacaatttataaataactaaaattggtgataaaaataaagactattgaaaaaaaagaccatataaaacatacgatgagataaattaagtaacaagcctataaaagagtagagtggtggcggttgatacgacatataaaaactattagtaaaacaccaaatagaatcttaataatgattaaaaggagggatgataggcaggccatgaagcaaacgtgtaagatggttgccggacttctagaaagtgaaaaaaaaaccccattgataatcatattcgattttcaaaatctcaatgacaataaaaaagagaagcagcgggcatgatgtataggattatagttccagagccaccgatggttggcgggacttctagaaaataaaaaatgaattgaaacgatagttatgttcgaatttcagaatcccaataacaataaagagtaggcggcgaatgggtcgtagaggagtatagtggcatcatttgacgtcacttctaaaaattataattaaaaaatgaaacccaacaagacaataaattgtaaaaactacaaggtccaatttttaaaggttcggaacttctaaaaagtaaaaaaaaaaacccaatgataatcatgtataattttaaaatctcaatgagaataaagaagggagacaccgggtgagccataaaggagtacaatggcaaagccactgacggtttggcgggacttatagaaagtaaaaaaataaacttgaacgataattatgttcgatttgtaaaattctaatgacaataaagagaaaagacagtggatgggccgtaaaggagtataatggcagcgtttgatgggacttccagaaattataaaaacgaaacccaacgagataataaactcaaaaaactataagatctaatttttaaaggtttcaagaagaataaatagaaatagtggtagaccgagcaagcaaataaaaaaggatatgacagaagtaacgggtagcagctggtataacttttaaaagctacgtaattagaaatatggggatgatacgtggatagctatttaataaattttaagtgaaatcatactgaaaaatatatgattttgtttgggtgctagccgcgcaattatgcgggccacccaactagttttaagaaagagctaattttttttggctgtttcatggtgagcaggcacacgcgagcacgagcaaggaggagaggaagtcgctgtgccggctgatcgacgcgcggaagctgacggcggaggcggcggcgcacgccgtccagaacgaccgcctccccgtgcgctccgtgctgcaggtgctcttctccgagcacggcaagctcaaccgcctcgccgagctcagcggcggtgcctcctccttcggcgcgcccagcccggcgtttgacctccccggcgcccgctgcccctccaagcgcgaggtgctcgcccagcaccacgagctccgccgcctccgcgaggacttcgcccgcctccaggtacggccatctccgccgccgctcgccgccgttcatcgattcgattcaaagctttttgaggtgttcgtcctcgtcttcgtcgcgacgtgcaggtccagtgcagcgcgctgcaggctcaggtggacaggctgagcacggagaggaggcggcgcggcggaggcggcagcggtggcggcggcgggttcttcaagtggagcacgttctggttcggcggcatgagcgccgacgtcgcgcgggtggaggactccgagagcggcatcgagcggcggacgccggcgagcgggaagaagggcaggggcggcgccgccggcgccgccgccgcgacgccgacgccgaaatggcgcaagtcgatgtcatgagaggatctgaaattctgaagccaaagctgatggctaagtgggtcgttaatctgttttactacctttaattacagtcagttacctttctgtctgaactattgtttgtggtgaaaccattcagataaatctgctcacttgagtgcataaataaatctgtgatgttctaaaaagagagggaagcatataagatttctggtttggtcgaggacgaaatggacttaagaatttagtttctcttcataaataaatcaacaaatagttgtacaacgccagtatgatcacataatagtgaccatgaacagtaaatgtctgtctcactagttgcagaaggaactctgcaaagctatgtatgcctcacttgagtactaacttattcagctacagaaaacaaaactagcaatttgacacgaatttaaacacacagatttgaagaataaacaggttgaaatgtgctgcatcatggtgcaaagaattgtttatttgttcactgctttcttgatggcttgcttgcacctggtgaggaacttgctgctgcttgtggacactgaatcttcatagccgtatctgccattgtcgtcgccgaccaccttgggcttcctgctcatgcactccacaccccttctcattccaaggatcttggaaggtgaggaaggcagagacctgaaacccctggagctgtcagaccttgggaaccagatcttcttctcctctcccctctccttgatctcaaagctgttcctgcacctgtcctgctgctcagtagcaccatcgccaccgacctcgacgatctcatcggagcattcggtgatctcattcctgcagctctcatcatcaattctgctttgcatttggtgctcgtctgaagcgatttcatcagcagtgttgtgatcttcagaagaatgatatgctgctgcaggatcttcttgctgctgctgatcctccatgagcatttgaagccacttatccacagttcctttgccggtgtggttcatgtttgcgtcgccttcggatcgaccgacgccttgccgatgaatcacattattctttttcaatagcaccgatttctctgcaggatatctaggtgttccatacatgccagttactctgtaaggaggacttggaggaactgaggatgtccttggcactgaaactgtctgagatctttcagtctcagactcacattgcaccatggctgctttgcccttgccattgccatctcttgacctcacaggagtgctagttgcccttgatccccttgatgacatggtcctttctctccttctgccgcgctgccgttctttgatcgccagatgctccagcttctccctcactgatgctcttcctctctcagtgtcaactgtgttgtcttccatggacctccttgggaagtttatcaccttgaaaggtgaattcctgaaatttcccattgttgaagtttcacctgcaatttcctcttcctctagggagatgtatgcatctgaagccctctggtcctcctccaggaaaaccctcagctcctgcttgagagggtttctgctcctcagtcttattcctggaaaatacttcaccctttcactgtgcctttcttctaagctgtgcctttcctctagcaatccatcatcgtcaacacgataccgcttccttgcttgatcggtgaaaggcttgatctgcttctccagttcatccttctgctggtacttcctccggagctcggtttcggatgagtcacacattgctctctgggcctcgagtctcgccatgagagtgctcgttgcagcttggttcatcctaagctgctccttgtacacaacagacctgcacattttgcaccacaatcaacaattagcacaaacaatcgacattgaaatcaactgcatgagagttcttggctcttgctgcatagattcatccttactggtgcatggcgtctctgatcatcttctccagcacagccttgtaattcgactgagcctccgccaagcggcggcacttctcgacgcgccgccgcctcttgatgaggagggcctccatgtcctggatggccacccgctcctcttcattcttctgcttcagctcagtggcctcgttctccagctcagtgagctcagcttgcttcttcttggcctcttccctttgcctcagcgagtccctagccgttgcaatggacaggtaagggttgctaatgtagccatcagcatccggattattgttctccttagtcgaat

SEQ ID NO: 60220 - DNA, 54967 bp, Oryza sativa
aatcccttatattatgggacggagggagtatagaatttggttctttgatacggtttttgatttgagaaccacctccttgtaggattggttagtctatcatgggatgatctcatgaactttggtgggatggccccatcctataatttgtattgcctatgcatacgtgcttatgaggggtggatggattttaggtggtgatggaccaacaagatcccatttcacaaaccaaacaatcttgtttggttccaacatgcattcatttagtgtggtttgataggctttcccaccttgttgagctgtggacactataaatcagcggttttgtttatgttagccacgtggaaatgacttgagttgtaatcaatgccatggaaaccattcgttttcatttactaagatatactgatcattaccatcgcttattaatgctcattggatgcaactttttttttgatataaccatgtttctgtaggcgaatggcgaagcgacggttgtgagtaattagcccaaatattcctctgggttaagttaataaaagttttggatgccagcccaattttgtgctaggtggagattagttgttgtaatgttcgatttcgccgacttaacctgtcagagatgtaaacagaaagtgttcaatctcatcatacttgcaataaagaatttgcatgcataactgcgcagttgcttgatgatcatgatgagttttaaggaaacaatacacatcaagctatgatcaggtggtttcatgttcatcattcgtaatggaaccaatatctgtgattggcaatgatacatcattgtaatattcagctgcttatgctctactcctttccattgtacttcatgtcagtctggagaagaaaggtgtacgtgattgctggacgtttgacctatgaatgttcaagtccattcagagaattattatataaagctctggtttatgcctaagtttgcagcttaaaatggaactttatcaggcaaggatgctctgtctcaggatctgtactctatgagtatgatcttttgataacgtggcagtttgaatcactcgatgtttttctcttttgggttgggcaaggatgtaacctaagatttcttagttgactacggttgttatcggatcactaagcttctctaatacttccttcattccaaaataaattattttttcacctatctcacacatcaacacaaaacttaaaagataagaatacttttactttatcaaatctcaatatagatattcttcactttatttatttttaatataattatttcttattttcacaaactctgatacatttacttaaaaaatgagtttattttaggataaatgaggagtcaaaaataaatttattataagatggggggagtaggttctagctggttgaaaactgtatcgatcagttgattccaaaggattagactgcctctattaaccctctggacggtctatgaaaactgtaatgaccagttgatgcaacaaatcatgtggtatttgagcttttatatgctggactagcagcagaaactgacaaaagtagttaaatgctaaaagtaaccggtggtgttcgaaactggtgagatgaagattaagtagatgcaaataaaataagaaagttattagtacatgattaattaaattaaattatcataaatttgataaatggatatatttgatattttaaagcaacttctgtataaaaaattttcgcacggaaaacaccatttagtagtttgaaaaacgtgctaattgaaattggggtaaaatccgaatcttaataagaaaagaatattgtttaaatatagataaaataattgaaaccatcaatgatgaccagtattgcatactgacgtaatcacatgcatttatattttacatgaaccgtcgaggtaccggttgtattcacgtcgtgttcatcgtcagaactcgccgttgtagtttctctctctatcgggaccacgtcattatcggtcacgttcttgctgttatgattttcttcgttgccaatatccatcatctatggacgagtcacatcgtgggacacatcctaccatcttacttactattattggttcaccgaagcaccagcatccatcttccctcctttttgtttctcgcttttggctaggaaagacgatgaacaatgcctgttgggtgctattgcttctttgtccaacctaaccatgctcctgaatcactcacataatattgaaaccatagtaatatgaatataataggaaaattctaatttatgttaatgaaacgggcacccgttcggaattaatggatcaaattttcatctatgagttaaagtaagctttttcaatttctagctaatttcatttgttttttcatttacaattttagttttagcactatttgatccactaaaaattatttttaacttataatttttctctgtattgaattatttatagctaaatgaaaaaaggggatttagttatataattgttttaatattaaattatcattccgaccaaacttatttgtggtttcatgtcgttatttttttattatatttctttcatcatttatgccgaattatgatatatgattttaatttatgtcaatgaaagttatctagaatctattacaatacacaaacgttatgctagtacatataaatattatatgtacgtatatgcaattttgctgtatatttatcaacaaattttctcctaaaaatttgacggatgtaattacagtacaatcgtaatgtaactagtatgtaactacaatgcaacttgtatgtaacttttacataattttgaaccgttagatttgtttcaagatttgtgcaactaaagaaggaaaaatgtcattgcgcgcatatatgcaagaggattcgttcccacgacctcttcaccgaaatagcatgttacgaagaaatttttgaaagtgatatacaagttacatataagatacggtgtaattagatcatgattatactataattatatttgtcaaatttttagaaaatttgacgaacaatgccccacgacacgcggtgtccgcgtcatcttccggaacggcaaaaatatagtcctatcacttttccggcggcaaccccaatttggcaactcccgagtctccgacacaatgccaaattgcttaatttcccttgcccggccggctgctcccacactcccacactcccaccttaccaacccacgccaccctgctacgcccaccgccacagccgccacacccaaacccaacacacctcccgacccgacccgccccgccccccacctcacacttcaccatcagtactctggcactctgccactgccgatctcgctcgcgcgagcattcacgtcgtcgctaccgaaggaggaggaggaggagatgacgctcctgtgcgtgccgctggtggcccgcacggtggaggcgatgcgggccgacgcggccgcggccgctgccgccggcgccgacctcgtcgagatccggctcgacttcatcggcagcaagttccgcccgcgggaggatctcccgcgcctgctccgcggctgcccgctccccgccatcgtcacctacaggtcagaaccccggccctctcccgctcttgctaccctaccgtacgtcgtgctctctcaggcagctaccgcgcaccgcgcgctggactggtttgatacaggatttgcgtccatttagcgcgtgttcatatgcacagcttgcaagttgcaacgtttcgagtgtttcagcttaccatgcatgattattcctgctttgctttgcttttggggttgtatacatttttcgggatggattttgggcgctccctgtttttttcccttttcttttgaatttttagcacagattatttactcaatgcttttaaaagtgtgatttctctaatgcttttaattagtacttatgcggctagactgcgttcgtttgaaacgattgggatctttttcctttcccacgtaaaccacataaaccggaacagtgtatgattaattaggtattggtttaaaatatattaatatgattttgtaagcaacttttacgtagaatttttttaagaaaataacatttaccacctcgtaaaaagtttgcgtggaaaataagaaagtagtagttaaaaaaagtgaagcgaaacatacctgatgaaccctgagttcatctcgacactcaaggctgttgttggcccgatctttcggtgagttgtgataactacgatttgggagaaacgttgacgatccgactacaactgtacaaaaccgttgcgttgcgccttagcgatcgatacacctctccgtgggttgttgatcttgccggtgcagatcaaccttattcctgcaagctatcgagaacaagcaagaacaagatataaagcaactgaattgctagatagacaagacgcacaaagataaattgatacacgataaagtggggttccgaacaagcagacggacggtctagccgacacgcgcgctgcaagcgaagtagcaatggctaaacttacaattaatcaaaacccgcgaaactctgaaggggtacctaactatttaaagagataggaggacgaccaagggcactctagggtcgtgctccacctggttggggcgcaccccacttgggccccacttgggccagggtcccaaacgaagttacaagcccaaaggcccatgacaggtgacgcagcaccttgtttgttcatccgcggatgactaggatggaatttggcgatgaggctggatccattggaaagaggactccgtaggctttccatcaagtactcacgggccaaaaacggaggtcgtatgcagattcggcggccgtttgaaatcaacagtgcagcaggtggccgaatcggattccagcacttggagaccttgatcttgatgtcttcttgttcacgcattatgtgagcaatggttgtatccgtagtagccatggtcacatcagtacccgaggaagatccaagctttttctaactatttctttaggcggtgcagagaggatacgacaagaaaaataaaacggcaacttgactaaagagtgaacaattttattccttaatgctggccatatacatattataagagtcacgagctccctcaggaatcaaacactttgtagtttgtactctagtatttcctatactcactccgtcactcgtcaatacaatataggttaattcttcatgagacttgatatagtttttagtactgcgatttgtttcaacaagatgagtttgcgccaaggtacgatgccgtcgatgcgtactagatacatataaagatttcgcctgcttttctaccacatccagaagttgaatttagaagagtttgattttgaagtcattttatgaaaacaattttttaatataggctttcaaaccgctaataaaaatattaaaccatatttttgtttgcttcttttcacgtacatgtcagctgtggttttgaacaatcaaagtcgtatgtacccctgcattcttaaaaaatcaattctaattataaacctagatatatgcgtgtcaggtttgtatatagggttttatcttcttttagaacagactagtaggcacaaataatctaagcgaacaactagcatgtattttatttacagtacgtgacacttctgctctatccgctattagtagtacttttttttttagaactggtattagtactatttctactttttttttttcgcattgcatgtttcacatgtgcacaggcagttgtggcagtcagagtgtgttgggacttgggagagttgtactgggagggaggcagtgtcaagtgaggctatgcgatctgcgatactataagcttgtatatgttcggttgttcactttatcatcattttaactttgctaaattttgataggggtaataatctaaaacaaaatcttagcaatatcattctaccaaaaattagtatactataatagtacggacatgctgttgttatctctgccatgggagtacctatacatctttcgaaagatttttataatcgtatcacacagatttttaatctttgtattaaaatctgatagatataataaaaagcaaaaagcaattaagaaacaccataatgaacattaaattaccatatcctcaagaaaaagaccaaatcaaatataaaatttaaaatttacatgtgaagattcaaaaattacagtgtaacttacaaaagttacagtgtaagtttcataaattacactataacttacaagaaaatgcactgtaaatttgagtgagaaaatcgagtgagagataagaaaaaatctttcgagtgagatatagcaaaatcgctctgccattgctttttaattgcacggttagttttttcatggcgtgttttgattgcgggggcaggaaggcccatatcaggcccaaattcattcagtctggcggtcatgaagttctgaagctacgggaatggcgacgaactaatcgtgagatagataattctgccgattcctgtcgcatatgcttcccgaagaacaacgagcacatgctttgttgcgatcaaagagaagaaatactgcatatgcgtatggtgctatagcttcatgatcaaacttgtatctacgaggcaacggcgttaaaaattaaaaatcaaatgggatagtagataagatatacaattcgtgatactcgaggtaacaaggctaattatttatctggtcaagatagagagttctccggttggtccatgcgcagtagaaagagagagcgaagcaaacactcaaacagcagctacactgctacagtgctacagcaggcggcaataagggaaaaaactggaggcgacacgtccgaatcggacgaccacgtcatcatgacgtcatcctgcatacataagtgaactttaaactatttttttctcttaaattatttatccaaatcatgatccgattgcaccattaaatttattgcaattaaatctttaaaacaagaccacacatgaatataatccgatgaacttttttaagcttattattgaattatttttaataaatgttgcacgctgttgcactaagtatatggaattgttttactaagtagatcgaaaatgtttcatcggacgctgtttcaccttatatgaaaacaatgtttcagcgaatagcgaaatgatgtttcaattcactgcaacatttgattcatacatagtgaaacaataagtaaattacgtgaacttttttgtggaaaaaaatgaaatggattcccttaatagagggtttctataatatgtgggtaatttgttacaaaagaattgtttcaattcactgcaacatttgatccatacatagtgaaacattatgagtacattatagagggtttccataatatgtgggtgatttgttgcaacggcgtgtatggtggggacacgtggcgggagcagcgcggggacatgtggcgggtagggcgcgcgcgcgggagggcatgacgtgtggcgcccgattttactccccacgtcgagcgcccgattctaggcattcctaaaaagaaataataaaaaaaaggagtacacttattcggatttgtaacataacgatatctagggatgaaaatggggcgggtatattccaaccgcccgccctacccgaggctcacaggaggaatatgggagaaaaaatgggatacccaatactatccaagttcgaatccgaattcgttagaaaatatgggttaggatacgggaaaacatgtatccgcccgcataccccatattataaaatatatatgaaaatctattataaatccacttacaaacatgataaaagattggttaatcactattttttatgagctcacatgtaatattgcataatttttctcttgatgtatctcttttaatactttaattaccttattatgtttaatatctatgaattagagatacaaatagatatccgtttccgaatccgatttgatgaaaataatatgggatagaatacgagatgagtgatatattatccgtcactaaccgtacccgactccgagtttaaagaaaaatatgggttaggatatgggaatgccataatccgaccgtatccgcccgttttcacccctgtcgatatccaatcttagattgctgtattttgagacgaagaaagcagctcaggttctcttatcctgttttgccaccatgctcacgcggcaaagaactggcaccaatcaatgagaggagaggaagcagacatatactccctccatttatttttggctgctcctatttatctcaaaataagttcttttttagataaacattacatcggtatttgtgaaagtagaggccagataaatgcattgggagcagataaagtgcaaataattgaattagaatttgataaagtggatgtattctagtcttttcagttttatgttgatatgtgtgagattggtgaaaaatgaacttattctgagaaagtattatgtaagaagttgaagcaaacttatcagtttgacatcttcggcagcctaatccatggcatctgcgcgaggcgtctctacttggccggtgcaaagtaattttcgtgtagttttaactttaatgatagcgccatctatgattataaaaagttttatcttaaaatatatttctactcttataaaaattgaagaagtttttatcggtactttggaacgttttctgtgtatgagtcggtttttaagttcgttcgcttttgaaaataaaggagtcatataagaagcctctttaaaaacactcgcatgctagcttgagacaatcggactcctaaatacagctcatgattttttttaaaatatatatatatatatatatctaagcgaattactacagtgaatttcatctcaactaaacaatatagcaataataagattaaaataaacttcacccgttgcaacacacgggcattttttctagtcttgtataaagagtaaaaaaaagagatgttattaagaagtaaagtgccattttcaatagtttggaggataaaaaatatttcagagattaagtgatctagctattggattagtttgggtagtaaaatggattttgttttttcttttctaagctcccatataagcacctagcattggagatggcctaagcgcacactgctacccttaacagctataattattttggcaattaacaattacttaattccctatttcatattgtagatgctgatcatagtaacagtattaccaatggcagtgaaaccatttctttttgtcaagacttgtgtcataacaacatatcaggataaatagggcaaatgtagcaatgacatggctaatagttggtaacaacatgttattgcaccagttgcttatcccagagcgtgttactctacctatatacaagctaatccctccttcgaaaaatctgagatctatttctttttcatcaataccaataagcaattaactcactcaccatgtggcaaaacaaataaacatgcaattgatcaacaatttaatttagcacatagtaactataaataggacttagatttttagaaaaactaaagaatgaaataggtctcagatttttggaaagaggaagcactatgttactgcatgagcatggcatagttactacaatagtataggaccatattactgcacattctctacgcactcagtgaaagtaggcacgaggttattgagaaatccagcatgcatgctctttaagacatgatagaataggcaataatctatacctagctatcttttacaattgctaattccacaagttttgccacattggcctgctacatggctttgtgatctgaaataaacgagcaaattgatgtgagatccactagagaggagataagaaaaacataattctctctattaaaatatagagaacaacttggagaaaatttagttctctgtttttctgggggattatggagctgttgtgaatttgtgataacacattcttaaattttgtgggacattaaaactagcaaaagttgtaagcttatatttgttcctgaatatatagcttaatctatattgtttgactaagtttgaatatttattaatatgtgaataaattgttcaagatttcaagtagaaccacaaattttgaaaagtgcccagctaagaacctaaacccaatttatttgttcgtccttttccgattgagacaaggtgaaatcatttgtcgtttttgacaaggttggtgcttgctaaactagttgagaggacttgcgttcatcattacccttgacaagtggcataagatcgttcatcattacccttgacactctagaaattgatattatgctgggatttaaaaaaaaaaggtccacgtaaacagaatgaccagacttatttgattctctcttctttatatttatcttttcaatttctgtgctttaattgatttactatgcaatgcaggtacatttgttttacttcacaatgttgctccccactttgtagttgttggttatatttatataactactgcatattagattcaccgttatgctttgcataaatgacatttgtatgtgcatatttcttttgcagacccaattgggaaggaggccaatatgaaggtgatgatgctacaagatttgaagcactccgtttagcaatggagctaggagtaaattatgtcgatattgaattgaaggtttgttacctcaaataagttaaactgttacgctgttcccagttaatatgtaatattgtaagcatccttagatttcaaattgattagtgcccactatttttcaaaatgcataacacattgtattaaaaacgattctgaaaaatgccttcttttcatggttaaaccccaccactactttttccttttatttgtggaacacaagtgcatccacattgcctccatttttcattctaccacaatatgactaatttgagcatgaaaatgtggcctgtacataactttgaaaatgagttttgagtaaatttggaatatcatgttgtagcttcatagctggaggtacaaatatgacactcattcatgcattatggatggtgcaattttaatatttttatgtattttaatattcagttctattgctcatgacaagatagatcattcctcttaagttcaaattgaatccatttgtcaatcatactattttattctttagagtctagctgccatttggccatcgcattaggaaggttaactaaaatataacactgaagggggaaatctattttaaaaacgtccaatgaatactcaatacatcgttcttatgctcatgtggtttcttttaagatgctctggaatgaaattgtaaaaagttccttttgtaattacttaataaacttgaagtcaaaaaattcatgttttccatttgttcctttagggaacacaccaaatatatttttttttgcatctttatgttaagtaaggagagcaaacaaacaataaaaaatttggaaaaaaaagtaacatgtaactgttcaagacaaaaatgccaacctaaaaaaagaaaaaaaaacacaaggtagctctagccaatagtttttcgggacgattcttcagtttttattcttgtatctcttatctcatactctatatgtttcatattataagatgttttaactttttcctaagtcaaacctttttaagtttatagagaaatattgcaacatttataacaaaatattaacactatcaaatatattcattgttagatttaatgaaactaatttggtgttgtaaatattgctaatttttcaataagcttgatcaaacttaaatatgtttgactcggaaaaaaagatcaaaactcttataatatgaaacagaaggagtatatgttttggaacacaatgcaaacctagttttaagcaatttaaaaagccaaatgctttaatataatttaattttcaccaatcatctagccatgtaggctctatgcctcatttatctaagtacatgattaggactgtatgggggcacatttgtatcttcattagccactaggcatttacatacataacggcatgcatactatatgtactaaccaagtttatttttcttgtaggttgctgacaaatttatcagctttatttatgggagtaagccagagaagtgcaaacttattgtctcggcacataattatgaaagtactccatcctgtgaggagcttgcagatcttgtggctagaatacaagcagttggagctgatatagtgaaaatcgcaacaacagctaatgacattgttgatgtgtcacagatgttccaagtgatggtgcactgccaagtaagtgtcattttataaaatccaagaaatgctttcacttttctacatggaaacttgcatgtcacctatcttgtatagttgtcccagtacatcttgcctctagcccactactactgcatgccccctttagattcttttttttttaaaaaaataaaggaagctattcagatccatgatgtttttgaattattgcacatgtcaaaactttgtgtaatggtccctaaggcctgtaaacatcactcggcatgggggattttctatggtttggaagtattttttaagtgaaaaacattaggatttgtaatttaattttagcatgttggctttcagaaaattgtatttcacaaattgtacttcagctaagctacatgagaactacaccaatctaaccctattttttttataaataggtcctttcaaaaacttatttcaaagctagaccgtgcaaaaaaacttaccaaaaatagaccgtcggctcaacgccaaccgcctttgcgctgaggttacactgatcagcgccgactcccttgccaatgtggcagccgagccaatcccctcgtctacatggcaggggctcaacaccaaccgcattggcgctaagctactaatctcagtgccaatttctggtgctgagctttgggacttagctgctcgcagttgggccacccaacacaactcatatgttgggcggcccagaggcgctgagccgtcaaatctcagtgccaacgtaattggcaatgaccctaaagatctcagtgccaactaattcggcgctaagttttgtgacttagtcgctcaccacaggcccgctcaacacagctcctgtgttgggctctgccctgatgcgagggttcaacgccaatacccgaggcaagccatggtgtacttgatagatgcattggactccttcacatgaaacatggatgcacccggatagagtagctctgcagccatattttcaagtcttccatagattgaaattccaaccccgttctcgattcctcccctatggcatcgatggttccatcttattgtggatccccatcggcaactgcgagcccatcattgctaagatccttgaattgagtgatttccggattgcgaccaacgattttctcaaacactctcctctcttcctctgacatcttgcccattggacgatcgtcattggagttagaagcatactcatccacatcatcatctgaatgcacattcaacaaatccatgttcaatccattaaataccatagcctcctcacactcctgtcgggtgtaaatttttcttcaaagcaattctctgatgtatgaagccatctgcctatcatcaagttcaactttcatctcattctcaacttgattcacatctaggccaacatctgacaaatcctcccctacctccacttcatcctcaacgggtacttccccctacctccatatcctcctcaacctgtacttcctgccctacctccacatcttccacaattaattattccttccgatccgcgacaaacatatcgttcttcggttcatgacagtacagggggattctatgcgcgaactttaattgaggtctaaaaattcattctccgatttgctgcgctctttcttccaagcaaacatctcaagcgatttgaattgtgaccctagtactatatctacatatgtttcccattccacctctctattcaagtctaacataaaattatgtgatatgggacctgcgcccacattgtatcttcctttcataccaaccgactcatcactccaatccaattcatctttcgtgcgggactttaactcttcaaatgtggatttggcatgaaacactaactatctaacagtctcccccgcaaattggcttccaccagtactttcatctaccacacagctaccaatctattcatctacaatgtgtaatcaataaataaaaataaagtatttcagaatagctgataaatgccacgccaatcccaaaactatcaaacctaagaacgttcaaatgtttcaaaaaaaaaccctaacaacgtatactaatctatccatccaatatgtaaccgataaataaaaataaagtatttcaaaataactgattaatgccacgccaatcccaaaactaacaaacctaagaacgttcaaatgttttaaataaaatctaacaacgtacaaattataaattaccactaaccccaccactaagtcctaatgttttaaaaaacacatgaatcatagtacaacttaactttcaaactcctacaaattgcctaaaacaaatcatttatctcgggttacaaccacacatctaaccctagccatcatcacacattcaaaatataggttcagaaatttacaaatcaacattaatcaaccgaagcaacatcaatatggaacttccacactaatcacgacccagacaacccaactaacaatagatcacgagccacattcctcaaatcatggttagaaccaaaacaaccaaaatacataataaaatgttcaagaaattagggttttcgagggagtttatctttaaactcgaccccacactcaatccttacgaaatcccatttgattttgtgtggatttggagagatttggggaagggaggagagagaacttggcgtcgtcacacgagcactaggggagaggaaaggagaggagaggaagaagagatgttgggttgttgcggcctcgtgtcgcccttagtaacctagctcaacgccaacacggccggcgctgaggttagacggttcagccccaaggcggttggcactgagaccctgccacgtagacgaggggattgcctcgactgtcatgttggcagggggttcagcaccaacagccctggcacgagccgtctagccttagcgccaagacagttggtgctgagccaacggcctattttttgttgaagttttttgcacggtctaatttcaaaataacttttcgaaaaaccaattggttagaaaaaatggaattgaacctgttaaacgaaagaaaaaaatatataaccccttttgttctcatgttctttccatattcgagtctccgtaatccctattttcctagtgaaagcaactaaaacaatgtgaatttacgatgggactagttcagccttattaaacctttatgtgttgaggagattcttaagaagaaaaaaacactaagctcatggaaaagttgtgctcttttcttagcttattcattcttgttgtatttcatcaagtttggtgttattatattaggaggtatgcaatagtatgtgggataatgtcgtaatatgtctgacttgtacttttatgttatttttcctctaatccataccattttgtattaacttccatttgactgaccagtagaaatggaaatgacaggtgcctatgattggactagttatgggcgaaaaaggtttaatgtcaagggtgttatcccccaagtttgggggatatctaacctttgggagtcttgatgctacaaaggtatcagcacctgggcagccaaccgtcgaagagctgatagacatttatgatataaggcgcataggacctgatacaaaggttctcggtgttatagccaacccagtaaaacagagcaagagcccagttttgcacaatacatgtcttcaatctgttggatacaatgctgtttatcttccacttttggcagacaacattgctagatttcttagcacatattcgtctccggatttttcaggattcaggtactaatttcaaaaagtagaaataattactttactatttcttggaattggatggactaattttttctaggagttggatatactagatttaagtggtattgactctcaagggaccacatgaataaggattgttgtaattttttgataaatcatacatgagggatcccccaatctgatgtcttccttagacaaacctcattcgtacaaacctcacctaatgaatcccttgttagttttcatgggaaaaattcagctatatatatttttcctggcagctctttgactgggtatgaataattggtttgtacagtcatatcatcactgactgtccacatgtgacatactcaaattgtggaaatcacagcgaaaaatccacacaaaaaacccacccaacccgcagttagagcatcaccaagagactctccatccaactctctaagctaaattttagccaacatagcaaaaaatagtactgaacatgtgaaacggccactccccctcccttgtctaggtctgttactgtgattcttttacatttcccttgatattctaacatttacagagtacttactgaacatagctttgcacatatttttacaaatatatggaaacaactccttaaaaatgaactgagcctacatctgattatgcttagggaagatgacagacccttgtttgaatcatggataattacttgtaatctaggtccctctgcgatgtttttaatttatttcccttttgtaaataactcttttatataattgaaataaaccataggggcttttccactgtttgatggtaaaaaattttttaaataagttttgcacattctgggagagagctcagaatagatattttagtttgacggtaaacaagaatccagtttgctgaaagtaaccagacttttggtaattcagatagcacaaattcatttttgtggaagccttctgttagtatatagttcctctgggtatggaagatgaaacattgaccactcttttctattttaatatgtctgttgattccaatagagttatgatgtaatgaaagcactgttcaagacacatctagaaatctgattttcatataaatattcaaatatacatcgatgtatttaattatacgacgattctagttttagttatttgacttgatgtatgttcaaactactacttttgacaactggagggggtatttcacaagaacaaatttgagcggtatatgactttatgtaatgcagttgttctcttccttttaaagttgatgccgtacagtgttgtcatgaacatgatccagttgctaaggtaccttgatgtgtggtacactttctctaattgcttacttgatttaattaattacttacctttttagacttatttaacctgacatttcttcaatctgcagtcaataggtgccataagcactataattaggaggccagatggcaaactactgggctacaataatgactacattggagcaatttgtgccattgaggatggcataggaggttttttataatcttaatcctgaaacaatcgttcaactgttttttcggagtcatgggaaaaaagtagctgataatttacatttcacaggtccaggatcaaagaatgctgccgtcacacctttggctggcaggcttcttgttgttgtaggtgctggtggagctggcaaggcaattgcttacggggcaaaggagaagggtgcaagaattgtagtagcaaatcgtacctacggtaaggttttttttgtatttgtttctgagacaaaatgttctatgttggctgcagttattcaattattcatatgcaaagcataattcattttattagtgtaaagtattggaagttctgtactcattatgccgctcagacaatgatcaatgctgaaatatgggaagatatattgcatccatttatatccatgtttgtatcattgtcatgggtgatttttgttccatcaattcttgtttcgcactagttataaagctcaaagctgatcatatttgagtacgtacatcatttaatatgataattttcttgtgttcttcagaaaaagcagtaagtcttgctgccgcggttggtggtcatgccctgagattagccgagcttgaaactttcaggcctgaagaagggatgatccttgctaatgcaacatcgttgggaatgtaccccaatgtggatggcacccctattccaaaggtctctttcttacacgcacgccatgttaatattctgtaagacggaatatactcaacacaataatctattgccagatagcgggagtacatatataggttaggccttctatatctctaccaacttataaaattagaatcgggagtacagaaggaatccgaacctaattacaggaagtagcaataacaaactcttaacatatatattccagctataaactggtggaaccctcccttctactctgttaccatctttaatttcaattaatcttggcatgctctctaattagcacatttgatactaccttgatatacctgtccgctcattgcggccacaatattttccatttgtatgtgcagcaagcactaagcttctacgatgttgtgttcgatgcggtatatgctccgaaagtcacccggcttctacgagaagcagaagaatgtggggttaaagttgtcagcggtgtggagatgtttctcagacaagccttgggtcagttcgagcgtttcacaaatggtattgaaggtattgtgtccttctaacttatatcatacactttgttatgccaaatgctatcacccattcctctttctgataatctactttctacagctcctgaaagcctgatgcgtgaggtattagcaaaacacacataacaggttcgttcttcagcttttgccttttcatttctattcttctagtcgtagtgatgatggtttagtatatttattagattctgttgtatcatttgcattgaagacgttctctaacaccatgccaaaaccacaagggcaagatgtttttgtaaaccaactaaccaaccgatagaattaatatagtttaaacgccaaactatatataatgccaataatgtttaactattggttgtaggatttgattcttagtgtggtttttttatttgagaacctccttgtaggattaattggttggtctatcatggatcacgccatgaactttggcgggatggtcctgtcccttaatttgtattgcctccggtttctaatagttgacaacattgattttttttacgcttgtttaacaatttgtcttattaaaaaattacataattattatctattttgttgtaacttggtcattaaaggtatttaagcatgacttgcattttcataattttgcaaaaagaaattaaataagatgagtgaccaaacgtatgtgaaaaattcaatgtcgtcgagaaattattgcctatgcctacgtggagggatttaggtggtgatggagcaaaaagattccatttcacaaaccaaacattcaattagtttactgtggttatggtgatctttcttacctagttgaattgtggtcacttagagcacccgcaatggtaaagtaaggtgctctctataaaacatgtacatctcagcaatagattagattaatagtaaaccgcttcaatagtgtgtctacatgggtatctatagctctctaatatattgcctcgtttttctctatagactatctccaagttagtagatagctttgctctctctcttcatttagtctcttccatatagtaaaatatgctgacatgaatatcttgtagagagcatatagataaccattgtgggtgcccttatatatctgcagtttgtttaggttggccatgtggaaatgacttgagttgtaaataaattctgtggagaccatttccttttatttatttatttactaaggtagtaccttagcctattatattagcgctcattggaatcaacttgttttgatataagtgtttgtgtagggctgtaggcgaatggggaagcgggaacggttgtgagtaattatagcccaagtattcctctgggttaagttaacaaaagttttggatgccagttttgtcctcggttggagattctttgttgtaacgttaatttctccgacttgtcgcctgtcagagatgtaaacagaaaatgctaagtgttcaatctcatcgtacttgcaataaattaagaacttgcatccatgactatgcagtttgcatgatgatcatgatgggcttcaaagaaactaataaagcatcaagctatacgatcagatggttccatgttcatcacgtaagattacacctgtcgacttgcttgctactaaaatatataatactagcaaaagtgcccgtatgttgcaacgggaagaaaaaagagaaaattgaattcaaacatattaaattctaattaattgaaatataaattttttggaatatttgggtatttttaagtaggtaggtatataattaaattaatttataagtaaactaagtgtgagaaataaaatgatatggttgcatttattttttattaaattctccatattaattacactctttgaaattttcttgaaatttacagagcttaattgttaattttgataatacaaactaaacatcattttagcatttatttaaataaaaaacattctttctctatgggccatttttagcccattttcttcttcagcccgcaaccgagccgtcccacttttctcaggccgcaaggtattaaagtctaactaacatctccatactcctctcagttccacgtttgtgatggactgtcggcccgcatgcggctcaagtgtcaccgtgtggtgatggaggcctgcccaacactcgatcgatctgagccgttcgtttcgatggacaacaaccccagtgcaaccctaaccctagaatcattctccccccacccttccccaccacaccatcggccgcctcctcccgcccgacgccgccttcccccgcccgacgcagcctccccccaccggcgccgcatctccccctcctctcacccctctggcggcgccacttcctctccactctccctccggtggtgctgctccctctccccctttccctcctgtctcaccggcatggcgcggcgacggcggggtacggtggagatggcagcgacggccgtccctccccctctccttctccccatcggcctcgatggccgtccctccctctcagcctcaagatccggcggcgtcctcccaacggcggtggcttcccgcggccggatccgataccggcggcttcctgcggtggatccagcgatgacgtagacatcaccgatccggcttcaccgatggcgccgacagcttcccgtggatggatttaccgcgtcacatgtaatcggattcgattttatttttcgccccattttttcgcccgagtttgtttctttttttgaatcggacagatttaattttttttcgtctttttttcgcggatggaggtggccattgcaggcggcggcgtggaggcgacactcacctccccttcctccctccacgctcctggatatggccggaggaggggagcgatggtgggggcggccactgcaggtgatggaggtggagctcctccctccctccctagcttccagtgttggatagtatagaagagaccgaagcttggcatagtacacttgctcgaagacgattcatcccatgaagacgtgtcgcagatgggcgcttgattgggtgatcaggccaaccacgcacagtacgacactggagtgagagatgccgcgtagaccgtagtcgatcacggcattgtcgaggaaatcgttgtagccgagctcttgaacggtgattaagtcaaagttgcgcggggctagacgacgaagacggagcagaattaatgctgatgtcggggacacgaagagtcgacgacgcaaacccgttcattgaagggaaaaaaaaaacaaaaaggtacagcaagcgcagcacagtaaccagcccatagtgctccatggtctatagaccaagtccatgtcctgtcgaaacccagtcagccgaccccatatggccatatcagccttagggcatctccaatgtttatgatcatgagtagcattaaggtgtgtctcactatttttatggttattaccacaatgtttgaagcaagagtaaactttaagatgggtcccacaatgtactattctagtacttcttttatcagccatgcaaatttttcatcatcacattcattttaccctattattttattgcttgtggtcaagccataagcttaaagctttcttttgcatttaatgccttatggctttgtttcacaatgtatatggtcactataaaatcttatggcctcttcttatggccacattgtggctgcccttatcctcccacgacctactccatgtctccatccatgtgtgaacactgaacaccgtggctgctggcggcttggcgcagcacgtcagcaacggcgggaggcggtggaggccatgggcgctcgtcgtcgtggagccgttcttcagatccggacaggggcggctgaggcgtgtggagaggcagttgttccccagcggcgacgtgggagagacggccggcggggaggtcgtcgaggcgggatctggctggaggagggagccacggtggcggaggcggcgctccctcccctccctcccagatctggccggaggggggagggcggcggcagcggtggtcccagcgatggcggcgcgcgttgtctactgttgctcgggcgcacgcgctgcgtcaagctcgtgccgccaccacatcgcgtctgtcagtccaaggtgcatctcgcctcatgttcatgccggtaccggagttctcatgtttcatgttgcaatgcaattttattggggtggattggagttctctcatggatccctctgctgattttatttgggtggattagagtccaatttgacaattcaaagttctctttatcatattcgcgtacgaattggaaatttggaaacgggctagctgccgaacgacttggttttttttttttggaacagacggtatatgcgattttttttttaatttaggcctatgggcttaatctcaaactggagtaggaatcggtgtgggtttcttttttgcgtgacaattgggcgcgctttttttatgcgatctaaccaaatctgatccgaaacaaatttttttgctatatatttgttgacaaattttatcccaaaaaattgacagatgtaattacagtacaatcgtagtttaattacactgtaacttgcatgtaattacactgcagttatcgtagtgttattacactgtaacttgcatgtaattacgctgcagttatcgtagtgttattacactgtaacttgcatgtaattacactgtaactacagtgtaacttgtatgtaactttcaaaaatctttctgtaatattttatttcggtaaaatggaggctgtgggaacaaatccttacacatatgtgtgtgctgtgattttttatttaacgattcaaaattacgtgaaacttatatacaagttatacggtagttacatgcaagttacagcgtaattacatataagttacactgtaattacatataagttacagtataattacactacgattgtactataattacacctatcaaatttttagaagaaaatttgtcgacaaatgtataggtggtcccgatccgaaatcggatgcggtggaaaaaatagcgccagattagaaatcggaaaaacgcggtgatggacgaaaaaatgcggatcagaggatgagacgattggaaaaatagcaatatttatattagttaagatatgactagaaaatgggcgtgcttgtgatttttagcccgtaggtattgctaagtgctagtatttcaagatttatagtgtcatattattttaggaattagtttagttatatattgggttaaacctatccaagtgttgagcatggccaaaaacttctaaggtccttgatgtaaaatctatcattaaattgtagttctactattaggcgcgctcctaatattacaagcgccaaacatgcatcagctcaggcccaccccaccccatgtcccagcccaggcccaccccaccccatgtcccgttatcccactcccaccattgtcggagtaaacgattgtcggtgacatggggccgggggtatcgtgactagaggcttgggtagccgcgatcactcacgtggcccgaccccctcggggggggggggggggtcgggcccgacggtgacgtggccacctctccctctgtctccccgaggggtcgggccggtcccgtttcggccccgagggctggggcaccccgaccccctgtggtgattggcgccacgtgtgtgggttaggtgagcacagcggcgctcacctaaccgcatttatagcgggttagacgagcgcgtcacgccgcattcaatgcggcgcagcgcatgcttatccggtctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcccggtcagatccattccaggcttcagtgcaagcatggcaagaaaatcgctggccattgaatgaagtatgaaacgggcgtccaccgggagagctgacgagcggagcaggaggcgtgtgtactgcttgtcagaggtcatttccggctgtagattagccctcattgtaaaaaacatgtttcttttcttaggcagagagaggcccatgtggtgacccctaaccagataaaaaaaggaggcccaggcctaaggagagaaaaaagggggggggaggtgagaggctggccacttgattggagagcctgaactctctctcgctctagagctctctggctctggagctctctgttttccttcacacacagatccaccagaacacaggagtagggtattacgcttctcagcggcccgaacctgtctacgtggcccgtgtcttgtgcgcttcttctcgctgacattcctcagatcgagggcgaagaacctcacttagcgcccccggccgaaccggcaaaggggggcctgcgcgttctcccggtgaggagccccacgctccgtcatctggcgcgccaggtagggggcgcgcgtgtctttcgaagccctcgtcctctttcgtgtgcgccaagcttcgcccgctcagcccaatggccgaacgggcagtggcgcacagcctctctccgaacgctagcggtgtcgacggggagcagaacccgcgccgtcgggctcgcaccccaccgtccccctctcgccgaaatcttgggcgggggaggcgctcagggaggtcggaggacacgcgacttcgccactcgcggtcgacgggggaggacggcgagacggagcgcgtcgccgcctcgtctacggcgatggcggtacgccccagggcgcgctccaggctgcgggcgcgctcctgcgtcacccgcccgtcgtccccgatccagagactccagcccgacgttggctggatgacgtggccgacttggtcatgacggcgcagcagcgactaggcgccggcgggcggtcctccgccaccgaggcctctggcgcagccgccgccggctccaagtcgtcgaggcggagggcgcggcgagcggcggccgttacccgccattcgtccgccattccctcgtcaatgcctccaacccaagaagatgtgcgtggggggccggatgcccgcctcgatatcgagcgccagcgcgacgctcgtcacgccgcccgcgcaacggagggcgcttcctcgtccggagcgccgcttcggtctgggcactggtccggccccccgtgtccccggttggcggtgccggctgtcgagcctttgtggcgagccttcggaacgtccgttggcccccaaggttccggcccaccatcaccgaaaaatacgacggaagcgtcaaccccgccaagtttctccagatctacacgaccgggatcgaggccgccgggggtgacgacagggtcatggctaatttcttccccgcgtcggtccactcttgggagaatttgtgccaagcagttcaccacgaacttccagggcacatatccgcgcccaggcgaagaagcggacttgcacgcggtacagcgaagggacgatgagtctcttcgctcgtacattcagcggttctgtcaagtccgcaacaccataccgtgcatccccgcacacgcggtgatctacgcgttcagggggggcgtgcggcacaaccgcatgctcgagaagatcgcctccaaggagccccagaccaccgcgcagctttttgagctcgcggaccgtgtggctcgcaaggaggaggcctggacctggaactcctccggttctggtgtggcagcttcggccgcccccgggtccgccgctcggtcagggcggcgggacaggaggaggaagaaggggtcggcccgtttcgacgacgagggtcatgtcctcgccgtcgagggcgcttcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccctggcggctcccgccggcaaccggcgaggtgaggccaagcagaaggccatcgccgaggacatcgacgatggcgacgatgacctggggttccaggagcctgaggccaccgtcgccaccgtcgatgggggagcgtgcgctcacgcttctcgccggagcctcaaggccatgaagtgagagcttctggccgcggcccctaccatgaggcgacgcggcgggcgcggtggtcggaggttgcccttaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcggcctttgacgccatcaaggtcccggggatggtgctccggccgtcccagccgatcatcggtgtgacgccggggcacacctggccgctgggtcatattgacctcccggtcaccttcggtggttccgccaacttccgcacggagcgggtggacttcgatgtggcggacctcagtctgccctacaacgcggttctggggaggcccgcgttggtaaagttcatggcggcggtccactacgcctatctccagatgaagatgccgggccccagtggccccatcaccgtccatggcgacctcaaagtcgcgcttgcttgtatggagcaacgcgcggaccaccttgccgcggcgtccaagcccgcgggcggcgacgagaggctcagcacctccgtcccggccgccccaaggcggcggatggtcacgtgcgacgaggtcccggtcaaggaggttgtcctaggcgacggcccgtccaagaccacacgaatcggtggtcttctggacgataaataggaagacgcgctcgtctccttcctgcgggcaaacgccgacgtcttcgcctggagaccggcggacatgcccggggtccccagggaggtgattgagcaccgtcttgccgtgcagccgggcgcaaggccggtccggcagaaagtgcggcggcaggccccggaacgtcaagccttcatccgcgaggaggtggcgcgacttctggaggccggattcatccgtgaggtcatccatccggagtgactggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattacccccataggaacttattgttatacgacaatgcctttcgggttaaagaatgcaggtcctacttttcaacgtactactcgaatttctttgggtagccagataggacgcaatgttgaggcctatgttgatgacttggttgtgaagacgcgcaaccaagagaccttactctcggatctagcggaaactttcaaaagtctccgctccgcccgcataaagctgaaccccgataagtgcctgttcggcgtgcctgcgagcaagcttctcgggttcttggtctctgcccgaggcatcgaggccaaccccgagaagatacgagctatagagcggatgcgcccccccagcaagcttagggatgtgcagtgcgtcaccggctgcatggccgccctaagtcggttcatatcgaggctgggagagaaggcactacccctatttaagctcctcaaacgctccgggccgtttacctggacggaggaggctgagcggaccttcactcagttgaaagcgtacctcagttctcccccagtcctggtcgccccggagccagatgagccgttgctattctacctggcggcaaccccgcaggtggttagcgcggcgttggttgtggagcgcgacgaggacaaccctcaccccgtgcatccccaccctgtgtcgactcgacccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctatcgccctctgaccccgaggtcgtcagcacagaagccgagtgcggggccgcgaggcctctcggacgaagagcgccctggagatgcggcccctggcgaagaggatcggccccgccgaaaggtgcagcggcccatctacttcgttagcgaggccctccgggacgccaagacccgataccctcaggcccagaagatgctttacgctattctgatggcttcgaggaagctgcgccattacttccaggcgcatcgggtcacggtggttacgtcttaccccctcggccaaatcttgcataaccgagagggtactggacgggtggtgagatgggcaatcgaactctctgaattcgatttgcgctttgaaccacgccacacgatcaagagccaggccctcgccgactttgtggcggagtggaccccagctcccgagcccgtctccgcccccgaggccagctcgggccccccgcagctgcctcacaccgcctactgggtgatgcagttcgacggctccttgtctctttagggcgccggtgcgggggtcacgttgacctcgccgagcggagatgtcctcagatatctggtccgcctcgactttcgggcgaccaacaatatggtggagtacgagggactccttgcgggacttagagtggcagctggactggggatccaccgcctcctggtgttaggcgactcccagttagtcgttaaccaggtctgtaaggagtaccggtgctttgacccgtagatggacgcttacgtgtgccaggtgcggtgtatggagcgccatttcgacgggatagagcttcggcatgtgcccagacgggataacgcggtcgccgacgaactctcaaggctcgcttcctcgcgagcccagaccccactgggcgcctttgaagaaaggcttgcccagccgtcggcgcgacccgaccccctaggggagacggacgcgcctgaacggcccctgaggcccgtcggagtccaggcctcgggacccgagggaagcgctcccagctcccctagattgattgcttggatcactgagatccaggcatacctcgtagataagactctacccgaggaccgcgaagggagtgaacgcgtccggtgcatctccaagcgctacgtgctggtggaagggaccctctaccggcgcgcggctaacggagtcctcctgaagtgcattcctcgggaacaaggcgtcgagcttctcgccgatatccatgaaggcgagtgcggagcccactccgcctcacgcaccttggttggcaaggcctttcgtcagggtttctattggccgacggctctcaacgatgcggtcgacctggtccggcggtgcagggcgtgccagttccacgccaggcaaacccatcagccggcccaggccctgcagaccatacctctttcgtggccatttgctgtctgggggctcgatatcctgggtccgttcaggcgggccccgggcgggttcgagtatctgtatgtcgctgtcgacaagttcactaagtggcccgaggcttatccggtcatcaagatcgataagcactccgcgcttaaattcatcaggggcatcactgctcgatttggggtgcctaacggtatcattacggataatggcacccaattcactagtgagctcttcggtgactactgcgaagacatgggcatcaagctctgcttcgcctcccccgcccaccctagaagcaatggccaagtggagcgcgccaacgcggaaatcctcaagggcctcaaaaccaagaccttcaacatcctcaagaagcacggcgactcgtggatcgaggagctgccagcggtgctctgggcgaaccgaaccacgccaagccgagcaaccggggaaacgcctttcttcctcgtctacggcgcggaggcggtcctcccatctgagctcaccctgaggtccccttgggtcaccatgtattgcgaggctgatcaagatcagcttcgccgagacgacctcgactacttggaagaacgaaggcggcgcgcggccctacgagccgcgcgataccagcagtgcctgcggcgctaccatcagcgccacgtccgggcccgatcactctgcgtcgacgacctcgtcctacgccgcgtccaaacgcgtgctggactgagcaagctctcaccaatgtgggagggtccgtatcgagtgatcggtgtcccccggccgggctccgttcggctggccacgggcgacggcgcagagctgcctaacccgtggaacatcgaacaccttcgtcgcttctacccctagtgggggtcgggcgtcatgtctcgggctcgggccaaccccgcaccccccgggcgtgcagggttggccgggggctaccacatgcatatccttatcttttttctcttccgtatttcaataaaagcattttcgatttcctgaggactgtgcctgtgccatcgtttccttttgaagaatcttggcttgagttagcacgctcgtgctcgaccctgccctcggtggcccgggccggctaaaatcgccaaacgaggcccagaaccgagccgtgccccggggcgtggtgaactccggggggggaatcggcaaaggcccacaatcgggtcatccataaccctcggtcaccacgctcccggcctggccagtctcgacatgcggatctccccaggcactagcccccacccgcgccgcttgaggttgggacctgggcacgagccctcgttcaagccaagacacagaaggaccgcggcacagaccatcctcgtctcatacacacaacaaacataactgacgcagaaatttcctctttacttgattacagattaaatcagtctatacaagaagggggcccgaaggcctcggaagaagaaggaaaagctattaagattggcgggggcctgggggctcactccggcgcccccgggccgtcggcctcgtcgccactgtcgtccgcaccgtcgtcaccgccctcctcgtcggagtcgagcgcgaacgcgagccgaggggccgtaccctcgaagctgtggacgatgtagtcggcggcgtcccggacccgcgcgcgcgcgccatcctcggttccgggagggaactcttccagcgctgcccacggggagaagtcagggtccctggcctggtagcttgccagtacgagctccaccgcccccgggcgaggtccctcgaggatgacttgatcgtctcctcgagctcctcggggagccgctggagggccccagccatctctgagaggcgctgggcgaggcccccctggttggcggcgtacttcgcgtgccgcccgccccagagacccgcctgccgcccggcgcggtctagacgggagacggcgtcccgaagcatgccgggccctacctcgctcgccaagcggagggcctcgacctccccagcggacgagtccagcgcgccctgcagctcggcgatggtgtgttcggcggctgcgaggcgggcggctaggtcgctgtggcccgcggccgccccgccgctgtgcgccctcgtgtccagctccttcgcctgcgcctcgagctcagcggcccgctgatccagtgcggccctctcggcgcgggcgccttccagattgcggcgcgcctgctcctcccgcgctgcctcgcggaggaacaggctgtccgccagccgctgcgccgcggcctcggcctcctcgagagctcgctcccgttcggtgagcgcgtcctcgcggaggcggagtgcggactcttcttcggcgcaggcggcctcgtgcgccgccagtgttgcctcccgggtggcgacggcggcctcgcggtccgccaggtctctctccttcgcgtccagggcgcgggcacgctcctccagcgccgtggcgcgaacctcaagggcctcttcgcgctggcgggacgccgcctctttctccgccgcccgccgttcccgggcagcggcgacatcaaggactccccgggcggcgtcgagcttctcctccagcttcgccgcccggctcccgtattggaggcggaggtcgttccgcgcctcgtcgagcacggcggtggcgatgagggcagtctcccgctcctcctccacctccctggcaatctccgccagctccctacgacgggccttgagctgtgtggtctgccggtggtgcgccttgcggcccgcctccaccatggcctccaccgagcgccgcccctcctcgacgcgcgcccacgccgtgtcgagctccgcccgctccgcctgcagggcctccatctgggcacttaacccgtccagcaccgtgctgttcgtggcggccaaggcctgcaggaagggctccgcgctcagtggggcagcggaagacagaggggagagccgcctcggtgtgggcgccgcgcggctcggcccgccgatcgacgtgccggactcgggggcgtccctcgaagctggctcgtcccaagtgtcgcccaaggggtcgggcccgagcggcgtgcccgcggcctcgtcgtgggtggcctcggaagttgtcgtcccctcgggcggagtcgggtcgagggtttggcaggccgcctggcgtgcgcgcgccgcctctgcctcccggacggactccccggcccggcggagtctggcctcctcccgagcggccacctcagcctggcgaacccggacggcctcctgggcagcctcctcggcttctcggagacggtccgcggcttctcgccggtcagcttcccgcctccgggcctccgcggtcgccgtctcctcggcctcagaccggccggacttggaagggcggggggggggggggggaggggcgacgggatctcgctgaggcggaagaaaaaccagaagacaaaaagaaacgggtgagtgaaaacttgccttgggagacgggagaatgaatatggccgcgatgggcgcggggacgaacctgcggggaggtcggctaaacgaccacctcgggggcgagatgaggttcccccggcatggcacaatcccccccatcttgcggagccgtttcttctttcgctccccctcgggctgcggcgtcggcacggcaccctccgggcgcctgctgctggcacgcaccgccccgtcccctcggggagatgggggaggggtgccctcctgcttcctcttcccccgggcgtcggcagggcggctgccccccgggcccccgtcgcggggcccagaagcacgaccttctcccggggtagattgttcccccctgcggctcccgcccacgccatcgtggcctcggggggcccgctcccccgacgccccgacctactgcatgatggtcaggatgttggcgcgctctggatcgcagcagagggggaggaccccttgggggatgagggatgcctccacggagctgagattaagcacccgttggaccaccatcctgaagtcctcagggtcccagtcccatttgcgcccctggtgggtcctcatgacgtcctcgggcccggtgtactcccaggcgccccgggcgcgccgctggagcggcgtgatccggcgacgaaggtagtcgccgaacaccatggcccccgtgagcccctgggatcgcagacccgccaggcggtcaagaacggcgtcgtagccgtctcccagatctaccgccgcccgccagctggaggcttgcgccggaggctggttcggaagtcggaggcgcgcttcgtcggcgaggggggtgtagaaccaatcgctcttccagtcgtcccactttttgcgaacgacgcagggaatgtagcggttcagcacctgcccccacggctggaagtagcagccaccgactaccgtcggcggcgacaccggctgtgcggtgaagaaccaccggaacagccggagagacgggtgtaccccgataaacatctcgcacaagtgcgcaaagatggccaatgtcattatcgcgttgggggtgaggtgtgccatctggagatcataaaactccagaatatccatgaaaaaaatagagaatggcgggaccagccccgccattgcgaaagagaggaagaagacggaccgccccgggtagtgtggcgccgggcgtccctcgcccagcgcgaccacctcccggccggtggcagattccggcttgaatcggcgcggcagcccggcctgcctctcgctcacgatgcgggaaagcggcagcacgctaccctcgagcggtgcggagccccgtgccatgacgccggcggaggaggagcttgagagcgagcgagtatggcaaggttagggcgcaggaaacggagagtcagagcacaagtggcgaaggcaagggggagagtggcgagaggaaggaaacaaatcccttccttggcgtctttgtacccttgccaacgctatgcccggctcctcgcttcccgcacccactacctcgccccctcgtttctcgcgcccgcgcctccactaaccccactcgcccgtttgcggcgcacgcgatagatgtgcggccgtggcgtttgagatggggcagatcgtgcgcgcattaaccgcgctcgccaaccgcgaaaaacgccatcatcatgtccccaggcgaaacaaaccggctcgtcccgattcgcgcgctgctcgagtaatgtagcggtcttgaagaggccgctcattattgtcgatcggtttctcccttgccgatgcgcgcgatttgcgaccgttgggtttctgcctgcctgtggggaccggccccacctgtcaccgggcctaaggagtggcatcatgcccgatcgcctccctcgaggggggcggtcgccctggcgtgacgccgggggctactgtcggtgacatggggccgggggtatcgtgactagaggcttgggtagccgcgatcactcacgtggcccgaccccctcgggggggtcgggcccgacggtgacgtggccacctctccctctgtctccccgaggggtcgggccgctcctgtttcggccccgagggctggggcaccccgaccccctgtggtgattggcgccacgtgtgtgggttaggtgagcacagcggcgctcacttaaccgcatttatagcgggttagacgagcgcgtcacgccgcattcaatgcggcgcagcgcatgcttatccgatctgtgaccagtcgcggtatgtgaccggtcacagaccggtcagatcgcgggttaggtggcaacaggcggcctgtcgcacgcctcgccccgtcccgtcggaatgatgagagcttcctggttctcgtctctagccggagctggcgtgctgactcctggagttggtatgtcagtcccggtcagatccattccaggcttcagtgcaagcatggcaagaaaatcgctggccattgaatgaagtatgaaacgggcgtccaccgggagagctgacgagcggagcaggaggcgtgtgtactgcttgtcagaggtcatttccggctgtagattagccctcattgtaaaaaacatgtttcttttcttaggcagagagaggcccatgtggtgacccctaaccagataaaaaaaggaggcccaggcctaaggagagaaaaaagggggggggaggtgagaggctggccacttgattggagagcctgaactctctctcgctctagagctctctggctctggagctctctgttttccttcacacacagatccaccagaacacaggagtagggtattacgcttctcagcggcccgaacctgtctacgtggcccgtgtcttgtgcgcttcttctcgctgacattcctcagatcgagggcgaagaacctcacttagcgcccccggccgaaccggcaaaggggggcctgcgcggtctcccggtgaggagccccacgctccgtcaacgatttactcctatcgcacgcctcaaccacccacctttattcgagtaaacgatttactttgataataaaaacaactcccctgcttctgatcccaccccacgtcccgcatcgtgctccgaccattattggagtaaatgatttacttcgataaaaacaacttttctgttttcggtatatattctatttttcccgtacccaaccaaccactctcgcctcacttccttttttttctcttttttttggatctaaatcgatccaccatcccaccccacagatcggcgacacaccatggaggaggacgatgacaccgtggcggttgatggcggtggccggtgagcgatggccggcggcggttgaggcgaaggcactgcttcgggcctcgttgccggacgttgggcagcaccttaaccagcaataaggtattcacctgggccaatagcaacaaccagcggctactccaccacgtcggcggcattgatagaataagcaagtaaggaaatgacactttgatttgcatctgcatactctccttcaacttcatgcatgaagccccaatatttttttcaaatcaaattaacgtgcaatctccaatattacctgatctcaattgatgggctgcacaggtcctacatttgcacatcgtgctccatgtggctggccgtagaggatagggtggagtccgtcggtgatgtaggttgtttgatatttttcttttgctcgtcatctctattgacatgaacgagaatgtttttacattttttcgtgcttgctagatgatggatggctgcgcaacgtcgggctcatctctataccataccgctacatccttctattattccatcgtcgactactactcgctccctggttgccctctccactaccagtctgtgttaccagtcagaagacacagactgttctcttcatccttatagcaagatccagcaaagccaccagatggatttttagctgaatcattttttttcatttctagtttgattcacctgtgagtaattttatcgcttgtgtgtgattgagcctgtaattttttcacttgtatgactattttatgatacagatcaacaatactcttagtatcaattttttactcttatactgtacattgaacatatcagtaaacatattactatatggtggctacgagatcatggctatatcgagaggaaggtggtaattgttttactcgcagaccaaggaatctcagtttttactcttatactatgtattgaacacatcagtaaacatattactacatggtggttacgagatcatgggctatatcgagaggaaggtagtaattgttttactaacataccacaaaatctaaacaatatttataatattggtaaaagaactactagcattgtaagctggtagtaattcttttacgaccatctaggtatggcgtcatacgatgtggagacattcatgtgagtaaatttgttacttttaaatgagcagatgtgggaggctgggagtaaatgaaaaactccacggagtaaattcgttacttttgaaacgtgcggagatactagaaaaatggaaaactcggaaagaaaaactagacggtaaatattttactaaaacgcgaaaacagaaaaactacagagaaggaaccaaaaacagaaaaatctggatggttaatattttagtgggcccattgatgaagcacggatgagatggaaaagagaaaaagaaacacggaaggtggagtggtaaaaaacgaaaaaaacgaaccgagaaaaggtgggatgcggaggaaaggtggggtggtaaaaaagggaaaaccggaaggagagagcgttgtgcggcactcgaactaatattccgcgctgtagagcgcggaatagtgctaatggaatttttatcaaatcgaattggcgagaagatgaacaagagagaggatggaggaggaagaaatgctaagttagtccaaaatttcattgtaagggcagtgagaggcatatatccaatatctacaagtttataatggtatatatgttcaaatatataaatggtagtgttatatttcaaaactacaaaagttacgatgacaagcctaccagaggaggtgaatggtagattatgtcagcggaaaacaaataatcgaatcttaatagattaaaagtacaccccaacctcaaaaaccaatggaatacacgtccggcggtctatccgacctactagagtcggtctgaccaaaacctagccggtctaaccgcaggtcactcggcggtctaaccgtcagccctaaaaccagcacgacaacgcttctgtgaaaacttgatctctcttaaaccaaccattagatcgagttgcagactcgatagaataaactaaataaactaaggaacaactccacctgagagatttgcaaactataaacggtttaagagaaaacaccctcgaaagtcagctgtctcagaattttagcaaatctgaactaaacctaaaacttaagcaaattcgaatctagtaagaaccaatcaacgaaactttccagatctgatctatgaagtattagaaaggttttggatggattaacttgaacaaaatcgcagcaaaacaaacaatcacaagttaatgccaaaaccaaatataaacgtaaaacttacgaaaccagaatagatcatcgatgccttgatgattgaatatgatctttatcacttaaatatattgttcacaaggtgtagctacaacaccccttataaatttctcacgaaaccctctctaatatgggagttcgtagtacgcgcgtacgcgccgcgagcagaactagcgcgcacgcggcacacgttttcggaaggacgcggtagccttactaactctgttagttaaagataatgatggtaattaacaatagattttttattttattaggagagtttttttactaatagattgaaaaaaaataagttacatttgaaaacttttgacttaagatttaaactttgaactcaaattttgaaaactttcaactcaaactttgaaaaatttcaatttgcaagaaaattttttaaaactttcaactcaaatttgaaaagtttcaacttgagatttgaaaactttcaactcggatttgaaaactttcaactcgagatttgaaaatttttaaattaagatttaaaaattttcaagtcaagatttaaaaacttttttaaaaaatgaaaacacttgctactggaagattaaaaagtaatcaggaaaaaaagcaaaagaaagcggaaaaaaaagaaaacagcggtggttagatttcgtgtgcgcgccgcgtgggccgtatgggccgggagtgcgcgctgccggcgcgcgcgtgcgaattaggattatcactctaatctctcaaacttggcttaccttaaggcataacctccatctctatttataccaagaaccttcaacttcaacttaaaggacgtgtaaaactccatttcacgatattactcaatccatcatatttctttttctccaaaaccgcagccggacttccattcggactcctgcgagtcctcgcgtgggccggctcggaccaggccgaccgctgctgctccctagccgactcggtttactaaccaaccgagccaaccgaaacccgtgcatgcaagctgacgtcaacacacacctacatgcatcaacatatgcatactgctcgccaccagcccggacacagtgcacacacatatgcatgccatgctacagtaccgcgagaactgtagcaatcactcaatttttcttccagttttccttcgcgaacgccgacgcttgcacgcacatctcgtgaaacccgttgcgaagatctctctcacacgatatccatccatcgtgtgccatctcgcattagtaccgaaaccatcataggtgccggttgggaacgggctataggtgccggtttttcaatcggcactaatacaagaaaccggcacctatgtggaaaaatagaaccggcactattagctttgctcgagcaaaaaaaaaaaagagagacggctcgaatcgagctaaactcaccaaccacacaccaccattgttgtcatcctccctcgagcccagcactactccccttcatcaccgtctctcggatccgagatcaaaatcaacaacaaactagtatatgcatggtacaaagcattaagaactcaacaagtttgggactagaactcaacaagaactcaagaacacaagaactcaaaaagaaaaaaaatcaagaactcatgccggggccgccacctcgcccgcaccatcggcgtccttctccacccctgtcgccgtcgccgcatggggatggcatggccaccaccgttgctgaggtgcgccgcagatgcctccgccaggcagccgtcggtgcgggagcccgccgcatccccacttcctgccccacaggctcccctctcgccggatctagcggaggggagcccgccgccattgctcgtggggtgcccgccgccgaccacggaacccgccgcgaggggagggcgctgccgcatccgctaggccagctaccagccgcagggcccgccgccttcgccgggcaaccaccgtgagaaaaaaagagaaagggaggagggaggaagagagacgcgagagcagagaaacgagagaaagaaggtggatggataagggttgacggagaaacgagtagataataatgatgcgcggtgggtgcggtgctgatgggcttggctcaaagctataggtgccgtttttttaaaaaaaacaccggtacctataatatattataggtgtcggttcttttaaaaaaccaacacctatagtatatgtgtcggtttttttgttagaactggcataggtgtcggttttatgttttttcatcgtagggaggtgggaaaagctacattggtatcggttttaaatgaaccttgcaccttgagtcgttgtctatgagggtttttgtagtactgtcgtatccaacttcgtcacccggcattcttaaccgtctggacctcaactccttattgagtctagttccgatccccaccgttgactgaaattgtccttcaagaatcctgactctcttaccttctcacatggtatcccgatcgcactagacctctgctcctccctgagatagtcccggtcctcaccattgaccaagactaacctcaagtcacctgcacacaattagataaaacaatcgaattagataaaacaatcgttcctgagtacatatatcataacctgacccacattaatcacacgcactcacacaaacatccacacataattccaaaccacttcattgattaaatcatttacaaagtcaatttgttcatcataaatattaatcatgacaatgatttcacatgataggtatctaattaacccttaggaaaaattagtacagtttttcgggacagaaggaggatgttctaatctattccatcgtacttcgtgcgagtcttcagaagaaaggtgtacgtgagtgacgtttgacctatgaatgttctaatccaatcatagaattattgtatagagttttggtttatacccaagcagagaaatgaatagtttcatgaactccatcagtaggggtgggcgttcagtttactcggataaattgggtcggtttcttcagttttctcctagatcggtttctctaaaacacaagccgagaaaagttacaaaaaataaaaccgacccgaataaaccgaagaaaatcggttcggtttttacgggattcagttttgaccgcgcggatgcgccgataccactcgattcgaaggcactgagcagcggcgtcgacaagttctgacactgccgccaagtgccccttcaaccagagcttctgcgctgccgccgagtcctccgcagaccagctctagcgctgccatggagtaagccgctctgacgagcgccagtgctcgccatcctgctagctgcgcgctcccgctccgctgctcgtgtcgcaggctccgcccctcaacgtttttgcttgctccgcacttccgagagggattagtgcagcgactccctaaatatcgagagaagttcagcatgcctttccatgagattgtggttgactggttctggttgggaaaaagtacaccgaagttctctcaatttgtcatcagtataaaaaacatcctcgaaccacaaaaccagatatacggggtcccttaactgtataaaacaggtcacctgaggtcccaggacagtattgacgccagatttgtccaccatggcgctggttttgtccaccatggcgctttcaccacggtcttcggtgctgagtcaacgcctaaataccctcttctctctcccccctctctctcccccctccagcctccagggcgcaaccaacgcatcgcagcgccgtgacgggtcacgtagctggacggtcgccaccagcgtgacacaggcgttggagccgtgtgactccaactactcgtcgggtgacactagcgtgtcgaacacggtgatggtgtcacccgcggccagcgccacctcgaacggcacgtcctcatcggccatcttcgcctagatcatgagtgcgtccacacccatagcctcaagcttctatggggagaagccaatcacctcctccagcgtctctgggttgtccgccgcagtggtgacgcgctcgctccggccatcggacacggcggcgccgagcttcgccactttgtccgcgtctgggcaagagggttggtagtggttaggttttcatggaacgaccgcctccccacgccggcggcggcggccgccgccggcgtcctccgctgtcgcggcgccgccctcctcctttcccgcctcctcctccgcgcccccgctccactccacttcgccggccgctgtgcgctcgcaagccgcctccgccgatcgtcgctcagccccactcaccgccgcccgtcccttgctactcactcgtggcaaagagaagagaaaaaagaaaggggaaagagagagggcgacgtggacacctgtcatgtggggcccacgtgggtgccacgctggctcagccgccacgtagagcaaaaccagggtcaaaaccaccgaaggacctcgggtgaccggttttatatagttaagggaccccacatatctggttttgcggtttgaggacgttttttatcccgatgacaagtttagggaccttcagtgtactttttcagttctgcttgccttttatctgaggaataagtttattctgtgaccctcaaaactgatcaaaatctaattcgtgaccctaagccaaaataccggatatctcaacccccaactcttaaaaccggtacaatttgactccctcggcggttttggagggcggtttcgctgacatggcgcttacgtggcgatgttgacttagtcttcggtccatatggggttgatgtggcgcttatgtgttctagaattaaaaaaatatgtgtgggacccatttgtcattcacatcaaaataatgtgggacccacccacatgtggggcccacatgccattcttgattgtgagacacaagacatgctatagtagatcggtgtatgcggtgcgttcggtttgcgttatctacaagctgataaaacagccgaacaccgaagaaaacaaaattagaaacccaagctccagccgaagaccgaaaaaaaccggtagttcggttcgggtcaggttgggtcggccttcggtcttcggggaatttctgtccacccctgtccatcagcccagatgacttgtctcaggagctacactctcaacttatgagataatgcaggctgttaatttgcattactcttgataattttttggtttaccttgaaaatggggcaatgatgcaaccagttgactaactaacgttgtttatcaaatcactaaccttctctaataagtttgttgtcgaatggacaactatgccacgtcgaaaggcgtggttctcccaacaatagttggaatgtaaaagcaattgtattaattcttaaaattttttggggatccccccattacatggccctagaggtctatttatagccttagcacaagcttccaccttctagggtttagggttacaaaggattttacatggttgcccttatgaaagggacatttacatgggtacgcagtgtcatttgcacatatgggtctttaatgggctgataggctgggcctggtctatggcgaacgggcctaaaaggccgggggcggcctgttgggccttcttgatgccgaactcgtcatggcgaagtctttgtagttcgcccgagatgcctttactttcggagtaccgacgcggcttttcagccttcgccatcttcgcttatggctttcgccatagggcttcgcctgaatggtcttgatgtctttagcttaaatcctggctggtactatggtttcggcaggtccggccgaagggcttcatggcatgcctccaacaagcccctcacgggcaagggtgagtaaggagcttcggccgagaccgtgcaaactatacggtatggcatgaggcgccccctttcggctgatgttcctgtcgaaacctctttttagactcctgcagaaaaaatatgaacactggcattcgcctttcgaaaatggcgaagctgtattatgacactgggtgattatattttgccaagtttgtctgctttgcacgattcttgacttgtatttttttttctttccccttttccctgttgttttagaggggattttgccaaaagtcatgcgttcggccccctttcggggattggcgaaaagatttgttgacttttcagctttcgacttctgttttcgactcgtagcattttgcgctgggaaaaacgcttgtgttttgcataagttgaatgtaacggcgttcagtatctttattctgaaacaagctatcgcggtttcaatgttcggcgagcgttgcttcggccgattcgtttcgtccccctggcattttcgtcaatcaagcgttcgcctcttatgtagctatgtggttgtcaaaatggcgaattggaggcgaagacatcctggtcgaaccttagaggattacgaccggtgccacatccagcgccgcgatgacattgccacactttggttagacttcgaaatgactaatcattgagctgctatcgcttgacgtcggtatgtatttcgcctccttcccaccttaaagtcgtgtacagtatagatgacgaaccgtgttcgccggacttagtaggggcgaggcgaaaatgtcctgaaacggatgatgtaatatacttataaaattttttgctcctttgtataacacgtatgtgcttttgcccgatggagcttgtgcgtgtttttaagtttcttttcgctatcattgcattttgtaacttgtacgttcggaagggtgaagcatgtcggtccccttgtgtgttagcaaaaggaattcacattgacttttagcccgcatcattcgctctcgacttttggcatatgcatccagaaatgcttaagtatttgcagaagtcgagtgtagcgacgatcggtatgttttctgaaaacgagctgtcgcggtttcgcggtttcaacgttcggcgagctatgcttcgaccgattcgtatcgcccccctggtgttttcgttgatcaaacgtttgccttggggtttttccacgaaatatcatacacaaaaaaggcgaagacacccatgaattttatatgactgagcgtcagtttgccattgcccagcgtcgacgcagcataatccccgtttttccttcttcgccgctttaaattttttttgtgttgatctaacaactagcgatgaagaagatgctcaagggggtagtccttcgccattgaggactgcttttgctgatgaatcggatgtaaagtccgaatgccttttggtgggcaatggaatttatctgtaacttgtgctttttggcaaataaatggggtgtggtgcgtgttacggctgttcggcttgtactttcccctttttgcctttggcaaaggtatttttaggtactttgatcgttttgaccattgccggcttttggtctttttagtacttcgacctttttaactgttatcggctttcggtcttttctttagtgctgctagggttttgccgttcgtccctttcggctgccccgttcgtctgcgggtgtgcaaccgatgcgaacttgatttcaagttttagcccctcacatatttccttggacttctcggagtcaaaccgcttgttattgccggtaatgaactctttcggcacaccgaatcaacagaaaatgtttttccaaatggatttttacactagtgccgaaggtactaccttagcccatcgaatgcggcttgacactcaggtgtccaattgagtttgccggcccctcggagcatcttgaaaaatgataaatctctttcggctgctcttgggagcaactccttaacccattttcgcccccagcccttgtcgccgtacctcgctggtactgtggcgaagggcgtgggtgtggcaaaacctcttcgcccgcagcccttgacgccgtaccttattggtactatggcaaagggcgtggcgtgtgacgaaaccttttcgcccgcagccattgacgctgcaccttgttggtactatggcgaagggcgtgggtgtggcgaaacctcttcgcctcgcagcccatcacgccgtgccttattggcaccatagcgaagggcgtggcatgtggtgaaacctcttcgcccgcagcccttgacgtcgtgccttattggtactatggtgaagggcgtggcgtgtggcgaaacctcttcgcccacagcccttgacgccatgccttattggcactatggcgaagggcgtggcgtgtgccgaaacctcttcgcccgcagcccttgacgccgtgccttattggcactatggcgaagggcatggttgtggcgaaacctcttcgcccgcagcccttaacgccgtacattattggtactatggcgaagggcgtggttgtggcgaaacctcttcgcccgcagccctagactccatgccttattggcgctatggcgaagggcgtggcatgtggcgaaacctcttcgcccgtagcccttgacgccgttccttattggtactatggcgaagggcgtgagggcgtgggtgtggcgaaacctcttcgcccgcagccattgacgctgtaccttattggtactatggcgaagggcgtggcgtggggcgtggcgtgtggcgaaacctcttcacccgcagcctttgacgccgtaccttattggcactatggcaaagggcgtgggtgtggcgaaacctcttcgcccgcagcccttgacgccgtaccttattggtactatggcgaagggcgcggcgtgtggcgaaaactcttcgcccgcagcccttgacgccgtaccttattggtactatggcgaagggcgtgggtgtggcgaaacctattcacccgcagcccttgacgacgtaccttattggtactatggcgaagggcgtggcgtgtggcgagaagggtcccattttgccctttcggtctgggtatccccacggacggcgccagctgttgtcgaatggacaactatgtcacattgaaaggcgtggttctctcaacaatatttggaatgtaaaagcaattgtattaattcgtaaaattttttagggatccccctattacatggccctagaggtctatttatagccttagcacaagcttgcaccttctagggtttagggttataggggattttacatggttgcccttatgaaagggacatttacatgggtacgcagtgtcatttgtacatatgggccgttaatgggctgataggctgggcctggtctatggcgaacgggcctaaaaggccgggggcagcctgttggtcctccttgatgccgaactcgtcatggcgaagtctttgtagttcgctcgagatgcctttactttcggagtaccgatgcggctttccagccttcgccatcttcgcttatggctttcgccatagggcttcgcctgaatggttttgatgtctttggcttgaatccttgctggtactatggtttcggtagatctggccgaagggcttcatggcatgcctccaacaaagtttgtctagccgatgatcctagagctaccgtgcatttcatctacagtgcaaccaagaagtaaaaggagaactgaagaagaaggcatcgcggacgcccgatgccaatggcatcttagatagtcagtagccatcaatttcgggaggaatctacccatgggagtgggacgcccaatgcctccaaaaaataggaggatgatcaaatattgcagttgaccaacaactgaaacattaagttatatatggtgaaacaaaaaaaatcagcaactaaaacatttaaatatcttataaaacatggtgaaaatacacgttaaaacatgtcgttatcacatattttttatataatggaatgaaacatcctagtctttactcaaagagttacagccaattattacataattcacatagaagaaaactcacaaagaaagttcacgatagcagaaacaaagctaagcaaacacaaactaatagactgtaatacccggtgttcttgagcatggttgggcgaattcgagggcgatttcgatttaaatgggggaagaatgtaatgccctgagtttcgaattagtatattttggggaatattagaacaaatgcgcaaaagtttaatttttaaaccattgttcgaataagcgatcaggaatcgtggatgcatagagttcgccgagtagtgcaaatagactataagttaaaacaatgtgggccgttagatcttttcagtctccttatatacccaaccaaaagaaaaacgaaaaacaaaaaagaaaaaaaaacagggggatcgctcctgcaagccctagccgccacatctcctgcgtcctaccaccgccgccgctgttcctgtctccgccggcgccgccgccgccgccggttcagccgtcgtcgtccttcgccaccccatccgctcgtctccttggtgagctgctgctgtgttcttccctgctgttcctgttttccctaatgctgccgccaattggatctgttctggtgttggtgccgctgcctgtgcatgctaacgttcctgctgctgctcatgctatagcgtggcttgctgcttgacgctgctgcatcgatcagagacgagaaggctccagacagcacaggaagcagttgaacaggagtaacaagggaaggaaaaggtagaacaactttggggaatttcagcgatttcgcagattagggaaatttgttgcaaagtagtgtttctctgcaattggaactttcttttagtctctagatgtaaaagatttcaataggaattaattcgttggcagtttgtgcaatttctgagattattggttatgggctggaaacggtattttcaaaactgacattaaaccttcacgattcaggttagttgtcctaaataaagtttgtagtcatcgacgatatctttctaacgccgctggtttcgctcgattccgataaacggtttaggacaaacaacagaaatagtactgctgaccgggtcctgaaatcaggacagcaaattcgttttccttaatctgggattttcagaggcataatctgatttttcactcaacatgaaggttgtagacaattttgtctagatgtccgaagttatattatttgctagattccgttagacggtttgtgagttacgtataaaatagtaagggaactgctataggttattttatatgttcaggttatcgattttagtaaatatcccttatatctgtcattagttcgatatagtggtttatgcgtagttttgctccacaggtatgaagggttccaacgttgaaggagttgagtcggagtatcgaaggagttaaagcaagtacaagacggacttgtgcgatggataaactgtgttgctttgttggttttatttacccaattattattcgaagcttcctattatcaattgtgtggttttggtattatgttacatattcatatttcacttcatgttcaagttcacgacgttattcatgtttctttcttccggaagtttctgtttacgttattcaagtaccatgcgtagttatgggagtgcaatttggatctttattcatgatccttaagaagcgctgatcacgcttgctcggcttaccggtaatgctaagaggatattcacacctgctcgggagggaactactattttttgtctccttcgttttaaattaatggaaagcaaatgcttcatattggtttcttattgcactaaacctgcgtatgttttactagttcaatattgtacttactgagtattctttactcactcttgtgtttaatttggtttttaggtacctaatgacattgatcggcatggggcgggagtagcacccttggactacacattattattgcacactattggaatttagttttagattatgtttctgcttagcataagttttgcgtagaacttgtaacggtcatttaaagttccggtccttattttcacgtggaatttgaggagctaggatggtttggattgtgtggattatatcgttattgagttatcttataactgactgtcgtggatgtccgtaattttaggaggagactgccgaaatttctaataattttcggagttaagtggtttttgagtgtattttggtatggcactctaggtacgtggttacctgggatgttacatagacaccaaccgaagaaaaagatcccctaactacttaattctattagagaacctcgacccgaagttggcaaatagatgcataattgtcgtgtcaagtttacgacattcatcatttattagcttgatatcttcatcatgtctttgtaattgaacccatcctcgaaactaatatgttgccctgaaaaacacctgcaaataagattttgatggtgtttttatcaaaaaccatatcatttctactaagcctaagagcccaacatacagcggaagctccaacaagaataattttttttatttttttactaacacccaaaagccaattcccaaacgtatgagatgtactatgtagaggataaagtccaaaaaataattgtatagctctccaaagaaatttagaaacatggcactcaaagaatagatggtatattgattcatttttcatataaaagcaacatcttaaactaccattccaattccttctagtcaaattatctttagttaaaacgatccctttaaggagataccacataaaaatcttaatcttaataggcattttaagtttccaaataatcttatttctctctatgtattattaattaaagctaagtaaatagatcgaacagaaaattggccattttgatgaaaattccatctaaaaatgtcatcctcgtctgttaagttaatatgtacaatggaagcacacaaattatgccacctaattagattttgaccaactaatgctcttctaaaagtaacattaagcggaatagaacccataacattagcaattgaggcatttttccttctaactatagaaaataacgaagggtacttttccttcaaagaataattccctagccacttatcctcccagaatcttactcccagaatcttacttgttcaccattattaataatccaggaagtcatatttaaaaatgaattcttaaccttcatcagacctgataaaaaatgggaatctcttgtttcctctcaacctgagttattgatttaccagtaagatattttcttttcagtaaatcttgccacacaccttgctcatttattaatttaaacaaccatttacttaaaagacattggttttttatttctaaattgtgaactctaagtccgccctgatcttttagctgacaaataatatcccatattgtcaatctatactttttttatgttcatccccttgacaaaagaaacaggatctataataaccaattttttgaagaacccctttaggaatatcaaaaatgatatcataaacataactagacttgacaaaacagaattaatcaaaaccaatctcccactaacatatatatgtttacccttccaactactaagtttttttttcaattctttcttcaattgttatccaatctttattactaagctttctataatgcataggaatgccgagatatctaataggaaaatcacctagctatcacatatgaaacaacaagtattaacagattgaaatatatgttttcctttcatcaaaatataatcatgcgatatcttgttctaaagatttaattacaacgaatacaatagtgtgatcggattgttgattggataagtaatttaggagaaaaataatcattttgaagcttgctaaaatacatgcacgtatgtatggatgaggtggagaaagtggagagagagagtagtagcaagtagtttaaggaattttgtggaacacaatgaagacacacattgaaacatatcactaccacgtataaaaaatttagttttaacggtttaaaacacatgtttttattttgacataatataatcatatgatatattgttgtgaagatttaattgcaatgaatacaacggtgtgatcggatcgtagattgaataagtaatttaggagaaagaatatttaaagagagtaggaaagaaggagaagaaacagctagacatgcatgtgacagtaacagggttcgtccgattcattgggctgctgatttgcatcatttttccaaatttcgtgttagagtactgatcgtatcagggaaagcaaaaatttatgtattagagtaaaactcaaattaatatacatttgtcctatccagatgtaataattactataacctactacattctaaatttgtaatacttaacatgcaaaaataacacatcatcatgcaatagtaatttattatattttaatcctcatgtaaacattgctatatcatctatatgtattatattctaaagcttatacatacaaatatattaaatcatcatcccacataatctagtccattaaattttctacaaacgtttctagggcagtcctaaacgttcctgcttcctagtttgtagctcccattcatgttttgtagctatattatatctatgaattggatttataagtaaggaaaataaaaacaattaaatccacaaccctcttccacctcacctcctccccatcccctcgcatgtgcatgcagctgcgcatacccgtttcctgcttcccctcctgcttcccattttgaagctcctattcctattttgtagctatatatcaaattaaaaggagaaaaaaaatcaaatgtttttaatctaactaaaatgttgttgcattcataattaaatccatagtgcccctatttttgctatatatgtcattcggccaaaaagcagtgcactttgcatgccatataaatagcataaattactttaaaaattagcatatattgcatcaccatataccattctataggcatatgtatggctaaattaaatttccagtatccaaacaaagattagaaaataaactattcagcgatattttatcgagggacaacaccctacccttctaaacttcatctcaactgacataaaaacattacaaaattattcaacaacaaaggttgcaccattatacattattttgcaaatgtgaatagataaaatataaactatgtaagaaaaaagaactaacccaaaatgaataactaaaaccattacataaacaatctgatgccttcagtgagagaaaaataatccaagcaagccaaataatgtttcacataagtgctttaaaatatattctatattaccatctaatcgaatttagacaatgtttaatgtatttttaatacatcatagatgaacataatttgttctagtgtacaaaccgttgaaaaagtggatcatccttacatataattcataatatttaattgttgattttttagaaaaagtatttaaatcatagaagcaatcataaaaaatcatataaataacaatgatgcacacatagttatatttagccattgtgttctcactggattgcgtggactctttactcacactctgctcgaaaagttatttgatgggttgtcttccacactgtgcaattgaattggactttacgagcctgtgcattaagcataggatcatgtccaacccaaatccacccattaataaacaacaagaatataataataataataataataataataataataataataataataataataataataaggaatagtactatacatgacatttaactatgtacaatctgttttaactcttgaattattttggagaggaagacagacaaatatatctgtgtattgatgaaatggataggatcaaccactcttgaggtgaggacgagagagggggaaacctatctacctatc

SEQ ID NO: 60221 - DNA, 64409 bp, Oryza sativa
  unsure (1)..(64409): unsure at all n locations
cctctccttttgttcgttaggaggctccggagctcgtcccgctgtcgccatcgtcctccgtcgctcgccgtcgtcgatcgttgtcggtgaggcctctcctcctctttctctctctctcccgcaccgtttagccgccgcttagccacgtagctgccgcttcgccgcgacgccgccactctccgccgccggccagtcgccgccggccgccgtcttgcgccgctgccgcatgtgtgccgcgccgtcgcgcgccatggtcgccgggccggtttgcgccgtgcccgcgcgcaccagccatcggttcggccgccgcgtggcgcgccgctccttcccggtccgtggacccgatccgccgtggaccgccctccccgagccgctgaccggtggggcccgcttgtcggcgcccttcctccctctccgagtcactgccatgcgggtcccgcttgccagcgccgcgccccgccttgatgacgtcagccctggaatatattgcgcaataaatgatttaagatttttcttttatagtaataaacacagtgaatcttctaaaattcataactaattcatccgagctccgtttaagcccattcaagtctcagtaaatcaagaaaaatgtgtagaatccattaaaaatggtttcgttctctgtttcagtagtcttatagtctgtttgcaatgtttgctttgtatgtcgctagattccggttcctccgacgctccggtgtacttcgagatagtcaccgaggttcctccagcagcagagcaaggcaagtcatgcttgtcacttgaacatgttgatcctatattgcaaatgctctattattttctttcaaatattgcattgttttataatgttactaggggttgtttacctattgccgtagccatgctattgttgtaccttgtttctttgtcaacttggggttctaacatggttagagttaggactagggattgcttagccatgcctagttcaactagttcacattggggaaaatcctattaatgattagactgtcggttctaatggttttgttgggttagtgacaccgctttggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagtcgacgcatccaggcaagggtgggcgtgatggagttgggacgggccctgcgacggcctctgtcgcttccggattcacctaggcacgagaggggactgcccgctgccttgcgaggagtgggggtgaaacctgaggtgtggtgtgcttggctagagggggttatgtgaagggtcttgtcacggcctctttccggtatgtcgtggtggcatgtcggcacacggaaacgtgtcgtggggctgtgtcttgtgggtacagttgtacacctctgatcagagtaaaactattcgaatagccgtgcccgcggttatgggcggtcaaccagattcaccgtgattagtctcaccctagtgtaatcttttgaaactggatagttttggtggagggttgggcctgttgcaaagtgggatagcgttggacagtggatagttaatattaattaattattacaactgtttaatctttcaacttctgtttataaatgctcgctttatgcaaatgaaccactctagctcttcttttataattctctacatcatacccctattccggtatgacttgctgagtacagtgggtagtactcagttttgctctatttttcccaaccccagagtacgagtatgtgtcagatggaggtttctctgaggagtaggcttcgtccgtgccgtcgaggatgcctgtggagtggtgttcccgctgcagttctagtcaaggcttagctcctgttgtctttctttccttccgctgcatttatgtaagacttttatgatgtttgtaagacgtggatctgaatgtcaacattgtcgtttgtgtaccccggccggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggatttgttccggaaaaattgggatctgttcttgtggttcaaggggaaaaatcttggtcgctcgtttaagtgagatttgtcaaaacaagtcagtccagggtttttgtaaaactattgagatttattcgtcagtcagttgggatttaatgggtgaaatgcattaggtcctagctcaggaacatgggttgcaaggtatttatgctcttactgttattattagtatgtatctaatttccccaatattttatcgttatgtgagtctgtcttatttattcgctctcatgcaaaacgatctatgcataaaattttgctcttattcgattctcttatttgagtcttttattgctttatttaaatttggatttgagcatgcattgatcctactcctttgtcttctctagatggccggccacccacccaaccaccgcggagaaggcatgattgactttgtggcagagttggcacgtatgacgctggtggtgggctaccccaacgcgccagagtacacgactgttccaccgctcagtggcgagcttcctcaccgtgttcgcctggaggttcacggctacgtgggtacctgcctagctaatatggtggttgaggcatccggaggcacagcagatcacgcctgtcaggaggcagcatacctgatgatggccagactacgggagcgccacaactacatcttccacgacacggcgtaccgatttcaccctcgtcgagccagcggtgatgatgtcagtactttccgtccgacagccggcgagaacgacactacctttggtcacatgtgtgctgtgatgaggggattggataggatgcactcagacttgcacaaggcgtccaaggccttgaatgatgggaagctcatgaggatcgtcgctctgaaggacgagatagcgcgcctgaagagggataatgctcagttaaagggtcttcccgcgccaggaggagtccggatccgcactacgccccacaagaccacgactgcacccgtgcgcatccagcttgcgcccaagaacccacctccatcagcagctcccgcagcacctccagttccgctcgcagctccggtagttcctgcagctccagtaccagctctagctcccgttcacgtgtcagctcccgcgtctgctctctccttcgctccagcatcagccgctaggggtccagccagtggcaacggaggttggttgtctgctactcccagtggcagctgcgatctcagcagcagtagatccagtggctcagagctgggcagcggcgagacttatctgccaggctccaggagtcgctcagagggacctggtgacgagcaggacgacgccttcgactccaccgaccgtaggagccgttccgagcattaggctcattttccattagtttatcgtctgtctagcatttgtttgttagtttgtgtatttaggttgcttgcttgtgggtcagtcgacggtcgatatcatgtgcctatgatatggctgtcttaataaggatttttgcttgctttttaagtgttttaattcagatcagaacaattacagtttaaattcctatataataaagcttagtttttgagcctctatttttcttcttttcccccgtctgcttttcctccagatggtctacaccaggaatggtagccgcgcaacaggtgagggcagcaacggcgaagagcgcactgagggtgtgcatcccaacagcaattccggcaatggtccgccaccacttcccgagaatccgacgctagcccaagtgatggcacatcagacttagatgatggcagccatgatgcagcagatgcagcagcaacaccagcagatgcaccagcggatgctgcagcacgccgaacagcagcatcagtagtttggtccccctccccctcagtccaagttgctagagtttctacgtgtcaggccacccaccttctccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccgccaggcactgaagtcacttgggaagagttctgtcgtagcttcaggaaggcgcaggtggcagatggggtcgtggcacaaaagaagagggaattccgggcactccattagggcaacagaactgtgacggagtatctccatgagttcaatcacctcgcgcgatatgcaccggaggatgtccgcactgacgccgagaagcaggaaaaattcctagcaggtctggatgatgagctaaccaaccagttgatatctggagattacgccgatttcgaaaggctggtggacaaggcaatccgtcaggatgatcaacgcaacaagatggacaggaagaggaaggccgctcagttcagggcacctcagggaagtcaccagaggccgcgcttcgctcccgggcagcagggtggacctaccaccatgatcgtccgccagtaccgcccgttcaaccctagcaactttccccagggcgccagtggcagtcagaaccaccatggaggtcagcccaaccgcggtgcagctccacgcccaccaacggcaccggcacagtcaggcccgtccgcgcaagccaagagggagactggagcaaaaccagggtcctgcttcaactgtggcgagcttggccacttcgctgacaaatgcccgaagcctaggcgtgccgggccaaggtttatccaggctcgtgtcaaccacgcatctgcggaggaggcacaagcagcaccagaggtcgtactgggtacgtttcctgttaactcaatccctgcaacaatactttttgattctggtgcaacacattcgttcatttcaaagaagtttgtcgggatgcatgggttaaggaaagaagagcttagcacaccaatgagggttcatacctcgggaaatagctcaacctcagtcagttttagcccttcagtgctaatagaaatccaaagatcaccatttctagccaacctcattcttctcgaatccaaagacctagatgtcattcttgggatggattggctgaccaagtttaagggagtcatcgattgtgcgaatcgcacagtcaccttgaccaacgagaagggagaaacagcagtgtacaaatcaccagactcaccaaagcaaggggtctctttgaatcagattgaggcggaaatcccagtggacaccgtgaagaagaatttgaggaaattggaagatatacccatagtctgcgagtatccagaagtgttccccgaagaccttactaccatgccacccaagagagagattgaattccggattgacttggcaccgggaaccgctccaatttacaagagaccgtacagaatggcggccaacgaactagcagaggtcaagaagcaggttgatgagcagctgcagaaagggtacattcgaccaagtacttcaccttggggtgctccggtcatttttgtggagaaaaaggataagacgaagaggatgtgcgttgattatcgcgcactcaacgaggtcacaatcaagaacaaatatcctttgccgcgaatcgatgatttgtttgatcaactgaaaggagctaaagtgttttctaagatagacctgcgatcaggctaccaccagttgagaattcgggaagaggatattccaaagacggccttcaccactcggtacgggctatatgagtgcacggttatgtctttcggacttaccaacgcacccgcattcttcatgaatctgatgaacaaagtgttcatggaatttctggacaagtttgttgtggtattcatcgacgacatacttatctattcaaagtccgaagaagaacatgagcaacatctccgtctggtactcgagaagttgaaggagcaccagctatacgccaagttcagcaagtgtgacttctggttgacggaagtcaaatttctgggccatgtcattacagctcagggtgtggcagttgatccatcgaacgtagagtcagttaccaaatggatcccaccgaagaccgtgtcgcagattcgaagttttctaggactggcaggttattaccgccgattcatcgaaaacttctccaggatcgcccgacccatgactcagttgcttaagaaagatgagaagtttaaatggacagctgagtgcgataagagttttgaggagctcaagaagaaattagtatccgcaccagttttgattctgcccgaccagatgaaagacttccaagtctattgcgatgcatcccgtcacggacttggatgtgtcctaatgcaagagggcagagtggttgcgtatgcctcgcggcagttgcgtccacacgaagggaattatccaactcatgacctggaattggcagcagtggttcatgctttgaaaatctggaggcactatctgattggcaaccgctgcgaagtatatacagaccataagagtctgaaatacatcttcacccaaccggacctaaatctccgacaacgaagatggttggaactaatcaaagactatgacatgagcattcactaccacccgggtaaagccaatgtggtggcagacgcattaagcaggaaaagttactgcactgccctatgcatcgagggcatgtgtgaggaattgcggcaggagtttgagcatctcaacgtgggaattgttgaacacgggttcgtagccgctctggaggcacggcctacgctcgtggatcaagtcagagcagttcaagtaaatgattctgaaatagcagagctgaaaaagaacatgagagtcggaaaaacccgggatttccacgaagatgaacacggcacaatctggttgggagaaagattgtgtgtacctgacgacaaggaactgaaggatctgatactcaccgaggctcatcagacccagtactccattcatccaggcagcaccaaaatgtatcaagacctcaaagaaaagttttggtgggtcagcatgaggagagaaaagctgaattcgtcgcactctgcgatgtttgtcaacgagtgaaggcagagcaccaaagaccagcaggtttactccaacctcttcaaatcccagaatggaaatgggaggagattggaatggactttataatagcactgccccggacatcatcgggtcacgattcaatctgggtagtcgtggatcgactcactaaggttgctcacttcataccagtacataccacgtatacgggcaaaaggttggcggagctctacctctcgagaatcatgtgtctacatggagtacccaaaaagattgtatctgatcgagggagtcagttcacctcaaaattctggcagaagctgcaggaagaattggggacccgtttaaatttcagcacggcctatcacccacaaactgatggtcagaccgagcgagtcaatcaaatcttggaagatatgttgagagcttgcgctcttgattttggtggagcttgggacaaaaacttgccatatgcggaattctcgtacaacaacagctaccaggccagtctacagatggcaccgtttgaagctttatacggccggaagtgccgcacacctctcttctgggatcagacaggcaagcgtcaactgttcgggacagaggtattagcggaagcagaagagaaagtcagaatcatcagggaaaggttgaggattgcccaatcttgacagaagagctacgcggataaccgccgaagggagctcacttttgaggcaggggattacgtgtatcttcgtgtcactccgctccggggagtacaccgttttcagacgaaaggcaagttggcaccacgcttcgtgggaccctacaaaatcttggaacgaaggggagaagttgcttatcagttagaacttccatccaatatgatcggcatccatgacgtgttccacgtgtcccaattatttagcaaattacgagaatgcttcaacacgttggcattatcgtaatttgctaaataatatttgacaaaaaaatcgagggggattttttttatatattttgaaccagtcgatttgcttgcagactcgtgcgcaactactcctctagctttagtgaccgcggtggctcaacaagctagtctttagaaggaggatggaggggagggcagaagagggggaaatcgtcatgcttagagggatgactgtgaaaggcggtaaacataggcaggtcagcgagacgatggtaccgaagctgtagagatgaaggagggtggtgggccactggtagcaggggcaaggcaaggagagtagttaggaggccggtagtggtggatccgatggctcccgctgctggagataggaagacaacaggcgagggcatctaattgctgccagcttgaggaggagggggtggcggataaggcccaccgaggcagggggtcgccggcaccattggcgacttctagccaagcgcgaggtcgagcagtggacgggcatgctgatggaactaggactttaagagtgaggaggggggagaggtggggttagagttagagtactatacaaatctcaaagcaatcggatggtgcaaaatttataagattttcttggagtgtttttgtgtgaaatgcaaataaattatcccttttttaagtaggataaccaattgattatccatggattccatggatgatctatactactattaaaagatagtattggtggtggtgagtctgccaccagcaccatcacttacatgtggcccatgatattaggattttgggcagtcgtttatattatgtagactgcagatctttaattttctaagcatgatatttttgtttgtttcttttagatgaaaggttgtgtttcaaccaattaaaaatatagttttttttaaccaggacttaatattgctattttcaatactgttgcaacgcacaggcatttggctagtatagtaataaatatataaaaaggcattaaaatgttgttttaagagtaatattggagacaaacaaaaaagggtttgttggaactatgccaccctatatttgcaaaatttgagatataccacccgtatctccgacatgtaggacccacatgagtcaatgacatgtggaccagggtggcatatcacaaatttcgcaaaatttgtgtggcatggttcaaattgtcccaacaaaaaatgtgtaacatagaccaaaagagactccatgtattataacatcataggagatgcaaagatactctatacattataatatcgtaagatcaaagtactctatatattataacatcgtaagagatgcaaatagacgagcacatcacattgactactctaatatatgcatgatcatattgacaagaattggtaagcagagttgtcaagggatgtcatcccgacgtcaacacgatggcctactactagagaggaggaagaaatagatctagcctattgcttgttttcaatttttgatggttcaactcaacgtattagatgtttcactagttaggtaaaaaatgttgcagtgattttttttggtattctttttgccgaaatcattcggatctactgatgtttcagtggtccaaaaccgatgtgtcatatgttgtaccaaaatgtttcaagtgtaagttgattgtgtttcatcgtttagattgttgatgttcaaaagttgagacatttttgttcgaggaatgaaaccttttttttctaaaatgataaaacatgcggaacactttgcaacattttacgtctgatctgtagtcgccaccgtaaattataaattaggttaaaaagtgagctactcctataaattagttcaggaattactctcatatatacatagccctctaatattggtcggatggaatgttagattttcttttacctcaccgcctcaccggtaaacgagtcaccggctatcctggccgggcaccccggtctaaaaggcccaatcccatatgtggaacaccgaacgtccctttggacggaccagattgctccgacctcaccgtctctcttctttctccccaatccctatagctctcgcttcgtcaaattctccggcgtttccagttcaaaaataaaaaataaaaaatctccggcgcaaatcctcctctccgccgccgccgcctccacctccaccgctcgccccctcgccgcgcctccactcctcacaccacgctcctcctgacctcctccctcgcgcttctccggcggcgcctcgctcctctgcgcggaccgttgcccctggccgagcgcggcgcggcgcgggccgcccgcggggggatcgggctcgggtagaggcgggcgacctggcgggggaagtaaggggtcgcgcgtggcggggagatgatctacacggcgatagacacgttctacctgacggacgagcagctgcgggactcgccgtcgaggaaggatgggatcgacgaggccaccgagaccgccctccgcgtctacggctgcgacctcatccaggagagcggcatcctcctcaagctgtatccttctgcccctcctcccagatccccccaccttttcccgccttgttcttatgcccaagtcaaatcgttaggggtctctcaagcatgctagggtttccagcggttcagtgattaccatccatgtttactagcgctcgctgaatcgcaattgatagggttatttggtttgcttagttttagttcgaacgttgtgctttggattagggttttggttttgtcagattagagatgcttctcttttatattatccagctaaactaatgaaaatgtcaatgttttctctttcttttcggagtcttatgtttttttttcaatgtagaccaatacatcatttattcagtttgatgttctcaagaagattaacattatataaggttacacgcatcactgaatcttgataattttgattccaatgaaaaaaaatgcaaataaatgtgttatgtttctttgtttatgatataggagaaaatgaggatctcttgggcttacttaaggtgataagttgttccaggacggttgatagttgccattgcattttgtttgtagaattttgtcttttcatgccattcaggtcatctgtttttaacaaagttcacaagcttgaaatctgtaaatttttgttgggcaaggaatcaggatgatatgggtattaatcagtgtgctactcacatatattaggttatgcactgttgcatggttttttctgtttaatgaaatatgatggaaacagttgtcggttgctgggctgaatgaagtggtacttgtagtaaatggtgctcgctacaccatcttatcttctgccttgcagaggtaaaataaattggatggaattgatagttgatgtaaaatacataaaatttgtcttctcaagccattcaggttatcagattttcacaaaatgcacaagtttgaaatgtgtaaatttttattgggtcaggactcaggattatgtgggtatggatcagtgtgctacccacatgttttaggtatgcattgcctcatgatttttgctggttaatggaatatgatggaagcagtaggagttggttgctagggtgaacgaagtggtacttaacttgtagtaaatggtgtttgcaacgccatcttatcttctgccttgcagaggaaaaacaattcggatggaagagagagttgttgcatatattaggctactttataaattatatactataagtaaaaacctttttctcatactgacctatttaggagagggaacaaatctataagtcaaatagtggatggatcacatgcgtgtccatgtttttacatcgattacaaatttgaatattctcatatctgaggttgaatttagatatcatcattgttttaacatgaaatgatccaaaatgccagaacatgaaatgtgcatcctatggagtatttgggaagcactgaaagtacactctgtggagtggcaaaaatgtttttcactctgttttgttagacatgccacatatatcttcattgcattttctagttaaaatagaaaagagcataatacaacatatccaatggaaaacattaaaccatatttgcatctgtcaaatctagatgagtggcttatgaattgggtagcacaacaaagaaacaacagttgtggtcaagccaccatatttgcatccattctatttcagatgtcaaataatttagttagtcagatgtccaaccaaactaggggtatcaatcggatacgaattatctgtagactacacaattctttaggttaaaatatggtttattatttccatcggttaaatagtttttccctctatttgattgtgtatatgtgttctacatttccaaataatgttatctgagccgtttgtattcaataaacaatatacatattttattgtagtttgcctaacagttttttctttttatgttttttccctgttcactcaatttaatataattattagttatgttttctaagaggttaaacgtccttaatatcatactgctacataaattacatggatattgaaaatccaactgaattacttatgtgtttgtttcatatttttattcatcacaacaatcagttttcctttttagtccgtgtgagcgtatttgaatatcttttgttatgtgcttaaaacatgagcatgaatgtgtaaagaccttactcgattcttattagatctgttgacatccctaccccataccgtatttcatgttgccacaattgatgtagcaaatcttcaaagatatctagttgggagatagtgattttcataattttctatgtagcttgaatttagctaggccccattcttgcaacttttattttcttttcttttttaaaagtataatatttgcatgtggtggattccttgacgcaccaaagaccacaagcagtgatggccacagcacaagtattgtttcatcgtttttactgcaagaaatcatttgttcggtttagcgttaaggtaagcaaatcttttgtctcagttactctgatcaaaccagtctttgattttatgagttgaaccaatgaatatctctgtttatgcttgcagagagttgctgcaagctgtgtttggctggcagggaagttggaggagagtccaaggagatcaaagcatataatcattgtcttccatagaatggaatgtaggagagagaacgtaccaatagaacacttagatgtgttttcaaaggtttatctgtttctttactctctgtttattttaaatattttttgaacctttgtgcacttcaaatcttgatgtctctagttcttgctctcttgctgctagagctgtaatacctatgcttttttttagaaaatatgtaacttttataaagaattatgctaattgaaagctgtaactatttgttgcagaaatactcagacttgaagcatgatctggtaaggacagaacgccatctgctgaaagagatggggtttatttgccatgtagagcatcctcataagttcatatctaactaccttgcaacacttgaagcccccgaactgacgcaagaggcatggaaccttgccaacgataggtacttcatttgaactaaacttaccttattgtagttagatattcttattgaattttatgcagttcaattatatcttactcttaagtcttaactagttttttatagtccttgggaggtatttctagttgtagactattaaggctgtgttcggcagcttgtgttcccaacccctctccctcgttttctgcgcacacgcttttcaaactactaaatggtgtgtttttttgcaaaaaaaattctataggaaagttgcttaaaaaaatccatttattaagttaattttagctaatacttttttaattatgcgataataagctgttacgttttccatgccggagggatagactcccaactggcacaaacgaacacagcctaattgtacctgttatcttataatacctcccaaggaccaaaaataataatatattctaccttattggtgaaattttgttttagtttagaattattggttctcttaaaagatttttccagcattgctcttgacttttctcttatagtactttgtttgtctcgcagatccttaccatttctaattaactattgaaaagcttgactaagtgataccttttattttctgtagtcatctgtctgtatcatgtcatatatgtacatgaatccttaatattctgatcagtgtaaattatgaatgagttgcctgtagtttcagaatgtaccaatttgctaattgcaacagcaaaaatcaaataggggctaaaatgctaaatgaactgtattctggacatatagttctcccttatgctatcatatgtatagagttgtagatagtgctctggtacagaatgataacagttaacaaataacaaatcttcccatgacagtgataagatccagttaacctagtgcaggtttgtagtttcagcaatatgaatgcagcattgttaaaggtgcccttagaccaaaacaagccttcaataataatcgcattagcttttggattttgaaaacttagtcacatatgctggcccaaattacaaggagtatgattatgctgtagaacttgtggatgaacttgatggccaatacaatatttttttataaaaaatatgagtatgttaccaaaatgttgttagctgatgatcagccttacacttcattggaagattatcatgtatgttgtatgaaaatctcatttatatctcttagcttcagtaagataagtggaagagaagaaaagaaagcaagggaaatgtaacgtgttagcactcttggtctaatgcaaccagaatttattgtgcctttaccgagatgacttttattttttttttcatgtaatagtatatttagatgaccaacctatttgccaagatgatgcctgtcagccatctcataaggaatgcatgtgtcaaaatattttaaaacttcaagtctgatcagtcaggatttagtgtaccataaaatagatttattatcaaggcttactgcttttgccttgagctttttcaatcatactgagagttgagttcaatttgcacttctaattcaatgcgtattttgcataacagcttgcggacaactctatgtgtaagattcaagagtgaagttgtagcatgtggagttgtgtatgctgcagcaaggaggcatggcgtgcccctccctgaagatcctccctggtggaatgtgtttgatgctgatgaggcaggaattcaggaagtttgcagagttcttgctcatctctacagcctccccaagtcacaatatatacaagtgtataaggacaatgattccttcacgcataggaggacttctgatacaaatgcttcaaaggttaaaaagaatgattggactcgctaagtttaatttaaaaaattgttaccgatgtcatttttttgtactcacgtgcaggaaagtcctgcaacgactgttgcaagcgataagggtacccctgtaccgtcaagttctagccaggaaaaggatgcactgattaaggcagggtcagataaggtgaaagaaaaaggtgacgatgatgggaagacgttaccttctgaacccaatggtaaagaaggccctgcagtgaatttgaagagtgagaagtcagaatccaatgttgatcgctctcgggaaagagaaagagatagatcaagagggcgggaccgtgatagcaggggccgggactctgatcgtgatagcaagggcagggactccgatcgggagagggagcgtgatagagaagcagacagggataggcagcggagacaccattctaaggacagaagttcaggtattgccattgatttttctgctttggctctttttataagcatgttacgttttcctgatgttgcatgatgcccctccaatgcaggatactctgacaaagagaagtcaaggcaccgctcatcaagaggtatgctagcacattagcggccctccagtggaccatatatagttttcttatctgcttcattttggctaccttttcagatcgtggtgatcactacagttcgcactcatctcgtgacaaagatcggcacaggcggcagtaatctagcagagctcgaaaacatgtaaactgatgaagtacacgttgcactatcgtggtaaaattgccattgcaactgggctccggggtgtttgttatgattgttaaactctttttttatttgcaacagaaaaagaattcttcttttgtggtgagtatcagacttcatagacttagctttgtatgacgcgtgggtctgggcatgaatcacttgttatgggagaaacttattcttgctatgcaaatctatatatcagttgattctatactatggccacccagattttacatagaagttgcctaacccttcgatcctcatccatgtcgtgagttggattagcatagggattaacacttggattagtgcttggtgccctcagttccctgcctctccttgtggcccaaattgttggatcacccactacctccaggtgtctgccctgccagcgcctccttccactgctcctccccctttgtggcccaaattgttggcccgctcactacctctaggcggataccctgccttgccaccgctcctccccctgatgcactgctatgttgtcgatatccttagctaggcgctccccccccccaacccccacccacccaaatggtccaaattgtcaggctgctaaccgctgttgtggtcatcctgtgtccggtcccgttaccggccctcaaattcgcatggtgtcactgtcgccaagcgcagcagccctcaatccgcctgcactgttagagatcgctgtctcaacgattgcatgaagtagggctttatctgtgggaggatcctacttgcgctatcgtgtccttggggggactcgatatcatcatctctaacaacgctagcagatcctctccgctagtgccacctaaccctatgaaccgcactcatgccactgcctccgccgctgtcacctgtagcctccatgccaccaccaattgaaggacaagtgccattctgaagattatactaaaagcagtaagacaagagcttgggatagtgtccaggaagacgacagataggtacactcttgccaattattgcagataactcaggcttttactttgtacaaatcagaagagaagaaaacattttctttaatgcactgttgggagattttgtatcatcatccaaaggggaatgataggttgtcccagaaaaagcagaaggctcatgtcgatcctttggagagaccatctgcatgcacaaactcaaaactctagtgaatttcattacaaccccgacattaatacctctgatcctttggtgagaccatctgggaagaagctggaaaaggcaaaatgcgcgcgaggtaatacttcttcatgctcaagtgagagtagtcctgtagttattgcattaaataacatatggttagagaaaatgtagatgagtgcacaatctagggagaaaagaaatgaccggttggctgaagttatttcacaagagaaagaaaggttgaaagtagagaaacgaaagttagatttagaaacccatgaaagagaagaaagaattatgaacatggatcttagtgctagatgggccaagaaaagcatattacttgtgtttgcagcaggagatcatatcgtgtcatatggattgagttcatgatgtatggatatatatgtacggataaggtataccctctacccttggatgtacgctatatggcaatatggtacatctgcgcgtgtacggacgttctctgtatacgcgaaggaaatttatcacgaagtccaccaatggaaaggttcctacccgtataggactaggtcgtcactgtatcgtgcagggtccgatgtctccgagtcctacttggagaccacctgacctgagatataaaagggaccccccgggaggacctaacgcatcgaatctcatagccaatacaacgaccacagcctacgaagccagagcctacaggagccaagtcgccaggtgatctagtcgaatcaactcgactacgatctcatcggtatcatcaagttctattattccctttgtaatttgtggttctctccatataatcccatatcaactggattagggctattacctattaaggggcctgaaccagtataatctttgtctcttgtttccttgatgtcgtattacgtagatcatcgtaccaacgtacctcaataccctctatatccggtctacgggtacccaccgtcgacagtggcgcgccaggtagggggccttggtgctcaaggttctactattatgacatcaagcttcgtcaacaatagcgtcaacaatggagtcaagcaaaaatctactgtatgatcggcaacgatctatacaagaaggcgccaaacgggttacttcacaaatgtgtctcgtccaacgacggcaaacacctcctcctcgacatacacgaaggggtctgtgggtcacatgccgccggtcgtacattggtcagaaaagcctttcgacaaggatttttctagccaactgccctcaaagacgcttgcgacatggtacaacggtgtgaagcttgtcaatttcatagcaaacacacaaagcttccagcgcaagcactgcaaaccatccctctcacttggccgttctcgtgctggggctcaacatacttggtccattcccacgaggacaggccggctacaaattcctgttcgtggcgatcgacaaattcaccaaatggattgaggcaatacccacgggggaaatcaaggccgacaatgccatcaaattcattaaaaggatattttgtagatatggattgcctcaccgcatcataacggataacggctcccagttcattagcgccgatttccaagattactgcatcggactggaagtcaagatctgcttcgcctcggtttctcaccctcagagcaacggacagttcgagaggacaaacggcatagtactacaagggatcaagacccgtgtctacgacaggctcatgtcacatgacaagaagtgggtcgaagaactcccctcggtactctgggccgtgcgcaccacaccgacaacgtccaacaaggagacacccttctttctcgtgtacagctgagaagccatggtcccgaccgagttacgacatcagagtacacgagtacagaagtactccgacgaggatcaggaggaacagcgaaacgacgatgtgaacctactcgaggaacatcgagaacgggttgtcgttagggcagctagctaccaacaggccctccgccggtatcacgagaagcgcatccgagcacgcatactttcgatcggcgactacgtcctctggcgagttcaaagccaagcagggtgaaacaaactctcacccaaatgggaaggaccgtacacgatcacacaagtcttgcggccaggcgcattcaagattgcagacggcgatggtcgcgagttagcaaattcttggaacattgaccaattgcgtaaattctatgtataagtcaatagtatccatacttgtaagacatcttacaacttcaataaagcctgtttcaaggtacagatttcaatcaaagtgtcccttcccgatgattccttacccagatgacacctagcgttgaaacctatcctcatgttcctttacgccgtcctgacaaggcctccgaggaacctaagggaacttcggctgaggacgcccagagctgataatgccttgtcgaatcctttagagacgaaagaccatgtaagatctggtcatgtaagagttctcgccgtgcgtattaaccaagccgtgtaattggaaatggattttccaactttacggctgggggctaggattagtgcttatgcaactaaggcaagtcggtccaagagccttatcttccgagaaaaattctccgacgataaggctgggggctagggagagtgtatgactcaagtgactgatcgaagtcacgaagtgagaagacactcgtacacaccgcatccagagtaagaaaagcttagttagatagatttcctttctacttcacaagtatttcttacagtctgcaaaaaattccgaaatatattacacttttcctaagatgcttgtcacagatataaaaagagtaccaggaaggccaacgccaatccattgactggaagactttctccgccagcggcgccatcaacttcgctaggttgtctatctccgcgggagtcctccgagaatgagaaaacccttcgtggaggaactcgaggtacaactgcggacgatgatctcgtatacacaccagcacgtgccctccggcataccggctcgatcgacggcactcctgcttcagggcctcgtcgatacgcttgccgatgccttcgagctgagcacaggctccgtttagccacgagatatatccggccgctgactcctcgggatccccgcgaggtactcggagttccctgcagacgacggccatgactgtgcaacaactcctgaggtacgagttgaaccacaccttgcgacctctgagtgcctccacagcccggtcctttttcacttccaacatagtcctctcaagttcggcgacctcgaacttcgtcctccagtattggatgtgacggtcgcgatcagcaagcgcactctcgaggtctgctcgacaagcaaacaactaagttaagctgttctcctcttttgagagcacggcaagttaagctaatccagatagaagagcaaaggagatggaaacaaaaagaaccaacctaaaggagtcgtcgtcatgcatgtctccacgggcagattctggtctatgtcgtcttgcggcacatacggctcaagcgcaagtgccggaatgattacaggcaactcaggctgcccgcgttgctggacatcctcgacatcgacatctctacaaacaacaacaaagtactcggaatcaaaatgccaaagaaaactaaggtgataactgcacacaccaaggcagttggaaccaacaaattgttttacaatgcatgattgattaaggagtacaggcgaaccgaagtcctactcttcaaaaagtgggagaatagactctcctagatcactgacttcttccatcacgtccttacgcgcgtcgttagccgtcccctgatccaaaatcctttggagatcgagctcaaggtgcgccaaccttatgcacgcgaggacatggcacgtcccgatgtagatcccgttggacgtctcctctctgatcttggtcgcatgcttggaggggatcgcctccatcaccgtcgccagttccgcgagcgaagtcgtcagcgagaactcgtcgggattcaccgggatggtggtcgtgacaccgcactccccggcgagctggtgcagaccggtgtaggtaacccacagcgagccacggatctccgacaggttgttctcgagctccgacatacggtgctcaagcccctgccgttaccgttcgttgccggccaccagctccctcattttctggaggtcctcgcgaacctccgtcagatcacgcgtcagcctgtcggcgcgttcgttcgccgacgatgccgccgccgccctcgcctccgcaatctcgtgacttatgccgcgagcaccagcctcgaggatgcgtcccatcttgacttggagctcctcccaggtgaggacgacagcaggcgggtctcgagcgggcacaagatcgctggctgggccgctggacgtcacctcgcggctcctgggcacaaccacgacatcggtcgaggccactgcaggagacgcgcttgagttccctctagacccatcttgcgtagccttcgcccgtgctgccctacaaaagattgccatggtggtcatcataacagtatgccagaatccgatcaaggcaagggcctcaaattttgtccagttacttctcgccgagtgtcaccggcctctgtcgtcgtggaggcgggggagacgcatccgaggcctaggtaaaccgagtacgatgtgagagcgacatcttccgactacacaatcgataaccaaagaggcttaccgatggggtgggcgtcttccggcggttgccgagcacggaggaaaacttcctccctttcctcagaacattgccaccactggtcgtggcagcagcagcggcaagggccccgtcggacgcctcctgggcaatgccctctttcaacgaagctaccgcctactggtccacgagcggcccgatgatgtcagccaggaggagagcctgcacaacatgaagtcacaatacgatctaagagttaaaaggtaaagggtcatcgattacactcacgttgattgcgtcttcgcgctcagccgcccctttctcgcaaagaggggtggggacgttgctcgccgtcgtggggccactgaccatcacctggccaacacgatgctccacggttgcgctattcaaacctgtagatcgagaaccaaatttcgataagtcaggaggaatgcgcatgaaaggagaggaacccagaatacaagaaaaataccccgaggagaaacccgggtcgcgtcctctggcccagagtagtcaaaggctggatgggctcgagcctggagcggctggatccgtctaccaatgaagtcggcagcgacttcatacctcgacaaccctcgtactcggaggtcatcgatgatatcgatgaaagactggaggaatggggtcaaggcgggtttggcggtccaagacggaatcttgtctggttgctcctcaggaacaatgaagactggatccgaatcttctatctgaagatagaaccacctcgcccgccatttgctatgagaagaggggcactggaaagggatgtatcgcgacttcaggccatcccgaagtcgaaaaccagcatacccggatacctttttaggttccatccagtgcaactcgtagtaaaaacggaagaggtcaagaaacggctctaccccaatgtaggcctcacagagatgagaaaaaatgctaaggaaggctatggagttggggttcagatggagcagagaaaggccgtagaagttcaagacaagaaggaaaaactcagatggcggaggaagaaaaccacagagaatatagtcctcaaccgcaaccatgcggcccaagacgggttcaggttcagtacctcctagttccctctccatggtcccacgactggggagagcgccctcctcctgcaacttcttcaaggacgcactggtggaagtggacttgtcgaggtccatcgccgctggagatcgccggagaagaaaccgaggcgagcgagttagggtttgcatggaagcggagaagacgaagagcgtttggaggctaaaaagtttttcgcaacagccggactctaaaatggattcccaaaacccccttaaataggcgcactatcgacggtgcgaattccaaggaaaggagagagatggccgccggaaatttctgggtccgttgcacgaggcggtttttggacttcaatttaaattcacttataaccgttgaacttcggatggtgttgtcgaccactccttgtctctacggttctcatactgagatcgaccagttgagaacgacagcaacttcgacatcagaagtcgcgatcggttacatgagttcatttaagcagaagtcgggggctactgtcagggttacggataaggtataccctctacccttggatgtacactatacgacaatatggtacatctgcgcgtgtacggacgttctctgtatacgctaagaaaattcatcacgaagtccaccaatggaaaggttcctacccgtataggactgggtcatcactgtatcgtgcagggtccgatgtctccgagtcctacttggagaccacctgacctgcgatataaaagagaccccccgggaggacctaacacatcgaatctcatagccaatacaacgaccacagcctacaaagccggagcctacaggagccaagtcgtcgggtgatctagttgaatcaactcgactacgatctcatcggtatcatcgagttctattattccctttgtaatttttggatctctccatataatcccatatcaactggattagggctattacctattaaggggcctgaaccagtataatctttgtctcttgtttccttgatgttgtattacgtagatcatcgtaccagcgtacgccaataccctctatatctggtctacgggtacccaccgttgacaatatactatttttactatttcttaataggttgtgaacttttatgttgtatgccgtgtaggctttgatgaattatgtactgttgcttgtaaaaactttatgggttgtgaacttttatggtgtatgctgtgtaggctttgatgaattatgtactgttgcttgtaagaactttatgggttctgaacttttatgttgtatgccatgtaggctttgatgtattatgtactggttattgttagaacttaatggtttgtgacctttatgttatatgcaagaatgctatgattaattgtgagcacatacaggttgcatacataattaggattgcatacataattgaggttgcatacattattgatgtattgcttacataaatgaggttgcatatataattggagttgcctactacataactgggaggttgcatactacactagttcctacaatgaaattgccatagatgctcaactagatcttcttgaagctgagagtgagtctgtctatttctaacgttatgatggttctgaataaagtcccacagctcagctataggggtatgcaaaggtgtgactcgctctccctcatcatcatagttgtagtcaaaaccttctttatccctctcatcttctactatcatattgtgcaaaataatacatgctgtcatgatttcacttaatgtgtctgcataccaaaatctagctggcccacacacaattgcaaaatgagcgtgcaaatctccaaatgcacgctcaacatctttgcgagctccttcctgttgttgggcaaagtgtttcttcttattcccttgcggttctaatattgtcttcacaaaagtggcccatgagggataaatacgatctgcaaggcaataacccattgtgtagttgtggccattgatgtcacgaccggaaataacccaacgggcgttccttacgtgcgtgcattattccttgtcccaggaggcaaggtacaccaaaagttgatacaattcagagtttaacaagtggaagcgtaattaattaatttattacatgggcggcgaagacccagcacacaagaagacaaacgaaaaacagcggaaaactagggcgacgaccacaggcggttgacggcaggcacgagctagacaccaaagccttcatcttccaggaactcctcttctgagtttgggaaaaattgagcaagactgagtacaaccaccgtactcaacaagtcacccacaagtgcagaataaatgcaagggagtacaagggggttataatatatagggttagggtttgcagtaaatagcattaatagacacttagttgctcaaagctattttgtaaacacgattctagagctatataatattattaatcaatgccgtgaacccacacgagcctgccttaacccaaggcctacgatgattcagaccaaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaataggttatactctgatcagaggtgtacatctttacccacaagacacatcttcctcacgtgtaaccacgtgccacataccaccacggtatacggacggaagacgtgacatagtttccaacatatcctagccatagacaagagtaccgacccaaccccacctacggccggaacccctgggacaggtaggcaagactgagcccctagcagcaggacactggccctgtgccatgacatctcgactaccgggccacagctcgtgtagccttcatttgtcctagagatgtccatcgacccccgacttcgtccatctccatccgtgtacttttgtttataaccagactgagccacaaactaagccttacccactagacatgtggaagtacggtagtgctttgcaacagaggcccgaagacctgtccttatatggccgaggtgctactatcaaaaccatgcaccccgagcccagcctaaaaccattttgagggttttgaatagaggggaggtgtgaatccaattccacaatgatccaacaattccatagtgtccaggtgatatgaatatcccaaagtctagagttgtaaaaccacctaatgttacctaattaagcggcgaagcatctacctaaaatcatactagtggtaccttgagtagagtgtccactagttggggttttgtttattctagggtaaacaaggaaataataacaataacaataataaggtcataacaaaggtaaataggcatggctagataaaacagtgataacgcgggaatttaaataaagcgataatgcaataatttaaatcaaaataattttataaactgggattcaatatgttcaaggatgatgtgacttaccttgctcgctttcccaaacgtcggcttcaacctccacgaagagcggatcttccgaagctgcagcgtctacacgaccaacggaaaagaaaaggcttttactctaataaactccatataaccagcaagaacaaagcacaaaaatgggttcttgacttcttaaggaaaaattagagacttgaacggtccaattccgagttcaaatggccaagttatggccttttgaagtttatatgctctttaaatgaatatttgcgaatttcttcatttaaaatttaatttaaaaagggtttattgcgtcagccgaggggagggggcgcgcggaccgggtccacgggagtggggcccacgcggcagcctcacggtccacggtggaccgggtgcacccgggctcacaccggccggcgccgtgggtcccacacgtcagccgcacccgaggacgcgggcggctgacggccgggccccacgcggcggccactcggcgcggccggcgggaggcggcgcccgcgcccctatggtcgccggcggcggccataggcacggcggagcggcggtcgagagaggggaagggaagggggaaagaggcggcggtccacggctcaccctaggttgacggcggcgacggaggaggcggccggagcggagggaggcggccgcgcggctcgggtcgacggggtcgacagcgttccggcagtcggcgaccgaaacggagaggtggacgaggttggcgaggatgcggcgaacccgaaggaggcggcgccgaggtgggaggtggtccggggcgacgacggcggcggaccggagctcggcggcgacggtggagagagagagcgacgtcgcgagctcgaatccggcgaggaggaagggcggcgagaggcggaaacggacggaggaggtgcggggagggtttaaatagggttggaagggggagagagcggccggcggggaaggaataggtgcgggaggtccggccaccatcaatggcgccggcgagatttgcgggggcaaatccgcctgtttgaacgcgagagagaggggaaaaaatggggggaaagggagaggggatcacggggagtgatttcccccactttattgcacgcggggacggcgggaggcggcgggattcgcggcggcggcggcgctaaggcgcgggggaggcggcgggagcagcgggaggaaggggatgacgggtgggccccacccgtcagcaagggtggcgggcgggcccgcccgtcagcggcgcgcgcgcggggagaggccgagtgggccgtggggagaggagagagagggggaggtagatgggccgggccggcccaagggagggaagggggacttttagggtttttctttttataaaataattttaactttgtttatttcttaataatttttatttgtgctctgaaaattccactaaaatttatttacgcattttaggcttttaggaaatttacaaaaatcctctaagccttatttgacttttaactttgcacattttaattgttggaggctttcacacggattttaattattctaggcataatctagaggatgtattttagagtcattttgggacgtgacaattgatttcatatttctcttgtggagcctatccttcagctagccttgcaaagagaggggaacgatgaagaacattaatatcattgtgagatcatggcaaaccgaagaatgcatgcggaatccaaagatcttttgaagcaacaacttccaaaactatagttcgtttgcttaattttcctttatacatgcctttccatgctgaagggcaatttttccactcccaatgcatgcaatctatggatccaagcattccaggaaaacttctctgctctccaagtgcaagtaatctagaagtgtcagcactagttggataacgcaagtactcgtctccgaaaatctcaacaatagctctcacaaaccttttcagactctctatagtggtactatttgcaatttgcagatattcatcttgagtgtcggctacgactccattggttatcattctaagtgtagcggtaatcttttgcaatggtgatagacccaaagcactagcatcatttccttttttgggctaccacatcattaactatatgcgcaagaaaagaggacgactcattccaaacctacgcaacaaaatgtgaattaatataagtggagaacaaaacaatatcaaccaaaatatgtaaattaattgcaagccttctccagaataagactaggtcatatgtaggatgctccaataagtagttgtggtgcaacctatcatggccggctcgacgattacgacgaataacctgacgatcaggaacaaaatcacctcgccatggagcattcgactgctcatattcatcttgcgcgactattgttgcagcaacgatgatttcatcactggatgaagatgattcatccaatagaacatgtctcaaaatgaagatcattgagtgatggaagaacaacgcacaataatgtggatggagcaaaaagatatgagtacctactttacattatgttcatgttatactgaatagacggctagcttatctgggagatgctttggtgtgggtataatgtttgcttatgcaattactctatgtgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgccccccaacctatataaggagggcagggagcccctctaggggcatgatgagacaacctgatcgtcagatcaatacatactcggcggattcaaatccccaaacaggagtagggtattacctctcattgagagggcctgaacctgtctaaatcctttgtctccacatccatccacttttaggtctcgtgcgctaccccgttttattattgccgaattcatgtttcgacagttggcgcgccaggtagggggtgcgtcgaattacctgtcgaaaagtgcgatggaatcaacttcagaagaaaccccgagatcaatctcatcaatttcgatggctcaaatcttcaatcgggtctaccgttgcaatttaatctctattagattaatttttaatcattgtttgatttcctgatattttgacgaatttcatatactggatgagatcgaaacacggccatcatcgtcgcctacttgggtgcccttgccgtgtccgagtgctcctctcttcctttccttgcagatggacgtgttgcaggagtggcacaggccgccaggattcgattcctgtttgcatgtatgatggttgatgggctccgccggctacctccgatgatggcatcatgccgaaagaacatcgagttagctgttagttgccggggcttatacatgttgcatggcacgtcgccggctatcactcatgatccagcctcactgctcgacttgagtttttcgtttcaatttgttatcaatatatattagattgatttctaatctcagattaatttcttactattttttgttgttgttcgcatataactacgcggcactattgaggcgattgatgctggtcatggactcgaggcgtctcagctttccggtcgatcggccgcgagtccactccgccggcttgtcctcgccaccgccattgctgattgcaacaacgacttcaccaccggcctgcctccgtcgccgccgactggtgttcccgtctgcatggctggcctattatgccgccgctgttgggcgtctacgacttcaccgccggcttgcctccgtcgccgctgagtggtgcctccgcctacacggctggcctattaagccgccgctgttgggcgtccacgacttcaccaccggcctgcatccgtcgccgccgagtggtgcctccgcctacacggctggcctattatgccgccgctgttgggcgtctacgacttcaccgccggtctgcctccgtcgccgccgagtggtgcctccgcctacacggctggcctattatgccgccgttgttggatgtctacgtcctcaccgttggctcaccttcgttgccgtcgactggtgtttccgcttacacggctggcctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatatttttcataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattattcggaataaatcaaaagcatagagatgagataaatttattttctgctcttaataattgcaaaagtacccgagtagtaaattctgatccgtgaaactttgttccattaatgacgaactcatgtcactcatatgcatgtttgggaagtgcctaggccgactcccggtgcttgatggttatgactagtcggacagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacgtctggcctattatgccgccgttgttgggcgtctacgtcgtcaccgaccggccacctcgaccgccgccgactggtgtttccgcctgcacggctggcctattattctgccgttgttgggcgtctacgtcttcaccgacggcttgccttcgccgccgccgactggtgtttccgcctgcacggctggcctttatgccgccgttgttgggcgtctacgtcttcaccgaccggcttgccttcgccgccgccgactggtgtttccgcctgcatggctggcctttatgccgccgttgttgggcgtctacgtcttcaccgaccggccgcctcgaccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggcctattatgcagctgttgttgggcatctacatcttcatcgccggtcgtctcgtctgctgctgactagtgcccttacctctacgtctggtttatacagctaccactactgatggacatcatcatcttccgtcgccgactgattatgctgccgccgattggtgcttttatcttcacaactacgcgtcttcactaccggtttgcttctgttgccgccgacttgtgttcacttcattacggcaatacaactttgtcatcatggtggagcgacttcatctttattatcttcggcaccggcaaactctattgctgctacttcgcaagttttactacttcaccaaccacgacgtctttgtgaacctcgacatctcggcatgcaatgccatgatattttactacaacaagtgactctccaatattcaagatttctacttggacaccttcaacacatatcttcaatcaagcaatgactactcgacgacaagaagctataattctcgactctatgttcagttgtttctcaactaaccaaagagtcgggggctacacaaatataaggctcaaaatttgacaaattttatgtcaagctgaagaaatcaattaatcagccaatgagtcaactccaggagtcattatcttcatctttgcttcggaacagacattctacttcaacaacttcaaatatttcggtttagacgagttgggcaacaacatcaactctcctccaattatttgtcttcacggttggcctactacgcaactgccgatagaggatctcatcgttatcatcggctgctacatcgctattgactggatcaccgacatcgtcatcttcatcaacatcttgttaagcctcttcaacatagcctactctgctgccgttgatgggaaacttcgtcatcatagtcggctatctctgttgccgctaatcatcattaccgtcggatgcgtttgtcgccgccgattattttcttcatcttcatgattggtggatttcgccatcaccgttgatgcgcgtctacgtcttcatcgtcggtttgcttttgtcaccaccgactgttcttttgttgttgttgttgggcgcctacatcttcactgctagctgacctgactgttgccgactggtttctccgcctccatggttatgcaacttcattacctttgattggtgtcactgtttttactaccactgacatcttccgttacttctgatgagcaatttcgtcttcatgttggtcatttcatctccatgccgactgcgtcagctattgccaatagacaattttgactatgacagaaggacaagctatatgctcaggggctcatcaactcaagcgtgaggattatatctccaatttggacttgttccggatacattccacatggattcatagtcatgagtctattttctatgctcaaagactggaccaattattattccccgtaagggctatcaaccgaatacttgcgccagtcgggattcaattattatatatattttggagtatctcataagggataatcactcagatcagaagctattcatatgagctacacctggtctatatcacccggaagatttattactcgagagcatgttacatgcgtcatcctttaaagggtgtcgaaggcatattttttggtctaggcctaatatgtctgcagcccatattttcaggtgtggcctgtcacgttcttttagggacttaggcacttttcgcttaggccaaagtgcgcgtgatcaagtgcccaataccttaaaatccttttataccgcagttactcaactttttaggagttggtacaatgcatcttaaaaggtgtcaaacagtaaagctttatatagctggcccgctgacttttttatatataagtcaaggtgctgtttgggtttttaagcaattgattagatacaatatcattgcttttcgccacgtaagtgtgcatttttattgaccaatattatggcttaggctgattatatattgtggtcatttttcaggcggttggtaaatcctttatgagtttatttacttggattttataccacatatgccatatatttccgggtgtggtgaaaccatgtgtcttttagggacttaagcacatctgttaaagcagtgtgcgcatggcgtatgcccaatactttggaaatttctttattcacaatatataagcttctttatagctgttttgctatgtgaattttcaatgatgtaaccaactttaggttacactcatcatattttacaaagcagtcggtatatcactcggatcatgttattcagggattcacaccgcatatgctacatattaatatcaggtcgcttggttgactataattattaaaaccactcggttggttggattatttattccttgactatatgcttggtttgttcaattaaccacatagtcgggggctacacctattaggtgcatctagtcgatgcacctgactttatttttcagccctccacagtcttcgtatttggtaaaagtacttcggagaccatggcgaagatgattgaagcactcagctttggagtaatctagttcgagagaagattatcttttcgactgtgaaggtctcaggggctactgtggagattatgggtaccccatacctacatggcatagttatccgactggctataggggataacttatatctatggaatatgtaacagatcatgacttgggtattacgtttccctgtatattatggaacggcctaaagtcctggtttgataagattgtaaagtagatttaggaaaccgataccgtattggttaaggtttctatcttgtaaccctgcccccccaacctatataagnagggcagggagccccctctaggggcatgatgagacaacctgatcgtcagatcaatacatactcggcggattcaaatccccaaacaggagtagggtattacctctcattgagagggcctgaacctgtctaatcctttgtctccacatccatccacttttaggtctcgtgcgctaccccgttttattattgccgaattcatgtttcgacactatgtcatgacgatgatattagagtagtatctggtagtttaggcgtggtgtctagattacgggatatcattatttggagttatatattgcggatgagaggtgggccgctgatggtgacagctcagtacgggtattcctccacgccggtatataatcctaagttaatttcctagggagggtattcctccatatttagccccggttgtatggtcatgacgggctgtcgtaaggaactcggcagtcaggggtggcttctcgaagtaccaggaggacatcggatagagggtattagctagtatatcggttaactagaatgtatgtatactatgtatattagaagtataggaatagattttcttcctcttttctatctacttagcttagatgatatattatgagaatgagtagtgaatgattgtgtgtcactctacccttggattatcttaacccctgcttagaatatgatcatcacaagtaatgtataaattattagtcaatgttccctctacatgatcttctcacgagataaaataaatacgatacccttggaatactctcgggtgaaatgctacaatggtatatctatgcgcttgcggatgaactctgtaaccataatatatcagaagtatttctgcgccattgctgggtattatatttctagtaatgttattaagaaataccaataagcatttctggcgccattgccggggattatatttctagtaatgtcgttaagaaatatcaacaagcatttctggcgccgttgccggggaagattcataatagagattacttgaacttatactttatatttacctctgtataatcattttcctttgcaggctaaccttggttgttttcactttttgttgtgcaaacagggtagtgcatgactggtttcaacttgccggaaaacttcaaagaaaatccagaagctttcttccggagtgtcaggccacgagtcgctgctccgcagaaaactctaccgacagagaaatcagccgtaccagcgccaccgaccttcaagactatggcaaacaagactctccgcgaattcactgctccctctgctgacaatgtggccattgggccgcagatcaacatgggagacgtggatttcgacttgaagtccagcctcatcatgatggcgcaggctagcccgttctgtggcaagcctaatgaggatgccaatgctcatctgcaatagttcctggagatctgtagcaaacaagactctccgcgaattcgctgctccctctgctgacaatgtggccattgggccgcagatcaacatgggagacgtggatttcgacttgaagtccagcctcatcatgatggcgcaggctagcccattctgtggcaagcctaatgaggatgccaatgctcatctgcaatagttcctggagatctgtagcacgtacaccatcaagggcgtcagtccagacgccgttaggctaaggctgtttccgttctcccttctcgggagagcgaagcagtggttttatgccaaccgtgctgctgtcaacacctgggacaaatactctacggcattcctctcgaaattcttcccgatgggcaaaaccaatgcccttcgtagaaggattttaagtttccagcagacaagagatgagtctattcctgaagtatgggaacgactgcaggagtacatggccgcatgtcctcatcatgggatggacgactggctgatcctgcagaacttttacaatggactcaccccgatgtcccgcgatcaccttgacgcggcagctggaggagctttcttctctaaaacagttcaaggaaccattgatttaatagagaagatggtctccaatatgggttggagcgaggaacgactccagacccatcagcgaggcatgcacgccgtcaaggagacggagttacttgctgccaagctggaccttctcatgaaacgtttggacgaccacgagaaacggccacaaggcaccgtcaaggcgttggactcacacgttatgtgtgaggtctgcggcggcacgggtcattctgggaatgattgcctagaaacccgtgaggaggcgatgtagatgggcaacaacaacgggtaccgtccacaaggaggtcaggggtggaaccaaccacgcccatattatcaaggaggtaacaacaacagtaatttttctagccaggcctccttgaaggatctcgtttttgcgcaatctaaaaccactgatgcgttaagcaaaaagcttgcggccaatgataagatcctagataacattaatgtcaaattagatggctttgcttctgctttttaaaatcagctgagctttaacaaaatgatagaaacctagctagctcagttggcatccttagtccctgcaaatgaaactgggaggattccggggcaacccgactcctccattgaaaatgtcaaggcgatcacgatgaggggaggtaagtctactcgtgatccgccgtatcctaaccctgcaggaactagtgggatatcaaaagaagcgccatctaatgactcggctgacaaggaagttcaaccagaaaagtcagtgccgcaggagtattgtgacacacggttgctgccgttccctcaacggagtaggaaaccgtcggtggacgagcaattcgctcgttttgttaaagtaatctagaaagaaatncccaaccatttcccaaaaaacccggtttggccccccgggttggttttgggggaacgccctttaatttggggcccaaaggtcccacatacgcccgttatctcaaggatatactcaacaacaagagacggctcctaacaacggaggtggtcaagctgatagaacaatgcagcaacttgatactccacaagctcctagaaaagaagaaagatccggggtgtcctacgatcatatgctcgatcggggcacaacaattcgaccaggccttgtgcgaccttggagctagtgtcagcgtcatgccgaaagacgtcttcgacaagctcaacttcacggtgttggcaccaacaccgatgcgccttcaactggctgactcgtcagtccgttacccagtagggatagcggaggatgtgccagtcaagatacgggatttcttcatcacggttgacttcgtggtactggacatggacacgggaaaagaaacgccggtcatcctggggcgtccgttccttagtaccgcagtagccaacattgacgtgggaacagggagtatccgttttcatattaacgggaaggaggaaaagtttgagtttcaaccgaggacagaacaatgctccgtggtcagaatcaagtacgggccaaacccgtagaatattcaagtggtcgaagtggagccacccaaaatggacagcctggtgaaattcatgcagaatttcctagagaaggaaataacgatgcccaagcaccgttattggaagacgccggtaaaaccacccataccggccaagaagttagagcagccggctcagaagaagccgtcttccgcaccaaagccgaagaaggtgtggaaggaaaagccaaagacgcccgctccatcacccccgaagatgggtggaactaaatcagaaggaggtatggtcttgcacgtcggactttaaatgacgcgagcttcgccaacaggtaaattggtatgtatccgcaaattttctttcaacaatttgaatttttgcatcaacatatgtttgaacttcaaaattgcatttatgaattttgaggaaattcttcaaatgaatctttcaaagcaaaccaaaataaaattttcaatgtaaatttgctgtgccacgaccacactgaccgttggaatccaacggccaaaagtggggccggttgggcccaccaggggttcggccgaaccagtgactggccaggccaacggtcggctgcctctctttttgaggcaatggttagtgggccccacaggtcagttttgatcgttgtgggtgcacttcttaagccaaccggccgggagagggaactccaccctgtttaaacacattttcattccctctccaaagtttgctctcaagttcaatcaagctttgatggtttccctcaaattcaaatacttagttgcatatatacaagttgcttgggtgaaactaaccggcgggtgaaattcttgtcattcctaattaacccccgccgagttagtccgttcttgttccattgtgcagaatgaggaggcgactgtctcgtctgttcaaggggtccggctcttcatcaagtcatcatgacgagtctagtactcgttcatcagcagatgtctcgatggaagatgccgaagctctgaggcgactcctaaacgacaccgacctcgaacttgtcagtgatcgggagagacaaacctactacatgctgagcgaccaggagtatgctcacacgcgagagtactcaccggagctgctaaaaaagataggtatggatgttgagtttcactctatttggaaagctgttgattggtagagatttgctgtggtagatgagcctggttctcgtctgcttactttgcaatttctgtacactttgaaagaaatagaagatggtatttcctctcgctttttccgtgaggagttcacacttacatggaaaggcttaagtacacttcttggttttcacgattcctgtaaaatcgatatccagaaaggaatttctgggttcgagaaaaataggttttaggaagatatttctggtggtccaatttgcaagaaacctaggacgaatgatatccataatcctacacttaggctcatgcacaaatggattgctatgactttgtttccttgaggtgatcttagacccattaggggagatgaattgattatcattgtcggtgacatggggccgggggtatcgtgactagaggcttgggtagccgcgatcactcacgtggcccgaccccctcgggggggtcgggcccgacggtgacgtggccacctctccctctgtctccccgaggggtcgggccgctcccatttcggccccgagggctggggcaccccgaccccctgtggtgattggcgccacgtgtgtgggttaggtgagcacagcggcactcacctaaccgcatttatagcgggttagacaagcgcatcacgccgcattcaatgcggcgcagcgcatgcttatccggtctgtgaccagtcgcggtatgtgaccggtcacagaccggtcagatcgcgggttatgtggcaacaggcggcctgtcgcacgcctcaccccgtcccgtcggaatgatgagagcttcctggttctcgtctctagccggagctggcatgctgactcctggagttggtatgtcagtcccggtcagatccattccaggcttcagtgcaagcatggcaagaaaatcgctggccattgaatgaaggatgaaacgggcgtccaccgggagagctgacgagcggagcaggaggcgtgtgtactgcttgtcagaggtcatttccggctgtagattagccctcattgtaaaaagcatgtttcttttcttaggcagagagaggcccatgtggtgatccctaaccagataaaaaaaggaggctcaggcctaaggagagaaaaaagggggggaggtgagaggctggcgacttgatcggagagcctgaactctctctcgctctcgagctctctggctctggagctctcggttttccttcacacacagatccaccagaacacaggagtagggtattacgcttctcagcggcccgaacctgtctacgtggcccgtgtcttgtgcgctttttctcgctgacattcctcatatcgagggcgaagaacctcacttagcgcccccggccgaaccggcaaaggggggcctgcgcggtctcccggtgaggagccccacgctccgtcaatcatgtttgccacggttagaaaaattaaaattactcctgtgaaatgtatgataaggcaatggttagaaagtataaagttctctgctcctgttgagtgcacttctttgattacttggatagcaaaagggctaggggtcgttagcaaccaaattgcttttatctcagccgctcgtccgtgtattgatgaggcttatctagcgcaaggcaatattctgaaacatggagtagatggatctttgatttactttttacccagttgtacaaatgaaatcccgttgccaaccgtatagatgtatgaggcaggttgggcaccaaccgaggatgcacccggatggacctaagctccacgccatagcatcggagtctcaacttgggcaagtgccagtgaggaccggtggcatgcgcctcatgacatccaatggggggacaatcaacctcccagatcatgtggtgtgcctccatctctaagtgaatggtgctcaagttcctctcgttgggacttgggtgaaatcactaggagaatggacacccttgatgtgcagacaggggagatccagtacaacctcacggaacacatagctcaaacgtaagaatggcaacaatctgctgatgctcagttcaccaacatcaacatgatgcagcaacagcacgatgacctacaagcgtactttcgctttcaggggttcaatccttatcaaggaccctgagcgaaagccaagcttggggggatatacctctccctccactaaggtaacttgtatcacattgtatatttccctttccaattgcatatttgctttccacttgcatcttataaaacttgaaaacaatataaaaatttgcaaaatagaaaataccaaaaagataggataggtttaagtcatgctaggtaagacaagctagttctcttcgttgaaatgatgaatagttgctctgttctatatctctgatatatgggttcttggtaaatgctctctcaaaggttaaatattagtagccaacaattatccgggaacctgaggtaaatgagctgcagttgctgatctaagtctaagttgttgcgagatatgagatagtaaatatgagttgctatgatcctgatactagtttgactttcattcaggatgttttgtttttcaaaatgataaattgagagttcctcatttgatataaattcctaccagagccaaaaatgtgctatcatgattaaaccatatacattttggttgcttgtcattccattgaactttgtcaaactcttgtgagttgtgtagataattctcatgctctatgatcaagatcatacacccacatatatgcacatgctaaactcctacactgggagctaagcaatattccattccatttccatattaccaccaaaataaattctccatactttcatatgttttcttctcctaaaaaaatccttttgaaaaagaaaaaaaaaagagagagggaaaggcatggttatgaaaaaaataaataataaaaataaagttatgctccattaagcatgagcatgacactgaaaaaaaaatgtagccatgccctctcctaatcaataaaagaatgattttttgggagaagaaagtaagcacaaaggagaagctttttctttattttcctttatataccatttccatcatataccacacacacatattgcatgatcttgatcttgagtatgtttagtcatttgctttagtctaagtttttatttagtaataaaggcgaatgcaagtatgccatgtttgatccctaccgagctccacatatcaagccttagagtaggaatcaaaaaggcaaagtggtgaggaattcattttgatacacttagagagactgagtgaatcatttgaggaactaggctttcttatgcaaaatcatttgaaaacttccggaataagagttgaataatgattgggtgattggtgctctaattgttgttctgtctttcaactgcccaaggcaaggagaagcagtgtctcgtgggaatcaggggtaagggtaagccaccgtaccaaagattatttaatctgagagagagtacatataccttgcacctatatctttgagatatgcagcatagtagcaactcctgatcaacaaccaagtctttgtttcctttcgtccttcacttgggacgagcaaaggttcaagcttggggggttttgttgacggttgttatcgatcagttttgaccgtcaatattgccaaaatatagaactagtaatgcttgcaacgcatatatctgttagaataataatattccactagtattaggtatactaaccttttgcagacaatggcaataaagtggaggagaatcgacatcaactcagacgataaatcaatcagacgttgtcgataaccagacttatgtatgaatgggccacaaactcagaattgacacgatgaattgggccaaaatttacaagtctacatagtgaagcaatagaggaggccgccagccgaagatgggccgggaagacccagcccatggttcggccgaacccatcctagcaccgttggatgcaaggtttggcgtggacgtccaggattgcatcccaatgacggttggagggcacttcggacaattccccttccacaaccgtcataactacctctatataaggacttcaccttctcacttcactcacacacttcaagtaatagctctctcattcccctcaagtttagtttagtagctctctcattctcatcaagtttagtttagtagtatctagctggtggaataggaatagagtagaaatcaggagtccggagccttcggaagagttcaggtatggctctagtagcttttctcttctcttttgtaagctttgtaattttattagaatactcttttatataaatttatggtattgaaatactttccgagtatatgagtacctactttacattatgttcatgttatactgaatatacggttagcttatctgggagatgctttggtgcgggtataatgtttgcttatgcaattactctatgtcatgacgatgatattagagtagtatctggtagtttaggcgtggtgtctaaattacgggatatcattatttggggttatatattgcggatgagaggtgggccgctgatggtgacagctcagtacgggtattcctccgcgccggtatataatcttaagttaattccctagggagggtattccttcgtatttagccccagttgtatggtcatgacgagctgtcgtaaggaactcggtagtcaggggtggcttctcgaagtacaaagagggcatcggatagatggtattagctagtatatcggttaactagaatgtatgtatactatgtatattagaagtataaaaatagattttcttcctcttttctttccacttagcttagatgatatattatgagaatgagtagtgaatgcttgtgtatcactctacccttggattatcttaacccctgcttagaatatgatcatcacaagtaatatataaattattagtcaatgttctctctacatgatcttcccacgggataaaataaatacgataccattagaatactctcgggtgaaatgtgtttctgcggatgaactctgtaaccataatatatcagaagtatttctgcgccattgctgggaattatatttctagtaatgtcgttaagaaataccaacaacaaacacaaagaagagtacaatgaacacaccaacaacctttacataataggtagaccataacctcaaatgcccatcaaacaatcaactaggctaacagctaaccaatcagtagcaaagatacctttgtggccactcaaaacaaacattatacaaaacaaaacattaaagcatgtcaaccaccataaaaactttaagcaaacataataacatgataatgcaatcattagacttgtacactcgttctcaaagcatcaagcaaacattccatcgaaatatggtttcatctatccctcacagccttcttggaacactcaagtccaaccccctattatgatattgtgattggctgaaaatatcatcactaaaaagagcactcaaacaaatatccagcctagcaagtagttaagatgcatggcatggtggctagtccatctatcactcaaatatttttctcaaaatggatagttgtgaccctaacaattgagacagaacaatagaaggcactagcactcaacacacatacattgttttattacacttactatgtaggaaaagaaaacaggcccaacagacaagagcaacaacaaaaacctcttagcatcgtcatcacatatgaatacaaaatcttaatgatatacaaataaaaacatagtgaaaggcaacacaagatcacacacatacatacaacgccttaatgatgacaaacaaccatggtgaaaaattaacacaagtgtacttgtacaaagcatatggaaaggtaactctatttacgcagatgagcaacgatataaaccacatcagggtaccaatacaacaagataaggaacatctacaacaggcattaagaaatatgggaatcataatcatttgcaatacaaaaataatagttggatgcaagtcgcaaacccacagccatcctatatgtgcatgtgtgtcaagttaatcattgttttccctagaatctaaagcctacactctgataccaactgtaacaccccagaaattcccaaaagcctgggatgccactaaagaaccatacgaccatgtgaaaatgatgaaatttttacattagattctttttgttataaaaaaattattgtggaagcttcgacatatagatacaaggatctaagatggcaacaatctgacacatatgaacaaactaagaatggtagataaaccatggtgaatatctatagtatttaataaatccactataacaacaaactctaattttaccccctaatcacaacatttataaactatgtgatatcataatgtgcagcggtgtagctactcccatccattcgtgcaaacatatccgaccgagtacctgaaaaggctataaggtggtgagaataaatctcggcaagcaaacggctttgacaagctatttaaaccatagattcattgtatagttaattaaatatcgagttatgattcacatgaaaacaatttgaacatccaagcactaaaacatcataaccttatcaataaaatccacatcctcacaaatcctagagaagaaaacacttctcaaagatgtcttcgactgtatgatttccatagcatcctgcaatatgtgtgtatgcaatgcaatgatatgaactactgccttcacacccaacaaggtgtgaagctgcatcatattacaacaatatacgatgatgtaccggtacggtcgcaacaataggttcgtagcataaatccaaatccaatgcaaatgtgacgcgaatgtaggttgaattctagagtaataatacgacaactgcattcctacataggagaccaatatacataattatctccaatagcataaagcataaccataagaatgtaaatcaataagtatgactcggataggtaaatcctttgtataacatataaaagtatcttggttgatgatatataatttcaaagtagaggtagaataaaataacaagtcaaagcggtagcaaaccaccgctacgtttacttgcctctaacaacgaagagacaataccaagcatcaccacctattcacaagtcaacctcagcgtattcactaaaacacgcatataaagtaacgacaaaagttgcacctactgcctcatcccaccaaaacacaataacaaggaatgccacttgaactataaacaatattactacttcaaacctttatatctcaaaatataaaaaggctatgactgcaaaaaaaatacattttagaaatctacaaaacaagacctagttcttttatgtagaaagcacttttttgttctgccatttaaatggtctaattcacacttgaatgcaggcttcagaatctgtacagaatttcagaggatacatagaaaacaactatatccggagttctacccatccgatcaaagtgtactttaccaacatggaaagctcacagaaaactctaaggggcctgattgattccactgtttaacctctccaaaaacagttcaatctacaactatctagattttgacaaaaaaaagcaatagtcatactcaaaaattcatatcgcttattccacttgagataaaatcattccctttggtcagaagatagatcacgatgttatctacaacgtttctgtggacactttgttcagaatatatcattttgaccatgtaattgatggaaaacagaggcactataaatctgcccagcctagctagaactaccaattcgattcacaatgtccaaactcttctctaaccgtctttaaccacgaattaaaccactaaattcaccccagaactgatgcacaaggggataaacctcacctagggttttccttttatatcccacgggaaacagcggggaaactccgatctaacccctccttctactcttctcctcctccacgttccatttttccactttgcttcttgatccaagctatgaaggtggagatctagggagagcaaggtctgctagagaggagaggaagcaaaactaagtataggaggtggaggagtcacaaccggcgtcatgggggaagggagggggggatggttcggttcctctcccctagggttttaggtgggggtaagggatttggctaggctcttgggccttgacccaagctaacttgcccacttacaaaggaactttattcaactaattgtggctatcttaataaaccaaaaacattatcttttatttttttaggggtattagaactatagagcgagactgcagatatatactttttatgttaaaccatagtcctcttaaatggtttaattttgatgaatatgattatttgaaatgatcataaatcgattggtaaaatctatccagtgcgtgtgcactgcatgttcttatctagtgacccttttgtgagccgtctgaatcagttgatgatggttgagatatatattcatgggtgttgtactaaccaagagacaaaaaggggaccacttgctagaatatgaggaccatatgctatctaccagttgtcatagcaattcacttgtattttttagatctgtttgaaccaccctactctacttaaagagaaaattccctgtgtacccctgaaagttcacctaatcccttctataccccctgagatttgctcattctctcccatgcccctaaatttcagtttggatcacttctataccccttccgtcaattgaccgttagttgaccgttaaattcacatcataaagtctattttaccctctagtatcaagaaaatataaatttataaagtatattgatggagtgtataaatttattgtatgcgactattatatttatgagtttatttcgtgaggtattatttgcgacggagcggcggcggcaggcgtcagaggggcggcggagcggcacggcggtgtggtcgtggcggcggtgcagggcgtttttagctggtgcgggagcgggcatgagaaggggaggcgcgagtgcggtcgtgagagggggaggcgcgggtgtggtgtctatacgtatgtttacgttggcttcaccatcaccactacgaattttttaagtagtaaagagtaaagatagtgaggaaaaaaataatctatactatatagtatgcatgttagcttagtcaatactcaatagttagcgatgctattaaacttgctctaacccgatgagtgttaatgagtaatgaccggcacaacacgctagcacgtgcggacgaattgcgacgggaaatcaccatggccgagcttcctctctatctacttctccttgctctgctggtcgccgtccccttcctctgcctgacccgttggtcgctccggcatggcggcggcggcggcggccggctgcctccgtcgccgtgggcgctccctgtcatcggccacctccaccacgtcgcgggcgcgctcccgcaccgcgcgatgcgcgacctcgcccgccgccacggcccgctcatgctgctccgcctctgcgagctccgcgtcgtcgtcgcctgcaccgcggaggccgcgcgcgaggtgaccaagacccacgacctcgccttcgcgacgcggcccatcaccccgacggggaaggtcctcatggcggacagcgtcggcgtcgtgttcgcgccctacggcgacgggtggaggacgctccgcaggatctgcaccctcgagctcctaagcgcgcgacgcgtccggtccttccgcgccgtgcgcgaggaggaggtcggccggctgctccgcgccgtggcggcggcggcggcggtggcggcgttgacgaccccgggggcgacggcagcggtgaacctgagcgagcggatttcggcgtacgtggcggactccgcggtgcgcgccgtcatcgggagcaggttcaagaaccgcgccgcgttcctgcggatgctggagcggaggatgaagctcctgccggcgcagtgcttgccggacctcttcccgtcgtcgcgcgcggcgatgctcgtcagccggatgccccgccggatgaagcgggagcgacaggagatgatggatttcatcgacgacatcttccaggagcatcacgagagcagagccgccgccggcgccgaggaggacctgctcgatgtcctcctgcggatccagagccaagacaagacgaatcccgccctcaccaacgacaacatcaagaccgtgatcatcgtaagccgagctcagctcgatcagctacctccccacttaaaaagttcaatttcctcttctttttgtgcaggacatgttcgtggcgagcagcgagacggcggcgacgtcgctgcagtggaccatgtcggagctgatgaggaaccctagggtgatgcgcaaggcgcaggacgaggtccgacgagccctcgccattgccgggcaggacggcgtcaccgaggagagcctgcgcgatctcccctacctgcacctcgtcatcaaggagtcgctccggctgcacccgccggtgacgatgctgctgccgagggagtgccgggagacgtgccgggtgatgggcttcgacgtgccggagggtgtgatggtgctcgtcaacgcgtgggcgatcggcagggacccggcgcactgggactcgccggaggagttcgcgccggagaggttcgagggcgtcggcgccgccgacttcaaggggacggacttcgagtacataccgttcggcgccgggcggcgtatgtgccccgggatggcgttcgggctggccaacatggagctcgcgctcgccgccctcctgtaccacttcgactgggagctgcccggcgggatgcttcccggcgagctggacatgacggaggcgttggggctcaccacgcggcggtgctccgacctcctgcttgtccctgccttgcgtgtgccgctccgagaccatgagcgatagattgctacagtatcatttggaaatggataagacatacagaaaaaaaaagaaggatcaactggatgtcatcatgtcatcagtatatatacagactcatactctcatttggtgatgtttcaagtgttatctgtaacttttaaattactgggttttgtcatcatgtaacatatttaacctagcattgaatttgtggaggggaatgagtaactcaccagcggtggcgacaacgactttcagattgtagcatcagcgtgttaaaactccgacagagaacttggaattccactacaagaaacttgttaatccatgacgaattcttggtgacggattcataaaccgtcactgacagaggcaatccgtgacgataatttgttttccgtcgtggacgtgcactagtggatattcttggcccgttaactcgtgacggttttatccagatcgtcacagtgtgtgattttaaaatcgtcacagtgtgacgataatcaaaaggcatttcaaaacttgttttgcttgaaaaggatttgaatttgaggttcaaatgaatttaaaaaaatgaaaagctacactctctcttggaccatttctggctcactctctcctcttgggctcgggccagcctccctctcgcgctctgccccttcagctgggccagcggcccattttccacatgggcagccaagacaggctagccgcaggccaccctgcgccttgtaaaaaaacaagaaacaaaaaaatgtagccctctaggggactcgaacctacgacaacacgcacagtattcatgaggaaaccccactgagccactgaagcgttttgccaaacgacgtgcactgtattatatatattaaactgtagcaggtaatggacctgccacctactcgtggtgttcatcataaaattcacgagaatagctgcagatttttacttttaatgcgtgtataaaaatttaaattagtttatctccctcatactaacttcaactttaattattcttttttataaaattttctaaactcatgatctatccatttattgtgctattacaactattatttttgtcatactttcatgtgactttgttttatcaattgaagatttaaatttcaaaaagtggcaacttcaaacaacattttgaagcagtaaatgattgcaaaacaaatcaaacccaaaagacaaattttttttgaactaaattattttgttactaatttgttacttgtatatgttgcatatggtaaaactgaaaatatttgcatatatatagtgtgcgaacaaaaaatatttggagcttgtaggaatttaacctaacacctatagttatccagcaacattcatagctacttcttttagttgattatgtatgcactcacttatacttttcactacaagaaatatattaaaagttaaagcaatttaatcaagtgaattaatcaggaaactaaatttttcctttaaaaatcatggccggaaatatttttgtaaaattctaagcggtctaaattattctctaaaattttccgtgaattttcggagctcaataactagttttaataccacaaaattcatttaacctattaaaataaatggaaaataaattaaaatatctctctgtccttgggccttttttggcccaagtgttactctctccctccctcagcccgcagcctttctctccctcctgggccggcttcccattcccctccttcttcttcgggctgccagcctagcccatttgctcccccctcgccgagaagtccattttagctccctcttctcaattaatttcaaaatataaaaaatccgagtcaaattttatcatactaaataaacttatgtgaaaaagttatcaaaaacaaagttgtataacttaattagatctatcaattttattttggttatttctccatctgactttgattgacctatataaaatttgaattttaaatataagaaaaatcaaataatttttctggtagtaaataatttgaaatgaaaaaaaaatgtcaacaacaaagttgtatgacttatcaagatctacaacttttgttttggtcattttgctatatgacttcatttcaataatttgaatttgaatttcaaattatgacaacttcaaacagcagtttcaaatactaaatgatttcaactgaaaaagtcatcaataacaaagttatataaatcatcaatatctataacttttattttggtcatttcttcatccgacaaagtaatagtaacattatttataaaatttacatatctctctcatagtttataaactgtataagagatatgtacattttgtgaataatgttacaattcgctttaacggatgaagaaatgacccaaataaaagttatagatcttgatgagttataccactttgttattgatgacttttttagttgaaatcatttagtatttgaaaatgttgtttgaaattgtcataatttgaaattcaaattcatattgttcaaaccaagtcatatagaaaaatgaccaaaacaaaagttgtaaatattgatgagttgtacaactttattgttgatgactttttcagttgaaatcatttattatttgaaaatattgtttgaagttgtcataatttgaaattcaaattcaaatttttgatacaaagtcatatagcaaaatgaccaaaacaaaagttgtagatctcattaagttatataactttgtttttgacatctttttcacataaatttatttagtatgataaaattcgatttgaagttttaatattttgaaattaattgagaggagggaggaaaaacagacgctgggccggcggcccgaaggagcagcgggcgccaaactttcagtgtggcgggatgttgatcaaaatttcaacgtgaaatgaccattttgtccagatattttagtggtaacttcggatgcaccatgggtattttagtaaaatcgcattggttcctcaaccctagccgatccaaatcagataagccgccaccacacgcgaggcgctactgcagatgagaccgccggcctctgtctccgccgctgctgggcgccggcctccgtcttcgccgccgccgggcgccgctcaccgcgccggcttcctcccccttcgccgcttgccatgccggcatccgtctccaccgctgccaggcgcgggagcggtggatccgctgccgccggcgcctctcgggcccagagggggcgtgcagcgcagcatccggggcagccaccggtgacgtgaatcgaggtggaagaagcaccggcgagggagagctccgacgagtcctcctcctcctccttctccggcagcaggtcagggcgcagatcccctcccagcagcgcgcctgcttcctacatctcgcgagctccgtccatcgagaggctgctcgaggaggacgccgcactgctgcacgcgtgagcatagggagcacggtaggcgatcatggtgggcgaggacggtttgacacggatgaaaaagaagaggagaggcgccagtctttctttctttgtttcttgcattagttttcttggcgagttttgacgcatgtgcctcacccatgtgcaggagggcggaggcgggatctgctactgtgagagggactggtgattggtgaagcgccccaacttcgactgcgagcgaccgcatcccaactgtaaccaatctctctctatccgctgatgctagttgcttatcaaagttcctgaatctgatgaatgcagaaacctctaatttagttaagcaagtcaattcatgctgtaacaatatgatctctgacaaaaaactgaattccttgtttctgcaaatgcaagtgcagtcataaataagaaagaatattcgtgaaagtttcatagaaactagataaaaaaaagaaagtgttttagataaaaaaaaagaatgtgtttattttcagaaatccacagttgctatattttcagatatcttcaaaactgaataatgttttaatccatttgccaacaaaaagaaaaagaggtgcagaaaacagcttacttgggggataccatggatcatgcttgatttgatcagctcaacggtgatttgatgctatctagattcatccttttttttttaagttcaacactgtacacatttgctggacataatgcatatatgttgttttcagcgtgacaaatacaatgaagaagaacctaatgcatttgatttgttcaaggagttccactacagcaagaaaaaaaatgctacaccactgctgtatagtaggctattgtaagataagtttcaaactttgctctttgtaatgcttatttttaattctctcatcaacaacaatgtttgctccttgcttgctagactcaaatggaaaacaagctgtctacaagttcgatgaagaggactcaatctgagatggaagcggaaacttaatcttttgatcagtcaagttcgatcaagttaattcatgcatgatgctatatcttttgctactacatgcattttgctgctattgctaacttgtgtcaagtcaatttttgactaagctaagctatacatgcttgcattttgctgccgcagcattcattaagctcctagacttgtatgcattgcttggaatctctatttgttgttggcttgagccatggtaaactgcaaggttgtatgcactttgaatgttgtaatctgatgttggatgaaaaatcatgtgatatgatattgaatggaaaaatgatatttctatttgatttgctgctgcaactattagttgcatgggctgtgtatatgggctttagttgtgaaattaagctgtatatatgggctgtaagcgatgtagtagtgggctgaaaagggcaccaaaaaatggtgacaaaattgggctgcaaagctgctgaaatgggttgtaaagctattgaaaatgggctgccaaaatggctgaaaaggagctgcgaaaatggatggaattgggctaaaaattggcccatctttgattttggcctgttaataaataggttgaggtagtgtctacgtcatcatccacgtaagcaaccatgtaagcatccatgatgatgtggcattcaatccgtgacggttatttttcgtcataggaaatgaacttgggctgggctaactaggcctcgggctctatcgtgatggtttaaaaccgtcaccgattccattaatccgtgatggtttttggtaaaccgtcacagaggttaatccatgacgctcaatccgtgaccatctctgaaaccatcacaggtgctacatagtgacggttttttgatgatccgtgacggaaatttttcatcatgcattaacagattccttgtagtgttcaatgttccagggtgagctaggacaggagggttaggggagagagggaggggaagtttcctagactttgaagcataggcgtgtagagacggcggtggcactgccgaagccatggttttggaggagtatggtgggcaggcttcgacatctagggagttagacccgaagtggttaggaggcgtgagcgatggtgacgtctttgatgacagagagatacatgagacaaggaagacattggtgcagaatgccttggagagatatatgagacaaggaagttgtcggtgcaggatgccttgctactgtgcggcttgtggaggaggagagattgggggggggggaaggtgaagaaggtaagtccggctagccttgctagcaccgaaattggcaggcgtcagcacttggttaggaggtgcttttaatgggtggaggtgggacagaggaggtggtatagaagataggagaatgttactatggtgcacatatctgaccatccaaaataactgaaattttatatgtattttcaggtgtttcctgttttcaaatattacaaaattgttagtaaaatatgattggtaactatagattttgaaaaatccgtagtataaacatccaataatcacatcatatttcaataagggagtatatgtatggctgtcgacatatttttcacatagtcatggtaagaagagaactctgtgttcggctgctagggttggcaactaatcactgttgcacggaaaacagagtggtccattagcgcgtgattagttaagtattagttattttttttgaaaaatggatcaatgtgattttttaagcaacttttgtttagaatttttttgcaaaaaacacactatttagccgtttgaaaagcgtgcgcacggaaaaagaggagagtgagttgggaactctggctaccgaactcagcataggaagtacttagatattgtagtttcattccatatatagagtattacaccatacttatattaatatattccatagcacaatacgaatagattcacaatagaaccatcaacacaatccataattttaatatatgacaaaaacattgaaattataaaataagcatagttgcaaacattgcttgctgctcatttattcctcaacaagttctctagctaattggtccaacacatcttcatgtctcttcagttttgcttcattgaaggttgatgtatccttctccatcaatttttaaatacatttggtatttttctacccttgcctcctctcttttagcacttgcgttctcttttatttttgcttctgctccaatcagtgttgcttctgcggcctttagcaatgttgctgctttagttgtaatagcttcatgaaagagaaccatattttgacttggcttgtcccccaaagttgatggagcaccttttccttttttcctctgttttgctgccttttgcctctcaaggcacttctctttgcgctctgttttctcctctatttcttggttcgatgatgaagtatatgctcctgattcagaaatcttgttcctcttattatggctactctcttcaaggactctacaccatttaggttgttctttaagatctttccacatataatccaaggtgaaagtattttggttgttctaacttttgtgccattcacgggctttctctattatcatatgatcagaatacccattagtgaaagtacttctagctttacaataaaatccacagaacttagtgacatctctcttgacattatcccaatgtgttctgcattgcttggggttccttttgtgcccattgctaggcaatactggtgttgaactctcaagctatagccttccaatactaatattattttttgtcattgcctttgatgggatcaactgagttgttcaaccaagagctcattagttgtatattgtcatcttcagtccaattgatgcgtgtccctcttcttccttcttcactgctttcacttgcctcttcaatctcaactacttgtttctccttatatcttgtatggtatggaaaagctcatccatgtgaagaagtgttggctgcagccccaattgaagtactatagtgcataccaaattgtgatctattggctgcaaatccaaatgcttggatagatgactacactagattttcttgaagttgaaaacctttaaagcttcctagagtagtttgcgcataataatcttgttggtgagcaccttaaaagattgaagggtgtccatatagttggtagttgcttagaggaccaaaaggatggaaattttggagaaaactaggtctcaagttttagggataacttgtgggaaattgggtagaatggggagttttggacatcactatttgttgcttacttgtttggcttaacaaaaggctccacttagtatctagggaactgaatggatcaatatgttgttcatctcacttgtgcctcctttcgtaggtagcacaagaatgttgtaagaagccaatggctaggaaagcaaatgagcaactcaaatgaaagagcaccaacggctagtagaagtagttactatctgtagtaactgacatgtatattttattggtgtgaacagaaaaacattacaagtattatattttgtagctttgtggccacaccttaagcttaaagtctagttttattgcatgacttgtggtctgactccacaatgttaaatgtgttgtactatagcagcatttattgcttatggttactttttagtgtacattgtgctattgtggatgtcctaagacagtatgtaattcaaaggcaataaaattattaaacgagataaaaaaaatgatgtagcttgatttataaaaaatacagatttaaatttcattcataataaataaagataaaaagttatatacatatttaacaaaatttacctgtatagctagagaaattatattgcaactatgtaattacaatgtaattagtctaattcagtaacatattttaagagcacacgttacgcttacaaaaaatcctcgaaaatagtaaaagtgaagtgatttcttgcatacactgtttaatgcaatttcaaatttaaatttaagtttagattgtttgtgtgtttttttttaaaaaaatcgaactgtttggatcagtaaaaaaaaacaaattgttcggttaagtgccaaaattatggaatcgtttgaggtactgaaccgaacaagcacctccgccgaatcattcgcggcatatcgcatcggcatcggattgcaattcgcaccaaaccgaccgccaccgccgcaccaccaccgaaattctcaattttctctcgcgacgaaaagggaataaaagcgcttcgcctcgcccactgccacgccccccatctcttctcccgactcctgagagaagaagaaccgctgcttctccacccgtcgcggagccccgtgtccatcctccggcgcggcggccgccccccagcgatccgcctcaggtgagagcaccgcccgcaccccctactgctctcccctcccctggagatcggcgtcccactcactcccatcccccacctcatcggtggattggattggataccagtaggggggcgatcgctcatcgctgcttgtgtgcatttcttctggtaggattgggggatttactgcgtgaccgtggtgtgatattatgttcgtgttcagtgcattgcttcttcttccaggaagagatatcaactctcttttattaatcgacacgcgtcctgtgtgttcttctttttatcgcatcgtaacatcgttaatgatgcagggtggttatccgcgttgttagaagatactatatggattgtaaaatctatagaggattgtttcattttcttcttattgttgctaacattaagaagatgctaggataggatcataggatggtgtaggtcgacactgaccactgcattgctattcgcgcaacgccaatcttttagtacttcacttcctgcttcactcctctgtcaaaagtcgatgcttggaattaaattcttctggaaattgggagcttcttcaaagaatcgtgttgtcctgaatttctttgtcccgtttggcattttcctttttttttatattgaatgactcaagcccatctagtgtaagtgtgtaactgcgtgctctaacattttcaactgaaccaggggatagttttcaagtttatcaccttgcctttgctggtttagctgtaccaaaagataaaaggaacaatttccaatgaattacatatacattttgtttaacaccaagtgagctttatataatatttatcaatagacttgaagacttatatatatatttgttataccctatgccttattcgaaacgaatccagtatgcttttttgagtaatggcctggactgcaagttgatttactgtttatgactattactattcacagttaaaactgcaaatttatagaggtgttaggaaatggaagaaagaaaataaaaccaaacagctgtttccatgtctcctaggaactctcagttgctacctaaaaagccaggtgtttcacttgcttggtaaaatgccaccgcacaatttggtaccactgcttaggacctggcacagtttggcaccgttgcttggaacataaacagaaggtctctttttagtgttctgctcaagagctttaagacctctcaagctcacaaccattatcatatgcaggttgctaaaatggataagctcagtggttctgcacgtcttattatcgtttcagatcttgaccacacgatggtttgtgtttttcaactcatatcttagacttgttcagagataattgcagcctgttatatgtcgttttaatccttcttcaattcaaacttgcaggttgatcatcacgatgaggagaacttatccttgcttagatttggcgccctgtgggagtccgtttactgtcaggattctctactagtattttcaactggaagatcccctactctttataaggaattgaggaaagagaagcctatgctaactccagacatcactatcatgtctgtggggactgagataacatatggtgaggcaatggttcctgatgatggttgggaggaatatctgaacaataagtgggacaggaatgtagttgtggaggagacagctaagttttctgagctgaagcttcaggcacgttcaatatttcacatctgattctgttaatctacaattatttcgaaaatctgatggctaaaataactagtaacattgttctattgccgtacatttgcatggatacagccagagacagaacagcgtccacataaggtcagcttttttgttgataaaaagagtgctcaggaagtgataaagtctctctccggtaatatggagaaatgcggggtgaggcaacattcgacttgatgttagcttgtttcaattttggataacttaagaactatttatggtttcttttcgtattatgttaactgctatatttcttgtaaacagcttgatgttaaaataatctacagtggtggccaagaccttgacatattacctcagggcgctgggaagggtcaagcacttgcatatttgcttaagaagttaagctcctgtggaaaaccaccaaacaatactcttgtttgtggggactctggtaatgatgcagaattatttagcatccctggtgtacatggtgtcatggtcagtatacaataaatttcatgaagtgtctaacaaagttcatgccagattgaatataagtttactgtaactgcaatctttttttaaatttttcaggttagcaatgcccaagaggaattgcttcagtggtatgcagaaaatgcgaagggtaaccctaaaattattcatgcaactgagaggtgcgccgctggtattatcgaagctattggacacttcaaactaggacctagtgtttctccaagagatgtggggtttccttatgttaaggaggaccatatcaaacctacagatgctgttgtaaagttttacgttctctatgagaagtggcgcagggctgaggttccaaaatcagattcagttgtacagtacttcaaaaatatcactgtaagtacatcactgcccagtgtgatgtttcttcaaaataatttgtaacctttgtcaaaatcagttttatcttttacctcaaaagaaattatcagaaccttctaattttggaaaagaagttatatttccaattaataaagtgaactgggtctgacgtattatattgttgagttaactgattttttatttgtttttggtttgtcttagcatgcaaatggtgttatcattcaaccttctgggcttgaatgttctctccatgcctctgttgatgcattgagttcatgttatggtgagaaacaagggaaaaaataccgaacatgggtggacagactatttgtctcacagtctggttcagacagttggctggtcagatttgacttgtgggaggcagaaggttagtccttagaattgtgtagaatgagtgaattagctcttatatgatattttttacacttcattcaaatttctttaatgttttacttacacaatttagcttgttcaatcatattttttcacttgtaggtttctctagacatgtcacttcaatctattaattttgttgtgtgttgtagtatatcctcgtacacaccagaaattatatgaaggttttaggcaatagtttatgaaaagattgacaacatattcaactctgcatctgtacgtacaaatgtcataatacattacacatatgcagtctagtgcaattcatttgtaaataaaagtaagaaaacatactcctcaataaaaaataatttattttatatacgatttaaattggaccaaagccaagaagagaaccagctgtctcggctagggacaaagaagaccctgcaagtacacccaatgaatataaatgattaaaatatgtccaaagttgtagaagaccggcatcaatgataatacattctttggagtctacatttttcaaagtacgaaactttggagtggcaaacacacatgaaactctaatatttgattgaaattgaatatgattctctgtactaaaaaacactaaaaattttcagtatggtatttatggatttccatgtttacctggatgcatgattgaacatctactctcttttgatgcttgtggttcagatgtctatgctgcaaactgatatatgatttatattagcttgtattgttctctgtactgtctagacaacagagcacaactactgtctaacagagagcagagcacaacacataaccttgatgacaggctataatttttgttattttattctttttgtacaaatgattctcacctgaaagttttaacacattcctactttaggtgatgcgcggttgtgctgtttgacaagtcttgcgctgaatgtaaaggtacatcatctctactcagtcttgcactgaatcccgttgcaattttgcatcgttagcatgtctgcatgatctaaaaacgcaggtttaacttcactttttttttttcaataatatcagcctgaaacccctgctggcttcctgataacacatgtacacaaaacatggctcaaaggatactcttcagcggatgagcagtcctccaagctttaaaccctttttcacccctgtgcacacggaatgaatttacttgatgataaatgaaggacctgctcgtctgagaatctcattttcttatttaatgtaatataaatgatctgtctcgtgactcgtgcgatgataaagtgaacgatctcagaaggcaacttcaacaaatgttggatatgattttacagagagttcagaattagatttcatgacacaagtaccgctaagctggcattatttgtgggcacttgccaacaagttttgcatcactatgtgcctagcggtcaaataccttgcaaaaattatgacattatgcatgtttttctttatttctgaatgatattaggtaacatcattggttcgccacggataaaaaacatttggttctttcttttcccctaccaaaataagcctcttgccatttaaaaaatatatggcttattctgagttggcacaagtattaaggcaattaaaatcaagaaaaatatgagttaaagtatttatgctactgatgcttaaatacatcgaagtagggacatcagctagtgataagttttagtagagagggagactggtgataagtttaaattcaagctaattatatattttaaaattcacattgtcggtgatatgtgtctgggggtatcaagaccagagggaggaggctgccggtaccaacgtggcactcccccgaggagggtcgggcccgtggta

SEQ ID NO: 60222 - DNA, 48397 bp, Oryza sativa
gccgtttcctccgcaccacacggtcgccaccgctccctccctccacaggccggcgtcgccgctcctccctccgcgagccagcgccacgcggatcccctccctccctccacaagccaccgccgccgccgcaacacctcgcggtcgccgccgccagcactcagagagagagagagatggaatacggggagagacgtagatatggatagggtttggtcgagggtattttggtcattacaaaaattaattgtatttctttcttttttaaaaaatgaaaacttaacagtgttaaaaaacagggccaaacggagtgttcgttttaaaaatgtagggtcaaataagcaaactagaaaaagtagggtcatattggtagttacacttcaaaacagggtcaaataagcaattgtcccatactaaataccatattaacacagccttaacttttgtattcattcaaacggttgtatctatctattgatacattaataaatatattcgtcaaatgaattttttttcagtcgtatagagtatcatgaatatacttctgaaatgattgtaacaaaagttttgatggatagacttaagaggtgattcattacctaatgcatatgtaaaaagccaaactgcctttctaataaataatgtatcatggaggcctgttctcgaataaacacgatcactattacccaacgcccaaaaaatgttaaactctcaacaaaaccgtccaagaagagctgcaatgttttacaagctgatctagaaatcatcccaacacatcgaaaaactgtaatttgtacaagcagattgaggagtgagcaatcgagtaaacgagctaaccatgggcaatgagatcgacacctccgtcttggccttcttggcctcgaggctccagatgcactactcgaaaggtaggccatcacctcatcgtgaggcggcggagatggcatggacgccgggagatccaagctggccagcggcgggggatcccccccatctacgtgcgcctcctcctagtcctgcctcccctgcattgcgtgcactcggacaccgcagcgctgttgagttatgatccaaattcatttgcacttaataaagaccagcttctgccgaagtaaagcggaggcccgtcgccggaggcttgggccacccattgggttctgcggtacggattgtaatacctgttagggtttcacctcatatatatacctcttgtaagccgctgtgcggtgttgtaccctcaccccgatacagtgaagatattttgctggctggcgctagtggtttttttctttcctactttgagaggcttttttcacgttaaatcttgtgtcttctacgattaatctactattctttgtcgtttgtttgcccatcgttttctaacgagcgctgcctctgacttgccactgccgtgttgagcccagtgctgccaagcgccggccaccgcctacatgtgccttcctttccacggacaggctcggcggctcccacgacctgaatggaaggaaggagagggaatttgggatgaagaaggaagaatagagagagagtggaggaagtatgacaggtgggtctttcttttctttgatgcttgggatgccatgtccgattagattggacttaaataggactcaatgtggacttattccaagcagtagcggtagtagtgcaggccttgggccttggcccatgcagcagcaaatagcctagctaggtactcccaatagagcagcaagagctagcaaacagatcggcagcagcagctaaagtttagtcctatttggagagaatgtcaccaacttagaaaactagaaaagagatggatgctgaggatttaacactggttcgaacgatgacgaaaatacggtgttacattgtgggtgtgatctagcaattttaggaaccggtaaaccttagattccacaaataaagaaaaagtcgactcgaaacatgggatgaatcgaccaatgctttgagcaaccccatcaccccaaaacccatcggcatccaagaaaaaaaaatcgcaaaaaataagcatcagctctaatcgagccaatgctttgagcaccccatcaccccaagatccagcagcatccacaaaatcaacatccaagaacaagatcatagaatcaggatcaagaagaaaattgatattcacacatgaaccacaaaaatccatgaacgataaaatccaagaacatggagaggaggacgtcgtagggaaggccaccgtagccaccgcccgccacccaccgtgggtgaagtcgagcttgtggaagccaacggcccatggcgagatggaggccaagggagggaggtaaggcgaagggcatggatgttgaagaggacgtcgagcgagccctgagctcgtggcggctgcatctggccacccctgagtcaccttgtgtggagattatgggtaccgcatacccacacggcatggttatccgactagttatagaggatagcttatatctatggaatatgtaatagatcatgacttgggtattacgtttccttttatattatggagcggcctaaagtcctcatttgataatattgtaaagtagatttaggaaaccgataccgtattggttaaggtttctatcttgtaatcctgcccccatcctatataaggtgggcaggaggccctctagggggcatgagcacatatgatcgtcagatctatactacacccggtggattcaaatccccaaacaggagtagggtattacctctcattgagagggcttgaacctgtctaaatcctttgtctccgcatccatccacttttaggtcccgtgtgctacccccttttattattgccgaattcatgtttcgacaccttgtgagggaagggcaccaccgattgcttggggctcatcaccatggagcaaccggagctcaatgttgatgggccaaccaccccccgcctccccgagctcatgacaacaagatttagccacctccgaagcacgtggatgtcggatctgattgcccctgagccagccgcctgcatggaattatgtttgtcccattttagtttttttttttttgctgaggtcgagtacatggaggttggaggccatggtgttggtggaggcgtttgcttgtggtggttgtgctgtccctattctacaaggatgtttgatcgaattcgggctccagggttataagcagacgacgaagacagtttgtttcaacagatatggagcgaccttgctcaacaagaagcggcgcggctaagggatggatgggtgtggaggggaggcggcaatttggggagggggaggtggggatggggaagagctgacaccaacaccctcgtcactgatgcgctcgctaacggtgtgcaactacgtgttgctacaggcggtggtggttgaggaccggagcccgatgacaaggagctggtgcaatccaagcacccatcacacttgcacccgcaccacctccatgttactgccattggcctgtacacctactcatcctcacactttcctttgccatctacttggtgttgttcctactccatctctctccctaatcggttgatttaggggcgtcagtcagactctggtgagatgttcggcaagcttgcgagatggggattccactagccaggatctagcagcctcaaatcaaatttcttgtcacctcttccttaacgtccttcatcgatccaacaagacaactctttcacgaccatctgagtaccgttgccactatggttatctggattttggattcatctttctatttgtttcttaatagctgcaaccatacatgatttgccatttgggtagagcatggaccacttgtgcaactctagttgacaggattgcattctaagctctttagattcaatggtgaactccgctgaaatcctttgccgagtctgataacgcttatatacaccaaaatctatggctcagcaagaaacctctgctttgagccgtttccgtggagatagccaaaagagattgccagcctgtcaagtggtacacacgttgaatgcggtccaaggatgtcaagtagtatgcatgttgaatgagatccaaggacgtagttgtcgtggcaatgccgtagctccaaatcgacctgctactctactattgtttggtttcattaggaatagattgcttccttagttcagtaaactgagccctccataaagttgcatggttcaatactttcaactaataagtacgacgatgtgttgtgtgtgtgttgggggggggggagggggggtgttaatgtaacctgccccctcaatctgtcatgtgtaataaaaatgttactccctacattctaaaatataggctcaatcacttttaacacaaagaccaattcaaaatttaccttgatgcatataagcaatgtgatcggagggggaaggggttaatggtgtaggatttaaagtgccagtaatatatgcatgcatgcacgtattatattatgagacacgataaaaagtatccgtgacttatatttttgagatggaatgagtatgagttctgaaaataattttaaaaaaataatacagtggcccagccaaatttcccttgacacgcacctaaattaggcgcacccagttatcacaccaaatctgtcagttgagagttaggacctctctggcaagtagacgtggcctaagtgactaaaaggcaatgtatttcttattaattgtctctcatgttcatgtacatgaagggtttagggaaagatagttaaatcatggagggttttttttggttaatgtgcatatacgtagggatatctgaaatttactaaaagaaaatatttcacgtgtacgatatacattatcgttaacttcaatgatcatcatcgagctgcttttcacgagtttgcactttgcatgacaaggcaccacatgttttgtcacagtcgtcacatgtctcatctctgcaaccaacttctctttagctcgaaaataaatcaatctcgtacgaaatatgacacatcattatttaaataaatcaatctcatatgagatgtgagacacatgctaatagacatatctaaattaatagtattaagatgtatcacatacaatatgagtttaatatattttgaaacgcaggagtacccataaatatgtatgcgtacaaacatggagcagcagtctctcgtgctgccaagtgacaagtgcaacaataatcgttcacatagggaaaacaaaaaagaaaggtagaagccccactctccttgtacgtacgacagcatgatcggcggcgccgccaggccaccgacaccgccggcggtcgtcgacaagacgatgtgcgccgcgtgcgacatcctgaagctcctaccgacaggcaccgtgctggccttccacgagctggcgccgtccttcaccaaccacggcggcgcgtgcggcgcggccagccggtacaccaccgcggcgctcatcgccgcctgcaccgcgtcctgcgtgctgctctccttcaccgacagcctcgtcagccatgtcgacggccgccgcctctactacggcgtggccaccctccggggattccgcccgttcaacttcgaggggacgcgcgaggagatggaggagaggttcggcgacctcccggggatgaaggtcagggcgctggacttcgtgcacgcgcacgtctcggcggtcgtgttcgtcgtcgtcgcgctcggcaacgccgacgtgcagggctgcctcttccccgacgccggcactggcttcacggagatgttcaggaacctgccaatgggattagggttgctggccagcatggtgttcatgatcttccctactaccaggaagagcatcggctacacggacatgatgccgcacaaggaagactacgggaaaggaggtaataatattcctggccagaccacgccgtcggtgtgatgaagtaaacataacatgatactccatttatactttataggaaggtataaatgactgtacagtgtaaatccgtagtggtgtgtagaagttggtatatatattggacatatatccaagcatggaactgtagaatgtactcatgtggggctttaagccctctttctttatatctaaactagcatatatgtggtgtaaaaaaatcatcggaaattacatatatctcgcgcgttgcagcggaatttgtaggtaattgtcaaggaaaacatatttggataagttacctacataagattagacagagtaatgaaaattgtggattttatttattaccatgcttgattgttcgtacatacatacatacatacatactatggactggagcaaacctcaacatacatacatacatacatacatacatacatacatacatacatacatacatatacacggtgcagtgcacgtacggcaaacgacagcggcgcacaggagacgatgcgccgtgcacgagacattggtgctgtgccgagtccttcacgtcacggcgttgcctcacataggcattgtgcgcggcatggcgcacgactgcacgagagaagcagggcagcagatcggcggctagcgttaggggcgaaagggattaagtcggagcgagtggcggctcggctcgatggcttttgccagtccagttcggtcggtttaggccaaagcaaagccgcctggagaaggggaggaagacgggtttgcctcatggccgagctgggtcggcttggtaggcttgatgggctaggccaggggaaatggaaaaagagaagaaaagagctgagcgactcaagttagactttttagaaaaaaaacaagaggattagggtttgggtctagatgagttgggctaggcccgcaagggacaacattagactttagcttacaagtttgaaaaattgattatcaaaatactttagtttacaaaggttttaaaaaaatacttattagtttcttttatttgtaaataaggattaatcctttaaaaggattttttaaaaaatatttgattttatttgtaaaagaattcattaaagggatattaattaataaaagggttttcaggaaagtaattagtatttgcctttaggtgaaaatattttcttgatattaattcataatcatggttgtttaataaatattattttaactccacaattgaatttagaatttgcatttaatttcttatttaatttattttggcagcatgaggtaattttgaaaatccaataaataccagcataagggaattttcaaaaaaaaatatttgtccaaattttggtttccacattttaaattcgaaattttcgggatgtttcatgctaatatctagtacaactctaaatcctaaactataaccgactacgtatatgtatctgacacaaatctaacagaaacattgctcatattcttgttcacataccaagcccttgtatttcccattagctttatgtgttgggcgtgcgctctccttgtcatgtttaacagagcagcttgaaactatttttttttcaggtagtggatatcaatccggcctatacatccctcaaggatgtaaattactagctcaatatcctttgtattataaccctttagcttgtcaatgaattgccgtttcgattgggggtagttcatactcgttagagaccaaactgtgggtttgttgttcatccggaacttttgctgaactgttgcaggcaatgaggatgccctgctccaatgccttcaacagcgcttcatcgctagttctatgtgttgaacacgtaataataaattttcatattgcaattcacgataaatgtatcttactccatctgaagagttccacgagctgcagattcagatagtggaattgttcttgataagatccctgcaaccagcatatatgcatttcaaaatggtcctgtctatgcagcataggtcaccaagtgtcccttagctcttcactcgctcaaaggacactagctctagccacgtagctgatatatgaaaagagaacagggtaaaagtcgtaatatacacaaactaaaataggacatatatatatatattcccttttctagtgtttgactatttttagatgctttgctgtacaaataactttttaggtcaattcttatagcgcattcttttccagaaatttggtgtaattcgcatttgtcattggctccgatgaacagcaactcaacaagctattgaacagttgacgttcaaccttacaatgataattatttcattgatgcgatatggaatgagaagtatacgatggcatgtaagaatctggtaaaaagaatataacagcaatatatgttattcttgttgagagattgatactactagagaggggccatgatatcacaagaggcttaaactgtacaagcatggcatcttttctaaacatgcagaagttatttttttaatcttaaagagaatataacttaaatggaaggtacgagagaaaaatatgtttttcttgctaatttaccagctgccagaccagtttttatgaatgaaagacataccaacaaaataaaattttgttttactttgttttgctttggaacttttaacagtctcttcggctgatcactgttgctgtcataatttcaaatgcaaattcttgaaaagttgttgtcatttttgctacagtacaagctcagctatctgttgctcttgttttctcttcactagctgaatgccgtgctttgctacggatgataaaaaagtatattagaatattgtctaaaataaattaacatgtgttttctcttaattgtgttaacaattcctttgctatagggaactctgaccctaatttgattttatatgtgggcatcatttagatttgtttgtttttctaataataagaagttcaagagcaaatttataaaattgacaatggaaatagatagggtgacagattcactaccagcaccattaatttcttttaaaggagtatagatgttctatgtgctcgtcttaacaaaccttactttttttacatgattacatcatttaatttgaattgaaattatgagtgcagtttaaagtgaatcaataaattaaattaacttcccaaaaagtaaattaataaatattattaactgaactttgaacatgcattgttcaaagttaccttcatctctatatatgaacatccattctacaaagtttgtcatcacttcatcttgagtatgccactaattgaagaatgttgtttctaaccgacgatctatagatgcttacatgctttgtaggagcgatttgaccaaagttaggaatacttttccattaaagattcccagaatttctctgggatacaatcgatctgccaattgcagcagccagccccccctcttgcctgtaagtatcacacccatgtgtagcattgttcctttcttttcactagcaagttacaagctgccacatagcagatctcttgatacccactttgcctggaatccctaccctctttcagatgctccttatccatacaaaatgctgactttctggccagtactgaaagaacaagagagaaagaaaaactcatattacaataggcgacttcggaacgcggcatcgcatacctctaacctctccatatctgatgaggtgtgaggaccttgctttttgtgagattctaattctagacatacgggataagagttcctgttgagaggccattgctgttcatgagagcctctgaatggaatcaaagcttctctcaacgttgacttggctgacgatgatatgattccttggggatgaccacaacacatacatttggtggctctggcctaatgtcagtgttgctgatcaattggtaatgttgtaaaccaagagggtgatgttgtctgaatttgaataaattgattttcagttgaacggtgaatccgggatgacaggagacaatatttgctgaatttccaagcacaggtatagattatccagagtgctgaatttccacagttcagtttcttaataaaacactttgcatacttccattggatactggacagcaaaagcaactatacaataggacaaagaaaaaaaaattcagaatgaattgatctgtacttagatcttagtaggaaagaaaaaacaactcatattctgatgttggcgttgatttgcattcctcatacctgtgacctgtgcattttacatcatcaagtttgttattctcacgcaaaggtctaagccgtacaatcttacgcagacattatccataccacacctaatggctgaaaggcaaaattctctttctcctcaaaatttttctccctaagcatggtacttcctagttcctatgccttgagaccttgaccctggtaattttgttgggatttgagagattatatatcagcaagcgctgctctcttgagtaataaagaaataatttgcattagttagtcagtccatgctatttataacagaacatttttcatatcattctcgttcttattcataaaggtgaaaaactagtaaaagcagatttatcagcaaattctagcaagttgctttgttctgattccttcacagttatttgatattttccttggattttctacagaattccatagtattttatatctaagactacaggcttgttcagattggtaccattttaaaccataccattatttagtaaaattgacaatcatgttgttgcatttagtttcttaccaaatattggtaatgtctatgaaattttggcaatattgtattaagactatcctatcaaaatttggcaacgttgcaatttaccaaaattttgacaataccaaattttggaaagattcattttggcattaatctgaacaccaccaccagcgtctctctctctctctctctctctcttctgacttagctttgtcaaatatgatagaatggaactactaaaagtaagaggagggtcaaggccttatcaacacctcccaaggaccatctcggcatcagtttgctgcatcaccattgtcatccatatattccatattccacactaaatccatcgatccgtggaccgtggtgtcgcgaggagcaagcttgcttggccatacattatccgaaccttcgtcttttccccgatcgaattgccgcaaaatctcatgtcgtgcacgcacattttccatggctatataagcaggcaggaggctcctcacctatgcacagctcaaagcaaagcaaagcacaacacaatcaaagcctcatacaagaagctagctagctagtactcaagctaaatacctagctagcagtagcaggcgaccagctgcatttttccagaggaaaaatctctcagtttagcttaattaattagctcttgggagaagaaggcaagaagaaaatggacagggtgaacaggctggcggcgcagcgggcggtggtgatcttcagcatgagctcgtgctgcatgtgccacaccgtgacgcgcctcttctgcgagctcggggtgaacccgacggtggtggagctggacgaggacccgagggggaaggagatggagaaggcgctggcgaggctcctcggccgcagccccgccgtgccggcggtgttcatcggcgggaggctcgtcggctccaccgacaaggtcatgtcgctgcacctcagcggcaaccttgtcccgctgcttcgcaatgcgggtgccctctgggtgtagcaccaacgacgcaactatacctaccagcgactggttcttgatttggactgataccgtggcgcagaataattttatacgggtactttggtttgtatcaggcaggtcaggtatatctaagggaaaataaatagtacgtgcaggccttttttgcactgcaatactagtaaatctatagagagtggggaattaagtgtgtcatgtcagccgcctgtaaggctcttttgagatgtaataatgacacatatccgtttaatggagtatacctcttttgtcgatcgttggtcttttcgtctgtgtgattttttaaaaagctatctaatccagggttttcactttcggtttgcatcgaaatttagggttttcactttcggtttgcatcgaaattctgaagttttggtgcaactgaaatttccaaaaattttgggaaattttcaactttttgtccgaaattatttgaaaattttaccaatttttgactgaatttgaatacattttgatcaaattcacaaaagtttgaaaaaaaattagggtgcaaattttgcttgccggaaggggggggggggcaaaattactaaaatttcaaaaaacttaaaccgaaattgaaatccctgatctactctagcacaaacacatatatgcttaattaggaaaaccatctccaaactggtaggacgattggttaattagggacttggggtatacctcttgggatgtggatcaagaacctataacacagcgtcttcaaactcgcattagttcactctacacgctgagtggacccacattcacataatcacatagcaactcgcttatattttcgtttttgtttcgtgtaaaatggttaatctagtgatattgtgtttggagtgaattggatatttaagcagtctcaaacctatgaagactctccatataggactattatcactaaatgaacacttggaccttacaggtctaaaccgaaataagaacactcatgagctgaaacagactaaacgggttggagtattatagaacaatatattttttggacagtggtttgggacaagaggagattgaaataggctaggtgtgttgcagcatggaggctagagagctcgagcaatggttgcacgagaagaaacgcactcagaaatctagggccacgtttgttagctgggctagatgattggcccattaacaataactcgaaagttttcatctgctaccgtcacaaccatccatcgcacaatcgtcccttcccaccacatcaccagtacatcgctgcaccaggtaacaccatggatgatatcctataccaagtagcgacccgtcgattcctgagactcccttccccctgtcaaaattcagcggcactattctgaaggccgtaaacacggaataattttgaacaagcaaaaaaaaaggcgaggaatgtgatctcctggtcaaaaacgattatctcctggtcaaaaaagattatccaagtctaccaagcttgtgaacgtaagttaaaatccgtcccacgtaattggtactttattttatgccgattgacatcttgcttcgtgtttgtagagaatataccagcaattccaagctaagtctgaaaccctagaaagacttatcttgatactttggagtcggccaggaaagaatttaggccccttttaaaacaaaggaaaaacataggaattccaaaggacttataccatgtggaaaataatcctatgagaccctttgaaataaaggattgatttctaccaattccattgacattcctatggaatggactattgtaggaaattttagaggaaaattagcatgaggtcttacctcatgttttcttcttcccgggtcttgaattcttatgtttttcatgtgtaactatgaaatggtagttttgaaactttcttgtgttttcaaatctcataggaatccaatgaacatgacattctattcctacattttttctattcccatgttttgacaatcctgtatttcaaatgggcccttaaagaagttaaagaagccgccaaagctagagagcatcagctgaggaatgagatcggccagcttcaggatataaacttggaataccgtggattagtcaaaggtaagcaagcaatctcaaaaacttccagcttcaggatataaacttggaataccatggattagtcaaaggtaagcaagcaatctcaaaaacttctagcaaaccctgtctcctgaagttaaataggtccaaaagacaaaacggttatctactaaaaaccaaagggagtagtatttagactgctttgagtcaggcttgggctaacaaaacactacctaataggtaagccgttggcgaagtcacaaggccctctacttttcattataaaaccgataaaccagaaaaagatggattgttttgcgaaagaatctttggacccataaaaagcagaatttgtgcttgtggaaattctcgagcaagcggagctgaaaacgaagacgaaagattttgccaaaaatgcggagtagaatttattgattctcggatacgaagatatcaaatgggatacatcaaactcgcatgtcccgtgactcatgtgagtcattttttgactcaaagcagtctaaatactactccctttggtttttagtagataaccgttttttcttttggaccaagaaaaaggacttcattaaatcacatgggacaaattacagtcgttttcaatcaaccaagaaacagaattggactcaaacccagttcagaagcctgagtaatcgtcccttctagctttgtttgctaattcatggctaatcaaattttgttcccgctggatcttcgtaatggaagtcgtcctttctcctgatcaaagccatcttgcttctctgactagaaacgccagggttgagcagtcctcctccttatcagtgagtagatgcacaactgagatgtagtctgtttcaattgcaaccggcagcagtgtccattgcagtgctaaccgaaggccctccacacaggcggcaagtttagtctctaacgctgaagagcagtttgcaagtgacttgcacatcgtaaagagggtttcaccattgtagtcccgaagaattgcaccgatcccagcactaccatcggactcaaggaaggagccattgatgttcagttttgcccatcctgagggatgtcgtttccagcattctttttgttagtgatatgctctagaggcaatcatagagattattgtatcacatactatgtttacatatttttccgactttgttccttgaagtagataacttattattggttaatgaatatgtgattctttcatgagactctttatgttgtttgttactatttttaaaggatcctgatcaaataacatatgtggaacaaataagtttaaatgatcagcacatgtattaattgatgattatatctcatggatcatggtacagagatatcaaattaataatgtgaatacatgttggggaacatgttgttggatagacccaacatgagacactgtaagagccatatgtgttgtatcatcagtgatctcatttagtgttggtgttgaatcctaattagacctgagattatcatgattcccaacatgtgtagtagcttacttagggactgctaaacgctactccgtaattgagtagttataaaagtagtttacgggtatgctgtgaaacatgcagtaggatatgaataatcaagatgagatttgcccctcctatggagagatatctctgggcccctcgatgttatagattatggaagtgcatggccatgccaaaggtgattgaggagtcaatcacaggttatataatctatcacaggttcgagcgaatgattgagctattaaaggatggcacatatctagccttgagcttaatcgatatcgtgaggcgaaggggttcaaacaagtatacactagaggttcagccgatatgatctttatgtatgtccggtgggtcaatacgttctgctagggaccgctgttgacacgtggaccgaaaaggagttttcgggttatagctgagtgtacatgaacctacagggtcacacgcttaatgggccgaaataaggggattggatggagatccaatataagcttaattcggatagggatccgaataggagtcctacaggccttggaggcccgagttatggatcctatatattcgtgaggggtgtaatcggcggaggtattgcatcacgtgagaaaccctagccgtcactcccctccccgggcaaaaccttagccgcgcgcgggtgctagcacatctgcgcgtgtcgttccgtccctgtacgtgtggataccggtagaggcgccactgctttgcggtgctgatgggcgtgggagtacggcgaggagaacgcacgaggaggataatgacgagctggtgcgatcgactacttcctctgtatcgacgcgcgctactttgcgagagttccttcgacttcttagcgccttcttccgctacacagcgcgtcgagtggtaacgatctatgatctaatacttgcatggttcctagtttacgtgatagaaaattttgatttatgctatcgtagtctacgcgtatcccgacacttttggcttatcatccttttgcgtccggcaaattgtgtcgccctggatctgcttcgcctttaccaagtcactcctttggccattttttattatcagttggccattctttattatcagcaaggattggacgtagctttccaagaaccttttcgatgcaattatgggtgttggtcttttatcgtgcattatctcattatgaatgtaccaagcaatctcaaaaacttctagcaaaccctgtctcctgaagttaaataggtccaaaagacaaaactatctactaaaaaccaaaggaagtagtatttgagactactttgagttttaacaaatttataatggcttgtgaatgaattatgatgttacttttaaaaagtgcaaatttacactgccatagattatttatatcatttaattcattcatatgtaccattgaataataatcatatatagatcattctgatattcagcacaatctagaacaatccctagagcaccaatgtatcccaagaaaatatcgtactccctccgtcccaaaatataaacatttttagcatagtgacaagtcaaacattttcaactttgaccattaataacaaaaaaataaaaaagatcaatcatctaaaattgatgttactagatttatcattaaacaaactatcataatatgcaactctttttatttaaaacatcttatttttatagatattattggtcaaagtagcatatcaagaaccgtgtcagagtctaaaaatacttatattttgggatgaaggaagtagttgctattaaccgttcatcttttgtttctaagcatgtgtttggtttgggaatgagtttgattcatccttcttttttggatgggatagtcctagttttcaaaagatggcacacatgttagggagataaaaaaatagattggatttgtccatcaattttcaagagaccaccctagatgaggagaatatttccttttagagatcatccacctcacatattcccaaaccaaacactagaaaatgggtccgacccaacacgaccaattccatcccttaactaaacgcttgctaagggaagcatgagtggaaccttgagaaccccgctgtattgctcgggtcatgttgcatcacatatttcacattaaatagcactgtagctctgcttgcattcaggaaaaagacatgcatttattatagggccttatttgtgaaataagggatctaataacactttattgggggtcacggcttaatcaacattttatgccaaaaaaaaaagtaccgcaaacttgcaaaattacaagcacaaatagtacttaacaaagtagctcaacttgtacaataaaccacgatgtggggcgaagcaatgcaccattatcattagtgcttccagcatatctacgacatcatacacaataaatattacagcagagatggccatcttactgctttgtgacttgagagtagggcacggttggatcgctaactcatagtatccctccatttatctagattctagacaacatattgaaaatcaacaaaactatatgatatgcagaaaagtaacaaataaggcatcacctagtataagattacaacatttaggagaaccttgcgaagtcccagcagcaaatctttgtcctggcggactctgctgagtttttgacagaccaaccattgcctgaaaactcaaagcagccagtggtgttgtaccacaagacgacttttatcattttcccattcgtaaatgcagcaccgcagggcacagaagtcaggctccggcaagtatccgtccaccagcagaaaacccatcaagccaagtatctgtacacatttgggttgtctttatccctctccaagtaatcccttgtgataagatcctcaattcgcttctttattgccttgaagtcaggctgcaacggaaaagagaaaaaaacttgtgatggtgaagacatcaaaggagtttcgagcaaacaagtgctttacacatttcccggatgtcagattcattatatttaataattatagtatatttcagaataaggaaacaccaacaagacggtggtccaagtctaactgaacaaaacggtgctagcccatcaaggcaatcaacaaactctacatcaacaaagtacaattaatgagttgtaccaagaatttcgtaggaacaccatgaccttaaaagaacataatggattgagcccagcacttacataaatggagtgtgtttaaaatgctttcactaacaagtgcaagaactttcttgaagaaataactcgtaccttaaacatgcgtccaagctgctccacacattccatcacaagttgctgatgacccaatactttgcgactcttcataatacgcacaattgatgcatcaattgcgtatctgcgatccttatcaacatcttcaactactttcttcttctcatcaactggaggaagaggtatctaaaaacagcacaaacacaaagataatacattgaaccagagaaatcagaaaagtacaagcataattgattatgcaacatcagaagttcacgctttcatattataccactgaatatgggttcactttattgccgtcagaagatctcactgctgattttctttaccactctatacatattccttagtactccctccatccaaaattataaggcctatatttttttacatggtcttcaatgacatactttgaccattaatttataccatgttatgtttccaacaaatatgaatctagtgatataacatgcataatatgtagcatatatatgattagtatgattattagtaaaaaaaaattaccaagtttgattttccttaaaaagaggacgtcctataatttgggacggagggagtttttttttttcatttttctttaactttatccagaactgaggacgcaaaacccatcatccttagcatgcacccatattggctagcggccgcttactggcacctgccaatgatgcctttgccagcactgccacattctacatcttacattgccatagtttccattctcttttgttggtgtgcagcttgcttgtgtacaatttaatggctgagcatatggagactaattcaagcctgtgttggcttcttggttgggtagccaaccttgctgtctgatcggatgaggccacatgatcaaagataacaacaggtggtctcagcatcattgaattggttaaaagatgcaacggtgtgaccttggtaataaaatgaacccaaaaatttgaggggtataaaactaaaaatacaaacttccgaagctacataaccaatgttgccagaagtaaattatcaaacctataaaacaaataaattgaagatacctttaatcttcgcagcttgtcagtaaactttgagttgaactcgaagacatcatttggtgaaatagatctattatttggttctttgctaagaatcttgtattttgcacaagatagagaatggagcaatcgaacaacatcatcatctgagagatttaactgtgtcacaatctcagaatagctgagtctatcaactccattaaacagcagcagcaatgcagcctaccaacaaaagtgaaaggcatttcagaagtcataatacaagagggaagtggataatgtgatttcgaactacctgataagttgtaacaatgagctcaatagttttggcctcaaatttagcattaatattacaggttcccagtgaataaatccaggtaagtttcctgtgttttgttcttgtttggtaaaactccttgaaaacctctacacatttcacctaaaaataaaaaaataaaacaatcactgtgtgtagagcagaatgccaaccacaaattttatgcaaaataaggcaaactccggccttttaaaagcctcaaggcaaacttaccatttctgcaggtagatttatatcaaaagatttgtaacttggccaaaatcctgttgtgaggacagtaacagctaaggctattccaggattcaactctgagtgtgtgcttatgaactcttcaaatttagcctggtgatctcttgccacagtgagatcagtaaccatgccctccattttggaagtgaactgccctccacattgttgctttagcttggtaaggatgcttctctcatgttcatcattagcactcttgtcaaaaagcaatctccttgcaagcttctttctgcaaatttagccccagaggttaacaactgcatgaatccatgcgcaagaatttaaagacaaaaagaataagcatgcaagataataacagcttacctatagaactcagcaaacaagtccttgtcactaatgtaggcaagtaaccttacaacctggtaatcacccattcaagattaggacttactaatgacactaatagatcaaacataacaaattgatggttgtaccttctcaagggtatcttcaattgcttcatcactaagcttttcactaccgcctttctttaagatattgtcacagaaggtagctagtaattcagcacttgaactgccagaaacacctttgttgcaaaaaacttcaaaagcctccttaagtgcctgcataaacaggatacagaacatgatccaatattttgatatcattatgacaataatggtgtgagcatatcaaatagcaaaccttatggaagagagtgtgcccctgaaaacaatccgtaacataagctacatacttgtcatgaagctcaatgattttccggacaaaaacctaagataacaaacagtgagtaattgaaacaagtgtagagccacgaaagaatatataaaaagttattgaaacaaaacctgttcctgtaaaccaactatctccttcttctctggctgcagtataacaaagaaaaagcaaaattacttcaagtgcaaatccaaagtgtttggcggagtgcagagctatatgtacagatcagcagagtaaatatcactacatatgttaccagcaagagttgagtacaaagtctagctaattgattaaatatcctaaccaattgataccaccccaagtacacaataagatgaatgtactaagacaacattaatacaaacaaaagttaatatatagactgtgcaccttcttattactagcagcatcttcggcttgcttcactaaggcagtgccctcattagtaacatgctacacagaagcaacattccattacatcatcaaaatagatttaagaaataaaccactctcttctgaaaaacaaaatacctgcttaaatatttgagaaacaggttctaaaccacgagttattctggaaaagagcctgtacattctagagagatcatcaacctggagtaaaacagaagatgctatgttagcagacttcatttgttcctgataaactgttgagagacgtggagcttctccaagaaaccttgtcatcacgaagcaatgcatggcatccagaatgctccttctccaggagctgacttgcgtattgagttagcaactcatgttgcactttctgtgaaaatcatgtcataccggagaaagtgaattatacataatgctctatcaggaaaaaaatatattctgatttctgaacatacaattataaattgtatatggacatgtggtgtgtatgcacttagcaaacgtagattaaatatcaaaaagtatgctctaaaatgtggactgtggagtagaagcaacagcagacaattcactaacctccaacaacttctgttcactactggagtgcaaataatgagcaactcgctctttctcccttttcagacactcctctgcctatgaaacaaacaaccattagaaaaaatatatattatgcttacctacagatagggatgttcatgaaacattcttgagaatacctttaacatgtaatctggacaagagtcctcaagaatccaggtctgggcttttatagagtaatagtctgcagtatctttgagcaagaaatcttcaaaatcattttcgtagtagtccatgctagtcaagccaatctcaacaaatatatccagaacattctttaacagggccctatcaatttgttcaccctcacgttcttgatctatctgttcgagaaagtatgtctatcaccagccatacacaataaaaaaagatagcatcacaagatacaatgactcaccaaggatatcaccgcactttttacttttcctttgatctcttgatatacctgttacaataaataaaactgattaaattctagatatagtcatcaagcaaagaaatgcaagttgtattgcataaaaaacgagaatcatgagtaatcaagcaagtagtgttaccagatcccggaaacagctaagcccaacttcacttagttgtggtagggacctccttgaaataaagtaccgatcaagataatggaagaagcgtgatagccaccgaaccatcactttatggtttgaccaccgttttactagctctctcagcataaactcatcatgtttctctcttaatgaaggtaagacctacaaaatattgaaaccaaataaaggacttatcttccaaaagaagtgaacaatacaaaagaagatctgagataggcaacatgcaaatgatgaagagtaattaaacttcattgaatttgtagtgcatgataattagctagaactactaatgaactatatcataatggaagaggatcctctaactttgagttattgacaagtgggaccgctgagtagagggcgcacatgtcagtgaccacgttagagagaagtaagtcagaggatctcaatcctatcataataggatggaaaaagtctgttttcatctctcaacacttcacacgttttaatttcatccctcaactataaaaccatataaaagctgcccatcaactctcaaaaccaaacaaaacttatcccactgccctatcctatagtgattttgactcagcaggtggggccccactatctatttgggaaatggactggagaatggtgaatcttacacaatcagccatgacactctatgacaaatgggccccactatctatttgggtccaaactatcaccaaacatggtggaggggcaacttttacccggttttcagaattgtgggagtgggacatatttaaccctgttttgcaattgaggtacaaaactaaactgagtcaaaaattgagggacgagaaatagactttctccaaataggaagggaaacaggacagggagcaactaagctcaggacttcatatacagatcctcaatatggcggggaaccagggtcccgaccatagaatcgtatgcattgcaatatctagttatagaaaatgttgtatcaattatatgatcaaccatatatttgagatatacttaacttatcaacaacaaatagcaattagcatatttacatatttaatacaagtcgctgcacactaaatagcaatgaacacatacatcctagaaacatatgcatatctatatgccaggatgatactataaaggtcctgttgatgcaaagggaaaaggaaaccgatatttcaaatggaatggatgtagtatggacagatttcagcagcagcaactgttccagcatcactaaatcaagtaatcgatgcttagcaagcaagttatgacctcgaaaaacttacaccttgaaaaacaaagttaacatattagacaatagacgcggcacaattcagaacattgaaaagcattttttctggtgaattacatgaggacttgaggagcactttgctcagcattaaaatgatccaatgcaaaatgagtgagggagagtgtaatagatatgcatatggtcattatgtaaattctctcagatatgaaagatgtgacattaaaccataaacagttcaaatcacaatatcttcgaagtgtttatgacacatcatgcaatcaacaggtaacaaaatcaaagattagctttgaacaaaaatgaataaactgcattttgcaccaagtaaagcacggtaagcaccgtatttcactttgcatgaggtgtggcacacatttcgcaccagattacatcatcgaactaatatatatcccaagaaatgccataagccctaaatgaaactttgtcaaacatggtcaagattcatcaagtttcataaggcttcactcaaatttcatgaggttttcctccgatttcatgatgcaacctggtgcaaggtacatttactaaagaaattgatccttttgtggataataatttattgggaaagaagtaaaggtcaatacaagggactgagggaggataaagaaacaacagtaatatgcatccaggcatctagcattctacccacagtggttgctcaattgatcctacaatcacaattcatagttgaaaggaacatatgccttgcaaattcagtatttctcaaaacttctcatgtcgatttggcgcccaaacagaaagtgattacacaataaagtgtggttgcacagtacatgctgccatgatgaaaagggacaaaatcatgaaagaacaatcatttcaacataaagggattccaattcagaaaacaaaactcaatatgatgctattttgttgaacctttgaagctttcagtaaagcagggcatgagccttttcggtaaaaatgatgctagtctgctctgggtaacaacaaatccaaatgtgctgaagaaaatcatcccaaattgaataatcaatgctctctaagtaaatcgcgaagtttatataaatgcacaggcagtgaattggagtacttctgtagtgatgatgttagtagcctacttccagtaagatcaaatccaaatgcactgaataaaatcatgctaaattgagcaactcatgctctccaagcaaatcaaaaaaaattgtatagtggacacaggcagtacaaactaaagtacttttagcagacagcatctaagagcacagtgaccaaataataagcaaaacgcagtaagctatattcaaaaaaacatgaagtaatactgcagtacttagtgcggtcctccttagttaagaaagtacaattatctacctatcagaagaagccaacaaaaaatatctcgattgctccaaagtatcgacaatgatcaaaattagagcagcatctttcggcatcgaatctatcttctctatgtaaacagctataaactctcaatgcgtgtgctattagtccattggtacatacgacatgattggcataatttcaacgctatccctaacccatctgcgttagaaaattcaacacaggagcgcattaatcgagctagtcaatgaagggaggaacccaacagccgctcaccatggacgtgatgtactcctcgaaggactcgcggtacttctcgtagagctgctgcgagtagtcgtgcggcggcttctgcgtgcacatgttgtaaatcgtcctggagcacggagacgaaccctaaatcagatcagcgcgcggggaagaaaaaaatcgaataaatcgggagagaaatcgaggagggcgggcacacgcacgtgtagagcatcatgtagtcctcggagctgaactggggttcgggcttcccctcgaggatgttcttcagcttggtgatgcccttctgcatgaactcccacccctgctccagatcgatcgtcttccgctcgtgggtcgccatcgcggccggcgccgccgccgaatcgggggaagggcggcgcgagacccaccccgccgaggatccgccggggagccctagcttggggggggctcttcgctgtcgtgtacgtggggggaggggaacgaggtcggtgggttccctcccgccgcacgcgaggtggacggaggcgaagaggggaggaggaggggggatgacgaaatgggaaaagtggaggggcctttttcttttctttttcctttttttttttgctcccttttcgctgatagggtggggcgcggccgcgcggggtggaagttttgctgttggggcggtcgtgtgatcgtgtctcgtgtgggaaacacgccggggtaaaggaaccaggtcttttatatctgtaataattgattattctgaaattcaataattggtaaattagtggtgctattctatgaaaactggcccatttgtaaattggtaaaaaaattattattctcggaatatctgaaaagtttctttcgcatttacttaaaagttttaatcacctatctactctactcctctctaggcattaattgaccctttcagatataataatgtgagatgttgttataaataaagattttaattgaaataaatacaaggaataagtctacttcaccccccaagtattgaggttggtctacataacccccagaagtacgaaaccgggtattctgcccctctaaagtatcaaaaccagtttaaataacccctagagtggttttatatgtggttttgttgtgcacacgatggcatgtcaatggttctggccttgtaacatgctaagcattttattcacaagtgaaaacaggctgagaatgatgtaaattagtgttaatatatactccattcaacccataatatgaggcgcacaagcatttcaagattcaacttctataatatttgaccaataattagtataatatgaattaaattttatttgttgggaatattatcattggattggcatttgaatttacgttcatatgattataattttgttgctataataaaccttatagtatatgagaaattataagccaatcgtaccaattttgatcattttttatattataggataaagggagtaatatattttaggcttgccgatcaatgagtgaaaagcaatagttagatcaacttaggtttactagactaatctttgtgtcatgcaagccaataccgctgccacataatcatttacatggcaaaactaccaacaaaactactctagggggttatttgaaccggttttcatacttcaaggggtagaatattcggtttcgtactttaggggggttaagcagaccaaccccaaggggtgaagcagacttattcctaaatacaatgatgtaatcggatcttaaaaattatactctctttaaaagagcggaataactatatatcattcgacagaaatttggggatgaaatcttacatattttggaccattggatctgtgccaagatttatgcatcgacttcttttcctccaattccagtggactccccttcttccccggcgccagcgacacccgcaacttcagcagggagcatatcggttagggtttggagttaagggagggggaagaaggggtttctcggggcttaagagggaaggatgtggggcggtgggtggtgcacatggacaggcggccaagcgccggaaccgcgggattgacagcgggcggagggccggcgttggcggcgggggaaaacggattgcaaccttgggaaagagatggggggagggagaggaggccaactagggggagccttgcgggcgccgttgaccccttccggctagccagcaaggctaggcggcggggtagcggcgcggcgactgcacaggacgtggaggagcgctcacgctcacgcatgcgtgaaagcggtggtggcggtggatggattgagaagtggaggaaaagtatgtttgttatgttgcaagatttggggaggttttttctgtcaaaagacacctagacagtccctatagtatttgattggaaaaaatagagtgtgcactagttaaggaagaattatgcgtatccactattcagattttgcctacatgaatttgcgtgtgatgttggtaatggaccacagcccacaagcccttttataattcaactcagtgtttttcctttggaataagttcacattaactcccttaacaagtgacagaatctgattcgtatccctcaatcacaattctatatctcgatcccttaactattaaaaccggtgcaatttgactccctcgacggtttcactgatatggcgcacacgtggcaatgttgacctagtctccttcccacgtggtattgacgtggtgtttatatggcattaaaattaaaaaaatatatttggaacccatttatcattcacacaaaaaaaattgtggaacccacaaaaatgtggggcccacatgtcatcctatctctcctgcccttcttcctcctctctctcccttatttctctctctttctctcccctttacttcactcaatctgctggaggcaggcgggggatcgagtgccgccgccggcggcggcgggcggtggacggtagccggcgggtgggcgggtgttggagcagcgacgcaggcaggcgggcgagggccacagcggcggtggcgggcgggagggcgggcgctggagtagcgacgatggcaggctggcgagggccaaacaactctccatggccacccgctgccgcaccgctgcaaccaccggtgtggacctcgacatccgtgctgttcgatgccgccgccgctccaggtccaggggtgcctatcgccgccgttggtcgaccgcctcgcccttccgttccccttggattcacttgccgcggcggcgccatatcaaaggtagaagaggaggcgacgcggctagagaaacaacgcctggacaccatgcttcgctgcctggatcctctccttgccaccaccgagtgaagtaaaggggagagagataagggagagaggaggaggaagaagggcaggagaaagaggatgacatgtgggccctacattttgtgggtcccacaattttttttgcgtgaatgacgaatgggtcccgcatatttttttaatcttattgccacattaatgccacgtcaatgccacgtaggacgaatactaggtcaacaccgccacgtgtgggccacgtcagctaaaacgccctccaaaaccgccaagggagtcaaattgcaccgtttttaatagttgaggtgtcaagatatctggcattatggttgagggatacgaatctgattattcggtcacttgttaagggagtcaaagcgaacttattccttttcctttcctttgttttatacttttgggtaaagtttattttatgtccctcaactatggtggagattcattcgcggccttcagccataaaaccaactacaaaatttcctcttactatcaaaactattgcaaatcgagtcccacgatggtttcatctgatctggcgtccacgtggtatgttaacttggttttcgtcatatgtggatgcttatgtggcagtagaagaaaaactttaaaaacttaatgagatccatatgttagtcagaaaaaaaataatatatacttcacacatgcatgcataaaagcgaatacaataagatgatatagctggctataaaagtttgcacatcagatttgtgcttaagtggagtagagagaagaaaagcgagatatatggtataataattaagttgtgtgagagaaagagatgggccatactttaatagtgttgtatatatctataactaactattgtatgtatggctatttaattagcattagattatgtgttatttttatagctagcagttggctatactattaaccttgaaagaaataacaatctagggtaacattgacaaatgcgacgatgtgtgttaatcttggcactcaaaatggtgcgaaaaaatacatatatatgcacatctagctgaggttaccggattcctatttatatgtgataaaaaaaccttatcttctaactactggtctcctcaaccttgtgccgttgtgcgcataccacgtatatattatctgtaacactcgccgtcaatccaaactatcaatgttgagattgctcttgaactcttcaaacgggcgcatagccagtggtttggtgaatccatctgctatttgatccttggaagaaatatatcctatctcaaataattttctagaaactcttctcgaacaaagtgataatacaagcatgaaacacatgatttgctgatagatacttaactccaatgttatcacaccacatgattcgcgaccttaggtgcatctataccaatttcacataacagagtcggcaaccacataatcttagctgtttcatcagctaacgccttgtattctgctgcagtgcttgacctggacacagttgcttgcttctttgcactccatgacactttagagcctagaaagatagcaaaacctctagttgaacgcctgtcatccaagcatcatgcccaagtccgcatcagaaaaaccattgaccaacaaagaattgacaaaccttgttaactgagaaagaaatacctggtcttgtcaaatttaagtactggagtgctccaacaatacttcagtattgcatcttttggcccaaatagattcatgagttgacaattttatcgcatctaagcaagggagtacttactggtttgcaatcgtgcattcctattcgttgttaaatatcatatgcacacttggcttgaatcaacattatttcatcatttaccttcacctctatactaagaacgtagtgcaagtctccaagtccttcaaggcaaactccttgtaagattctgcaacattaattttttttgaggtgaaagcggcaagagtattgccgaatatattagagagaggagagttttacataacgttcaaaagagcaatattacaggcataaagtgagcgcctcgggctattaagcatataggtaggtataagactaggacgacaagctaaatcagggcagttggaaaacgaaaacgctttcttgtatgtcttcattgatctgttgggcagctcgacttgaattcggttcctgatgtttgaagatttttgcattcctttgcagccatatgtgctaccgtgtcttgattaggatttcgactcggtgtcgtgattctattctactggttccctgtgctaaatccatcatccagtgtgccaaggaggtttggtttattgtcccctgtatgccctgtgttgccgctacaagttccaagttcttctagtgaaatcacattccctgaagaggtgttcagtgtcttcaaaagcgcttctacacagagggcaaatccaatcgcattcccaatgtcggattagaaggttttcagctgttagggctcttttgtgtagcaccagccatccaaaacaatctttgctttggtagtgcctgtgctttccagtttgctctgagaatggggtcttgttggcaagttatgaattggaacttgtaagaacttttgtgctaagtagatacctgtgctggttctcttccagattatagaatcttcattctgtattgatagttgaatgtttgatagaagattgccaagttgcaccagctcgtgtatggcttccccattgtcaatctgtctaagcgaaaacacccagtggttatcgtcaagttcggttgctagattcttgttttttcctgttgccaactgaaagaggtttggggcaatttctttggggcacattccttggagccaattatccttctagaaaagaattttttgcccatttccaatgacaatttgggtgcaggcttggaagagttgcaaatcttttgcattgcatggtaattccatgtcattccatggtctgttacaatcatgccatcttatccataaccatctcacttgaagggctgatgaaaatctttccaagtcaaggattcccaaccctcctagttccctcggcatgcagacgatctgccagtttacaaggcttttttccggctttacattctctgcaacattaatgaagttgcacttgctgtagatctagccactattatattgccaacataaataagcacaaaaattgtgatgtctcctttagtataaaagaataaggatgtatctgctccttgatggtttaaacccaagctcatgaaattttatacttaactaggctcgtggtgcttgtttcaagccatacagagccttgtctaacttacatatataagttttgagttaacaccaagcacttatacaaactcaaaaccacaactctctcgcatacacacacacgaaaatcatggatttggggagaaaccactgagtgtccgtctcgcacaggaacatggtagaacgactcatcttggatgcttcttgactcacccacacatttgcatcgaacccgttagctcgatcggacggctacacaattgctagtagatcggacaaccatggaaggcgtcattgcttaataaagaacgagaacgctctctgttaagatttcacaatttaatatggttataattgtaatctcacatatccttctccttattttctgttgtattccgtctaaggcatagttcatattcttattgcccacattgcaacttatcaggaatggctttggtatgattctgtaaaaaaaaaaaaggcaggccgtggatttcctccaaactcaatcgaagcagacgaacgatccaaactgcctccgcacattccagaaacagaagggccccacacgacccccgtttcctcccctatttatttccgccgtctcccccgcgagatcgattgatcgaatcgaagaaaccccaaaccccaccaaaaccctcgccccacgcctccttcgtccacaagcctcgcgcgcggcggcggtggcggcggcggcggcgtaggcgtgatgaatatgtcgccgcgcattccggtggtggacctcgaggacgggtggcgcgacgtgctcgccggcgtcgccaagctcaagtgcatcctcgatggctccaacgtcgtgcacttcgtccccgacgagtacatgcacctctacacgtacgttccccaatctgctcgctcgtcttctccgcttgggttctctcggattcgcgggggtttttttgttcgttcgttgttggttccaatctgatttgatctgatctggtacggctgatccgtggcaggacggtttacaacatgtgcacgcagaagccgccgaacgactactcgcaggtgctctacgatcgctacaagcaggccctggacgatcacatcgaatccgtcgtacgtgtgctgctcttaatctcccatcctttttgttttgggtgttttttctgcgacccggctgctcgatttcgccgctgcacgtttaggttcttagtgcgatgatgaattattgccgaagggggttttcggtttattctgatttatcagcgattttttgggcgaatttcgcaccaattaggggttgccgctggtccgtacagtttaacatgttgcacttgtaacccgtgatttggaccctcggttgaggacttgaggcattatgtggacgattcttatttcttaactgtctgttattgtttttaaactttttttatcgatccattgttattccgcttttttttttattgttgcttagttgtgcccgtgcgcaggggctgatcagtccctcctgcacccacaagacccatggatatccttaggaacacccccttcaattttttcaccataaattcaattttttcaccataaatgataaactaaaggtccctaaatggctggaggttaaagaaactgtgtaattaagcccccccaaatttttgttcctggatccgcccctgcccgtgcgatgcaaccaaaaaaaccccgatagtgaaaatctcttcatagtgcgtaaatggctgacggaaatcatggaaagtaaaattgaacgtgatcttgtaatggaaacataataggacttgtgtttgtgcagcctttgaaaaagccaagacgtttcaacgtagtagcaattacatagacggctgatggcattttgacgcttatttaatttggttcatttttttttctgctcctgtgttgcaacctgcatgttattggtgtcctcctgtgtatttcctgaatgagttcttggagatggatatgtatgccttatttatgataattgtttgcagtgaagcatgttaattagattgattctgtactttcagtgcgaggcacatttgttgggatcgatgattgcatcttaagaatgatagtatgagatcgttaatgtgcctttttcctaatttatatctttgagcttgaaggtgttgccctccttgaatgagaagcatggcgtgttccttctgagggaaatagtgcagaggtgggagaaacacaagctaatggtaaggtggctgaggaggttctttgactacctcgatcgttactatgttacacggaggtcccttgattcactcaaagatctgggctggagtagcttccgggatttggtgagcctcagttagttttcagagaatctttagacgagtataacttagaagcactacagttgcttattattactccatgatttgacaaatacctttgatgattcttctgttgtgataggttttcgataagctcaaaagtactgtggcaacaattatgattggcatggtgagcttgccctccgcttcttaatctcgtgcgcattctacagagctaacttgatcactactaatttcttttatttaatagattgatgatgagagggaaggcaatctaatagaccgtccactcctgaagaatgcccttgatatctatgttgaaattggggatagtcaactgaattattacagtgatgattttgaacaatcatttctcaacggaacaacagattactattctaagaaggcacaaacatggattcttgagaattcttgccctgaatacatgctcaaggtatttgtggagttctgaaatttacattgctgctaagtttaacgataccctcttactagttatgtgcttaataggctgaggaatgcttacaaaaagagaaagaccgggttgcaaattacttgcattctactacagaaccaaagctatttgcggtttgtctcagttatatgtttgatgtttcttggcagcttttcaatgatgcatgtaaaacatgcaatgactttctgtgcttctgaaattgtacccttcaacctaaatgctttcaggctgcactcttcgagttgatagataggcgtgcagaagaaattctgaacaaggagaactccggatgcaaagtgttgctttgtgatgaaaaggttgcattacactgaaaaaaaaaactctggtttgtgaagttgcaaaatgaggaaatcgctggcaatcaatttactgactattttttgctttctgactgtagaccgaggatctagcaaggatgtttaggctcttctctaggataactgacgggctgcttccagtatcgaaaatatttaaggaggtattgaattgtctcattatgctccacatgctgcactgctgaaatattccaatctccttgaaatgttacttctgtgcagcatgtcattgctgagggtatgtctctgctgaaacatgcaacagatgctgccaacagcagaaaggtgatgattctatgtctttgctctgttccttggcccagtggatttgctctgttccttcatattgtgctttgcaagtttccacatccttgggatgacattcttaatttatatttcatttgtttgtcaaatcagtctcctgtgggtgcataatggcatctaacatcttaattgtgctgactagcctgcaattctataatagcaagagaataagggcatgtttggtatagctccaactcctaaatttaactctagaaattgagtatggagtggagttgtggagctgcctaaacccaactccatctctttagtttattttgtgagagtactcctgcgagctctactctctttctgagtggagctgaaaccgtttggttgagctccagctctaggaaaggtggagctggagttggagctgtgccaaacataccctaattattgctaaatagatacatgcaatagataataatgtgttctaattattcttgaatctgattttcgaatggactatttgttcctagatctcaccctgctgtgaatctttactatgtggtcgatgtagtctgtccaacaaactggttacaataagacccacagaagcacatatggattcgagaaagggatccacgaatattgggtagcccgtagccgttgttaaaccaggtcgagtactttatgaaaagggcggagtatctgaaactgtaaggaagcttattacaactgacagctttacaagtcaattgctattagaaggatttactagttaactggttttcatgctttctactgcaatatttttttcgtgttatttttttcagaagtgaatgcatcgcaaacgttggaattgtattgtgtacaacttgtgctaatcagattacttatattattgtattctgcacgtatacaggatgagaagaagggggtggtggtgggattgccggagcaggtctgaattagacatacatttgcttttaactaaggttgtactactgcttttttagtcttaatgggttaccaccgattttaggattttgtgaggagtgtcatagagctccatgacaaatatatggcatatgtcaccaactgtttccagagcaactcagtatttcacaaggtttgctacttgccaagttaccgaccctaattttgtcttgcagcatttggttgctcaaaccttgtataatgctgattgacctactttatttacttgtctcaggcacttaaggaggcctttgaagttatttgcaacaaagatgttgttggttgcagtagtgctgaactgtttgcggcatactgtgatagtatcttaaaaagaggtggaagtgaaaagctaagtgatgaagctatagatgaaagtcttgagaaggtatatagttattgcaatactgtttgtacaaactagttacgaaatctcttgttcaacagtgtatttaatttgtatcaggttgtcaagcttctaacatatctcagcgacaaggacctctttgtagagtttcataggttcgtggttctctattttcttgatgacaattttattatgttcccaaagtaaataggaaactcacattttggaagcctttgttttttctggaataatctattacaggaagaaacttggaaggagattgctgtttgataagaatacaaatgacgaacatgagagaatcctactctccaagctgaagcaattcttcgggggacagtttacatcaaaaatggaggggatgctcaaagatattacattggcaaaagaacatcagtcaagttttgaggagtacgtaagcaacaatccagagtcaaatcctctgatagacttgaatgtgactgtcttgacaacaggatactggccaacatacaagaactcagatataaatcttccattggagatggtacgtctatggatttcctgtttaatttgcactaaatttttgatgaactatcacagattaactttataaccgtccgattcacagttgtttgagacattctcattttcctatttgagtttgtcttgtaactcatcaatggccacgaaatgcgacctgaatattgcagtgctaagccataatgccatctattgttctggaactccatgttttcaggttaaatgcgtggaggttttcaaggaatattatcggtccgacaagcaacacagaaagcttacctggatcttttccttgggaaactgcgtcgtcattggaaattttgatgctaaacctgttgagttcgttctcaacacttatcaggttatttcgaaatctttgtacaaagtgaatcgctcacacacttaatgcatggaacaaacttctcacttaattctctcttaccttttccctctttggtcaggctgcattgttgctgctattcaatgaagctgataaactgagttactctgatattgtgtcacaattaaaactgtctgatgatgatgccgtgcgtttgcttcattcgctttcttgtgcaaagtataagattctcaacaaagagcctagcaacagagtgatttctccagaggacgagtttgagttcaattccaaatttaccgataggatgcgaaggattaaggtgccatttctaactatttacccattcccccctggtttttcgagctaactaaacgtaattttttttttgtgtgcaggtaccacttcctcaaatcgatgagaagaaaaaggttgtcgatgatgtcaacaaggacaggaggttcgcaattgatgcatctcttgtgcgcatcatgaaaagccgcaaagttctgggccatcagcaacttgtagcggaatgcgtggagcagctcagccgcatgtttaaggtacacggcagaacacatacatgtcgattctgctaacctactttttgaacattctgccaatttgtgtaaagctttcagtcatctgtggtgagaagggagagaaaatccatgttttcttaagacttgtgttgtcagatattgacaatggggatttgttctcactcttgtgcagcctgacatcaagatcatcaagaggaggatcgaggatcttatcagcagggagtacttggagcgtgattcggagaatgcccagacctacaaatacttggcttgatgattggtcctgaggcgacttgctgactgtttgtctgtttactcaccctctggattcctagggcagtgccctgatgttgccaccagtagtctctgtttacttacatccacgcatcagggttgtacactcttttcctgctcaagtgaatgattagaggaaaaacagattaggagaagcagctatggctcggctgtgactgtgaaccacatttacatgtttagctttgacgccctttgctctaccttttgagtttctataatttttgttgattactttcttcttgccgatcattgtgttaaatcgcaactcatcatggagaaagaactttattgcagagtcactggcactttacctgcctagtgcctagcattagcatatgtggtttattaagctcgttattattaaatctaaatacatgtcgatgacacgccctgcattaattgttctgcaggcctaataaacgacctagtactgtataaaataaaataaaaaatgttgggggtaataagcagtttatatctaaactagacgtagtagatcatgccgacttcgataaggctgatgtgcgggatgttgagcacgaggccggggcctctgcaattcttgcggaggaaagcgtaggcgacgttgacggcgaacttcttgaacaccgacgagctcttcctcgccttgatgtacgagtggcccatgatgtaggcgacgccggcgtgcttggcctccaccagcgcgctcagctcctccttcaccctggggtccgtgtgctggttcgccacctcgaaccgcacgcgccgccggctcgcgaaccccggcgactccgcctcgtgcatcgtgtgcatcgagtggatgagcgactccggcttggcggccgcggcggcgcgcgccaccacgctctcctcctcgccgggctcccgcatgaggagccccgtcctggcaaggtcgctgggccgcgggaccacggccatgcggccctccacctccacggaggcgacgaccccatcgtcgctgatgctgcagcgctggtcgaagtcggcctccatctgcacgaactcggcgatccgcagcacgaggtcgttctcgaagtcggtgtcctcggcgagcacgtccttgtagccgtgccgaacgacgcagcggtacatgcggaactcccgcgggccgatgcggccgacgaggtggcgctcctcgtcgcggacgtgcggcaccggcacggccttgacgcagatgaagacgagcacctggtggaacgccggcaggttggtgacgaagtgcgagaagatggccggcacgccggtggccagctcggagtagatgatgccgatccccgggacgcgcacgatgcccaggctggggccgagcgcgtggatccacctgagcgacaccttgttctgcacgtcgaactggtgcttccgccgcgtgccgtagtgccacacgtacatgacggcgacgaacaccagcgacagcaccagcggcagccacccgccctggggcaccttcatcagcgccgccgacaggtacaccgcctcgacgacgccgaacgccaccaggaagagcgccgccaccaggcagctgtactgccagacgaagacgatgacgagcgccatgagcagcgtggtgaccagcatcacccccgcgcacgccatcccgtaggcgttgccgatgagggtggtgtcgcggagccccatggtgacggcgatgcacagcagcatcaggatccagttgatctccgggctgtagatctgcccgtggatccgccgcgacgtgtgcacgatcttcacgcgcgggaagcagcccagcgccgtgcactgccgcacgatggagaaggtcgccgatatcaccgcctggctgcccacgatcgccgccagcgtcgcgatcaccagcaccggccagaagatgcccgctgcaaaatgcgacatttcattcggatcgatgtcgtcgtatcacgattcatgtcacctcaccaccagtgattagcagtagattagaggagtactccacttacttggaatggactcgaagaatacgaagtggatgtcgcagtggggtgatttggacaggaaggccgcctgccccatgtactgcagcaccaagcacgggtagatgagccccacgaacgcaacctgtcaacaagtgtacgtacgtacgtgtcaaacaaatgtcaagatatttaacctgctcttaaaatcaatctgcattatattaaacgagacgcagtactgcactatcagtgctctgacagcaagcataaacagacacatatacccttatggatgcagctgtgaagtggccaagatccgcatacatggcttcggtccctgcacatacatacatatatatattattataaaatatgtagttgatgagtcgcagtgcagcgagcaaaataaggtttgtttgcctgtcatggagaggagaattcccccgagggagatccagccgtccttgccggtgtgctggaagaacctgacgaggtagtaaggggagagggcgcgcagcaccctggggttccacaccacgatgttgtagacgccgagcgccccgaggaggaggagccagacgatgaccaccggcgcgaacaggaacgccaccctgtgcgtgccccagtgctgcaccatgaacaggcacaccagcaccgtgcacgacaggatctccacctccccgctcgtcagcgcggtcgagtgcacttgcagcccagagaaggacgacagcactgcccagccagcagccaggacaaaagatcgatcatcgatcacatcagcaacccaaaccacacaccaagtagtagtagtattacggtacgcgcgctcaccggacatgggcggcgtgaggacgccgtcgccgatgacgagggaggcgccgaagaggacggtgacgaggaggaaggtgcgggacttgcggtggttctcgaggaaccgacggagcgcggtgaggatgggggtctcctggggggcgtagccggggcggtagtaggaggtgagctcctcgtcggcggcctcctggtttggcatgaggctgaacttggcgtggcgcaccagcagcgagtagagcgcgaacgtgccgccctcgccgttgtcgtcggcggcgagcacgatgaagacgtacttgaggagcgggatgagggtcagcgtccagaacactagggagaagacgccgaacacgatctcctcgtcctggaaccgccggagcgacccgatgatgaaggtgctcttgtacacgtacagcggcgacgtgctcaggtcgccgtacaccacgccgcagctctggtacgccagcagcagcacatgcctgtagtagctcctccagtgaccctgtacccgtaattaattctactgattatttattattttatcagattattactttcattcttcgtattatggccctgtttagttcccaaaaactttttcctaaaaacatcgcattgaatcttttgacacatacatggagaattaagtatagataaatcaaaaaactaattgcacagttagagggaaatcgcgagacgaatcttttgagtctaattagtccatgattagccataaatgctacagtaacccacatgtgctaatgacggattaattaggctcaaaagattcgtctcgcggtttccaggtgagttatgaaattagttttttttattcgtgtccgaaaaccccttccgacatccggtcaaacgtctgatgtgacacccaaaaattttcttttcgcgaactaaacaggcccaatatatggagaaatacgtgcttatttaatttagggaagattgcaaaaatcaccctaaatatatcatcctaagttcgagatttcttcatgtaaaacgacttgttacaaattccatgtcttaactcaccttgtttcgatatatattcctcccaattaccattgtttgcgcgttttttctcctcgtgtcttacttggtttagtgtattttttgatggacatgacccaaccacatcttttgcacaatgtaagggcatgtttggttcaatactaaacttaaccataccaaatacttggcattactcaaaaactgtcatccatttgttttatatccaaataatttgtcatgccaaattatttggtttttggcatacttcataggtagcaaataaaacacataccaaaacattagcatccctttgtggtaacaaaccaaattcaaagcctagccaaaaacatttggtaacaatccaagcactttgcagaaaaataaataaataaaaaaaatgaggcaatgatcaaatcttgccatgccaaataaattggcaaggccaacaatggccaagaaccaaacatgtcctaagtttttttttttaatctggttcggctgaggagagacaaaatcggtaggaaaaaaaagctgtccattttccttccatcattggtcgcactaaagtgatacacattgcaaaattatttaactagcgtcagtattcttcatggattggtaatactgtatactactgatgccctctgtgctcacactgtctgactcggtcacaagctatttttaggacggtgttagtaactagtggtgtaaaataacaatgagctactcctactgcatgccactcttaatgtaaatgttctccttgcatgatccactcttggaaaaaaaaacaaacaaatcactctgttattgtcaaataattcagtcaagaataacattttagttgggatcgttcttcctgattaggtactagtaatatattcttccataagtatggtcagagataagatgcagggtacattaatcaacaccatttcctactacacctcagtaacataaaggaggaaataaagagaaaaggaaaaaaaagggtcagattccgttgatggaccagcaccgatgttggtttaggtaacagaaatgcaaaaaattgcaaacggtaggggtgcacatcatgtccgtatgcttacacaatatcacaaattcatcacaagaggcaaataaataaattatttggaaaatgcgatttcaatgcacgccagagcaaggggaaatgtatagctcaccgggttcccgtttgcggcacctgcaccggtgacatctgccggcgagagaccgctttcgcagtcggccaccggcattttattttattggaagatgaaaggagagggaggaagatggccgggatggagtcaccaattgcggacatgcgcactctctctcactgcgtgcttcttctccgattcgccgtcccctaaatctgttgttttatttgggttaatgagcactcgtcggtattcttggggttatgtggatgagtttgtattcatcgaggcaaatgtagaggggagagagagagagagggggagagcccccggtttataatgaggtgttaacagttgtggccatggagtcatgcaaagatgaagcattagaggagtagtagcgtatagtactctaattttgtagctgtgccgctttttaagatattttactttccttggaaaagtactggtacgtattaaaatttacactaaaaaatttgacaccacgaaataccaaatatctagaggtaccaaatttatattatcatcttcgggtacatttttaagaacagtaaaattactcatagtccatgctgtttgtactttttattcgggattgttattaatacttaatagtgtcaaagaccgttacaagtaataacaatgtgttgaggcgttgagcgaatccatttagtttttaacttaaaaatagcacttcctccgtttatgtaagtttggccaggctttaattttttctaagttaacaattcttataacaccaaatttcattaaatccaacagtcaatatattttgatggaatatttgttcggtgttgttcttttataaacttagtcttaagaagtttgacttaaaaaaagttaaactatattatagagtgcattatttatttagggaaaagtccgaattacacccctcaactattggatgagtatgaattatccccctaaacctaaaaaccagacatctttaacccacaactatcaatatggatgaaaaaccccctaacttgactcagtgcgaatttggatcatacgtggcggtccagtcagcttaaaaaatggtgggacccacctgccagctcttcctcttcttcctcgttgccactgcttaaaaaaagctatgtcgagggtgaggcggtgacaagcgacacgggaggagccagtgaaggaagctggggggcagggctggcgcatctcgccgcaccagtagaggggggcgactgacatcgacaccgggctcagatatgatgattttgatttgggggagtcggtcgagaatttgagagcaatggcggagaaagtgagccaggggagcacggtaggggaatgatggcgtcctccggggtcgccgtcaccatgaccaccgtgcccatgacggaggagcacatcgatgccttcactcaccaggtccgcctctgcttggtccccctcaaggatgtggctgggccaccgctgacgtcgccctggcaccgaggcggaaggcgatgacgaccaccactggggaggagcgcgtggcggtggcggccgtcgaggaggagtgcaactgggggcggtgggactcgagtggcggaggtggaggagctcgagcgacactagctggaggcgatggccggaaagggaatcggcggcgatgtacaggtcggtgatgttcatagggagctccacgcagcaggccggcatgagctttggcggcgagcacgcacaacagcagccgtgcccccccaccgccgttcttggctccccctccgccactccgagctggctccatcgtccccgcctgttgccgctgcttcgaggtgccttccccgtccctgcccgctaccactgtcctcagctccccttccgccactgagctgcctccctcgatgatgcccgccatcgccatccttgactcctcctcggccggttgctcggtgatagagagagggggagtcgagaagagaaagagaaagagaaagagagaggtgaggggaaagagagagaggatgagactaaaaggtgggacctatcgatttaaagaaaaagaattgctgactggattgccacgtaggacaaaaactgctccgagtttgagttagggggtaattcgtccggtattgatagttaagggtgaaagatatctggttttcgggtttagggggggggtaattcgtactcacccaatagttaggggtgtaattcagacttttcccatttatttatcggctccatgttgacaggctaggtttgatcaaatgatgtcaaatcatttcaacgtaccagaacactgcatataaggggcagatgactcggtatggcgagctgtggcgctcgccataccttgatctgctagtgagacccccccggggcgcgtcctccttcctaggacgccgcgccgcaccggcacgatcgagagagggagagtgagaacatggcgcgatcgagagagagagagagagagagagagagagaatgggcctaattagttggcctggttcatcctttatgtgcgaaggcttgacgagttcaaagtttgtcatgatttagcaagcctagcaaaaaagatggctgaacttgagagacacattgtatttccattggtatattgtctcattgagttagtattgcttttactggtggcgactagatcagttgagagggccttctaggtaatgaagattatcaagacggagctacgcaacaagatgtccgatggttggctcaatgacttgatggtgtgctacatcgattcaaaggacttgattttcaaaaaaaatcaaaaaaagtatttcagaaaaagaaaagtaggcaaatgcaattgcctaaatctcctagacctctaagcaattaaataaatgtttggtataccttcacattttattccaatcattgctctttatgttatcaatcttaagtatatagtatactaattaatctttgcaatttgttttgcagtttctatatgtctatctatcctcactagtctctagttcttatatgtgatgcattgctgacagctggaatcttagaggtattatttacaattttggcaaatggatgatgaatgtgaacctatggctagtgcttgttgccatgtttgagattgcgtcatgatcggataatgttgcgtcatataatatagtgcattaagattgtttttttttctttgtgctagtccatgggccacaccggcgacaccgtcacacctaattttttttcccgtcctccaccactgtgcatatataaagataagcagcattattaatttgaaggtgcctctaggaaaaaaacagaacaacaattttctacggcgagtgcccgagcggaacgccacaccacacaaagataagcatgcgagatttaggcacaatgctattcttagtgccacaatgcagcaccgacacctgccaagcctaaccgtgaatcccttcttaactcccgccatggcgctcctctccaactcgaggaggacacgcacgttgccaccacaggctacgcaaaattctctcccttcctcctccaccacctccactccgacgatcctcctcctgatcctgtgccggccggcgatggcgtaccggttgctggagctcacgctggtctccgcgagcgacctcaagaaggtcactctcttctcgcgcatgcatgtctacgccgtcgcctccatctccgggagcaacgtccccatgcccatgcacggcacccacgccgaccgcaacggcggcagcaaccccgcgtggaacaccgtgctccacttccccgtccccgcccgcttcgacacccgcggcctcgccctccacgtccagctccgcgcccggcgctccttcggcggccaccgcgacgtcggggacgtgttcgtgcccctcgacgacctcctcgccggcgcgcacgacggcggcgagccgaggccggctagctaccaggtgcgccgccccatgtccgcccgcgcgcacggcacgctctacttctgctacaggttcaccgacgtcaagcatcccgccctcgaagccatcgaggccgcgaccgcgaccgcgacgagcagcgccaccaaacaagggcagtacgtgcccatgtacgcgcaggactctgatgagaaggcgacggagaagagcgtgtcgtcgccggtcaccgcctacccgccgccgtcgaacgccgtggtagcgcacccgccggtcgtgccgtacggcgcgccgtacggaggagggtacccaccgcatcagcagcagtacggttacgcgggtcagccgccgtacgcgtacaacgccggcccaccgccgccggcgacgtacagctacgcggcggcacaacagccggcggcgaggaaaggtggacgaatgggcatgggcctcggactcgggctcctcggcggcgcggtcggcgggatgatgctcggggaaatggtcggcgacatggaggctgacgccgcctacgacgccgggttcaacgacgcactggaattttaggtcttttgtcgtgttttcctgtgtacatgggcaatgcacctgtataaatttgtcacgtgcataagaaatttcacgatccaacaatgggaaacgcgatgtcaggccacaagggtaagcagatcctaaatcaacgctatatatatatatatatcatccagtacgtacaaccacacatctctactccttaaaaaattcaaattggtgttggtgatagtgaagccaaagcagatataggatctaacatacaaagcagacatgcgatccaacatacaaaccatcgacacgtttggagcgacaaaaataaaagaagacgtacacgcgatccggaacaaaaaaaaaaatcgtaaaaaacagaaacgccccgcaacctgcgccccctcctccgcgcgcctccatcgccgccccgcaccctcccatcgcctctcctccgcgctgcccctccaccagcaggcggcgcggtccatcgccgccccgcgccctcccctcgcct

SEQ ID NO: 60223 - DNA, 900 bp, Oryza sativa
gggaggactttgggccagacttggcccaaaggaggaaggagggttatttttaggtttttctttttattaaactttgataattgtttttgttgcttaataattatttccggtgctctgaaaattcaagtaaaatttgagggctcattttagaccaaggagaatttaacaaaaattctccgggccacattcgaatttttcttgtacgtattttagtgtttgccaatttcttttcgaattttaattaattctattattccttttagagaatgatttttaatttcgggatgaatttatcaggacgtgacaaagttccgattcgtccctccatcggctgtccttccagatgcatgcaccatattaatagggaaatgattaccatctaccttcatcggcttctttgaatcatcgaatttgatatttcccccttcaatggccacctggatctgctgtctgaaaactttgcagtcattagtagaatgagattcagaattatgccatttgcagtacctccttttgccaagttccttagccgatggaattatatgaccagcaggaagttgaatttgtttctcccgaagcaataaattgaaaattttgtcaaccttggtgatatcaaagtcgaatctttcttcttttccagaactcctcacccacggtgtcacgaccggaaatcacccaacaggcgttcctgacgtgcgtgtattattccttgtcccaggaggcaaggtacaccaaaagttgatacaattcagagtttacaagcggaagcgaaaatataaacactacacgggcagcgaaagcccagcacacaaagacaacgaaaaacagcggaagactagggcgacgaccacaggcgcttgacgggaggcacgagcttaacaccaagcccttaattttcaa

SEQ ID NO: 60224 - DNA, 892 bp, Oryza sativa
gtatagttctagattcgtgtttaccaaatagctttgagcaactaaatatctttaaatgctgtttactgcaaccctaaccctttatattatagctcctttgtactcccttgcatttattctgcacttgtgggtgtgtcttgttgagtacggtggttgtactcagtcttgctcaatttttcccaaacccagaagaggagttcctagaagatgaaggctttggtgtctagctcatgcctgccgtcgagtgcctgtggtcgtcgccctagtcttccgctgtttctcgtttgtctttgtgtgtgctgggccttcgctgcccatgtaataagttatctatttacgcttccgcttgttaaactctgaattgtatcaacttttggtgtaccttgcctcctgggacaaggattaatgcacgcacgtaaggaacgcccgttgggttatttccggtcgtgacaagttggtatcagagcccccttgaccctaggacgagccgtagatcccaagccttagcaagtattttcgaaataaaaatcctttgttacttgtgaaaaccctctagtctctctctgtcctgctgcttcatttatcgtcaaaatctgatcttttaaatgttgcttttctttttgtttttgtttgtagatggccggcagtgtcacccgtcgtggtttggacatgactggtttcgtcttggagttgcggggcatgtgcgttgtcctggggtatccacatggagtggactaccagggcaggccgctcccggagtaggagggtgacgatgcagagcccctcgctgcttgggaggttactgcagtgatcctcgctggctctcccgagcggacttcgctggcagtcaccacgggtggagattccttccccgccgcttgccagagcgccg

SEQ ID NO: 60225 - DNA, 1095 bp, Oryza sativa
ttctttccccccccttttccttcttgggccggctcggcccaactccctccccctctctcctctcccccgcggcccatcggctccctccccgcgcgcgcgccgctgacgggcgggcccgcccgccaccctcgctgacgggtggggcccacctgtcatctccctcctcgcgccgcgcccgccgcccgcccgtgccctagcgccgccgccgccgccgaatccgccgcatcccgccctccccgcgcgcaataaagagggggaaatcactccccgtgattccctctcccgtttcccccgttttcccctctctctctccctcggattcgtccgaatcgcgcccgcaatcctcgccggcgtcatcaatggcggccgagatctccgcggccggtttctttcttccccggccaccctctctccctcccgaccctatataatcgtcccccgagccccgctcttccgtttccgccgctcgccgctcgctctttccgtcggattcgtgctcgcgccgtgctcctctctctccgccgtcgccgccgacctccggttcgccgccgccgtcgctccgggcttcctcctgactcggcgtcacctccatcggcttcgccgcgttgtcgccgaccccgtccgcccctccgcttcgcccgccgaacgccggagcaccgtcgtcctcgccgtcccgaaccgcgccgccgccttcctccgcttcggccgccgtttccgtcgtcgttgtagtcccggggtgagccgaggaccgccctttcgcttccctctcctctccgctctctcgggcgccgctccgccgcgccggtggtcgccggcggtgaccatcggggcgcgggcgcgccgctcccgtcggccgtgccggcgaggccgccttcgggcgcgccccgcggctgccagccgcgtgctcccggtccaccgtggaccgagaggctgacgcgtgggccccactcccgtggacccagtccgcgcgtcctctctcccggctgacgcaataaatgagtttttaattaaaatttaaatgaagaaattcgcaaatatccctttaaagagcatataaactttaaatggaactatcttggccatttgaactcggaa

SEQ ID NO: 60226 - DNA, 1421 bp, Oryza sativa
ccgtggggtcttcaacatatgccaatatcggtattaattgccaaaagtacccgccccgattcacaaagtaagtttttgcccgaaacgcaccccaatacactccaaatatgtccaaaatccaagttttggcgctttttaacttttttcattcgggtcaaaaacatcgcacccgtggggctcaataatatgccaatattggcattaatggcaaaaggtccccgcgcgattcacgaagtgagtttttgccacgaacgcacccaatacactccaatatgtccaaaattcatgttttggtgctttttgaactttttcattccggtcaaaaacatcgcacccgtggaggctcaatatatgccaatattggtattaattgacaaaagtacccgcgcgaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacgaagtgagtttttgccacgaacgcacccgatacacgccaataagtccaaaattcatgttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaacatcgcacccgtggggctcaacatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatcggtattaattgacaaaagtacccgcgcgaatcacgaagtgagtttttgccacgaacgcacccaatacactccaatatgtccaaaattcaagttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacacttcaatatgtccaaaattcatgttttgatgctttttgaacttattcaatccggtcaaaaacaatcgcacccgtggggtctcaatatatgccaatattggcattaattgacaaaagtcccgcgcgaatacggagtgagtttttggccgaacgcacccatacactccaat

SEQ ID NO: 60227 - DNA, 679 bp, Oryza sativa
aaaacatccaaacatgaattttggacatattggagtgtattgggtgcgttcgtggcaaaaactcacttcgtgattcgcgcgggtacttttgtcaattaatgccaatattggcatatgttgagaccccacgggtgcgatatttttgaccggattgaaaaagttcaaaaagcaccaaaacatgaattttggacatattggagtgtattgggtgcgttcgtggcaaaaactcacttcgtgattcgcgcgggtacttttgtcaattaataccgatattggcatatgttgagaccccacgggtgcgatgtttttgaccggattgaataagttcaaaaagcatccaaacatgaattttggacatattagagtgtattgggtgcgttcgtggcaaaaactcacttcgtgattcgcgcgggtacttttgtccatcaatgccaacattggcatatattgagccccacgggtgcgatgtttttgaccggaatgaaaaagttctaaaagcaccaaaacatgaattttggacatattggagtgtattgggtgcgttcgtggcaaaaactcacttcgtgcttcgcgcgggtacttttgtcaattaatgccaatattggcatatattgagccccacgggtgcgatgtttttgaccggaatgaaaaagttcaaaaagcgccaaaacatgaattt

SEQ ID NO: 60228 - DNA, 701 bp, Oryza sativa
aagtgagtttttgccacaaacgcacccaatacactccaatatgtcaaaatttcatgtttggatgctttttgaacttattcaatcggtccaaaaatatcgcacccgtggggtctcaacatatgccaaatattggtattaattgacaaaagtacccgcgcaaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacaaagtgagtttttgccacgaacgcacccgatacactccaataagtccaaaattcatgttttggcgctttttgaactttttcattccggtcaaaaacatcgcacccgtggggctcaatatatgccaatattggcattaattgacaaaagtacccgcgcgaagcacgaagtgagtttttgccacgaacgcacccagtacactccaatatgtccaaaattcatgttttggtgatttttgaactttttcattccggtcaaaaacatcgcacccgtggggctcaatatatgccaatattggcattaatggacaaaagtacccgcgcgaagcacgaagtgagtttttgccacgaacgcacccaatacactccaatat

SEQ ID NO: 60229 - DNA, 1255 bp, Oryza sativa
cactccgatatgccaaaattcatgtttgggccttttgaactttttcaatccggtcaaaaatatcgcacccgtggtgtctcaacatatgccaatattggtattaattgacaaaagtacccgcgcgaatcacgaagtgagtttttgccacgaacgcacccaatacactccaatatgtccaaaattcatgtttgggtgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaatatgtctaaaattcatgttttggcgctttttgaactttttcattccggtcaaaaacatcgcacccgtggggctcaatacatgccaatattggcattaattgacaaaagtacccgcgcgaatcacgaagtgagtttttgccacgaacgcacccaatacactccaatatgaccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccagaaatcttgttttggtgctatttgaactttttcattccggtcaaaaatatcgcacccgtggggtctcaacatatgccaatattggtattaattgacaagagtacccgcgcgaatcacgaagtgagtttttgccacgaacgcacccgatacactccaataagtccaaaattcatgttttggcgctttttgaactttttcattccggtcaaaaacatcgcacccgtggggctcaatatatgccaatattggcattaattgacaaaagtacccgcgcgaagcacgaagtgagtttttgccacgaacgcacccagtacactccaatatgtgcaaaattcatgttttgatgctttttggactttttcattccggtcaaaaacatcgcacccgtggaaggttaatatatgccatatttggatta

SEQ ID NO: 60230 - DNA, 620 bp, Oryza sativa
ccaaaattcatgttttggtgctttttgaactttttcattccggtcaaaaacatcgcacccgtggggctcaatatatgccaatattggcattaatggacaaaagtacccgcgcgaatcacgaagtgagtttttgccacgaacgcacccactacactccaatatgtccaaaattcatgtttggatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcatgttttgatgctttttgaactttttcaatccggtcaaaaacatcgcacccgtggggctcaatatatgccaatattggcattaatggacaaaagtacccgcgcgaatcacgaagtgagtttttgccacgaacgcacccaatacacttcaatatgttcaaaattcatgttttggtgctttttgactttttattccggtcaaaaacatcgcacccgtggggctaatatatgccaatattgtattaattgacaaaagtacccgcgccgaatcacgaagtgagttt

SEQ ID NO: 60231 - DNA, 665 bp, Oryza sativa
ctttttgaacttattcaatgcggtcaaaaacaccgcacccgtggggtctcaacatatgccaatattggtattaattgacaaaagtacccgcgcgaatcacgaagtgagtttttgccacgaacgcacccaatacactccaataagtccaaaatttatgttttggcgatttttgaactttttcattccggtcaaaaacatcgcacccgtggggctcaatatatgccaatattggcattaattgacaaaagtacccgcgcgaagcacgaagtgagtttttgccacgaacgcacccaatacactccaatatgtccaaaattcatgttttggtgcttttagaactttttcattccggtcaaaaacatcgcacccgtggggctcaatatatgccaatattggcattaatggacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcaagttttggcgctttttg

SEQ ID NO: 60232 - DNA, 1130 bp, Oryza sativa
tccagaaatcatgttttggtgctttttgaaatttttcattccggtcaaaaacatcgcacccgtgggggcacaatatttgccaatattgacattaattgacaaaagttcccgcgcgaatcacgaaatgagtttttgccacgaacgcacccaatagactccaatatgtccaaaaatcatgttttggtgctttttcaacattttcattgcggtcaaaaacatcgcacccgtgtgggcccatatatgctaaatattggcacttattgacaaaagttcgtcgcgcgaatcacgaagtgagtttttgccacgaacacacccaatacactccaatatgtccaaaattcatgtttggatgctttttgaacttattcaatccggtcaaaaatatcgcacccgtggggtctcaatatatgccaatattggtattaattgacaaaagtacccgcgcgaatcacgaagtgagtttttgccacgaacgcacccaatacactccaatatggccaaaattcatgttttggtgctttttgaactttttcattccggtcaaaaacatcgcacccgtgggggctcaatatatgccaatattggcattaattgacaaaagttcccgcgcgaatcacgaagtgagttttttccacgaacgcacccaatacactccaatatgtccagaaatcatgttttggtgctttttgaactttttcattccggtcaaaaacatcgcacccgtggaggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaatatatgccaatattggtattaattgacaaaagtacctgcgcgaatcacgaagtgagtttttgccacgaacgcacccaatacactccgacatgtccaaaattcatgtttggatgctttttgacttattcaatccggtcaaaaatatcgcacccagtgggggtccaacatatgccaatattggtattaaatgtgacaataggtacccgcgggacatcacgaagtgagtttttg

SEQ ID NO: 60233 - DNA, 1695 bp, Oryza sativa
cgcgaatcacgaagtgagtttttgccaggaactttcccaatacactccaatatgtccaaaattcatgtttggatgctttttgaacttattcaatccggtcaaaaatatcgcacccgtggggtctcaacatatgccaatattggtattaattgacataagtacccgcgcgaatcacgaagtgggtttttgccacgaacgcacccaatacactccaatatgtccaaaattcatgttttggcgctttttgaactttttcattccagtcaaaaacatcgtacccgtgtggctcaatatatgccaatattggaattaatggacaaaagtacccgcgcgaatcacgaagtgagtttttgccacgaacgcacccaatacactccgatatgtccaaaattcatgtttggatgctttttgaacttatacaatccggtcaaaaatatcgcacccgtggggtcccaacatatgccaatattggtattaattgacaaaagtacccgcgcgaatcacgaagtgaatttttgccacgaacacacccaatacacaccaatatgtccagaaatcatattttggtgctttttgaactttttcattccggtcaaaaacatcgcacccgtgttggcctatatatgctaactattggcacttattgacaaaagttcgtcgcgcgaatcacgaagtgagtttttgccacgaacgcacccaatacactccaatatgtccagaaatcttgttttggtgctttttgaactttttcattccggtcaaaaatatcgcacccgtggaggctcaatatatgccaatattggaattaatggacaaaagtacccgcgcgaatcacgaagtgagtttttgccacgaacgcacccaatacactccaatatgtctaaaattcatgtttggatgctttttgaacttattcaatccggtcaaaaatatcgcacccgtggggtctcaatatatgccaatattggtattaattgacaaaagtacctgcgcgaatcacgaagtgagttttttccacgaacacacccaatacactccaatatgtccaaaattcatgtttggatgctttttgaacttattcaatgcggtcaaaaacactgcacccgtggggtctcaacatatgccaatattggtattaattgacaaaagtacccgcgcgaatcacgaagtgagtttttgccacgaacgcacccaatacactccaatttgtccagaaattttgttttggtgctttttgaactttttcattccggtcaaaaacatcgcacccgtggggtcccaacatatgccaatattggtattaattgacaaaagtacccgcgcgaatcacgaagtgagtttttgccacgaacgcacccaatacactctaatatgtcaaaattatggtttggcgctttttgaacttttttattccggtcaaaaacatcgacccgtgggctcaatatatgccaatattggcattaatggacaaaagacccgcgcgaatcacgaagtgagttttgccacaacgcacccaatacactccaatatgtccaaaaatcatgttttgggctctagaactttttattcagcaaaaacatcgcacccgggggctaatatatgccaatatggctttatggacaaaagtccccggcgaatcacaaatgagtttttgcaaaacgcccccaataacttcgatatgtccaaaattatgtt

SEQ ID NO: 60234 - DNA, 2745 bp, Oryza sativa
tcgcacccgtggaggctcaatatatgccaatattggtattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatcggtattaattgacaaaagtacccgcgcgattcacgaagtgagtttttgccacgaacgcacccaatacactccaatatgtccaaaattcatgttttggcgctttttgaactttttcattccggtcaaaaacatcgcacccgtggggctcaatatatgccaatattggcattaatggacaaaagtacccgcgcgaatcacgaagtgagtttttgccacgaacgcacccaatacactccaatatgtccaaaattcatgttttggcgctttttgaactttttcattccggtcaaaaacatcgcacccgtggggctcaatatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaacatcgcacccgtggggctcaacatatgccaatattggcattaattgacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatatcggtattaattgacaaaagtacccgcgcgaatcacgaagtgagtttttgccacgaacgcacccaatacactccaataagtccaaaattcatgttttggcgctttttgaactttttcattccggtcaaaaacatcgcacccgtggggctaaatatatgccaatattggcattaattgacaaaagtacccgcgtgaagcacgaagtgagtttttgccacgaacgcacccaatacactccaatatgtccaaaattcatgttttggtgctttttgaactttttcattccggtcaaaaacatcgcacccgtggggctcaatatatgccaatattggcattaattgacaaaagtacccgcgcgaatcacgaagtgagtttttgccacgaacgcacccagtacactccaatatgtccaaaattcatgttttggtgctttttgaactttttcattccggtcaaaaacatcgcacccgtggggctcaatatatgccaatattggcattaatggacaaaagtacccgcgcgaatcacgaagtgagtttttgccacgaacgcacccaatacactccaatatgtccaaaattcatgtttggatgctttttgaacttattcaatccggtcaaaaatatcgcacccgtggggtctcaacatatgccaatattggtattaattgacaaaagtacccgcgcgaatcacgaagtgagtttttgccacgaacgcacccaatacactccaatatgtccaaaattcatgttttggtgctttttgaactttttcattccggtcaaaaacatcgcacccgtggggctcaatatacgccaatattggcattaatggacaaaagtacccgcgcgaatcacgaagtgagtttttaccacgaacgcacccaatagactccaacatgtccaaaattcatgtttggatgctttttgaacatattcaatccggtcaaaaatatcgcacccgtggggtctcaatatatgccaatattggtattaattgacaaaagtaaccgcgcaaatcacgaagtgagtttttgccacgaacgaacccaatacactccaatatgtccagaaatcttgttttggtgctttttgaactttttcattccggtcaaaaatatcgcacccgtggggtctcaacatatgccaatattggtattaattgacaaaagtacccgcgcgattcacgaagtgagtttttgccacgaacgcacccaatacactccaatatgtccaaaattcatgtttggatgctttttgaacttattcaatgcggtcaaaaacaccgcacccatggggtctcaacatatgccaatattggtattaattgacaaaagtacccgcgcgaatcacgaagtgagtttttgccacgaacgcacccaatacactccaatatgtccagaaatcttgttttggtgctttttgaactttttcattccggtcaaaaacatcgcacccgtggggtctcaacatatgccaatattggtattaattgacaaaagtacccgcgcgaatcacgaagtgagtttttgccacgaacgcacccaatacactccaatatgtctaaaattcatgttttggcgctttttgaactttttcattccggtcaaaaacatcgcacccgtggggctcaatacatgccaatattggcattaatggacaaaagtacccgcgcgaatcacgaagtgagtttttgccacgaacgcacccaatacactccaatatgaccaaaattcatgtttggatgatttttgaacttattccatccggtcaaaaatatcgcacccgtggggtctcaacatatgccaatattggtattaattgacaaaagtacccgcgcgaatcacgaagtgagtttttgccaaaaacgcacccaatacactccaatatgt

SEQ ID NO: 60235 - DNA, 547 bp, Oryza sativa
gggtacttttgtcaattaataccaatattggcatatgttgagccccacgggtgcgatatttttgaccggattgaataagttcaaaagcaccaaacatgaattttgaacatattggagtgtagtgggtgcgttcgtgacaaaaactcacttcgtgattcgcgcgggtacttttgtcaattaataccaatattggcatatattgagaccccacgggtgcgatgtttttgaccggaatgaaaaagttcaaaaagcaccaaaacatgaattttggacatattggagtgtattgggtgcgttcgtggcaaaaactcacttcgtgattcgcgcgggtacttttgtcaattaatgccaatattggcatatattgagccccacgggtgcgatgtttttgaccggaatgaaaaagttcaaaaagcgccaaaacatgaattttggacatattggagtgtattgggtgcgttcgtggcaaaaactcacttcgtgattcgcgcgggtacttttgtcaattaaaaccgatattggcatatgttgagaccccacgggtgcg

SEQ ID NO: 60236 - DNA, 733 bp, Oryza sativa
ctcaacatatgcaatattggtataattgacaaaagtacccgcgcgaatcacgaagtaggttttgccacgaacgcacccaatacactccaatatgtccaaaatcttgttttggtgctttttgaactttttcattccggtcaaaaacatcgcacccgtggggtctcaacatatgccaatattggtattaattgacaaaagtacccgcgcgaatcacaaagtgagtttttgccacgaacgcacccaatacactccgatatgtccaaaattcatgtttggatgctttttgaacttattcaatccggtcaaaaatattgcacccgtggggtctcaacatatgccaatatcggtattaattgacaaaagtacccgcgcgattcacgaagtgagtttttgccacgaacgcacccaatacactccaatatgtccaaaattcaagttttggcgctttttgaactttttcattccggccaaaaacatcgcacccgtggggctcaatatatgccaatattggcattaattgacaaaagtacccgcgcgaatcacgaagtgagtttttgccacgaacgcacccaatacactccaatatgtccaaaattcatgtttggatgctttttgaacatattcaatccggtcaaaaatatcgcacccgtggggtctcaatatatgccaatattggtattaattgacaaaagtacccgcgcgaatcacgaagtgagtttttgccacgaacgca

SEQ ID NO: 60237 - DNA, 19118 bp, Oryza sativa
tctactatcaatcaatcgaatcgttcttttcatattgcttttagttttctcttagtttgtccatctttgtcggtttgcaccgtaaaccgtccgccgctgctgcgagagtgcgacacctctttgtaggtttgtcctgaaaaccttccgtttgcccacgagacgggtagttatctagaaattggctccgctagccggtttagttatcaaaacccatctagatttagcttttttgctagatcgaggtggttggcgactctaggatcaccgcaaggcttaaggtgctacgatcgtgcttgtcaacttgtcaaaaaagttgccaacaggccctatgtataagtaactttaggttttcaaggaattgcatttttatgataattttctctgctattgttgtggtgagttgataatttagtcactaaatatgtaactttctgaaatttactcaaaataaaatatccaaatatttcagaatttctaacacatattcagtcattttaagtatctcaaataaaaaggtcgtcaatgacaaagttgtatatctcgttgacctacacaattttgattttacctttgtgttcactcggatttatataaaaaagtttattattcttttttttaaatgttcttgtaaatatcactaccggttaattactcaatgaacataacagtccagaccatggtccaaaatatctgctccatagtatcagtgctggcttgtaataccaacttaacggtggtactttttcttagagagaatccctttatatgccactaaaaattagtctgatcccttgtatgccactgaaaattggctttttccttatatgtcatatatctatctatctatctatctatctatctatctatctattatctatctatctattatctatctatctatctatctatctatctatctatttctatctatctattatatactaaaagtccattaaacttcctacaagcgctcctaaaccgccatgtggcgctcctataaacgctcctagattgccatgtggcgctttagtaaatcctagaaattctaagaaaaaagcaaaacatctagccatcgattttcatttaatctggtggacccgctattttaaaccattagttagatctttgttaagaaaaaacccaaatcaatctataaaaaaaaaatcccacgttacccccgcggtgtccccgtggacctgtacgtatgtacgtacatacgtacgtacgtatccctgtaagtctttttctttttttttcttcttatattcttatattagatgaaaaaccatgttaaattaaagttgtaaaaatacatgctatttcaagttttattctaaatagcgcatcgcatcaaaacatccattaaaattattaataaattaaaattgtagattatatgattgtatatctcttaagaacatagttaaattggacttatattttcaaaaaataaaaagaatttaaattatgagcagcgttctaaaatttactcactccctactgtataatattgatatgcccaaatgacattattaaattatcatgaatatattttcatatattatatatgttcctttattcatatatttttggaaaattaacgatcatatatttttttacaccatgtggatgtattttttatctcttaggtttcattcggtctacctcattagatgagcttatctaggacacgcgaaaaaaaagcatgccatcagcgtaagattaattaagtattaaatattacaaacttgaatatggatttatttgatcttttaaaaaaactttgcatagaaagtatttgaaaacatgcatcatttcaggaaacatctcaccatagagggagtagccaatccgataagattttagaactcaaccttaaatttactataaaatatatagtatataatatattttgtcaattaggaatagagccaaatatatcaatcatatatccctactaattcctatgtgtataagtttcatatacaaaccactgtccaccaattatcaagtcatattaattacttatgaagcatccgtgcttaatgcacctaataattagatgacatctaatatgcagtgtgttatcaagtactgataatggacaatactaaatgagaaaccatcaacaaatgataggtaagtattgataccaccaagccacaacaaataatagttgactacaaatatattgaaactattgggtaatagtgttcccacacacctacatacattcctaggttgccacgtgacgctctaataaattagggtaaatctaataaaatttataagaaaaagtaaaacatctagccattgatttacacttaaactggtggataaattatttttaaccataagattagacctcttcaagtaatccattacgactatgactaatagcattcctgcacttccaagatgccgcatgacgctctaataaattagagaacatataagaaaaatatattaagaaaagaaaaatataactgtttatttacacataaaccagtggatatattattttcaatcattatattatatctattcaaataatccctcactatgtacgtacacaagaaatgccataaaggaaaaaaagaagagtgtgtatactatcagccccatcaagtagttttctctatctttctttgcagctctgagattttccacaaattgtgcatatgagtagcgaccactcctggcgaggctgtcgaagaagccacgctacacagcaccgcttcacgccatctcgccaattttcttgaaagcattttttttactattaatgttaaaggcaatctcgagcgcatatataaacgtgtgcacacccatcatagaaataggcatacgcacacctaccctaagagaaaaaatatttgtcaaaaaaagaggaaaaaatatgtacttagtatttgccaagaaaaacatatatataaatatatatatatatatagcataaaaatgtcgcatgtaaccacattatatctttttaattatatcattcccatctatataataatatgctaattattaacattatagattattccatcgtatataaccgaaacaattcgcactgtcattatagtttaagggtgtaattcagactatttcctttaaaaaaagtcatttcaacacaataaggattcataatacaaatttaatcaatactaatttagtaaagtacccgcgcatatgcgcgggccaccttcctagttggtctaaatttacgcatcctctcatgtcactcccgtcagttgactgtgggttgaccgttaactctaaagtaaaaaagatgtatttactcttctgaatataagattctttctactttttattcctctgtcactgttagctcataacaagaaccagcagtggtatatcaccgcaaatgaactgggtagtgatatttagtaacattgtcagtttacttcagtttgggcaaagaaaccaaagtgaactgacagtgataaattctcaccgccggttcataccgaaccagcagtgatgaccacttctgtggtagtgattgctgcaatttatctatccatatgatttaacgcgcgcagcttccgcaccgcacacaaacactaacgccgtgccataaacccaaccaatttgatcgaccaccccggcagtcattaattgttttgatttgttacactaaagtattgagatcaactgtaaaaacttgtaagcgtccaaaagtcttgtgttttatgcgaagtgaattccccacaacacgcatggcaattgtttaataactccctccatttcaaaatgtttgacaccgttaactttttagtacgtggttgaccattcgtcttattcaaaaaatttaagtaattatttattcttttcatatcatttgattcattgttaaatatactttcatgtaaacatatagttttacatatttcacaactttttttaataagacgaacggtcaaacatatgctaaaaagtcaacggtgtcaaacactttgaaacggagggagtatatgttggcaacgtcaatgtgatacaactgtctgtgtgttcacttgtctgaaaccaagtggatcagtcaagtaattaattgtataacagatacggtacaattataatgacatccaaagaaacggagccggcaatgcgcatgtcatcttccattccagccggctgattccccaacacctacgcacctctctatcattgaaaacaattagcaaaatataccaggtaacctttcttaacatttaaaactgtgcacttattacaattctaatgcagtttgcggaatattgccttcactattaaattattgatgccgttggctttttagacatggtatttgaccatttgtcttattagaaaagctatataactattatttattttgttgtgacttgttttatcatttaatatattttaacattagtactaaatttttaaataagacgaatggttatcgtcatttccaaaagtaaatttccaaaagtaaacaacgtcgtacatttaaaaatgcaggagtagcagttctttgaaagttcaacggacatctgaaaattattctgaatttgttgttcatgacgattctgtacttctatttgtaatttacatattgcatacttatcctaaactacaaatattctctctgctctccaatctttatttttcatggatagactgcatattaaaggaactaaggttctgacacttggaaacatagcccaagaagtcagtgcaagcaaacatggacagtgacaattatcctagaaaaaaaacatgtacttaaccactggacggcaagccaacattactgcaaaaacataataaatctacgtaacaacaaattaactatcaaaagaagacatctttgacagcaagaggggaaattcttatgatcagatacagatcagatactatatagatgtgacaggctccaattttcgttgatactaatatccatttccatgtcctgacatagctctggatcatggagaaggggcaggagataggagcgtcagccggcgagaaaggttcagagcagcacgccattgacgtccgccccggcgagcatggcgccatcggagtcgtcgccggcgccgctgcagaagcaccggagaaggagagattggctgttgttgaagaggagcccaggaagaaaagcaagagggttgcagctcttgatgcctttagagggctaaccattgtggtatacatatatctactgcatatgcagtgaaaaatatgaatagttttgtttccatctagttacactttggtagtacttatcagtgttttgatgatcagtgtaatttagtattcatgaagtgtagaaagtagcacccctttttatttacccccttcaataaaaaaaggaagttgttttggatgtttcaagtaaaaccttagaatgtttggtcattaattaatgctctttaattatttagatttgaactatgaaaaattgaaaatcatctatatatatttgtctcaaaagttacttccataaaattataattttatcggatctttttgtaaaaaaaattataatagaaactaactgacaaatgtgccgatgtttttatgaccaaagggagtagtaaaaacagaagttgaaattctttgaatgagcatgaatgtgacagtgtaaactgttgagttgcattgtgcagctaatgatactggtggatgatgccggtggggcttacgagcggatggaccattcaccatggaacggatgcaccttggcagatttcgtcatgcccttcttcctcttcatcgtcggcgtcgcaatcgccttcgcgttgaaggttactacagacacttgcacaagagcacctcttgctatgaatctatgaataatgctgttgttaaattctggcaattgatcgtctggcttatacatggttgcagagagttccaaagttgggtgcagctgtgaagaagatcaccatcagaacactgaaaatgctcttctggggcctgctactgcaaggtaagtaaaaccttcaatgaacatgcccactatcaaatgcaatgtgcatatcaacaaattttcagtttgcaacttgaatgttatgacaatcattggcactgccgaatttgatgtttcgcatgtatgaaggtggatattcacatgcaccggatgacctgtcttatggggtggatatgaagaagataagatggtgtggcatcctccaggtccagtaccttaatttgctgaaagaaaacaaaaaattgttcagagtttatgttctgtttatttcttcagaatttattagttctgttttgacaatgcagaggatagctttggtgtacttcgtggttgctctgatagaggcattcaccacaaaagttcggcctacgacagtgcggtccggtccatatgcaatcttccacgcataccgatggcaatggtacacaaatattaccttgatatttggctaacaatgtcactgcaattcagcgaacatctgttcaatttctgaaaatggtgagcatttctggtcttttctgttatctgacaggctaggcggttttgtcgcgttattcatttacatggtcaccacattctctctatatgtcccggattggagctatgtctaccacaacgatggcgatgttaatgacgggaagcaatttacggtactacttgcagttttccctgatcatgtgagcagagctgcaaatcctgtatttgctacagtactgtcttatccctgcaggtacaatgtggtgtgagaggtcatctggaccctgcctgcaacgcagttggttatgttgatagggtggtttggggaatcaatcatctctacacgcagccagtttggatccgatcaaaggtagaaactgtaatcttgcaatgatcagatgtacaatatttgtccttctgtaatcaagtgcaaaattttgttttgttaacctgtaccctgcaaactctgaaactttttgtgaactgcaattatctttgattaggattgtacatttagctcaccaagggcaggtcctctccgagctgatgctccagcatggtgtcttgggccttttgaaccagaaggcttattaaggttggaaatctgacaacatgagctaactgaagctgaagttaatttgtcttagaagcttctttgcactacgtattaagtaattcagctgtctaacaatttattcttttgcagttcaatatcatcgattctgtcagggacaattgggatccattatggacatgttctcgttcatttcaaggttattttgtgttaatttatactattttaagttaatatttaacaagcacaagtttgaaacaaaagtgtctgaattttagacccacagagagagactgagacactggcttctgctgggattttctctccttgcactcggcattcttctccacttcacaaatggtactactactccccaaaatctatttcccacaactgataaaaaaggtcaaaatatttattcaggacttttacatccattttatctttcttgcagccattccaatcaacaagcaactctacagcttaagctatgtctgcttcacggctggtgcagctggagtagttctttcagctttctacatattggtatgatttttcattagtacattgaggcctcgtttggtttggtgtggaccgagattttagttcaaagtcccagcctataaacacggatgggctgggttcgattacttgaggcccatctaaacgaggcctgatatggaatttcagtactcattttcatgaccgattttaattttatttatttactggattattatttttttattaatagattgatgtctggggactaagaacaccattcttgttcctggagtggattggcatgaatgccatgcttgtgtttgttctagcagcacaggcaatatttccagcatttgtcaatggatggtactatgattcaccaggcaatactcttgtaagtaactttgttgcaagtttatttttaatccatcatgacagcatggtgacatctacaggcaaagttttgacatgagtttgatttggtttaatccattacctaaaaaaaaatctgcaggttagctggatccagaagcatgtgtttatcaatgtatggcactcacaaaggttgggaacactgctgtatgtcatatttggggagattgtcttctggggtgttgtgtcaggcatcttgcacaagctgggaatttattggaaactatgaggattttggatttaagtgtaaacagcgctaaggagaaccaattactgttgcttttacagataaagtctggtttctgatttgcatgtgatattattttgtatgatgctattatttgtataatcgaagcaaaaatgagatacatatattttaatctttgaagcattctttaggatattgatgttgatgtagtaagtggccatatatatgcttgttcagtgtgacaatatgctatttaccaaaaatcagtatgtatatcccctcatgatttttgtagataatggaagttttaattaaactgagttgattacatcaaggtgatactacttcactgagaacactcctggcctctgcataatctcctcatgattctggtagaatgatctcaaacgtctctgaagagattctatcacaccgattgatttggccatgttacaacgggatcacattcttgaaaccaaccgtccaagccagtgtaagttcagagttagaatctctgatgatcttcaaagccttcaaactgaaaagaatcagatcagtcacagtctcacagagagactgactgcagtatcagaagaacatggacaagttgcaactgtggtcagggatcccgagacaagcctgcctgtcctatctactcattgttcagacatcttcttgcaatcaaccaaaaggcccatactacatactacatggataacagccaaattggctggcaaaaatgcctaattggctgcagaatctagtcactctatgctcaatgttatgcgttcttgcccttatctgcatatatcattgggcttgggatccattgcatcagacatgttcagcaagcatggcaatgccaaattgccaatgctactggctttgtttccttctgcttgaatcagcaaataaacagtgtgaaatggcggcatccatggtttgctccgttttgtatttatgctggtttcttatcctgcaataaagtacatgtttgtatttattttgtttttaaaattttagttctgttttttggtgccttgatgtgctgtaatgttgtcttgtaagaacaaaagagaagtcttctccccatacttgtcaatcatgcaaatattgtcattttcccctgttaattgtcatgttgttattcttcaagaacatgaaaggccctgtttagtaggacaaatattggtcttatcttccatggggctaaaaatttttgtcagtattgttgagattttgattccaccagaagaaaaacaagattctaagttgaaggaaaaataaactggttgctccatgaagttgcaaaaattaattaaccatactgcaagtctgcaacctgtcttaattggtattaatctgccatgctaccagctaacaccattatattttcagagagtcacagatctaatcctaaaaaaaaaaggggaaaataatcacagatctctatagctttggtgcatgcagcatgtatgtatcttatgatctgtcagacttggtatgcttatccctgaacataatgcattgctcccatgcatgaacgttgtgagatcagagagcagatgatcagttaatcaattgtgcatacatgatcataaatttatattataatacattaatgtataccgttgtgaataaaagaataaaattatctgcccaatgttcttcgatgaggaaacaaacagtaaactgaaccaacggctaagtagatgaatgtacagctatagtattaaaaatatatactactagtaagcatgtaaaaacaataaaattataggtgaactaatgcattaaaagaacttatccacttctgcatcttattaacttaattaatcaatcaggtattgcatgcttgctatattaacgcatggtgtgctcctcttcacttgccaatctgagcatatgcatgggaatctatcacaacagttgacattataataagcaaaaaaaaaaaaaaaaacagatgaataactacatttttaggtcaaaatattgactcctagccggtgactgcatgaaggatttagatgtgtatatatactgtatttgcataaactactaacgtttgatgctctgcacccatccatatgcgcatcgatctgtgtattacatataataaattgttggtactgcaaaataagccgacatcgatctctatcttattacatattttccccaactttatcgtaaccccaaagagaactattatatatgcttccctattaatgaaaaatatcgaaaaagatagagccacaaattaaaatagtattaataaatgtatataatttagcttacaattaccaattgtttccttctagacagcggcggagctagcactccggctgccatgagcagctgccggggctcgccgatgcataccaagaggtgaaaatgctatgtggctaatattgggcgctgccggtagactatcatagtgggttttatacgggtagtatatctatcaccgttttttaaggatatgtttggaccaaaggatttaaagatgatattttttgtgtaggatttttttccttggagttatctggattaattacgggaacggtttccgaattccatcttgcttttctactatgttaaggtgtttttcctatttttatgtttcatatatattcttacatgttgtggaagaacacaataaggatcctctcctcttagccggcttttagcaaaatacattttagaggaggaaaaaaatgcaagataaaccccgaagggtggaacttaattatatatctatatgaatcatatatattcttggattttaagatgatcatgcattgtgagtcaactactcgcaatgtcagcgaccacatggagaaggttgatggtcagttacatgtccactcccgaaaaggtcaacctggttatcaccaaattaaaaagcgattattgcaaacagctagctgcaacacacataattcaccagtcaaccacttagcttttgccgccaactaatttgtgtttagtcaacgccccattaacgcaaatttgagctggattctccacagtagaggctgcatgatagtattattcatctggtcagtgccttgggcatgccgtgtccattcatttcagttgtagttaactctgttttcaatcccattgaaatgatactaacaaaattttcaagaaacatatatttttgcatggttatattcagtgcttctatatgaaaaatgaaaaaaaaaatatactccttacattttttaaatatatgatacggatgatatttggacatacgttttgagcattcaccttatttggaaaaaaaatagtaaaactatgagttatgctcattatacatttagtaataaaacaagtcatagaaaagtaaataatatagaaaagtaaataatgtttgaacaagatgagacgaacgataaaagtacatatcaaggaatcaacggtatcatatatttaaaattatagtagttaattagtacataatgtatctcttaggatgcatagcattagcaatcttaggatgaatacacatggccatgtaagtgaagctaatttttaatgagagttttacacttttactcttagtatacatcatttatttggttttagattaagcattcaagaaaatactgatggaccaaattttaaaaatttaacaaatctcatcctaatgtcaaatatttttgaccgtatggaagaaaaaagaggagtatggaagaaaagaggagagagagagagatgcatagcatcagcaatcaacaaaggccagtaacggaaacccaaaaaaattaataaactaattctgaaatgtagtcctgaaattcaacaataatattatgtgcgacttatctcaaatcgcacggcagagaggaacatggaaatgcatcagttgttgccacgtggtatatagtgcttgcgtgcggaccagcctaattggtagctgttgagacgcgtccgatccattaactaaccgtggttgtttgtagttgaataatggagttgccggtctggatatcagacactcaatttaagtggacactactaaatgtgtagtgccaatcataatcaagcaagagcatatattttattttggaataaattcaccggaggtccctcagcttaacagcgagattttttaagatctcttaaccacaaaataaaaaatatatacccctaaactcacacaaaccatgcactcaagatcctatggcggtatatatggatggtttcgctaacgtggcatcctagtcagcaaaaaaaaattaaaaaagtacgtggagcccacatgtcagctgcacatttctttcttctccttctcttctcttcttttcttaagtgagggaggctggcgacgggcagagcagcggatggaggaatggcggccagaatgcggcgtcgcctcgagcaccgtgataggaggagggaaaggggaggcgggcggcgggcgatgggggaggggagaggcgcgacaataaggacggcgcggtgacgggggacggggggcgcgacgcggcgacggggatggcgaggtgatgggggacgggacacccggtgcggggtcggcggcgggaggagcagagtcagccgcgtagggtggcagaggcaccgcagctggtggaggagatcgagggcgggagctcaagaagtgtgacggcggcggctacagctcgagaagcgtggtggcagccgccgctccgcccactttgccacgtcgcctgccgccgtcccccctctgcggcctactccggccgctccgctccgcccactgccatgctcgcccgccgtcggtcccccctctgacgtgcttgcccaccaccgctctcccctctgcagcgctcgcccctctccgcagccgcgcttgcccgtcgacgccgccgttccacctacctctggccgcgcgccgctgccgccaccacgatcccacgccaggtcggcgcggcggttgccggcggcgcggaaccgcctcgtcccgcgccgccgccagaggagccaagggcagacgcggaaggccagggtctcctcatcagtgtccttgtcgaagtatatccccacccccgccacttaggaggacgccggggtggctggggacgagagctggagcacgacgcggagcaagaggccgagggaggtgcacgtccaggacagcgcagcgagaccgaggtgggtctcatagatggaggtcgctaggctaggccccgcggggctagacgccgcggccgcgcgcagcacaagcgtgccatcgctgctctgcccgctgcagaagagaagagagaaaagagaataggagaagaaatgagaagaaaaaaatgtgcagctgacattgggccacacttacttttttttttttgctgactaggataccacgtcagtgaaaccacccatatatactgccataataccttgagtgcatggtttgtgtgagtttaagagtacacatttctagttttatggttaaaggacctaaaaaaatctcgatgttaagttgagggacctccggtgaacttattccttttatttttcatattaaagagtatatatattttattttcatattttagtataacctcgttatagtttgtagtatgaattattatttagttcatatttcgatcactctaatttcaaatacttgtcaccggatactatttacattttaactttgaccgatcatattattccttttaaaaaaatatactccatctgttttatattacaagtcattggaaaaaatttgtacaaagatatagtaatattttcaatacaaaacaaacttattatcaaaatatatttaatattaaatttaataaaagcaatttggtggtgtagatgttactaatttttttataaacttgatcaaacctaaaaaactttgattatgaaaaaaattaaacgacttataataggaaacgaaggagtattagtcatactgatagtctaaagttaataatggtcaaagttaaaatataaatggttgtgacaagtaaaagagagaatatatgttcatatacatgtgtagcatctcaatatctcgtatacacaaagtcacaaaccgctcacacaaaacagaggcgggtagctactggctttgcttggtaattgaccaagtaacaaacatttcattaaaacaaaatacagtgaacaaacatgtcctggttgcttttgtttctgaactgctcaacagcacatccacgttgccctgttctgcagcattgcattcaaagcagacatctcaagtccaaaggtgaacaggttcagagtaattccaaaccaagtcatcacctgacctaccaaggtaccaaggactaactccagcagcagcagcatgcaactgcaacaatatcttaaatttctccctttattatagccacttgaaaagcaagatctccttaattaattaccttgcatcattccaaaaatttcaacctttttgcacagcaacacagcatgtatatattgtgatatattggtccagtagatatagtatgtccaactaaaagtattgtatggtatgggtggcattcatgatggtcatattaccaatggccttgcctacatgctgcttgaatgatgccatttaatctttctgagatctacctggctaggtgtcgaattgtgtgacagccagcatggataagggtaatttgtgtgggaaactcatgaggttttttttaggtttgattttcatagccaattacttgtgttcccctgattttcaaaaataagtctgataatcaacatttgattaataaataaaatatcggttttagcctttgcaccaattgataatttacagaacggcacaactagttattgggctagttgggtgggcgcacgtctcaatgtcaatatatgcagcacacggctagtttctgaaatgcgctatgaaaacccaccggtagctaataaaagctctttgctgctcaagcttcgtaccatccttggctctccaactagatatccacacatgaaaatcattaggaccggctatattatcgaattatgccgtattattttagaaatttaacataagcatgttttctgatttgctaggcagcatccaaaagtcacattatattgctacatggattatggctaggtttagaggacatgcatcatttataagaccttatctgccaaagcatatcccagttcaccttttctcctctaaagcaactaatgtgtcacctactgccctaagtaccttgaatttaaatagtacaatcaactctagatcaaaaaggtcttaatggtcctattccttctgacgtggcatgattatttcctttggagcttggttggcacatgtatgtgcaatgagagcatattatgccataaaccccacaaaaagaaggacaagctagtgcccccaaaagacatcattttaacccctttataattaattcatcacttttatctcacttaactataattaagtttggtcccttaaaagcccaattctttcctttggagagtagccctgcagccaagtgcatgcatgcctgctcaaacatgccatgtgcacaaaccttcccccagcatcttcctttgcttcatctctttatgatctccaaaggaaaagaatcatttcctttttcaattgctctagagttacagcatacaaccactaaaacaacatacaaataacaactttaaattgtgcagatgttttcttctctaatgaattaaaggataagttgtgtgcaaattaagattgctctcctacaccagttgatgaatctagctatctcgacagattaaaagatgcaacatggagtaaatatgggaaagtaaatcaattaacatatatactcgtttaaaatagaagtacatctcccataacaacatattctagtggtcatttataattgttgttcaccaacccctcacttgtgttgcgctctaattaagcagggttgtggttgtcttttatgatttatgtgtttttccttaagagaaactacgaacaaaccatcggataattttctatgttgctacaaccacacaatactattaagcaaagaaccaggccattatgtattcgtacgctcgcatcgaaatatataccttttatcattgaccggcaccgatccagcatatagctccaaatacactctactctaaacctatatatctgtaagaaccacatgatgacccggattattttacggcatttggtcggtgcgcgcacaacatcccctccccgttgggtaagtgtagcaatacacacattaccccccatctttgataccattggtgtatatccacgagggcaagcaagcaagcaagctccacctctctgtcactggcatctccatgtgccccaatgactgcatgtggtgtggctccacaccccaatttccctctcctctcctcttaaaaacctccctctcctctccaccattgtccacacacataaaaaaaggcaaaccaaaatacctactccacatctaactaattctacaccagcttatatatttatacacacacacatctccatctccacatctccatttccatttcagagagagagagagagagaaggccaatcttactaccccaattccatccccctttgcatattctcactcactctcaagtctcaactcaactcatcaagatatcatcatcatcagagaggttgtagaagctacctagctagctagctagccaaaagagatatctttcagaagaaaggaaggaagaagaagaagaagcaatgagcagtggtggtggctcctctccaacatcatccccttctgtctgctccagatcatggtaggcatgcatacatgcaaactctctcatcacacaaaactatcaacatctattcatatgttcaccattttttgtttctttaatataatcaccctatatgtccataggtccgtctagtcttatcatgagttgcctatcaacatatcaacattattttggacagaaaattcacgtgttaatccgtgaaatgcatgagcaagaaaatcagtgaagattaatgaattgcctgatgacgatcatgtgttaattattttgatttgtgtgtgcaaataaattaattaattgaatcaggtctataagtgaggattcgttgaagaggtacgtgagctacgcgagcgagagctgcatccaggagctcctcgccgcgtcggactccggcggcggcggcggcggcggcgacgatgggtggaaggtgctcgcgtactgcaacggcgtggagatatcgaagcggcgggccggggcggcgcacgtcttccggagccggtggctgctgcacgccgtctcgccggggaagttcatggccgtcgccaacgccgtcgacgccgccaaggtacctgccactttaattagcagtattcctggcactgctaaaccaagcggacgaattaacgcatgattaattaaatattagttaataaaattttaaaaagattaatatgatttgtttaacatattttctatatgagacattttaaaagaacatattgtttagcggtttgttgaaatcgtgtgtgtacatgaaaagcgagagactacaagttaggaaagcgtggaaaagaacacaatctcaattacttttactgcttttatttaatggatcattaactaaagcctgggaaactaaaacgttttttggttaagtaatcatcaataaaggaagaaaacttaattcaagaggtttcactaaagagagattaataaaaggtatttttttgcaaaggattttttttgctttagattaaagtgaacaactaattaagaccttttaataaggtttgaaatatatccttccttttcaacgaattaatttgtactgaaaactaaaacactttctctcgagcagtagctctcaatacccaagttatccgtcctttctcatcaatctccaacgacaaataattgctagtacctacaactgatcaaattgtcgaattaatattgatgcaatttcactaactaattaattgattaaaaagcaaccaacaacaacgtactacccctataccgtactaccgtgactgtgagagtacacacattacgtacatatggtgtgaaaatgcacagcatttttttataatactatggcattgtttagtttggaaaaatttttacgtttggttgtcatatcggatatacggatacacatttgaagtattaaatgtaatataataacaaaataaattacagattccgccagggaactgctagacaaatttattaagcctaattaatctatcattagcaaatatttactgtagcgccacattgtcaaatcatgacgtaattaggcttaaaagattcatctcataatttacacgcaatctgtgtaattagttttattttttgcctacatttaatattctatacatgtgtccaaacattctatgtgatagtgtgaaagtttttattttaggaactacacaggacctacgtaataaatgggtataattgggtaacggtgacagtagattagtaaaacgtgttaccattgatgagtaaagttaatgcgttgttgtctcgtgatccgaccgccagcccaacccaccgtacctgtcgtcgtagctagtatctttgttacgcccgtgattcttaaaggccttcaaattaaacgtacccttttttgtgcatggtacaaatctaccaatttgtaccattttgaacgacctattgtacgataccatgaatgcaaaggaatttaccaattgtacgagcatgcagtaattaacagtccaggtatcagtgataggtaaagtgtgtctatttttttggtacttaattagaaacctagcccttgtacatttgtttttccagctttattcgatataacatgatgcaataagtattagcatacctataactaaaatgcctaaccctaatcgtacagtaaaatttaaattttaaaacctattttaagagttgatttgattttgatgttttttcatcgtatagttgaaata

SEQ ID NO: 60238 - DNA, 3941 bp, Oryza sativa
taaaccaaaataactaatatgactactttttttagctctctagatcagagtctacaaaacatgtggcttggaaaattttaggcttaccaactacaaaagctcaaagaccacattattgattaacaaaagccaaagctaacaaaattaattaatggaggggtattgtgctgcagagaagtctctgttttctactgtacacagactgtatagaaatactaatgtaacagtaaccaaagttcctactactacctagctagccccactacacctctcctcatgcacgctgcaacaaaattctgatgccaacttgtcgccatgctgctcccccggccatgcatgtcgcatcgtcagattgacacgtacctgacacatccagaaaattgttcccaagaaattattattactgccattggaaaaaaataaggaaaacgacagcctttactaaaatattgcattatagagccagcgatgtcgtgaagcctgaggacgaagaacattttttagactttcggttaatttttatgagtatttttcgtgtcgttaataataacaacggctagctcaggagctggctccgtctctagctatttctgtgaacaaagctaattaattgagaaaatactctcttttactttgaatatgagttgtttctttacttgtgctctagagttaaaagtaaaataatcttattgcccttgaactacacttgatattaattgggagagagtagcattttggtagagcaaatatggagaagaaaaactttaaaagaaattgtaatatttaaaagacaaatttaaaaatgtaaaacaacgaagcaacctacattaatctactaaagacagaaaaaaaaagaaactactgcagtaacatgtgtgagacgaggcaggcatatgcatgaatctacgagcccacaagtacaggccaaatcatttggcacttcgagatcagcaaaaaaaaggggaaaattagacagatcgagagagaaagagatgggtatatgaggatgattaattagagccatgtgtgtatcataatcagagagatgtggtaattaatcaattactccaattaattagatgatgcatgcacgcatgtatgctgatttaattacgctctaaactcgtgggctggcagtagtgtcaggcaggggcacacggtgccatgtgagggcacgtgtacccacatgccaaaaccttaattaacgtgaacatgattgtcttaacggctaattaaaggcacgcagcctgtcagattgttgtcagcaatttcctgttttaattcaaaacgaaaaagacgatgtgcatgtgtgaaattaccaattttgttttcttttagtagtcatctccgtcgagctggacaccaattaaatttctaaaaattagatagtgcaaaacagtggtaaaaactacgcaagtgcaagtgaaaaataagataaggtttaaaacaggggaatagtaggaaaaaatagaagatcgaaaacttctttgtacgtaaccagctatctggagtattgatcggcaagcttaatttgaattaagcaggaaattaattaataccattctgaattaaatcggtcccgatcagacaatttgtgaccttaattaattagaatggctctcgcctggtcggcagctaattaattgtacttggcgaattaattagtgaaatgggccatttatgggcccaaaattactaggccagatagtccaatggctaaaattaagatctttgcatgcagcaatggtcctcttccaaacatctttatcttttgactagcacatccctcatataaccactttattaggtgtgaattgaccgctttaatctgaacattgaccgtaataattttcaagtataatttcactagttaattagtaaataaagaaattatagttgtactttctacgtttcaaattacaagacacttaaaaaatttttctaactcaaacttttttaactttaattaagggtatagaaaaatataataaaattttaaatataaaacaaatatagtataaaaatatattaacactatatttaataaaatatagtaattttcaagtataatttcactagttaataagtaaataaagaaattatagttttactttctacgtttcaaattacaagacacttaaaattttttttctaaatcaaacttttttaactttaattaggggtatagaaaaatataataaaattttaaatataaaacaaatatagtataaaaatatattaattttatatttaataaaactaatttaatgttatagatgtggtacaattttggataaacacggtaaaactcatgaaagtttaacttagaaaaattaaaatgtctcataatataaaaaaggtagaaataaattgatattcggtgcatagttatactcttgaagagggtccaataatccaattgaattacactgcaattactccttccgtatagtataagtcgttttgactttttaagtcaacatttctttaaaattcataaaagaaaacctttagcaacatctaaaacagtaagctagttttattaaatatatgttgaatatattttaataatatgtttatttcgtgttgaaaatgttactatatatattttaataaacttaattaaacttaaataaatttaactaacaaaacagtcaaaacagcttataatataaaacagatgtactggtatctatttaattaattaatttttacatatccatatatatttattaatactgcttaattaaataaacaaataaaacaataatattgcagcagtgggagtcggacctggtggacgcccggtacatcagggagctgggcgacgacctgagcatcgtccacctcaagctcggcgccgacgcctccaagcgcaccgccggcctcttccgccgccgcgacgtcgtcgtctacgagcgccgccagaccatggacgacggcacgctggtggtcgccgtggcgtcgctgcccaaggagatcgccgcgggcctcctgccccccggctcctcctccggcgcccgcggcgccggcctgctgctccagtccggctgggtcgtcgagaagctcgacgccggcgacggcggcgacggcccgccctgctgcgtcgtcacctacgtcgtgcagctcgaccccgccgccgggtggctgccccggtgcttcgtcagccggctcaacagcaagctcgtcatcatgatcgtcgccaagctcaagaagatggccctcgccaccatgcactccgccgccgccgacgacggcgaggtgatgccatgagtttagttaggaaggagagagatcatctggattaattaattccggcgatcgatcgatgtggcactgtggctacaagctcgccgtcgtcgtcgtcttcgtacgtgagtaaatacgattttgtagaagagtgtggtgttgcgtgtgtggaggtgttatttgtgacatgcgtcgcttgcatgacatgcgtttcagcatctctctatatataaatatgaactttgagagtgagaattgttaccgtgtgtatataaattaattaatgtgcttttgaattttcttgaagaaaggctgcatcctactccctccattacataaaaaacaaataagataggataaaaaagcatactcatatccatattcattgtactatgaaacgtcacatcactcactctagctagatccattgtactaggaatgaaaggagtatgtatgtggctaaatccccagctagacatctatgatggatcatctatcatatatataaaagacacgtgttagatgacttatctccgacagataaaaaagaaaccgttggatctataacagatgaacttatcgaaatttcaatatggctgcaggggattagatgatccgtaacagatgtaatgtcgcccccttgtttaaacttctgtgattggagtgaccaccgtcgtcagggctgcaggaat

SEQ ID NO: 60239 - DNA, 930 bp, Oryza sativa
tgtttttctcttcatgcgtctaaaaatttatgttttttttcctatgtgctaatcaaacgatagtttggagactttcttgtgtttaaaaatcccctaggaatccaataagtatgtcattctattgctacgtttttcctatttctatgtttttctcaattatgcgtttcaaaggggtacttaaaaggtttcaagacacaagaaagttttaaactaacgtttaattgatagaaaaacataggaccacaagggacgtgaagaaaacataacgtgaaacctggtgtttattttcttcctaaattcatctaaaatagcacatcttaactaatgaaaagtgaaactcaaaatgaaacgaggatgagccacatcattcgataaatattagccgttgaattcactataagacaaagaggataagtgaatcttggcagttggattagatggatggtaaacatagtaactcaagaggtttccggagatgaagctactagaaaatgaaagaaagaaagaaagaaggaaaagctaaagaataagcataggaaagtataaggttatgtatataatttagggtttgcatctattgtaaaaactattttacaaataaaccctcatcataaccaaagattcaccggtcaagattgagctatttagagcttatacaaaatgtatattcatttgattaattttatttctaacaattaattttaatatatttgacaacaaaattgctatagttgcatgcacagtcatggtcacccgaacataagtttaatgcttttcatatgaattcaaaattaaatcaaactcattccttaaaaccttacaaatatttgtatataggctataaagagcacgtgccgacaaaaaaaaacttataaaaaattgtaacaaatattaagctttttaattgtattatcataatattagtcatcc

SEQ ID NO: 60240 - DNA, 4717 bp, Oryza sativa
ttcgctgagagtaagtcaactgttcgaaaatctcaactactgtagaattaatccactaccgaattccttttttttttttgttgaagaattggcactactgatttctagacttcttcatgattacacagcactatcagcacccagacagacgaaaaagaaccagtccctcatcattggtgtgtcagctggtggagcttttgttgttgtgtcactgcttgttctttttacagttctgtttttcaggaggaacaaaaggccaaagctgcagccacaacccaggagcccatcttacggtaagaagcattggataaaaaaaaaatcatgttttttgtccatttgagttgaccaacacatgagctggcaaataaaattacttaaatggctgtagcttcatgggacatcaagagcaccagcatcagcaccccgcatctccaaggcgcgcgggtgttcacattcgatgagctgaagaaaatcacaaacagcttctccgatgctaatgacattggaactggtggctatgggaaggtaatatatagtatatttgttgaaacgggtatgtgactatctttagtgcctgacatccaaagcgataatgctgatcaattgcaggtctacagaggagtactcccaaatgggcatctaattgcagtcaaaagatccgagcaagggtccttgcaaggcaacctagaattccggactgagatagagctcctatccagggttcatcacaagaaccttgtcagccttgtgggattttgctttgaccagggtgagcaaatgctggtctatgagtatgtgcccaatggcacactcaaggacagcctcacaggtgtgtccatatgttcagttatgcatgactgaatctgcaattctcctttgtgaaaataaacatattctgctcacatctttttcagggaagtctggggtgcgcctagattggaagagacggctgcgagtagtacttggtgcagcgaaaggcatcgcgtacctgcatgagcttgcagaccctccgatagtacacagggatataaagtcaagtaacattcttcttgatggaaacctccacacaaaggtttccgactttggtctctccaagcctctgaaccaggatggaaggggtcaggtcacaactcaagtgaaaggaaccatggtgagtttcacagctctcttaactgcaatactgcaacgattaagcacattggatactgtttcctggttatttttcatcaactctgtaagatgagtatacagagctgtttaaagattataaaatacttgtcatgtagggatatttggaccctgaatactacatgacccagcagttgaccgagaagagcgatgtctacagcttcggtgtgctactacttgaagtgataacggcgagaaagccattagagaggggaaggtacatcgtgcgtgaggtgaaaggtgcaatggataggaccaaggacctatacggcctccatgagctcctagacccaatgctagcacccacgtcgctggccggcttcgaactgtatgtcgacttggctttgaagtgcgtggaggaggcaggaatggaccgcccatcaatgagtgaggtggtggcggagattgagaagatcatgaagatggcaggcgtaaacccaaaggtcgactcggcatcaaactcgatgagctacaacagcaggacaccgcgtcatccatacagtggagagtctcaatttgattacagtggtggcatcccatcttcgtccagggttgaaccaaaatgatcagttcggtcggcccacaatgatctccatgtaaataacttggcgcttgtttgtttgtgtacagttcatcaaggttctgaactgcttcgtacagtgactttcttctggaatttctgtatgattaattagctaacaatctgggtgtgtaagttgttgtgctagaaatctcctgttggtaatgccttttatatacgacacttttttagtgttatctgtcatatatatgtttaacgattctatggcgcaaaggggatttggggaatttgcttctccagtattataaccaaataaccaaagaaccaaaatttttcccaaatgcaacaggctgacactgagaagatgagcaattcatcatcattttcctttccaatcgaccaacggtgtaatctagactgcgccccacaaccacaacattggttctgatttcaccgattccagaactaatcaaacctcataaaccaaaatacagtaagtagctaaactagtactgatagtggggataaaccgatcgcgcgacaaaacgggtcgagatctccgtaatctagtaataaatcgatcgcgcaagtagattcagattgggggttagtgaccatggcgggaggacgtagggggcttacttgggatctgagatggtgcggcgcgcctcctcgtcgaccgaggcggcgcgcgccggagagggaggcccgcgacggtgggggctggacggaggcagacagcgggcggcgccgcgggatggaagtggaaacgtggcttagatctaaggctgtatttttctgttcctaacgttcctgctaattttttcacgcgcgttttctaaattattaaatagtattatatttttataaaaaattatagtataaaatttgttttaaaaattcgtactaattttttaaaacttttttttctagtaagtactccctccgtcccaaaatataatacttcatccatctacttttgacagtcatatttcatcttggcacacagacaaaggataatcaattctacttatcatctatttaagcatactactagtcattcctcgtaaacaagcgattcattaatatttacatttatcgatgcccatatagccaatcttgtgtggaagaatagagagtcacgtgttaaatatgagaaagtcattaagatgatagggtgctagattgaaatatgcctatcaaaaataaattttttagattaggaaatatgcatatcaaaagtaaatgtagggagtaacttctagcctctagaatttgtataaaaatataacaacttttacaccaacatcaagatcctctattatttaattttcccacataccatcatttctcatccaatcacaaccctcttctatctaattctacataatttcttaataaccacgtccaactttaaaaatacttacattctgggacggatagagtagttaattatgcattaattcatcctatcgttttgaatatccaactaatacctcccagcacatcataaattctaagggggtgtttagatgaaggggtataaaattttggcgtgtcacatcaggtattatatagggtatcgcatggtgtgttcgggcactaataaaaaactaattacataattagtttactataccaccatattgttaagcctaattaatctatcattagtaaatgtttaatgtaccaccatattatcaaatcatggagcaaataggtttaaaagattcgtctcgcaaattagtcacaatatgtgcaattagttattttttagcctatatttaatatttcatataggtgttcaaacattcgatgtaacaagggtgaaaattttagggtgggatctgaacagagcctaagtgtagcttagagcatgatggtgacaattgtttccataaattctaataccaaaatagcaaaatctcatatcaaattctctaaagagtatttatgatttaaaatcacgttactatctaatggatggatcaaaactttgactctgtaaaataaaaatataggccaccctaaattaacaataaaataaataactttatctaatgagttagtttcaatagtttgaaggaaaaagtacacccaaggtccctcaacttgtcatcgagatacaaaatcatcctcaaaccgcaaaaccagatatcccacgtcccttaattaatcaaaaccagtcacaagaggtccctcttaatcccggtttggtcctacgtggctgccgagtccagcgtgggacccatgtggggcccacgtgtcatggtaatccacgtcatcacccttcctttttctcctcttctctctttcagggagaggcaaagcggcggccggcgggtgcagggccagaggccagcaggagagaggagggcgacggcggccggcgcccagcggcggcagctggcgggaaacacggcgacgcggcggccccgacggcgatgtcatcgactgcgtgccgacgcacctgcagccatccggttcgggatgaagcagccacgcgtcgccggcgtcgtccgccgcgactccaccaatgacgaccgcgactccacctgctcgtgcatgccgaggcggcctctgtgccgacgctcctcctgtgcgtgttcggctgcccctggcgagcgacgttagactctgcttcgcggcggccgcgccggaggccgtggacgtgccgcggctggtgctccacttcgacagcgctgggtcatggagtagcagagcttgagcacgggggcagtgccgcagaactcagggattacgtcgcagctgaacccgaacctgagatccacgcaccccttcagctcctccaggtcgtcgtcgactcgtcggtcaggctccgcgcgtgccgccgccgccgccatcgctcccgctcctcgccgtacatgcgccgccgccgaagacgacgacgccgcagggcttctccttggcgaccaccaccggcttcgtccgccgtggccacgccgcctccaactgtaccccgcacca

SEQ ID NO: 60241 - DNA, 2282 bp, Oryza sativa
tgcgcaataaatcgagtttaattatagaaattcatttaaatggctcaaaccttctaaaattcatatctaattcattcggactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattctccttgagcatgttgatcccaatttataaatgttttaccgtttacaaataaatatgcatgttttgctaattacacggggtcagggtttacctatctgctcgcttgtgccatgtttacttgatatctgttctttgtcaaccttgggtaataaattgactagctcgtgttacttatgtgacctagctagaactatatgcttagccatgcttaattaccactagctcagtcgatgggataattgcagttttagacattctagtatcttgttgagccgcgtgctcgagacatctggccatgttttatggtcgtaattatccaactaaaatgcgactgaatggtgggctgtgggtgcatggttttgcgagtcgcacccatagcaattaaggaccggttcacgggaaaccctagaagacttacagcgcttgccacaagcgggagtgggtaactgcttgatctgaagtatagctcgaccctttcctaggcaccggtggcgagggtgggcgtgatggagttgggtcggccggggtgtccggttgtccagctgccggattcaccgcggcgcaagaggggaccgcccactgcctttttaggggtgggggtgaaaccttagcgtggtgtggatggttaggggagggttatgcgaagggtctcgtcacaatcactcgacgtggtgacgtgtgcatcatgggcacatgatgacgcggtgacatgtcggtgggttgtgtcttgtgggtacagttgtgcacctctggccagagtaaaactattcgaatagccgtgcccgcggttatgggcgctcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgctaggatcgccttttttcgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgtgacaattggtcctgaacatataaacgcatacattatgaggtagtgtcatattcttgattagattaaattggcacttgttatgaaacgagaccacctgtgggtatttgacatgatcaatggttgtatccgtcgtaggcgtggtcacatcatcggcagactttgtcaattaataccaatacttgcacacatgggtgcgatgttttcaaccggaacgaaaaagttcaaaaagcagcaaaacatgagttttggacatcatggatcggattgggtgcgtccgtgttgaaaaattactccgttactcgcgcggccaatttttgtcaattaatgctgatattgacacacgtgggtgcgatgtttttaaccggaatgaaatgttcaaagagctagcaaatattggcctatgttggcacacgtgggtccgttgtttttgccaattaatgtaggtattggcctacgttggcacgcgtgggtgcaatggttttaacctgaacaagaaaaaacagttaaaaaaccagaaaaacatgagattttgacttattggaatggattgggtgcgtccttgttaaaaattcactccgtgactcgcgtgacaaactttgtcaattcatgccaatattggcaa

SEQ ID NO: 60242 - DNA, 11253 bp, Oryza sativa
ttgaaaaattactccgttactcgcgcggtcaatttttgtcaattaatgctgatattgacacacgtgggtgcgatgtttttaaccggaatgaaatgttcaaagagctagcaaatattggcctatgttggcacacgtgggtccgttgtttttgccaattaatgtaggtattggcctacgttggcacgcgtgggtgcaatggttttaacctgaacaagaaaaaacagttaaaaaaccagaaaaacatgagattttgacttattggaatggattgggtgcgtccttgttaaaaattcactccgtgactcgcgtggcaaactttgtcaattcatgccaatattggcacacgtgcgtgcaatgtttttaatcggaacgaaaaagtttagaaagcaccaaaacatgtgttttggacataatagagtggattgggtgcgtctatactgaaaaatcactccgtaactcgcgcagcgaaagtttgtcaattaatgccaatattggcctacattggcacacgtgggtgcgatgtttttagccggaaaaaaaaagttcaaaaaccacaaaaacatgagttttggacatattgcagtagattgggtgcgccctcgtcgaaaattcactccgtgactagcgtggtgaacttttgtcaattaatgtcgatattggcacacgtgggtgtgatgtttttaacaagaacgaaagattcaaaaagaactaaaacatgagttttggacatattggagtgtatttggtgcgtccgaatcgaaaaatcactctgtgattcgcgcgacgaactttcaattaatgctaattttggcacacgtgggtagcggaaccaaaattttcaaaatacacgaaagcatgagttttggacatattggaattgattgggtgcgtccgtgtagaaaaatcactccgtgactcgcgcggtgaactcttgtcaattaatgccgatattggtacacgtgggtgagatgtttttaaccagaaaaaaaaagttcaaaaaaaagtaaaacatgaattttggacttattggacgtacgtccgtgtcgaaaaatcactccgtgactcatgcggcgaacttttatcaattaatgccaatactgcactatattggcacacgtgggtgagatgtttttaaccagaaccaaaaagatcaaaaagcagcaaaatatgagttttggacatctcgtagtggattgtgtgcgtccgtgtcaaaaaatctctccataactcgcgcaacgaacttttgtcaattaataccgatattggcacaatggcacacgtgggtgctatatttttaaccggaacaaaaaagttcaaaaagcaccaaaacataagttttggtcaaattggagtggattgggtgcgtccgtatccaaaaatcactccgtgactcacacggcaaacttttgtcaattaatattaatactggactacattggcacatatgggtgagatgttttttaccggaacgaaaaagatcaaaaagcagcaaatcatgagttttggacatcttgtagtggattgggtgcgtccgtgtcgaaaaatcactacgtgactcgcgcggcgaacttttttcaactaatgccaatattggcctatattggcacacgtgggtagcggaacgaaaaaattgaaaggtacaaaaacataaattttggacatattggatttgattgggtgcgtccgtgtcgaaaaatcactccgtgactcgcacggcgaacttttgtcaattaatgccaatattagcacacgtggtgcgatgttttctcaccggaacgaaaagttcaaaaatcaccaaaaacatgagttttggacatatttaagtgtattgggtgcgtccgtgtagaaaaatcattctgcggctcgcacggcgaactttcatcgattaatgtcaatattggattatgtctacataactatctcgtagcaaagtgcgggctatcaactaattaaaccttccctccggcgtcaacatcgtcacaacgtcattcttattcgtgccaaatttaggtggctttcccagtttatccgcatgtccacaaattaatccctcatgctcttggcatttacccaccagacgatcacatcacccgctccatttgcaacggagctccttactctacctcgacttgcaaccgaccaatggtcgccgtttgttgggacatccatacccatgcattctggatacgctcttctctcctccgtcttgctcgtcctcctggcgctctccatcatcacactagtgccacgcatgccatcaccgcagtcgttcttccgatctccaccgcctcgcctgatcaacagtagggttcctcatccatccgatgccagcgattgtattttctccgacggtaaatgggtgagggacgccgcggccgtgactgcttaccgggaggactgcccgtttcttgaccctggtttccagtgcatcagcaacggccggagcaactcgtctttccgctactggcgatggcagcctcatggctgccagctcccgaagtaggtagccatcgccaatgacatctttgataaattagtaatttcttttctgtggtttttcatgatgtggacatttttcagttacttgcattgccactcattcttcaattccaaatgatttgaggtgtttaggttcaatgcaactgatatgctggagaggagccggaacggcagaatcgtgttcgccggcgactcgatcggccgtaaccagtgggagtccatggtgtgcatgctcgccgcctccgtgccagcggggaagtcaagaatatatgagcagtccgggaaacccattagcaggcacaaagggtacctcgccatggtcttcgcagactacaacctctccgtcgagtactaccgcgccccaatgcttgtcatgatcgaccgcttcccggcaagcagcggtgccgtcaggggagcggtccggctggacatgctgcctcggcacgccaaccgttgggctggcgccgacgtgctcgtgttcaatacagggcattggtggaatgagcacaagactatcaaatcgtaatttgagccgtagttaattaattaattattttgtttctatgcatactatgttgtttcatttattataactgatccctaagtctcaaactactgccacatacatgttttcaggggaaactatttcatggttggtgatcggctgaacatgagcatggacatgaaggaagcattccgatggtccctggagacagtgaaagattgggagataagtagtacacgggttccaaatagttattttttcttcaggagttattctccttctcattataggtaagaattgttagtgaacgatacacacagttcacctctttggtgaattttaacaagacaaaacataatccttcatacaatttgaccattcgttttattcattttttttgcaaaataaaaaagaatataagccatgcttaaaaaaatatttgacgataaaccaagtcacgggtaaaaacgaaaaaataaaagacaatacatatttttttaataaaatgaatacaatacatatttttttaataaaatgaatggttagaacgtatttaaaaagtcaacattgtcatgcattaaaaaaatggagatagtacgttccaacgtagatatataatgcttttaaaatggattaaaatggagtagtggtggtgatgagtggtgaatctaccaccatccccatcactaactccctactttttgagtaattttatagtacattctacttgaagtatatatttgctgcagtatatggaagggtaggttcgatatttgttaaaaaatatgaaaagtgttgtttagtattttgaaattgaagtttattttcatccggattgattttccagttgtagtattttttctgtatctcgtcatccattcgtgatatagcgcttcttcagaatttatcgcgtgtccccggcgtccttgactcccgacgcacttgcctccagccccggcgcctctatcccgattccttcatgacaaaaaaaaaagttatgtccagatttcacccgatatgtctggaccaggaaacaactaaataacacgtgattttcagatggagctaatataaattaaataactattattttaggaaaaaaagttacctccggatttcatccggtatgtccggacatggacaacaatgaaaaaacacgtggttttcgggcgtgctagcataaattaaataactattattttaggggaaaaagttactaccggatttcatctgatctgtccagaccaggaagacaactaaataacacgttgttttgtggtcatgctaacataaattaaataactattattttagaacaaaaatatttacatccggatttcatccggcctatccggaccgggatgacaactaaataacgcatggttttccggtcatgctaacataagttaaataaataatattttaggcaaaaaaaagttatgtccggatttcatccggtatgtccggactgggacgaccaaaaaaaaaacatgtgctttttcggtcatgctagcataaattaaataactattattttaggaaaaaagttatgtccagatttaatgtgatctgtccggaccaagataacaaacataaattagataaatattagtttaggaaaaaaaattccgtccggatttcatctggtctatccatactgggatgataactaaataacacgtggttttccggtcatgctaacataaattaaatatctattatttaggaaaaaaagttacattcatttggtctgtcgggaccaagacgacaactaaataacacgtggtttccggtcgtactaacataaattaaataactattattttataaaaataagttaggtccggatttcttccggtatcccagaccgggatgacaactaaataacatgtggttttatggtcatgctaacataaattaagtaacacctattttagaaaaaaaaaggttacatccatattttatccggtatgtccggatcaggataacatgtggtttttcagtcgtgctaacataaatttaataacaattattttagaaaaaaaagttacttccggatttcatccaatctgtctggagtaggataaccgaaaaaacacatggttttctgatcatgctaatataaattaaataactattattttagaaaaaaaaagttatatccggatttcatccggtcggtccaaaccggtatgcaacgaaataacacgtggtttttttagtcatgctaataatataaagaggcaattgtgcttcagtccttgatttacaattcaattgtgattttactcttactttttagggtttgtgattttgcccctgtttttctgaaatgagtctgcccctggttttgacataagtttggtggcctgaaatttccaaattaaacgaataaagaaaatgttattattatttgtgaatgaccattctacccttggttcaatgagcaaaatcccgaattcctttactgtccgggttgcaagcgctgggttgcaagtggtggcggcggcgacgcgcggccagcgcgcggcagggaggagaagcggtgcgggccagcacgcggcagagtcgggcgcgggcagggaggtacggcagcggctagggctgtcaacgagccgagcttgagcgagcttgcctgtctaggctcgagctcgagccgagcctataaaatgttcgaactttcaaacaggctcggttcgagctcgatcaagctcgagctcaactactgagctcggtttttaattagaacattgtatatttcaaaggataatttttaaaaaatatttaatttatggtttatcatattagtataagaagaaaaaaaataaaataaacatataatgccaatacaaggcatacaaataacatatttgatctaccaatttattaaatagcaacgaaaaattatatattactaggcccgttagaagctcgagctcggcgagctttgggacaagctcgggctcggctcgtttggagctcgagccgagctcgaatcaagcctaggacgagtcgagctcaagtagctcacgagtctcgagctttctttttttacagccctagcggcggcggcgtcgtggctggcgcgcgcagggaggtgcggcgctcccgcggctgcatgcgcagggacggcctttggaggcgccgcgacgaggatgacggcgaggaagaggacattgccgtcgacgagagggactcgctcgggctgccgttgccggtggtgagcaactgctcatcgtcggagtgtgagtacatggccgagtcagaggctgagctggcgaagaccgaggaggagaagtgcgcgtcggcgtcgtcagcgtcggagtacgaaaagacgtcgcagtcgagcacgaggagcgtcgcattccatggtgctgccgacgccggaggagacgggcataagctgagtgttagtgctgcttctattattgtgcgtttagttagttgggatttgggatgccataaatacaatggtgatcgatcacgatgcccatgcacgctgtgggccaaaatcatccatgcaactgttcgtttatcaagactaaatctctataacgagcaaaaagtgcaaatatctgtcactttttaccttcttttttctaatcattagacattagtgttcgttttgctctagaaattatcattgaatgccaaaacatgtcaggggtatatttgtccattcaccacaaatttaacaccgctaccattaattaacaaagtaggggcaggcggctacttcatttcaaaaaagcaggggcaaaatcacaaaccctaaaaagtagggataaaatcacaattgaatagtaaagcaaggatagaaacacatttggccctaatataaattagctattattttagaaaaaaagttacgtccaaattttacgtggtctattcgtactaggatgacaactaaataacacgtgatttttcgatcgtgctaacataaatttaataactattatttttgaaaaaaaaaagttaattctggatttcatccggtctatatggaccgggacgataactaaataacacttggttttaaggtcgtaacaaattccctttttaatcgatatatgtacgtgcccgatccatttttttgttctctccatttgctgcttgctgcctgccggttgctctttgcttgctgctgccctgcctcctactgcctgtcattccctgtctgcgctccttgcccctgactgcttccgtcgcccggatgccctgcaatgctgctgccgcttcctgcactgctgctgccgcgcctgtagcagttgcgcccgggtgccctgaagccacgacccttgactgctccgcatccccttgccgctgcgcgcctctggccgagccaccagtggccggcgcccttctgcggctccgccccttcccacgcacagagacgtcaatcgtggagttggggaatttccaaagacctaggttttgggtgcgcgggaagggcagatggaggaaaggaggtcggaaaatcgaatcaaatcacattcgcggtggctatcagcggcggcggtagcgcatgggacgaaggaaagcgaacggaattctctcgggccggatctgaccgaataagagaacgcgaaaatacaaaaaatactccatgcaaaaagatagaaagacaaatttacccttttcaatttatactgtaaactaatctaaaggaaggtcggatgaatcgacaccgttacatcatttactaatctaaaaggaagatcggatgaatctacaccgttagatcgtttaaactacaagtatatactttgcatgtaccgtaaaaatcctctacatttttaaggtcaaaaagggtgccatacatgtcaactaccccaccatcaattctctacttttttggaagaaaatatgacagtataaatgtgaataccaaatacatacataaattaaaggggtgatatatacattaatgaaggtaataatgctttaatgctaattttctttacttaaaatcacattgcaacgcacgagctagttaattaatatatgcatatatttctctctctccatattatactgtacaatgtttttccattctctatattaattaaaaatgcatacaatttcaagtttatatatagttccgtacagagaactttacagtttaaactagtattaaaatgaaggtcaaaaaatgacagcaatggcacgtggaacacgggtggctcgtgtgctgaccatcgagatccagtgaccagcagtgaccaattcgacgaggagtactcttggatcaacgccatgatctcgaacgccatcgacggcatcagaagccacggtcgaaggaaagcccatttcttgaacataacgtacatgaccgaactgaggagggatggccacccgtcgcggaaccgggagcctgggacgccgcaggacgcgcccgaggactgcagccactggtgtctgccgggcgtgcccgacacatggaatgaggtcctgtatgcacacctcatgtcaatgggatatgatatcaggatacactagtacaaaaccctcgcagggaccggctgtatatgtgctatgtgcctttttccacctccacatgataaaaaaaatataaaactagcatatttaacaactatagttgtcggctcttaaaaaaactggtagtaatattgggtataattttatgctttctaaatgtttcttgaaactaaatgatttgaaatgatgatgagattggtatatgtgatatgattgccttacttccccttatgttgtaagggaatgatgtctatctatttatgttgatatcatgccatgattaatatgctttatatattgcttaaatgatttgcttaaattacgttgcaaatagtttgtgaactaaaatttgctttatgctgaaaattgagactacaaatagccttccattgacttagagctttcatgtatgtaagtttgatggtgctcttgccagtacattaatttgattaatgtactgagtcttgccatgtgttgttttatgttttgcaggattagacttagtttaatttgagtgatgcggttttcgactgcttcttataggatttgaacttaatgggggtaaacccctagtcggtgtgcttaaggattgggtagtcaagcttccgttgttctcttatatatttatttggccggtcggcctatgtaactattaagttgatgtaagtctcttagtccctttcgtcttaaatgtgtttgctatatatgtccatgcttaagatgaaagtgtgaatctagtgcacatcttgggaattagattcacatgagttaagaatatttgagatgttgtagatctttagccattttgtcaagtctcctgattgtgtaacacatctggtcgccgctttcgagtggtttgacgggcatatctcacgccgaagttgactggcaggctaaaggcccagcaatgtcttcaatattcttctctcgatgtgtcggatatttcattatgtttgtttgatgacttgagttattcacttcatctcttaaatataatgggaggtccggagagcctacgaaaactgccgccgcagctaagccgctgccgagccaagtcgagccgagccgccgctttaacccgttgctcgatagctgagttgcctagccatagatgcaaacctaggttcctactggcctaccgtttgtcgtaccggggctttaccgtgaatcgtgtctagcccaccagtttagcctcagccgttgttgagtcgttcgctcgtttattcgaacgaggtgtccccgtgtttcgttcgtccgtccgtgttgagtcgtcctttagtttagagccgttcaaagccacaggttccgtttgcctatttcggttgaccatttgggtgatcccgtgtcacgtagaattgactcgttgagtcggtatctcatgaggcttgcttgccagtaaagtgttaagaatccattaaaattggtttcttttgctgtttcagtagctctttagcttgtatttattgtgtgccttgtttgtcgcttagactctggcagttccgacgctccaatttattttgaagtggttgaagaggttctatcagctcaagggcaaggcaagtcatacagatatcattgatcatattgagcctatctgcaaaacccctgcttttctcttaaaattgcattattttataatgtcatgtgggaaggaatttacccgtactcagccttatgcttaccctgattcattgatagcctgggataataatttgattgtaggttgggctccgtgtgctgtggttgttgcttgaacaaaacactcggctgaccgtgagccgatgttgacgcacccagcttcccaaaagccgttgtaactataggctgttgctctggggttattccagatgcaggttgatgcttaccaccattattagtgctgatggtcctatattgtggaaaaacaccctcaggaaggaaaatcgatcccttagcttgatactcacttgatcatattagacaagcactcctgattggttgatcaaagcatgataaacagcatagtcaatccgatcttgcatattattgagccctttaggatctccttatggtttctcatttttaggcttggcatctttaggagaactcgtttctgggtcgtcatcagatagcatcgctatcttatacctctgaattactgtccctgatctagttaacacaaatgagtgcaaaaacttattttgcatttggttcatcatctgctcgaggtccaccttttgttctgctgtcaacttgtctagcgttatcgggacgatgttgtccgggtcaacattagttgacttgatatccaccatgatgaagatatgtcgaagtcggtcccactgagcatgccaaaagcatgttgatgcgaaaaacacacactggtctgagagatttgctttactctagtgcaggtcctaaattttgcttttgggttcaaggcgtgccagttggtttgatcctgcaaccaacaagaaacaaaggagccaaagttagatccataaacgatagccgatcggctggattgctgatgacgtatcgttcatatcaggctgatgcgatatggatcagattggcagtgaagtatatggcaaagaaaagattaaacctacgctattgcccgtatatatcagtaatatatgagataatccaagaaatgccattgacaagcgtctaagtcccaaaagtccatcgacaagtatgagttccaagaaatgccatcgtacaaacgattttgtcccaaaaatgccatcacagttagggttccg

SEQ ID NO: 60243 - DNA, 8965 bp, Oryza sativa
atttcttggaactcacacttatcattggcatttctgggatttggatgcttgtcaatggcatttctttgattatcttataatatataatgtaggcttcgaaatacgcttaaacctagtgattcggatagatcggacaacatgccgagatagtataaaccacttatatctaaaggtactttgaagcaaagattatatatattcctagcaaggccttaggcaaatctaacatgtattggctactgttctgatactaatttatactaagataccagtttagattaaaagcaaaatttgctacaggacataaaaaacgtgtaattagctgggagacaccgcaagaacggaaatatgctatagggcatcgcaaaatattggtaattagctgctggacacccgcgggattattttattatatccggagaaattggagagagaaaaaactgtgtaagtacggttctacccttcgaatttttttcttttttttctctatccttctctgttccttcttttccttgttcttttctctctcattctctctctgctcttttcttcaagcaagcccgagggagagggagagcatcagctacagcgcggcgaggcgcgggcctggtgcggcacctcggctgggacggcactgcgctgtcacgcacagggctaccacggtatgcacatgcacgctgcctccaaacctagctcaagcatcagtagcagcgggccaacgacagcagtagcacggtgggttagtgggtgtcgctttcagcacctccatgttctcacttgacatggccacacccatctgctccctgccacgccagcaccacgcgaccgacctcgcttgggcgcccatcctcatcgccgctccgcccgcgggacttcaccctcgtccaccacgtcggcgtcggggacatcgcttgaaggagaatgcgtcggctcgtcgtcctcgtgcgagtacgccatgaaggtggtggactgccgtgcgctctccaagaagggcaagctgggccacgccgtcgcggagaagcgcgttcttgtaagttcaagtgccttaatttggtttggtgattaatgacaaatctaataatatgagactaacgtttttatgagcttttctttgactagtctcgtttcgatatgaaaataaaaatgatgagagttgtcaactaggttatttcccgatgatgagatgtggtagatatgcattctttggtgatggaccttaatcatgataaggataaaatgcatggagataaaacgttatgtaccacttcttatctcctactttttgataggttcatatatatgatttccatgttattgttatataagtgtgagactaacgtttactcgagtcgtatcttatttagtctcatttacattaagaacatggagatcatgaatgtatgtgttttatgttggtctacatcattactacatatgctttctctatgtgtacaggataaacccccattggtcattctctaattatgcatacacttgcatctcttgtatatttatttgtatgcatatatttagggggagcaaatcctatacatttattgtgcatgttgtagatccatgttgttcacctattatttatattggatctttgcatttaagcttgcatgtgagtatatgtcaattgtggtgttaatgaataatgaatactcaacaaacatattcatatctttcatatgcaactggttggtcatcaagtgcaagatgacaaccgatttgttgggactaatgttctcctttgagctgtgcaaaggaataggtcccaccgtgatgaggctaatagatgacaccatggtttgatgatcaccaagccaaggacatcgccatgttgacaagaatgaagtcaagattgtgatgagatgaaagtcttgacaaaggatggtcaagacctaggcataaacaagattcaactgaatagtcacatgtgttgatcttggttcaagcattgaccccaagttggatggcacaaggcaaaggtataatcgagcgaagatgttttcttagtctttttcccggtcttcgtgtttggtgtagaccggatttgctagataggcgccatactatcaagaggggtctatgaagcgagcacgtggatgatcttgtgccatattagttcatatgaatgtaggagcatttggtgggcttgtctagccatgtgtgatgagttttctcatgtcctaaacaaagagagaagtgagcaagtccaataggagcgagtgacatcttgtgggtatgtctggtggatatcctttggagtgtgagccctttatccttgacttaagttgtgtttcttgatgtatttttcatgggttggatagctccttgaataatctttccatagagtccaagaacatcaaattccgagatccaagtcaagagatatcgtcattttactgtcggtgggtcgtgctgaaaatcggtcggcggtcagaccgaccttgtgtagccggtcagacctcccgaaggccccgaaagcccgccaacggctagtttttttgtgcgttggactgagggccggtctgaccgggtttagaagggcggttagaccggcaagcacgtcctaaaaggtgttttagcctctaacggctagttttggtggttgggggtatatatacccactccccagcagcaagggtgaagttttggcactccattgcattatcttgaacccttgcaagagctctcacacccttgtgcacttagtttatctagtgaggtgttagagagtaagttaagccaatccaagtgcattgcttcattgttatagctagtgtggcacttggtcatcctcggcaagcatcctagacttgttactcttggaggttgccgcctcctagacggcttgtggaggtgttgcccggtgacctctcaaaggagattgtggaggaggcccggtgccatttgtgagtggtttggagttcaccaccttcggagtgaaggaagaactaccctagtgatcgaggcttgggtagtcctctccgtgggccggctcccaccatgcccaccccttgacgaagggggcgtgcggtggcttcgttgttgagcggtggagttgggctcgcctcaacggggattaggaatctggcgagtttccgaacctcgatgaaaaattccttgtctcttgtctcatttatttgttgcatttacatttgtgcaatttacatccatagagacatatttgagcccatatcacctaggtttgcaaaacttaacttagttgcttagttaaccttgcaccttaccttgcttagcaacttaggttagttttgtttaagtgccattaagttttaaaaccgcctattcacccccctctagtcggcctccttgatcctacaagtggtatcagagcttggtttctctttttatggacttaaccgttccgagagaaaaggatggcttctagagatatagtccacccgggtggtgaccctcttatatttgatagcacaaattatgcacaatggagaattcacatgatttctcattttagggccatgagcccaaaaatatggtggattgtagatgtgggcttttctcatgctttggatgaacgtgctcccacaagtgggcaagagaaatgcctacatctcgatgctcaagctactaatgctatattttgtgctttgagtgatgacatttttagtgaagtatgcaatctcaagagtgcacatgctatgtgggtaaagcttaaagaaaaatatgaaatgcccacacttgttgagaatggttgcacataaggacggatgtcgggtgaagacttcacctcctcaagagatgatgaggagctcccaacaccattcacatcatctcattacttaatggcaaatggtaagaatgaggtaaataaagattctcttgatattactattgaaagtagtaatggtgatgatgatgatgatgatgatggtgatgagccttcatatgatgaagttttggacatgcttagggaggctagtaaatacattgccaaagagaagaagaaaaattaaattttagagaaaactcttctctctttgaaagactcaaatgtggagctaataaattcttataaggaactttgtgattcttataagaacataaaagaagcttatgagtctcttctcattggcaatgcatttagtaagccaaaggtggacataggtatcatatgcaatttaattgatgatgatatgccatgtgtagctagctcatgcattacatctaagactaatatgtccacctcttgtgatgacttgcaagacataccttatagctcaaacatagatgaaaactcttgttcttcctcctctatgtatgttgttgctaaccttgtagaggaaaacaagcaattacaagccaaagtcaaagatttaaaagaagacttggatagaaactacataaggaagaacacacttgacgaaatcctaagcaagcaaaagagctcaaatgacaagtgtggacttggcttccaccacaaggagaatgctaagaagacaaggcacatgcctagatatacaaggaagcatgcatacttaagaaaggatggaaagaaaaatgtgagtaagaaccatcctcacattacatgttgtggttgtcatgagaagggacactttgcctcgttgtgccccaaaatgaaggatgaaaagtacaactccaaattgagacaaactggcaagaagacaagtcatagaggtcaaagcctaacttgctacaattgccgcaaaaagggatatattggtaaaaattgtctcataggtaatacttctaagcctaatattatttttgatgattatgtgcttaggaaaaataggcaaggcaatgtgtttgccagttatgttggtttacctagacttgcacctagaaggaggaccatttgggtgccccgtattttggtaactaacattgatggacccaattttgttggggaccaaaatgtgccaaaatgagaatataggtacatgagaggcattgaagttttggcctatgctagaaaatgtgattctcaccaagttcaagaattggagccaataatgaggatgaagaattcacatcaagaaccaatgccatctcggtaacatgcttttggtttgtaatttttttatatagccttatgtatgttgcattgcattctcatagctctttccaaaattaaatttccctctcgtatgaaaatcgtcatatatgcatgttaagcataataaatgtggcatatgaagctataggtttggtcataatcacacatcatgtttgcctcatattgcttttgtgcttattgtcaatcatttttttatcttagttcgatcttgagtttattttcctatctttgttgagatgaagagaatatcacattaaggaaaagtattgcatttcttgcatatgcactacaactcttagaatgtgaacaaagtgatcaaagtgcaagaaaggttttcaaaaggtccattttgaccaaaagtcaattttttgagaaaaaaactataattcttgaaaactattacatggaaaatgtttcaaaaggtctctaatatgttttccaaactttagtttgcaagaaaaaatatttgtaaagtaaatatgcatttttgactaaaattctagtttctaggatcttgttttggagcaaaactatttttctctctacaaggatatctaaagggaatttgaaatggagaccaaaacaagttagatagagttggtcatttcaaatgtttttggtttttgaaccttatccgaaagaccaacctattaaaagaaatttgatgtcaaaactcaccaaaaaatttagctagaccatatatggtcactttctagcacttggttgagtttatttcttaaacctgaataattgcatctttttggctcaaaatcatatttgaacttcatgcatattaatttctctcaaataccatctcatttgcttcttttcgcatttttagaggaaggtatttgaaaagagagcttttgtgtccgtttgctaaaacttggcctttactatcaaatcttgaattcagggagtagaaatgagagttgcattaatggggaacaatctgaatcaaatccatattccccttgctcccaaatatgaatttttgaaaaaagttgtatccatcgcctttgaaaagagcctaatttggtgaaaaagtcaaaaatcttatttaaatggcccaaatttgtgaaaatcctttcaaaagtatccaaatatgtatttcaaatgttttgcaaggctttcgaagtaaaaattttcatttgtgaaacaaaatagcaaaattggtttcaataggatcttgtttttgttgaaaatgttttatttccctaaatcaaaatatattgagtttttggaaaaattttctatacaaaacttttagagttggtcatttcaaacatttctctaattcaaagttctcccaaaataccaaccattcaaactatacaaccatttaaatttcagccaaaatcttgacttggccatttttggcctaaacttgcatatggtgtgttaagcctttagagtcaaagttctttgtgaatcttggcttggaagtgtatttataaccctcctaaggctttacgaatgtcaaactccatggatttcaaatttgaatgtgatttgagctctcaactcaaatttactcaccctaaaggcctacaatgcttattttgtcttatcttttaatataaaaatgatttttaagaaattatttttggaaaatttcctcacaagtataaagatcatatatgcaaggtttcaactcatttcgatttgatttgcaaagattttgactttttctcgttttgctcagcctgctgaaattttcagaacaaccatgtttttgggcagatttgtgattttcgtatctccaaatgggttgcaaatttgaagaagatcacaacatgagttttgatcctctatagttgaaatttatttcaaaatttattcagaattgttggaggtcatttatctaccttttcaatgttgttttaaagctaatatgaatgtccaaaatctgaaacttccagtttgctgaaactttgagacgtttttatctctaaatgggttgcaaactaggaggaacttataatacaacttttgatcctaaatagttgaagtttgcttccaaatttactcaaaattttcagtggtcatttggatgccttttcaacctcattttcaatctcaaaaatctgaaaaagtctgaatttttcagttggctgaaagcttttgagcttcatttcttcatgttaattgtgatctaggcaatggtcccaaaatgaaacttgtgcattcttttatgaactatctccggggtttatggcatattttttcgagcttggttccacaggttcctattgttaaaagatgccaacattgctatgtgctttttcatctaaacatggatttcaatgtgcatatcatttcttgtttattatttgagcatggtggtgaaatataagatatttcaagtaatgagctctttgttattttaaaaacctcatgaattcttgaactcttttagtttttgaaatacccatgatatatgaaaccacctaaactcaaaagtcatttttggatttctcaaaaccaagcctccatggatagactccaaattccaatctttgccaccaaatacaagttgatccttgctaccaaagctaactaccattccttcatcccaaattcgaattcctatacacaagtggtctctaaacaaatggtagtttatcttgatcatcttgaacacggcactagctcatcattttcattccttgccgatattgtgcacatgtaaaattcttccaaatagccttgaccaagctcttctcaatttttgacattcttgagaaaacctttgatgagaatatctcaagtgaaagttcaagtgctcaaactaaccccttctacatatgaaatctattccaaattccatatccaaagacaaatatctataagtaagggggagttttcctaaatgggcaatttctaaaatttgttgctttgtgcttccataaaaattttatttggccttgtgggtctttattcatttttgggcttttgtaattgcctattttctaaccctttttcatttttgggtgattaatgccaaaaggggtagaatatttgaggatcccacatttgatcttaaagggagagaatatttgtgatatccttatgatcatagctataaaaggggaaaatattctaggatcccacatcatagcattacatatgcatcatatgcgtaagcatgtcattggcatatatatcactcctatttactcaatgacatgcatggatataaatcaattgccaagcttcaatacaatgataatctatatacttcatatccaaatgtggttattattaatgaatttgtcatcaatcaccaaaaaaggggatattgtaagttcaagtgccttaatttggtttggtgattaatgaaaaatctaataatatgagactaacgtttttatgaacttttctttgactagtctcgtttggatatgaaaataaaaatgatgagagttgtcaactaggttatttcccgatgatgagatgtggtagatatgcattctttggtgatgaaatgcatggagataaaacgttatgtaccacttcttatctcctactttttgataggttcatatatatgatttccatgttattgttatataagtgtgagactaacgtttattcgagttgtatcttatttaatctcatttacattaagaacatggaaatcatgaatgtatgtgttttatgctggtctacatcattactacatatgccttctctatgtgtataggataaacccccattgatcattctctaattatgcatacacttgcatctcttgtatatttatttgtatgcatatatttagggggagcaaatcctatacatttattgtgcatgttgtagatccatgttgttcacctattatttatattggatctttgcatttaagcttgcatg

SEQ ID NO: 60244 - DNA, 1097 bp, Oryza sativa
gcattgaaaaagttcaaaaagcatcaaaacatgaattttggacatattggagtgtattgggtgcgttcgtggcaaaaactcacttcgtgattcgcgcatgtacttttgtcaattaataccaatattggcatatgttgagaccccacaggtgcgatatttttgacctgattgaataagttcaaaaagcaccaaaacaagatttctggacatattggagtgtattgggtgcgttcgtggcaaaaactcacttcgtgaatcgcgcgggtacttttgtcaattaataccgatattggcatatgttgagaccccacggctgcgatgtttttgaccggattgaataagttcaaaaagcatccaaacaagaattttggacatattggagtgtattgggtgcgttcgtggcaaaaactcacttcgtgattcgcgcgggtacttttgtccattaatgccaatattggcatatattgagccccacgggtgcgatgtttttgaccagaatgaaaaagttctaaaagcaccaaaacatgaattttggacatattggagtgtattgggtgcgttcgtggtaaaaactcacttcgtgcttcacgcgggtacttttgtcaattaatgccaatattggcatatatttagccccacgggtgcgatgtttttgaccggaatgaaaaagttcaaaaagcgccaaaacatgaattttggacttattggagtgtattgggtgcgttcgtggcaaaaactcacttcgtgattcgcgcgggtacttttgtcaattaataccgatattggcatatgttgagaccccacgggtgcgatatttttgaccggaatgaataagttcaaaaagcatccaaacatgaattttggacatattggagtgtattgggtgcgttcgtggcaaaaactcacttcgtgattcgcgcgggtacttttgtcaattaataccaatattggcatatgttgagccccacgggtgcgatgtttttgacccgaatgaaaaagttcaaaagcatccaaacaagaattttggacatattggagtgtattgggtgcgttcgtggcaaaaactcacttagtgattcgcgcgggtacttttgtca

SEQ ID NO: 60245 - DNA, 1704 bp, Oryza sativa
gcgagccgccgcgcgctgctcatcttccacaggccgccgcacaccgtggcctcctcgccggtgaagactcggaggtaatagaggtagagaggggagaggtggacgccgccgccttgccgctcctactcgcccgccgccatcctcgccacgccgtttcccatccaccacgccacgccgctttcccatccgccaccccactgcgcggcgccgcccctccgctggccgctgcctgtctcctcctccccgtgcctccgccgccgcccaactccaaggcctcccccactggcgtcgcggccctcgcacggtcgccgaggagctcggccgggctgccgcggccgccggccgccgtcgcggcgccgcccttctctcccgcctcggcccgccgaccggcctcaggctgtcaggcacagagagcgagaggagtaaccgaggaagagggggagagtgactcagcctgataagtcgggcccacgtggatcccatgctgactcagctgccacgtaggataaaaccggaatcggatccaccgaaggactgaccggttttaattagttaaggggcgccggatatctggttttgcagtttgcggatgattttgtaactcgatgataagttgagggaccttcggtgtactttttccttgtttgaaagggccaccgaaactgggcctcgactaggcccaattgcctcggaatttgaccagcccaataccgaagtgttaccagtacacaccaccctcttcacttcgccgccgccaccgctggcgacggcgaccgcgagcctccgctatccgaccttacctcgccgctgccgctgccgccggctgggagagtgaggggcggacgcgcggaggacggtgcaggcgcttcggttacggtcggccgaggacctgcagcgagttcggttcgatccgtgagttctccagctcgtcctcttccgcgactagaaaaaaaactgtgttatgcattctgatacaacgagtctgtgagttatgtgatgtttgttttgaatcgattgcaattgcctgtccctagctctactagaaatttactgaaaatgttaattggttgtgcacttgtgtgtgatgcattaggttaaatttagtggaatcgtcttagatcgatcaggttggtggccacattaggatggatggaactcaatggcaatcgccaatttggcatgtctgttcagttgattgttgcatattattattattgatgcagtaacggagctctgaagcttgaggatatacactgtgggagctagggtgataggaacacactcaatttagtatctctgttgttagaatagaagtggtaaaatctgtgacatgttacgaatgattttaggaagaatgatggtcttcctcccatgattcatgccgagactagccggaccatgaagctgtcttttgtttagtaaaagtctagaattaagaactgcaaaaggttacacttgaggatttcttttttttcgcggcgctatctgggttggaatattctcaaatgcaaatttttgtgatggagaactggtgaatccttgattccccttgtttctttgataacttttgtgcaagccaaaaggaagagagaggaacacctgagaacagtaggtatgggaggcattgggaaaacacgggaacatattgtgatccctaattttagagggaaatgatggtcgaggctttcctccatgttcccatgc

SEQ ID NO: 60246 - DNA, 5130 bp, Oryza sativa
ataaggaggaacttggattgatccatgacaagccatccgataagaccacaatgcttcggctaaacgagtatgccattgccgaggataatcagaaatcttccttttaatcaacttgatcaaacttttgttagatgcctcggcttgcccattagcttgtgcataatacggtgaagaattcaacaactttatacccatactatcggcaaactgaacaaacttatcagacacaaagattgaaccttgatcaatcgtaatagtctgaggagtaccaaatcggtagattatatgttcttggacaaactgtattgcatccccagaatcagccttcttcaaaggaatcgcctctacccatttgatgaaataatcagttgccaccaatataaacttatgtcctttactcgatggtggattaatcatgccgatcatatcaattccccatcctctgaatggccatggtttaatgatgggattcatagccgacgccggcgctcgctgaattgctccaaatttctgacaatcttgacaacctttgtaatatctgaaacaatcttctaacatcgtcggccaaaaataccccgcacgccgaagtaaccacttcatcttatgagccgattgatgagtaccacaaattccttcatgaacttcgccgattgcaactttagcctgataagcactcagacacttaagcaatactccatcaatcgttcgataataaagctcatcatccaataaagtatatttcaacgctttatatcttaacttcctataagccgactgggatggattttgtaaatattgatgcacatcatatctccaatcatcggccgtcatggcagcaacttcaatctgaacatccttgatcatcggcttatatcccgatgccccttgagctaaatcatagacctcaatattctgctctcgagatacatgcttcaaagttactagccgaaactccttcatcagtttttggcacttctcattataaactatcaacgtatcattcttacactcatattctcatgccaactgactgattactaacaaagaatcccccatgatttcaacagcatcggcttcaacctccttgagcaattgcaaccctttaagtactgcctcatactcagccttattattagtcgcataaggtttgatagtataagcaaactcaaaacatgccccccgaggcgaaattatcctttgtgtagacgttcgaatcctccacgacgccctcaaaataatagcttgggttctccatcttcaattggctgtatatcagaatcggatacttttaaaaaatctccatcccaaacttttccagataaacaatcaaggccatccatctcccaaagagctaaatcggcacaagcaacattgactgacctgtcggctggtacgatctctatcttgttgccttgccattgaatcaagcattggtgcatggtcgaaggaatacaacaattagcatgaatccaatcccttccaagcaacaagctataagaacccttcccatcgatgacaaagaatgttgtagggatggttttactgccgactgtcaactccacgttcagaacccctttggtttctgatggattgccaccaaagtctttaagcaccatgtttgtcttgatgaggttttcggcgttcctacccaatttcttgaatgtagcataaggcatcaagtttactgcagccccaccatctaccatcatcttaggcatcggcttcccattgacataaccgtttatatacaatggtttaagatgccgattctctgtcccctcaggtttctcgaacactgcttgttctggtgacaaccaacttagccgattcctcttccaccttgtctacatcggcttgatcaatcccaaattcggctggcaatgtaaaaaccatgttaattggtgccactacaacactcttcccttttgccaacctctttgcctcatcggctacaacatcatcggctataggaatctgattcttaacacgcaattcctgtcttggttttgctttcttcagccgatggttaatttcttgttcaacctcctgaaggcgctccctgttcctcaatctttgaacccttctcttctgattcttcatgaaaatactagaaggacaccattgatttgtcctgactacgtcatcctcctggccacgaccttgattcactgggcccaatctttgacgaacagacactctttcctgcctcagccgattactcctattatatgactgacttgagctctcaatgatatcattgcacccaaggtagttttcgatagacggcaacctcatcccttcattccagcagaatctaaagaactcacaaccccaatgaggatcaaaaccatcatcgtgttcttcataatgcttctcctgctgcttctcatacttcctctgatatttgttgattatcttagccgaattcacttgaaaaccctttgcacggacgctatcggctgattggccagctgtatgtaccatattaacaggaaaaggattaccatcgaccttcattggcctcttcgaatcatcaaacttgatttttcctccctcaatatccgtttggatctgctgcctgaagaccttgcagtcattagtcgtatgagacccagaattatgccacttacaatacctctttttgcccaactcttcagccgatggaattgtatgtccagcaggaagttgaatctgtttttctcgaactagcaaatcaaatatcttatcagccttagttatgtcaaagtcatacctctcctcttttcctgagtttttcacccattggtaaggtataacctttttgctcctaacccactcagctgcagctatttcagaatcatcatcctcaccatccgatccatacatataaggataaacatgattaatcttcctagagttcttcctagcttccgcgaacctttgttcatgcaaacctaccttctgtgtaaggtacgacaagctttcggaatcttcagatgagaatttttccttgatcggagcaatcatcccttaaaaagccaaatcggctaactgggcatcagtcaagctcaagctgtaacacttattcctcatttccctgaacctttgaatatactcatgtaccggctcatcatgcttttgcttgattgacatgagatcagacagtttcatctcgtgaatcctactatagaaataactatgaaactgcttttctaaatcggcccaactgttaatcgacccatgtggcagcgaagaaaaccaagtaaaagccaacccagccaatgacaaccggaataacctaaccctcaaagcatctacagccgatgcctcaccacactgagctaaaaatcggctaatgtgctcataagtcgatgtagtgtcttgtcctgaaaactttgagaaatcaggtactttgaaccagttaggtaaaggaactctttcaaaccattcaggatatggttgtcggtacaaatttccagtctcctttggtttaagcccaaattgctccctcattacatcacctatcacatcagcccatggtcgctgctgaggtgttgcttgagattgttgtggtgtgggctcatgtcacgaccggaaataacccaacgggtgttccttacgtgcgtgtattattccttgtcccaggaggcaaggtacaccaaaagttaatacaattcagagtttaacaagcggaagcgtaaatagttaatttattacatgggcagcgaaggcccagcacacacagagacaaacgagaaacagcggaagactaggacgacgaccacaggcgcttgacggcaggcacgagctagacaccaaagccttcatcttctaggggctcctcttctggggttgggaaaaattgagcaagactgagtacaaccaccgtactcaacaagacacacccacaagtgcagaataaatgcaagggagtacaaaggagttatactataaagggttagggtttgcagtaaacagcatttaaaggtacttagttgctcaaagctattttgtaaacacgattctagaactataccatattatttatcatggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattatactctgatcagaggtgtacatctttacccacaagacacatcttcctcacgtgcgaccacgtgccacataccaccacggtatacagacggaagacgtgacatagtttccaacccatcctagccatagacaagagtaccgacccaatcccacctatggccggaacccccgggacaggtaggcaggattgagcccctagcagcaggacaccagccctgtgccgtgacatctcgactaccgggccgcagctcgtgtagccttcatttatccttgagatgtccatcgacccccgacttcgtccatctccatccgtgtacttttgtttattaccaggctgagccacaaactaagccttacccactagacatgtggaagtacggtagtgctttgcaacagaggcccgaagaccggtccttatatggccgaggtgctactatcaaaaccatgcaccccgagcccagcctaaaaccatcttggggattttgaatagaaggagcggtgtgaatccaattccacaataatccaacaattccaaagtgtccagatgatatgaagattcccaaagtctagagttggaaaaccacctaatgttacctaattaaatagcgaagcatctacctaaaatcatactagtgataccatgagtagggtgtccactagttggggttttgtttattctagggtgaacaaggaaataataacaataacaatattaaggtcataacaaaggtaaataggcatggctaaataaagcagtgataacgcgggaatttaaataaagtgataatgcaataatttaaatcaacataattttacaaaataggattcaatatgttcaaagatgatgtgacttgccttgctcgctttcccaaacgccggcttcaacttc

SEQ ID NO: 60247 - DNA, 9288 bp, Oryza sativa
aatgacggtgcgaactcgattccgacggggagagagagcggcgagtggcggaaacggcggagggaggcacggggagtgtttatatagggttgggagggggagagagcggccggatgtgggggaatcggccgcggaagatccggccgccaatgatgcgccggcgaggtttagggggaaagatttcgaacgaatccgagggagagagagagggaaaaacgggggggaaagagggagggaatcacggggaatatttcccccctcttgattgcgcgcgggacggacgggagcggcgggattcgcggcggcggcggcgctagggcacgggcgaggcggcgggggcggcggaaggtaggggatgacgggtgggccccacccgtcagcgagggtggcgggcgggcctgcccgtcagcggcacgcgcgcggggaggaggccgattgggccgcgggggagaggagagagagggagggaggtgggccgagccggcccaagaaggggagggggaaaaaggactttttagggtttttctttttataaaaccattttaactttgtttatttcttcttaattattatttgtgctctgaaaattccactaaaatttatttacgcattttaggcttttaggaaatatacaaaaatcctccaagccttattcgacttttaactttgcacattttaattgttggaggctttcacatggattttacttattctatgcataattttgaggatgtattttagagtcgttttgggacgcgacagctcaaactgattgtattgatgaacaaattgaggttgaaccgatcctgcctgttggtactgaacttgaggtgatggaggctgatattcataactcaaattgcccccctggtaattgtgaaggtttggctgagtaccacgcgccaaatgctcaggaataacttgaggtaccactgaaccatctggttgcacatgatgaaccaggtgttccgggacaacctgatttgtagtgtactgcacaggctgaccaccaggtgttgcaaatccaggcaacacattcattgagccttgctgctgaatcggctgaacgacctactgtctcaacggcgtctgctgaatcggctgtaaagccagtcgccttgctggcgtctgctgaactggttgcacgacctgctggattggagatgtttgttgaataggctgcacaacctgttgcctgggcggtgtttgctgaatcggctgctgctgagctgaattaacagcattctgaggaggtagaaacacctagatgcaatctggtcttgtgttagctgagtcacattcggtctaggatgctgagattgctctcttaccaataattgacgattgattaattggcctggagccgacgacggcgctgcaggtgctggagctgatgctggtgccatcggctgagctgatgatgcaacaggaggaattccctgagtaagtggatgaacatcggtgatcaaagttcaataatttggaaaagtacccccttgcaaataaactgggcctgcagcctgatgttcagctattgaaccatcggctaccgatttcattatatttgacaaggtattagtcaacactccagattgattaatcaaagcactatacacaacatagtcaactcgatcttgaaagttattgaaaaaatcttggaatgcattgtcattctgattaagatttcccccttgtggtccctgagtgccgtcaccttgaactccatgtactccatggaagtagtcaccctggttctcctgggtcgacccatctgtaacgcctttgtcactcggctgggctgatccgtctggaacttgtttcttttctccctctttagaagaaccgatcccaggatcctcaagaaccaccttcaccttgtacttctgaacaaatgtgcccttgcgagtctgcatgaatgaacttaaaaattgatcttgtgcttgttgcatcattgcattgaagtcttccttctgttcgggagtgaacttctctggatcaatgggcacaacgtttccttcatggacgtcagtcaaaccgagcttctggatcttttccttaacattactcaggctggccgacgacggtgacagtggtggtttgtcacgtcctgataaattcatcccgaaataaaaatcattttctaaaaggaataatagaattaattaaaattcgaaaagaaattggcaaacactaaaatacgtacaagaaaaattcaaatgtggcccggagaatttttgttaaattctccttggtctaaaaggagccctcaaattttagtggaattttcagagcacaaataataattaagaagaaataaaaaaagttaaaatgattttataaaaagaaaaaccctaaaaagtctttcccctcttgggctggctcggcccacctccctccctctctctcctctcccccgcggcccatccggcctcctccccgcgcgcgcgtgccgctgacggacgggcccgcccgccaccctcgctgacgggtggggcccacccgtcatccccttcctcccgccgctcccgccgcctcgcctgtgccctagcgccgccgccgctgcgaatcccgccgctcccgtccgccccgtgtgcaatcaagaggggggaaatattccccgtgattccctccctctttccccccacttttccctctctctctccctcggattcgttcgaaaacgtttccccctaaacctcgccggcgcatcaatggcggccggatcttccgcggccgattccccctcatccggccgctctctccccctcccaaccctatataaacactccccgtgcctccctctgccgtttccaccactcgccgctctctctctccgccggaatccagctcgcgccgtcgctctctctgttcgccgtcaccgccgagttccggtccgccgccgtcgtcgccccggaccttctcccgcttcggcgtcgccttcttcgggttcgccgcaacctcgccgaccccgtccacccctccgtttcgcccgccgaccgccggaacgccgccgtccccgtcgacccgagccacgccgccgccttcctccgctccgatcgctgttcccgtcgtcgccgtcgacccggggtgagccgtggaccgctgtttcgcttcccccttccctcccctctctcgggcgccgctccgccgcgccggtggtcgccggcggcgaccatcggggcgcgggtgcgccgcctcctgtcggttgtgccggcgtggccgccttcgggcgcgtcccgcggctgccatgtggggcccggccgtcagccgcccgcgccctcgggtgcggctgacgcgtgggaaccacggcgccggccggcgtacgccgcgtgcacccggtccaccgtggaccgtgaggctgccgcgtgggccccactcccgtggacccggtccgcgcgcccctcccctcggctgacgcaataaatccgattttaaattaaaaatttaaatgaagaaattcgcaaatattcatttaaagaacatataaacttcaaatggccataacttggtcatttgaactcggaattggaccgttcaagtctctaatttttccttaagaagtcaagaacccatttttgtgctttgtttctgcttgttatatggattttattagagtaaaagcctttttcttttccgttggtcgtgtagacgctgcagcttcggaagatccgctcttcgtggaagttgaagccgacgtttgggaaagcgagcaaggcaagtcacatcatctttgaacatattgaatcccagtttgtaaaattatgttgatttaaattattgcattaccgctttatttaaattcccgcgttatcactgttttatctagccatgcctatttacctttgttatgaccttattattattgttgttgttattattaccttgttcaccctagaataaacaaaaccccaactagtggacactctactcatagtaccactagtataattttaggtagatgcttcgcaatttaattaggtaacattaggcggttttacaactctagactttgggaatattcatatcacctggacactttggaatggtttggttattgtggaattggcttcacaccgctccttctattcaaaatccccaaaatggttttaggctgggctcggggtgcatggttttgatagtagcacctcggccatacaaggaccggtcttcgggcctctgttgcaaagcactaccgtacttccacatgtctagtgggtaaggcttagtttgtgagtcagtctggttataaacaaaagtacacggatggagatggaagaagtcgggggtcgatggacatctccagggcaaatgaaggctacacgagctgcggcccggtagtcgagatgtcatggcacagggccggtgtcctgctgctaggggctcagtcctacctgcctgtcccgggggttccggccataggtgggattgggtcggtactcttgtctatggctaggatgggttggaaactatgtcacgtcttccgtctgtataccgtggtggtatgtggcacgtggttgcacgtgaggaagatgtgtcttgtgggtaaagttgtacacctctgatcagagtataatctattcgaatagccgcgccctcggttatgggctagccgagcaatgtacccaagttagtgttttaattcttaaaaccttcttaacaactaaaatgtggaatggttggcctgggttggcttgggacgagctgggacccagggtcgggttgccagttcggtctgaatcatcataggccttgggttaaggcaggttcatgtgggttcacgaccttgattaataatactgtgtagctttaggatcgtgtttacaaaatagctttgggcaactaagtgacttttaaatgttgtttactgcaaaacttaacctctatattattatccccttgtaccccttgcattaattatgcatctccggtgtggcttgctgagtactgtggttgtactcattcttgctctatctttctccccccttcagtaagagaagctttggagaagaagtcttaggtggagtcttggcttataccccagttgagcgcctgtgaagatggacccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcattcgggaaaatgaaattttctcagtcgcgacaaggtttctcagccatgagggaagctgccttctgacttctaatcggtcccactgggcgtgccaaaagcgtgttgacagaaaacacgaggcctgggagatctacttaactccagtgcaggtccaaaactcgccttcagatgtgtgagcatgccagttgatttgatcctgcaatcaacaagaaacaaagacaaagaaaccgtaattaaatccataaatgatagccgatcggctaaatgccaataacatatcatttatctttgagccgatgtcatatgtaaatcgatcggcaagtgttaagtaaacaaatcagaactaaatctactcaatcggctgtagacatcaataatatataatccttatatcgatatatacttgaatcaagtgattgggatagatcggtcaccttgccgagacagtataaatcacttaaatcgaaatatatattattaatgagattatatatatatattcatagcatagccgatcaaatagatctagcatgtattgaaattctaagcacgacttaatagatcaaactcaactgatacagcattaagtatgaaaagaagaacaatatctagacaatcaagccgctggatgtttcatagagtggtggatatctcatataatctaagccaacgtcgttatttaacctaatcggctgccttctggtaacagatgttagccgattgtaggttagatgatgatatcgtcaaggattatgcaagatatatgataactcgacgaattacgtaaacaagactagagtatcataaggatggaagcactaatctcgagaacacaaaccgccataacaagttttaccttttgttgaagatcgaaacccatgcagctcaacccgaaagcaagaacttgtcgaaataaaactaaagcaaaaagggtggtgatgcgccaaaattgtattgaacgtgtgtgttatccattacatagggctcggggcctatttatacccaagaattataagatatgtccatattggacacgactcttatccctaacaaactctaagataccataagtctttgtggcagacttttgcccacatttatctctaaggaatttacataaaatatcctaattaatagatacaattgccttcccaggactctatccatgcgtggcaatcatcttgaagcacatcaattcgaacccgttgtcgtacgcaagtcgtattattggaatcggctacatcacttaacctagtctgactcagacttagccgatcccaatcgtagccgatccggactccagccgattcttactctgtttccgcaacaacccttatcttcgattccgcttcgatccatcttcatctccgatgctgatattaccaaagttggtcgttaacagcggtgagggtggtccggttgcgatcggctgcggcctcctcatggaggcggagggaggactccgcctcagccgccgttctctcgtgggcggccaaagtggtctcacgctggtctagcatgcacgcccgcttctccagtgcctgggtacgctcctctagcacccgagcatgctcctctagctcccgggcctgctacgcctgttcccggcggtgcccatcctgttcgcgctggttgcggtcaaggacctcgatccgtggatggaaaatggcggtatcaaccccaccatggcgaaggacaggaggtgcacggatcgctctgggtaccgcggccgcggttgcgactcccccaccctcacggcggcgtcctccggcatgatcttgcgggtgaggctaaggtacctctctgccgtgatgcgtaaagccgggagcacagcgtcaccagcgtcttggcccgtggtagccggcgggaaaacggcgaggagtatggtgtatggaacagcgtggagcgagagaagcgttagggcttgaggagcgagtatgcgggtgagcagtcggcgagaggaaggagacgaactctctccctccctgcccttttatccccagctccccgcctcgcccgcgctcgcctcctcgtttcacgcccttgcggctgccccctcgattcccgcgtctgcggttgccttctcgactctcgcgtccacccatcacaccaccccactgaacccgcgccccgcatttagtgcgcctgtcatcggcacactcggcgcggggcgtgcgatgttcacgggcgcggttaggcgggcccaccatcggtcccatcacgtgcctagcaggtgagggagtcgaggcggcgtgggtgacgattctggacgtggtctagccgaccccccgattttcgcgccctaggcacccccagcatcagcgtggttaatggtggtcaaatcaccattctggctaaagcgccagcctggccgctcgccgacaaccctctgaattccccgccgggcccacaaccacagcacgggaagtcgtgaggcgccacgtcagactgtcctttgggggccaatgttcgacgcggtaccgggggctactgtcggagatatggtcccgggggtatacaaagtgaggggaagttaccttcccatctagccgcgtggctctacagcttggccttactcccgcacctcgcgagtggcagaagcggccggggggcctcggggtgccacgtcatgcccctcgggccctcgcgctgcctcgccccgaggccctcgcccaaccgccatttggtggggggagcgagcggggaggcgacccaggctgaacagccatcaatgcgtgacgccccaactgtccctcaccgcgtttaatgcggtaggggcagacgtgcggtgccgcctgactaacccacgtcaatcaggcgggaccagtctgtgaccggcctattgccggtcacgtccgattggacgggtggccgtgcccccacgtcgcctctgtatccggcggagtggaggtaggtatgtcccgtcccatcggagtgtcattcggagttccctccgtgagaggacgaccaccacaagtcttcacccatttatgagggaatgacagggctgttccccgtgtcaggtggggggtggcgctgtgtcctgctcaaggacggactgctgcttagcctccaggcgaaggcacgggtcatgacccggtcaaggtaaagtgggtcgccctcccatggaagagtagagtagaggcggtgcatgtggtatccccttgaactataaaaggaggaccttgcctaccgagaaaggggacgacactcagtagacctgaactctaggaaagcgaagagcaagaacgctctccggagttaggatcccttgtaacattcaaccactagtcccacacacaggagtagggtattacgctcgatagcggcccgaacctgtgtaatcttggcgttcgcatgcgatttaggagcattcaaggcggatacgcaatctcgagaggcgagccctttcccccggccgaactcacaaaagggggatctcacgatctcccgctagagaggatcatctcctcgacacccgacgacttggctcctgcacgctccggctccgtaggctgtggtgggtgtgttggtggtgatattcgatgaccttaggtcctgcccagggggtccctgatataccgcgggtcagttgatctcttagtaggacttggagatatcggacccctcacaatatggtaaagacccagtcttgtccgagtagaactccttccatccgtagataccatccttatcacgtgatagatttccttaatgtatacttgtcacgaccggaaatcacccaacaggcgttcctgacgtgcgtgtattgttccttgtcccaggaggcaaggtacaccaaaagttgatacaattcagagtttaacaaacggaagcgtaaatataattattacacgggcagcgaaggcccaacacacaaagacaaacgagaaacagcggaagactagggcgacgaccacaggcacttgccggcaggcacgagctagacaccaaagccttcatcttccaggaactcctcatctgggcttgggaaaaattgagcaagactgagtacaaccaccgtactcaacaagacacacccgcagatgcagggctgcaggaatt

SEQ ID NO: 60248 - DNA, 1051 bp, Oryza sativa
cacgggtgcgatgtttttgaccggaatgaaaaagttcaaaaagcatccaaacatgaattttggacatattggagtgtagtgggtacgttcgtggcaaaaactcacttcgtgattcgcgcgggtacttttgtccattaatgccaatattggcatatattgagcccccacgggtgcgatgtttttgaccggaatgaaaaagttcaaaaagcaccaaaacatgaattttggacatattggagtgtactgggtgcgttcgtggcaaaaactcacttcgtgcttcgcgcgggtacttttgtcaattaatgccaatattggcatatattgagccccacgggtgcgatgtttttgaccggaatgaaaaagttcaaaaagcgccaaaacatgaattttggacttattggagtgtatcgggtgcgttcgtggcaaaaactcacttcgtgattcgcgcgggtactcttgtcaattaataccaatattggcatatgttgagaccccacgggtgcgatatttttgaccggaatgaaaaagttcaaatagcaccaaaacaagatttctggacatattggagtgtattgggtgcgttcgtggcaaaaactcacttcgtgattcgcgcgggtacttttgtcaattaataccaatattggcatatgttgagaccccacgggtgcgatatttttgaccggattgaataagttcaaaaagcatccaaacatgaattttggacatattggagtgtatggggtgcgttcgtggcaaaaactcacttcgtgattcgcgcgggtacttttgtcaattaatgccaatattggcatatgttgagagcccacgggtacaatgtttttgaccggaatgaaaaagttcaaaaagcgccaaaacatgaattttggacatattggagtgtattgggtgcgttcgtggcaaaaactcacttcgtgaatcgcgcgggtacttttgtcaattaataccgatattggcatatgttgagaccccacgggtgcgatgtttttgaccagattgaataagttcaaaaagcatcaaaacatgaattttg

SEQ ID NO: 60249 - DNA, 702 bp, Oryza sativa
cccgcgcgattcacgaagtgagtttttgccacgaacgctacccaatacactccaatatgtccaaaattcatgtttggatgctttttgaacttattcaatgcggtcaaaaacaccgcacccgtggggtctcaacatatgccaatattggtattaattgacaaaagtacccgcgcgaatcacgaagtgagtttttgccacgaacgcacccaatacactctaatatgtccaaaatccatgtttggatgcttttttaacttattcaatccggtcaaaaacatcgcacccatggggtctcaaaatatgccaatatcggtattaatggacaaaagtacccgcgcgaatcacgaagtgagtttttgccacgaacgcatccaatgcactccaatatgtccaaaattcatgtttggatgctttttgaacttattcaatccggtcaaaaatttcgcacacgtggggtctcaacatatgccaatattggtattaattgacaaaagtacccgcgcgaatcacgaagtgaggttttgccacgtacgcacccaatacactccaatatgtccaaaattcatgttttggtgctttttgaactttttcattcctgtcaaaaatatcgcacccctggggtctcaacatatgccaatattgtattaattgacaaaagtacccgcgcgaatcaccaagtgagtttttgcacgaacgccccca

SEQ ID NO: 60250 - DNA, 1628 bp, Oryza sativa
  unsure (1)..(1628): unsure at all n locations
aaatgataacantgttacagnacnccatcacactgaagactcaatttagtactttaggtttcattttgtccatacaggtcatctaagtatttgttttggcttaaaatcatccttggacccacttgatttgccatatggctatttttagtcaacaattctattagaaagtgtcccttttgcctttaatttgtatacaactgtgcactagaaaaaagaaaacaaaaataaataaacaacattacatatgtatttcccattatttcaacatgtgcacatgaaacttgagcctaatggctatcgtatacacttgtaagtatataatttatttttgttttacataaattgctatgcattgtctataaaaagaattcattgtatgcaattgttttctcttacacacgcacgcgccgccaagcccgccgctcccgccagccgcgcgcatgctgctaaggccgccgccgagccgcgcgatgccgacggccgtgcccacaccggcttcgtccaggaaaatcttctgtactagtccaggaaaatcatttctctaatagtgaaaccgcgggtagctaacgtatattcacagtcaaatttgtttttttttcgttgagagatgtgaatgttgaatttgaacttgaatgtttgaggagtgatatatcacatattaatacatattctcaaattggtttaaatttttttcataaccatttgagagacatgcaaataacgaggggatattccctcaaggaataagttcactttaggtccctctatttgtcgactagtctgattttcgtccctgcaccataaaaccgggtacgacccatccccaacttacgaaaaccgggcaaacaaggtccctcggcggttttgatagcggttttgactaacgtggcgcctacgtggctaatttgactcggactttatctgacgtggcgcttacgtggcaattcgatcctgaaaaataagaaaacccgtaggacccacatgtcagtttcacacacaaaataataataaaaaagtgggacccatgtgggccccacatgtgatcctcgctcctccctccactctatatcctctccctcccctcttctctctatcccttctctctttccggtcgatggagcggggcgagcggcggccggcaaaagcgggcgacgggaggggcggggcagcgagcgagacaccgacggcgagagctcgaggtcaacccgaagaccagtctccagccacgcgcgcgccgcgcaacggggtccgacgccagtagcgccgccgccgccgacgcgatgggagtgctccgggcggcggtgcccctacagccggaggccgacctcgtcctggctaccggcggcggcgaacgggggcaggtggggctcgtcctcgtcgatggctccaacgggttctgcaccgtcggcaccgggaacctcgtgagctacctcccccacgcctctccctcttttctcctagtcctccttcgcccgtgccttaccgcgcgcgacgaggattgatggctggcgttggaacgcatggtggttgggctgctcgtgagccactccagagctgcaaatggtagagatcaaattttgtcaggcaccaaaagaggaccattctcatgtcagcgtgggcaaaaccat

SEQ ID NO: 60251 - DNA, 1431 bp, Oryza sativa
  unsure (1)..(1431): unsure at all n locations
gcgcccccnaatgattccataggacacacncatatgaacatagaacgagtttatacctctggttatgtagaggatgtgtgtgctgcatctgcgtaaaccgtaacatgaagtttatgctcaataatgaaattttatatgaacacatagtattcgaattcgactcacttgacatcacagtactatttttggccttacaacggaaggttgtaaagccagcccacctgaactcgaagcgtcatggtaatccactactggaaagatgaatccaagctttttagtatttcattatatcaaactctaatgcggcaaaggaactgtttctgtgatatattgtgtttttaagggataataagcagggtagcttcgttttacttttctgtacctttctatacccttctatttcactaagctctattttatactagtaccagttaacattgaagcaagaagttgatctattctgtctccctctcctgaagtttcttcccttttccctctcaaaaaaaaaaagaagaaaaaagcctctggccttgaccaccggtagttacagacaaatctacttatctaagatcatttctctgttttgtttgatgatgtgttaggtagctggcttttctagctgctatgtttggttttattcaattgaaattggtataataaataccaacttgacagctatggactgttgatttcatgtaactctgcatatcgattttcatgcactatctaatccatccaaagtgctcctagatttgtataagtgcattgaaaatatttgaagaagggagtgttagtttgatgtttcaaagtttttataaatcttgagccacatctgagaaccaattatccatactgtcattcttctttatatgtttattttcctcgacatttattaaaattcttggggaaaatttgtttttcaatacataatatgcacttaactttgttttatttgtttcagaatcaaacaataacgatttggctgaaatacggaatgacaatgttccagcttcaattccacaaaagcagaaaacttctaaagcagagaggcgtgctattcaggaagctcagcgtgctgctaaagctgctgccaaggaggcaggtaatatccttgttctcatcttctcatccccttccactcccttgtggggtgtgctgcagcataattataacattagtttggacctgtagggttatcaggaaagtctgcaggcactggttcaggggctaatcctgcaatgcccaagcaagccaaatcatcaaaagtttctcagaagaaagatgtgccccaagctgcatctactgctgcttctgagaagaaggttactgaacgtccttcagaaagagataggaagaaagatgcgcctcaccctcgtatgcagtttgatgatgtgcaccgggtggagaaagcaaaaaaacgtgcaattgtaa

SEQ ID NO: 60252 - DNA, 8365 bp, Oryza sativa
  unsure (1)..(8365): unsure at all n locations
ctgtannnattaganacttagtagccatgtgancancancgaattggataaattgattatcatcaattttggttgaatatgaataactcaacaggtattcactatgtttcaggttgggctccaatatttgtctggtgaggtttctggtggaaatggtcgttgtatagcaatgcttcttgcattccaagtggcaataaaagattactctacacctcccaaaaaaactctgagtagagatcttacagcgaaaatcagcagttatgtgtcgtttcttattgagtgcaggcctctgtcaattagcatgggcaatgctattaggtttttaaagaacaggattgccaagctaccactcacattgtcagaatcagaagccaaagccagtcttcaatctgatattgatcgattcattaatgaaaaaatagttgtggcagataaggttattgtcagtcatgctatcacaaaagtcagagacaatgatgtcttgctgacatatgggtcatcgtcagttgttgaaatgattctggatcatgctcatgaacttgggaggaagttccgtgttatagtggtagattctcgtcccaagcttgagggacaaggattactacgtagattagtggaaaagggcatcaactgcacgtatacacatattaatgccatctcatacatcatgcatgaagttacaagagttttcttgggtgcctcctcaatactatcaaatggaacagtttattctagagtcgggacagcatctgtggcaatggttgcacatgcatttggaattcctgttcttgtgtgctgtgaggcatacaaatttcatgagagggtgcaacttgattctatatgtgctaatgagcttggtatgtatatatcttttgaatttatgctttgtaactatttttttttaccatgcataagaatcataacacgagtcttttacccaggtgatccagatgtcattttgaaagttcctgggaaggcagatttgggccatcttaagaacttggcagacaatgaaaatctccaactgttaaatcttacgtatgtccttgaattccattttttttaagataatatgtccttgaattccataggtgacttgttttcttagttctgtcaatgttccctttgattgagataattttgcacattgataggtatgatgccaccccttctgactatgtgtcgatgatcataacagattatggaatggtaaaatacctttcacctctaattgcagtcatttacttgtcctatttgaagatattcatataagatgtccttttgcttagttttcctcacataagcatctggctgttgaattataggtgttagcaagccttttctatggatgttttttagcaacaaacatttttttcatcttttaagttgcacttgtatacttttttcctcaaaattaaatcttgcagaaaacattaattgatgccgattgcatgtactgaactacttcctccgtttcacaatgtaagactttctagcattgcctacattcatttagatgttaatgaatctagacatatgcatgagtttagattcattaacatatatttgtatatgggcaatgctagaaagtcttacattgtgaaacggagggagtaatatattctcttctacagttagacaaatgtcttttttatgccaacttttttagatttttatgaacaggaaaaattttattcaatcccttggaagtattatggttggtctatttaacccttgtaggcttgaattcagtactcttaccacctaaagaacaaaagccggtttaaataactccttagggtagttttgtaagtagttgtgagatgtaaacgaagatgtagcaggtggtggtgtctgctgaaccaatttcagccaaacaggctcggcttctcccatgtattgtctgcctggcagatacatgaatccatttctcccaaacaggcccagccgctccctttctttctccaattgttgagccagggaacatgtcaccactattgtgcttctacgagctgcctactagtcaaaacattatttaactgaatacatcgccaagctatcctactagtagttaaaaatatatttgaccgaatacattgtcatgtcattgcacttgtcatagcccatctggacaaaacctctttcaaagccacttacctttgatagtttggagatagattacctgttgatatttgtggtggtacatacctggtttactttaagggcccaagtagacattttcgttataaatatttaagatgatggctctcttatccggttcattgaattgctgatggggttgttttgctttgttccagcttccacccacaagtgtacctgtcattgtgagagagtatcgcaaagaacagctgtggatatagatgtactgcattatgacaacaattttggtaactgttgttggcttgctgcccaaagtgcgggatgcgtgaaacatgtacttctgtttgagagctctcagccgccaaaccttttttcttttgagcttatcaatttgtttgccacaagatggtccaattttgatatcaccatggctccgtctatgaagattgcactctggcacctctagaggggttatgttggtggtagtcatcaaacgttgtgatgcaactatgctcgtacctatgtcttcctgagcctcctctggtcatgcgcgtgatagtaactgggacctgagatgaattcgaagctatatttgtaacagtattcacctgtccaatacatcatgtagattggggggacttcgcgattacgcatgaggtatcgggatagggataggttgcggaaatctcatacgttgcctgagcacttcgcgatgcctataatttactagtaatattttgcaacttggggatagttagatacataccgattttcaagctgcatggaattatggtgacaagttcagagtttttattatgaaatcatacattcagtcactctcggcctggagtgaccgacttcgtacgttcactgaacttcggaacgactgaatcatgataatcgaacattataaaatcttcttgcagtaaaaacatgtttaaatcctagaattcagcatgatacagtgcacgaatatatcctgtggagcatgtcctcgcagctaaagtacaactcagaatacgaataaaaatggctataaataagcctataccacaatggatacctcgctacatgggcaaaacgatgaacaaaaactttccacgcaaagaacaatgtataaacggttgtctagattactggcatatttgctcaacggcagccacaatctgggcaggctgcacgacggtggcatcctccagaggcgcagcatacggcgtcggcacatcctgcgacgacaagcacatgatgggtgcgtcaaggtagtcccagaagttgtcgatgatggccgatctcaagctggcgccgatcccgcccgtgcgcatgcactcctccacaatcagcacgcggtgggtcttcttgatagagttgcctatggtgtgcaggtcaaatggcttcaacgacctgatgtcgatgacctcgggatcataccctttgttcaccagggtcttcgcagcctgcatcacatggtacctcatccgcgagtatgtgaggatggtaacatgttctccgggacgcaccatctcagcctcctccaggcatagaacatattcctcgtcgggaattttctccttcaggttgtacagaaggacgtgctcgaatagcaccacggggttctcgctccttatggcggctttcatcagacccttggcgttgtaaggggtagagcaagcaaccatctgaaggccggggatcgactgaaagtaagactccagacgctgggagtgctcagcaccaagctggcgaccaactccaccaggacctcggatcacgattgggattttgaactggccaccagaggtgtagtgaagcattccgcagttgtttgagatttggttgtaagcaaggagaaggaaacccatgttcattccttcaacaacaggcctcaaccccttcatcgctgctccaactcccatgccggtgaatgagttctcagcaataggggtatcaaggactcgtaggtctccaaacatctcagccagacctttggtcaccttgtaagaacctccatagtgaccgacatcttcaccaaagacacataccgttggatcttctttcatctcttctatcaaggcctcgcgaagagcctcaaacagtaagacctcatgactgaataaaagttacagaattaggaatttgccttagattacatattctatgcactgaaatgttatttatttggataagataaaaaaaatcagaaatgtaacacctaaactagcacaagtgcacaacacatataagcattgtaatgaaccagggcaaatactgaattctgaataccagtgttaaccgattcgttacaggtaccgataatcctacagtcaacattacaaagtaaatgtaaaccaactaagcttgacagcctgaagcaattttttatgagtatatgcagcctatataatagcatggtaagtggccaattgggttggaaactaatctctctactttaatgtgtctgacgttgggagaactaaatgactggagggagtaacagaacagtttgtgtcacccggtgaggagcatattccactgagctcaatgtcaaatttgaatggctagacgttataaattctgtgctttccagccctatgtccattatatagattagtaatagccaaaggggaaaaaaactaaattcctaatttcttttttgcaatacaccaaacattggacatgtctacagtgcaggtaggagtataaggcagtatgcaagtcccatcagtgtttcaatcaaggcctaaattgatgcttccaaagtcattccctactcatatccaagaaaatatatgtcaaattgtgaatgccagccagcagcagaagccatagctgaaagctgatgggcaagtcagttgaatgttctactttgttgattgaaattcactttacagtggtctctactggtagtaaaatcaatctagacctttcatcttttcttatataataataataatgggccatatctatcctactactggtaatagacctcataaatctaaagaccgctataaaatactcctagtttctcggatgcttcaaacaatttcttcatgaactgtttctagtcataagttctctaacttcaattcttcatacaagcttagtaacattcaactagccccctgtatcaactttcaacgaacggaaggctgcaaaattgcatcacctaacgagcagaataacaagagcccaacccctaaacagatccaagctccaaaactggagtatagccccaacacacaatagactaagaccaacacaatccagccaaatcaaacccagattgagctgaatcgatcggtcttatgaacagaagaaataattgaacgcttggttaccgtatggattctgtactacacaattataaaattagaggggtgctgaattctttacccgtcagacttggaggaggccgcgctcgccggcgattccgccttggactgcacgcgagaagaaacacaaacaaacacaacatagagcagttcagtgaaaccatcagagcccagcagagcatcgtagcgaacggaagtatatcagctcagagagcagaacgtctcacgcaactgcaacggcggcccgcgccaccatccttccccccgcccgccgcgccgcgcacgatccggccgccgccgccacgcgcacgctcctcgccgctgcaagagcaaaacaaacaccacatgaatacacaataatcccacggaaccagcggagatccgacgagcaggggaggaaacctcgcttaccggaggctgatctgcggccagcggaggaggaggaggagaaggaggaggaggatcccacccgcggggcggcgtggagggaggaagcggccgccattgttgaggtcgggatctctctctctctctctctctttctcgggaggacgcgcaggcgatgggttggtggtccgctatataaaggtggggggaagtcttggggtggcggcggtggaggaatggaggcggcggcggcggtggcggagagaacgaggtgaggtaagagaggagaggacgagaaatggagagggagacgatgggctgtggaccgggtctatggacatgatggggggtggattttggttttgatctcggccgctggattttgatccactgtgtgagaatcttgaaaatggattgtttgctcatatgcacgtacgcacattcaaacactatgagatactggacttttatactccatccatccgtcccgaaatatttgatgccgttaacttttttaaacatatttaaccatttgtcttattcaaaaacttttatgaaatatgtaaaactatatgtatatataaaagtatatttaacaatgaatcaaattataggaaaagaattaataattacttaaatttttttaataagacgaacagtcaaacatgtttaaaaaaatcaacggcgttaaatatttagggacggagggaatatattataagattaacggagtaaacatatgcgtcttgttgttaatgggtatgtcgcctaccattaaaaataattagtcgtatatgtgagtatacatgtcaaatatcatatattatatacttgattatggataaataaaattttcaagaaataaatttaataaatggttttaagcaagtgatcttagtatcgcattagaagattgtttttaataaatatatgtatttttagaagtgtggattatcatctgcagtaataatcagatgaagaaaccgaaaagaacacggacataacgtaaggactcttggattaagcacggtccatgcgaaaatcctaacgagcgatcaatcgccccgcgtgatcaccccctcctccacgctacttttctattttagtaaatttatacacctcaagtttacacatctaaaattcatacacataatctaaaatttatacacataaagattagagacccaaagtttataagttaaaagtttatatatccgattcaaatttaaatttgaattcaaatattttttatatgtagtatttctatacatctaaagtttatagacccaaagtttataagtcaaaagtttacccgattcaaatttaaatttaaatttaaatatttttatatatagtatttctatacataaatttttctaactttattattttttattttttaaaaaatttttgtggtgtagtaggaagagaagaaggggaggaggaagagggagaggagcgtattggtggggggatgggaatgatcgctgtgggcgatcacccgtccattagtgtcacccaacgcccggtccatatatatatgtctaattatgagattatttttagattggatgtacaacacgagcccctttgaattggcctcctccctccttgtctcttctcctcctaagctaggccaccattagaaacacccttttgctccaacttcgtaaccactctgacttttatgttctcgtctctgaccctgttcactgacgtcctataaccccataattccaacggtattatcaccaactcattacctaccattgtcttccatcgactacgaacatccctctaaacatgagaaaacaccttattccccatcatcaccgtcaaaaagttgccaccgtttcgctggtgagttacattgatacctcctcctccctcttgcccacttacggcttgcctaaattcagtgttcccatgatgaaacctaaaaaaccatataatgatgagttgagaaaaaatggttattgttttttctttcttaaagagtacaccctccgtaaaaaaatatatataaatcctagctatatacatggaccaggtttataattaggattgttttttaggatggagagtacatttgaaagcgcacaaacactatccagacaacaccacaacatttaaacaccgagcgtcaacacacacttatactttttccataaaaaaaaacctagatgaggtgtaacaccacctcaacgaatctggatataaggttgtcaagattcgttatcttaggtgatatttgcattggtttttccgaggccaaagggagtacgacccactcgacgcgagcgtgtgctcaaaaaattggtggacaatgacgtcccttccaaacatgtatcagtttctgacttgaatttggactctctcgaatggtaagtttaggcacatgactcatgaggtcacaattaactattaccatgacattaccagttgcatacaaatatgtttgagtaaaatgcaccagcggacattaacttgggtggnngtctatgcgactgctctaatttnnacagtca

SEQ ID NO: 60253 - DNA, 4781 bp, Oryza sativa
  unsure (1)..(4781): unsure at all n locations
cgggttgagtgtcacattatgatagaacatacatgctncccgctctatgcatagccggtatccgttaggccttatgcctagcagtccacgggtatccgtgaattcattatccttacaccattagcacgatgcgaagccttacctgttatacccacccgtttttgataccctttatagtttacgtttacctatcacctatgacatcatttttatactaccctggtttttcgttgtcgagtaatgctttgcattccaagcatccaaagaattagtgtaagtatcccaatagggttgaatttccgtatggttgggtgtgcccggcctgtatgttttatggcctataataataagagtttttgcgtgggaagcggtccgttccattaaagtcgtttgcgggcttacctgcccgctccgaaaaaacgtcggttggagcggcgtatttcccgggtagggagtattcgcctgctcgggagtcgagatagaaaaggttagcgtgcgtgtgggcgtgcgtttccgtagcgtgtaacatggaaagtctggtgcattttactcaatatcttttcatgctgcaacttatacttctaagagttaccataaaagttatttaacacatattagaactctgacggtatcaattctgcaacaaaaagattatatatactagatgaaaaacaggtatatccgcatgaaaacaaacagctatagtagtaggcaaggttatgtttcttatctgagttgttaaaaatgtgtatatatggaccgagtgcaggccaattgggtcagtgtggaaggacctcaatggtcagcctcggtctcatcgatgctaaaaccttgtggccttggcctcatccacctaggccaagtggcactaccctttcaacaaagtgttgctgaatttttcagtcttttgtcttgagtttcatcttgcagaactgagaaatgacaggcaagagagctgtttagtgaagggaaaaaggcaaaatatttgtcaccagcaaccacactatttcaaatattactgcaaatattaatgggtgaatagctaatttagttcctcaagcttcactgaagactcaatttagtactttaggtttcattttgtccatacaggtcatctaagtatttgttttggcttaaaatcatccttggacccacttgatttgccatatggctatttttagtcaacaattctattagaaagtgtcccttttgcctttaatttgtatacaactgtacactagaaaaaagaaaacaaaaataaataaacaacattacatatgtatttcccattatttcaacatgtgcacatgaaacttgagcctaatggctatcgtatacacttgtaagtatataatttatttttgttttacataaattgctatgcattgtctataaaaagaattcattgtatgcaattgttttctcttatatatgtgaatgagggggtataagtgacatttatcaagagaattgttggttatgtgggttcaaggataagtttgaattaaaataaaaacttgaagaagtaatatgaacagattgaaacattaaggactaagccgatccttgtatgaaacttggaggacatctttggctattcacccaatagattatggactaagctgatccttgtatgaaacttggaggacatttttggctattcacccaatagtaatctagagagaaacttttaccacttcaaacaagtactagtatgtttttcgccaaagcattttaatgatacttttctttactaacaaattactccctccagtaatacatatatgacatttagaacaatatttgatcaaattttttaaacaaccatcaacagtttacgagtttcttagtttaaaaaggaaaaaatggtatgcacaaatttgcctaaaaaatcattataataatatcagaagctaactgaatttaacaaaatattctaatacgaatttgatagtcaaagtctttttaaaaaagttaaccaaatcttgtcctaaacatcatttgttttaggaccagagtactacacaaacataaaaaatgacaacttggtgctcttgaaagaaagatcaacaacgcatcttcaaacttaaggaaagagcttgaaaataacccaacaattccaaggaacatatttacagagactatcaaacctgaactacagtagctagaagtaagaacagtggaatactacttattccattaatccagcacatgacaaattgataatgtctccaaggctgcgggcaatacatcatctgagctacaagagagcacggccaggctaatccaaccatggctagtcctacagaaagcaccaaagtttcagcacatgtttttagtgcatcacaagtcacaactcgaacaacattaacaacagcagcagtagaaggtgacacaagccacccagcatcccgacggcctcgtagccccggcgaccaccatttcttcccctaaccctcatcgccactccgccgggctggtacgccatgccggggttccaccctgccggtatggcgttgctggcaacaaacatctggccggagctgaacgtcaggcggacggagaacgggccctgcagggcggagccggagttgagcctccacactgcgccccatgactgctgcatcggaatccatgaccccgaagcaccagcaccaatcggcatgatgtcgacagccgcaaggtcactgtcgttgtcatcgtactccaccagcagggccaggtagttcgggttggagccagagtccacgacaaaggttagccctactccagtccattcacactccacactgtacaccacaaaagtaacagaaaagattaaacatactgtttgttacatgatgagaaacatagcgaaaaccagacagtttgcatatctgcgtgaagtgtcatatgtacttggccgttgcagcagccaagaataatagtgtagctgagtgcctgtgtactatatatgatgatccattattcatgtgtaccgggtgtactgaatttggaggaggccagcaccacggagttgatcagcctggccaggcctcgccatggcaccgaatgctgtcccgctcatgtcaaagtgagctgcttcattcatgcattgaccatcgactagctcttccaagcatgggccaccaggcccctggtcagtgatgacaacggttacagggataccagagcaagcttcattaccagcacacaccacctgataaatcagttatttccaaatgtcaaatggcagacatgcatgaatgagcatagcttcagctgctaatggtcaatggatacacacccggtagcacgaaccacatcccttgccagagtcatagatgtaggggctaccagcagcaatcctggatgagaacggtggctggtcaacagcatactggtacccacatgcaccgcctacaacaaatttatgcatgagacatcacattttcgcaccacaagccgctttgagtagagtgcgtatattcacagattttattttttgtggtatctaccataccttcacttcctgcaccattaggatcgccataccatgtagcaatgccattcgaccagccagagagctcacggtggagctcaatggacgtgcaaggttggaacaccgaagcgagcactgtaatggcaatgaagtacaagagctgaagcctggaagccatgtgctgcactctgtcacattatggctgataaggactaacacactgttggtttgcaaggtcaacaacacaagtatagattgtatgatatgtattcaatgggcatattttgtgctggaggtaatgaagaacaggacagcaagaaaggttattgttttggcttcaattgcgcctcagaacataattcacagcattgagaatgttttcataacaacacttcactgagttctcattaaaaaaacactccactgaagaaaatgaaaatgccataaatgtggtacagctgttttctgaagttagaataaaaaatggattttaaggagatgatagacaagaagggcaatgtgccgtgaattacaaaaagttgttgtcatggattatggcaaacatgtaaaggagggtgttagaaaatttccaattactgatgaccattgtcagctgattaacctttagtttctactttacgatttgtcaccattacccaaaaacatagcacctagctactaaccaaaagaaacacatgcccaaccttaaataattatgtcttgaagaagtttcgagagcatactgtttaagtccaaagagcaaatggcacagtaagccattactccattgattgaaaaaggcataccgatcatgttatattcagttcgttttctaaatagaaagatagaaatgacaaagttttattcgctaacagtactacacaaaatgaaatatgaaacactattcatgaagactaccaacagaacagcaaatgtttgagaaaaaaaatacaagcattacttcctccgttttacaatgtaagtcattctagcatttcccacattcatattgatattaatgaatctagacatatatatctatcccatattcatattgatgttaatgaatctagacatatatgctagaatgacttacattgtaaaaaggagggagtatcacctagacaaaatacaatgctttgatgaagtactgtaccagtggaaatcaaanntnaacatttttttgtgttttttnttgaggagaggataaccaactggtgcatatcggagtntaaagtcgagtaaangggagaggganagtgatattatgagtaanagagatacgataatcgtcgatgaa

SEQ ID NO: 60254 - DNA, 593 bp, Oryza sativa
cgggcttctgttgcaaagcactaccgtacttccacatgtctagtgggtaaggcttagtttgtggctcagcctggtaataaacaaaagtacacggatggagatggacgaagtcgggggtcgatggacatctcaaggataaatgaaggctacacgagctgcggcccggtagtcgagatgtcacggcacagggctggtgtcctgctgctaggggctcaatcctgcctacctgtcccggaggttccggccataggtgggattgggtcggtactcttgtctatggctaggatgggttggaaactatgtcacgtcttccgtctgtataccgtggtggtatgtggcacgtggttgcacgtgaggaagatgtgtcttgtgggtaaagttgtacacctctgatcagagtataatctattcgaatagccgcgccctcggttatgggctagccgagcaatgtacccaagttagtgttttaattcttaaaaccttcttaacaactaaaatgtggaatggttggcctgggttggcttgggacgagctgggacccagggtcgggttgccagttcggtctgaatcatcataggcccttgggttaaggc

SEQ ID NO: 60255 - DNA, 1683 bp, Oryza sativa
ccggtggtgacgtcaccgctgacgtcatcgtcgtcgttcaccgtggcccggtcgtggaccgatggatcttggccgtccgttttggatagatgaatctcggccgttcgttttcgtgaactatcgccattaacccggtcctccgtgaaccctagccgatgatgcaataattcccttttccttttcaaaaataattcattattgcgtcataattcaattaaaatccataaaaatgctttaatccggtttaatctttaaaaattcataactaattctttgtaactcagtttaatgtggttcaatttgcaaaagttgtataaaataaagatctacatattaaaattatccataaattgaattaaatttatttaatcctttttaaataggctttaattagatttaatcttgtaaaattcgtaataaattcatatgaagtccgaataaggccgttcaagtctcataattcatctaaaattatgatctacatgtttgtttactttttatgtattgtctatttggtttttattagtctttttcctcgttttgcgtgatagcttgtcgtttccgtcgttgcgaaggttcgtgagtgcgccggaagtattaagaagattaattgaagaccgaatattgcaaggcaagtcacacagatcccaaacaaccctttgagcatgttgatcccgtttaaagctattgtttctattcaattattgcatttattttcgaatgtcattgggtggaattaacctattgtttgttatagccctttcgttcttgattactttattccttgataccttgggttattataacttgactagttgagctttatatattggttcagctagatagtagatatgattgcttagccatgcttagaaatattagcacactattgggataacttatgattcactattatttaatgatggcttaatgatagttcacgatggtcaatcgtgattggttaattaattaaattgccaactaaaacttgataatggtgggttgtgagcacatggttttgagactcgtgctcatgacaattaaggaccggtttacgattttcggttgtgaaacattaaccgtgccaactacaagccagcgtgggcaacggctttaccttttgtatagcatggttcattgcggagcaccagactgagaagtggcggagataagcccacgggggtcgctggggagtccatgccttgttttataagggggtgattatgatccaggaacggtgcactgtggaggattgtgttgtgcgaggggtactgtcacagctcctttccgaggtaccgtggtggtattgaggcacatggtgacatgttgtggggctgtgtcttatgggtacagtggtacacctctggccagagtaaaactattcgaatagttgtgcccgcggttatgggcaggtctaacaatgtctttcgtgattagtctcacacttctcaccataataaatgatgttataactcgtaataatttgattagctcctggtttggagatagatctgtacagccgggtatggctgttcaggatggttggacctgtgcagcatgggtgtgttgttcagtgttgattaatattgatgattaattactctattgttttataattctcaaatgtttgctaaatgctgcttttacaaatgagccctatattatgccatcctttggtatcca

SEQ ID NO: 60256 - DNA, 11378 bp, Oryza sativa
tgtcaaatccgattattatttgcattattttcttagggttttctcctgatttcacctgcattttcttagggtcttttataaattacaatttggcttgggaggaaaacttcggggtgtgacaaacctaccccccttaaacggaatctcggccccgagattcggaggagctggtgaagaggtgcggatgggcggctttcaactcatcttccctttcccaggttgcttcctcttccgaatgatgactccactgaactcggcaaaaccgggtgaccttgtttctggttctcctttcgctggtatccagtatacgaaccggcttctcaacataagttaggtcttcctggatatcaatgtgttccgaatcagcctgttcttcaggtacccttaagcacttctttagttgggacacgtggaacacgtcatggatgccgatcatgttggatggaagttctagctgataagccacttctccccttcgttccaagattttgtatggtcccacgaagcgtggtgccaacttgcctttcgtctgaaaacggtgtactccccggagcggagtgacgcgaaggtacacgtgatctcctgcctcaaaagtgagctcccttcgacggttatccgcgtagctcttctgtcgagactgagcaatcctcaacctttccctgatgattctgactttctcttctgcttccgctaatacttctgttccgaatagttgacgttcgcctgtctgatcccagaagagaggtgtgcggcacttccggccgtataaagcttcaaacggtgccatctgtagactggcctggtagctgttgttgtacgagaattccgcatatggcaagcttttgtcccaagctccaccaaaatcaagagcgcaagctctcaacatatcttccaagatttgattgacccgctcggtctggccatcagtttgcgggtgataggccgtgctgaaatttaaacgggtccccaattcttcctgcagcttctgccagaattttgaggtgaactgactccctcggtcagatacaatctttttgagtactccatgtaggcacatgattctcgaaaggtaaagctccgccaaccttttgcccgtatatgtggtatgtactggtatgaagtgagcaaccttagtgagtcgatccacgactactcagatcgaatcgtgacccgacgatgtccggggcagtcccgttataaagtccattccaatttcttcccatttccattccgggatttgaagaggttggagtaaacctgtgggtctttggtgctctgccttcactcgttggcaaacatcgcagagtgcgacgaattcagctatttctctcctcatgctgacccaccaaaacttttctttgaggtcttgatacattttggtgctgcctgggtgaatggagtactgggtctgatgagcctcggtgagtatcagatccttcaattccttgtcgtcaggtacacacaatctttctcccatccagattgtgccatgctcatccttaaggaaatcccgagcctttccgactctcatgttctttttcagttctgctatttccggatcatttacttgagcggctctgacttgatccacgagcgtaggccgtgcctccagagcggctacgaacccgtgttcaacaattcctatgttgagatgttcaaactcctgccgcaattcctcacacatgctctcgatgcatagagcagtgcagtaacttttccggcttaaagcgtctgccaccacattggccttacccgggtggtagtgaatactcatgtcatagtctttgattagctccaaccatcttcgttgtcgaaagtttaggtccggttgggtgaagatgtatttcagacttttatggtccgtatatacttcgcagcggttgccgatcagatagtgcctccagatcttcaaagcatgaaccaccgctgccaactccaagtcatgagttggataatttccttcgtgtggacgcaactgccgcgaggcatatgcaaccactctgccctcttgcattaggacacatccaagtccgtgacgggatgcatcgcaataaacttggaagtctttcatctggtcgggcagaatcaaaactggtgcggatactaatttcttcttgagctcctcaaagctcttatcgcactccgctgtccatttaaatttctcatctttcttaagcaactgagtcatgggtcgggcgattctggagaagtttccgatgaatcgacggtaataacctgccagtcctagaaaacttcgaatctgcgacacagtcttcggtggggtccacttggtaactgactccacgttcgatgggtcgactgccacaccctgagctgtaatgacatgacccagaaatttgacttccgtcaaccagaaatcacacttgctgaacttggcgtatagctggtgctccttcaacttctcgagtaccagacggagatgttgttcatgttcttcttcggattttgagtagataagtatgtcgtcgatgaataccacaacaaacttgtccagaaattctatgaacactttgttcatcagattcatgaagaatgcaggcgcgttagtaagtccgaaggacataaccgtgcactcatataacccgtaccgagtggtgaaggccgtcttcgggatatcctcttcccggattctcaactggtggtagcctgagcgcaggtctatcttagaaaacactttagcccctttcagttgatcaaataaatcgtcgattcgcggcaaaggatatttattcttgattgtgacctcgttaagtgcgcgataatcgacgcacatcctcttcgtcttatcctttttctccacaaaaatgaccggagcgccccaaggtgaagtgcttggtcgtatgtaccctttctgcagctgttcatcaacttgcttcttgacctccgttaattcgttggccgccattctgtacggtctcttatagattggagcggttcccggtgccaaatcaatccggaattcaatctctctcttgggtggcatggtagtgaggtcttcggggaacacctctggatactcgcagactatgggtatatcatccaattttctcaagttcttctctacggtgtccactgggatttccgtctcaatctgattcaacgagactcctttctttggcgagactagagatttgtacaccacggtttctcccttctcgttggtcagggtgactgtgcgattcgcacaatcgatgactcccttaaacttggtcagccaatccatcccaagaatgacatctaggtctttggattcgagaaggatgaggttggctagaaccggtgacctttgaatttctattgttatagaagggctgaattgaaccgaagtggagctattccctggggtatgaacccgcatcggtgtgctaagttcctctcttattaacccatgcatcccgacaaatttctttgagatgaaagaatgcgttgcaccagaatcaaaaagtactgttgcagggattgagttaacaggaaacgtacccagtacaacctctggtgctgcttgtgcctcctccgcagatgcgtggttgacacgagcctggataaaccttggcccggcacgcctaggcttcgggcatttgtcagcgaagtggccaagctcgccacagttgaagcaagaccctggttttgcttccgtctccttcttggcttgcgcgggctggcctgactgtgccgatgccactggtgggcgtggagctgcaccgcggttgggctgacctccatggtggttctgactgtcactggtgccctggtagaagttgctagggttgaacgggcggtgctgacggacgatcatggtggtaggtccaccctgctgtccgggagtgaagcgcggcctctggtgacttccctgatgtgccctgaactgagcggccttcctcttcctgtccatcttgttgcgttggtcctcctgacggattgccttgtcaaccagcctctcaaagtcagcgtagtacccggatatcagctggttggtcagctcatcatccaggcccgccatgaacttctcctgcttctcggcgtcggtgcggacatcctctggtgcatatcgcgtgaggcgattgaactcgtggaggtactctgtcaccgtcctgttaccctgatggagtgcacgaaattccctcttcttttgtgccacgaccccatctggcacttgtgccttcctgaagctacggcagaactctgcccatgtgacttcagtacccggtgggcgggtggccatgtggttgtcccaccaagctgacgcaggaccctgaagctggtgtgtggcgaaagcgaccttctcctgatcattgcactgcaggagattcagcttcttctctattgcatggagccagtcatttgcctccatagggttggtggtgctggagaaggtgggtggcctgactcctaggaactcaggcaatttggattgagggggagggggaccaaagtgctggtgctgctgttcgacgtgctgcatcatcctctggtgcatttgctggtgttgttgctgcatctgctgcatcatggctgccatcatctgagtctgatgcgccataacttgggcaagggtcggattctcgggaagtggtggcggaccattgccggaatcactgttggggtgcacgccatcaacgcgttcttcgccgttgctgccctcgcctgtcgtgcggttgccagtcctggtgtagaccatctggagggaagagcagccggggtaaagaagaaaaacagatgctcaagaactaagctttattacaaaggaatttaaactgcaattgttctgatctgaattaaaacacttaaaagagcaagcaaccaatccttattaagacagccataccataggcacatgatatcgaccgtcgtctgacccaaacaaacaacctaaacacacaaactaacgaacaaaagctagacagtcggtaaactagtgggaaaacgagcataatgctcggaacggctcctgcggtcggtggagtcgaaagcgtcctcctgctcgtcaccaggtccctctgagcgactcctggagcctggcagatacgtctcgccgctgcctgactgcgagccactggagctgctgctgctgagatcgcggctgccactgggagtagcagacaaccaacccccggtgccactggctggacctctggcggctgacgctggagcgaaggagagagcggacgcgggagctggagctggagctggagctggagctgcaggaactgcgggcggaactggaggtgctgcgggagctgctgctggaggtgggtttctgggtgcaagctggatgcgcacgggtgccgtcgtcgtcttgcggggcgtggtgcggatccggactcctcctggcgctggaagaccctttagctgagcgttctccttcttcaggcgcgctatctcgtccttcaaagcgacgatcctcatgagcttcccatcgttcaaggccttggtcgccttgtgcaggtccgagtgcatcctgtccaatcccctcatcacagcacacatgtgaccgaaggtggtgtcgttctcgccagctgtcggacggaaggagctgacgccatcaccgttggctcgactggggtggtagcggtacgccgtgtcgtggaagatgtagttgtggcgctcccgtagtctggccatcatcaagtaggctgcctcctgacaggcgtgatctgctgtgcctccagatgcctcgaccgccatgttggcgaggcaagtctgtcacatcctgattttcgtttcaggatttataaattatttaataaattattaatagaatttatattaaatgttctttaatttacaagtgaagttaaatgtgggaaataaaatttcctaaataaaaaaaagcatagatggatttaatttttattaagtcctccatgattaattatactctctggaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgttgggccgaatccggcccaactcctctctctttctctctcttcccgcgcgcggcccacgccggcccagccgagccgcccgctcctcctctctccagccgctgacatgtggggcccacatgtcagggccgtcttcaacctccggccgccgcgccgccgaagcccgaaccctagccgtttttgcgccgccgtttccggccgaatccgaccccatctcttccaattgattgaggggttttgttcctctcggtctcctctttcttttcccccaagaatcaaagcaaatggttgaggattcgatccgaatcgaactcgttttgttttatctctaaaaaacgagtccgagttcttcccgattcgattcctctcgtttgcgacttgatctgttcgattcgagctcatataaaccttccccatgatctcctctttcgtttgccccctttcccgagtcctcccgtgcctcctagcgccgtcgcgacgagctccaagtccgccgccgccgccggccatcttcggcatcgtcgcgccgccgtctccgtcgtcgccgtcggtcgccgtcaccaccgttaggtgcgccgtgaggagaagaagctcggccgcccctccgttttcgccgttgaccaccggagcgccgccgtcgccgctaacccgagccgccgccgccttcttcttcgtcgccggccgccgtcgtgcatcattttgggtcggggtgagtaccaatgggttcgcctcgttgccctctacgcgtaggtggtctccgtttccgccgccgatgtccctagcgccggcgagctcgtcgtcccgagccggccgccgtcgctgacgtcatgctgacgtcaaccttagggctgacgtcattgtttccagggctgacgtcatcatccctttttccttttcctttttccttttttctaatagatcaaatctttggaaaatcataactaaataaccgtagatccgttccaggtggttcaagttgctaaattcttctaaaataaagatctacatattaaaattgtccataaattgagttaaatttatttaattctttttaaatgggctttaattagatttaatcttgtaaaattcataataaattcatttgaagtcagaatgaggccgttcaagtctcataattcatctaaaattatgatctacatgtttgtttactttttatgtactgttcatttggtttttattagtctttttcttcgttttgcgtgttagcttgtcgtttccgtcgttgcgaaggttcgtgagtgcgccggaagtgatcaagaagattaattgaagaccgattattgcaaggcaagtcacacagatcctaaacacaatcctttgagcatgttgatcctatatttaaattctctatttatttcaactgtgcatttattttcgaatgtcaccgggtggtgtgaacctattcctttgttatggccaatttgcattgaatgccctattccttgataccttgggtaataaattgattagcttgaaccttatgtattggtttggttcagctaaatgtcatatatatatatataattgcttagcaatgcttagaaacattagctcattaatgggatgaattatatacactacattattattatggttatatttaatggcagctcacgatggtcaatcgtgattggttaattaattatttgccaattaaaacttgataatggtgggttgtgagcacatggttttgatggttgtgctcatgacaattaaggaccggttcgcgagctactgttgtgaaacattaaccgtaccaaccacaagccagcgtgggcaacggctttatcttttgtatagcgtgattcattatagtgtgccagactgtgaagtggcgagaagtccatgggggtcgctggggagtccatgcctctggttgtagagggggtgattatgatccaggaatggtgcactgtggtgagttgtgttatgcaggggataatgtcacagcctctattcgggtactttccagtatcgcgacgcatggttgacatgatgttgaggttgtgtcttgtgggtacagtggtacacctctggccagagtaaaactattcgaatagccgtgcccgcggttatgggcgagttgagcaatgtttttcgtgattagtctcacacctctcacaataattatggatgtaataactggtaataatttgcttagctcctgctttggagattagatctgtatagccgggtatggttgttcaggatggttgggcctgagcagcatgggtgtgctgttcagtgttgattaaaattgatgattaattactctactgttttatttctctcaaatgttttgctaaatgctgcttttgcaaatgagcctatattatgccatcctttggaatctttgtgcacttgcatatttgctgtgtggcttgttgagtatgtcatatgctcattcttgcaataatcaatcaacctcagttgaagataaaggatccggaaggagaagacgtttggcttataccccagttgagctgcctgtgggagtggagccggagcttcgctagattttatttttccgctgcagtttccttcttggtgaggactaagtgcctcttaagtaagtatttatcggtttagttattatgatggatttgtatattaaattgtcagtttgtgtacctcggctgattcctggacgaggattttatgcacaaatcagttcggaaattattagtgaatttccgggcgtgacaagttggtatcagagccatctcgactgtaggataagccaaatggtcaaaccttaaggactaattttccgaaaacataatttgtgaaagtttctcttttcttccttatctagaattcttcgcaaatcgttttgtcgttctctcctcttttccctctttcaacgtgagtagttgttaaacttgatggagaaactcgaaggcgtcgatgttgtcaacttctgcaagtaaagtggatcgaggaagaaccgaagtgcccagatatcaagatagagtgaagttggatcctagtttagaacctatgccgccaaagtgtctttgaagaatagttagtaggatagaacgtttgttgcttgcttgtgtgtaggtatggttgcattcccgtcattggagtagtccaatgatgagtgtgtaactatactaggttgtttgcttaatcaacttgaacaatataatggtttacacacatcagatcagtgttaaactggttaaggtcttgtctttagtgtaacccctctccttctatcttctctaatctgcaacagatggtgaacactcgcactagtggaagtggaaacaataacaatgaagagaacccaacccttgctcaagtgctggctcaacagacccaattgatcaacatgttagtgcaacaaatgcagaaccagcaagggaacaacaatgtcaatcctccgccgccgcagaacaagttagctgattttcttcgtgtgaagccacctactttttctagcactaccaacccagtggaagcaggtgattggctgcacgctgttgagaagaagttggaactgctccagtgtacggatcaggagaaagttgttttcgcttcacatcagttgcaaggacgtgcttcagaatggtgggatcatttccggatgaacagagcagaaggacaaccaatcacttgggcggagttcactgaagcattcaagaagacgcacatacctacaggagttgtttctttgaagaagcgtgagttccgggcacttaagcaaaaggatcgtacagtgacggaatatcttcatgagttcaatcgtctagctcgctatgctccagaagatgtgcgtactgacgaggaaaggcaggagaagtttttggaaggcttaaaggatgagctgtcagttatgttgatctctcatgactatgaggattttcaggagttggttgataaagcaattcgactggaagacaagaagaacaggatggacaatcgtaagagaggaaggattgttttccaggaggcacaggatagtagccagaggtagtgtatcaagccactccaaattggtgaatctttttctgctggtcaaggacagtcacaacagttgggcatcagtggtgagattaactcagagactaatgcaagcaatgaaggcaatgatgagcaagctactcaatcagtgtcatttcagcaggatcagtctcaagaagataacagtaatggaagggagcagcgggtgtgtttcaattgttatgagccaggtcacttcgtaaaagagtgtccgaagccgaagcgtcaacagccacaaggccaagtcaacaacattgtcctcacaggagcaaatgcagtgccggttgtgtcttcaagtgttacaactcagccactagtatcaaagcagcagtagttttctttaaagccttagaataattatcgaagttatggaataagatagactgcagtttatctatgccctttttctttctagccgttccgaatctcgggacgagattctttgtaaggggggtagatttgtcacatcctgattttcgtttcaggatttataaattatttaataaattattaatagaatttatattaaatgttctttaatttacaagtgaagttaaatgtgggaaataaaatttcctaaataaaaaaaaagcatggatggatttaatttttattaagtcctccatgattaattatactctctcgaattttctcggatttttcggagctcaattgttaattttaatcatacaaagaaaagttcagcaattatttaaatatcaaattaatcaggtaatgatctaattataattgttaagtgattttcttgtttaaaatccttaaattataaattgttgtttaaaaggaattattagaaatgattttaaaagtttaaaagagaagatcttttcttttaatttgctaaatctcaacataaaaatgagctagataaaattttgttaaatactttgcttgttcctctattttctagatttttctgggaattatttgagcaaaggaagtatttttaataaatgaaacatcatttcacaaattatttttaattgaaaaagtttttaaaatctcctcctaggccgttgggccgaatcc

SEQ ID NO: 60257 - DNA, 3954 bp, Oryza sativa
ctcgcagaatatatgcatatggtacgagaaacgctccaaaaaatattggagataagtcacttggagaaagagagagagagaaagagagaggggcactcacagctataggactaggagagaggggtgcctccttccttccttccatgcggctgcgaaagtgggaggctcgtgcaaatcaacgagatatccaacgctttgtttcatcactgggaacaagaatcgtataacaagagttaggggaaaatccaaatacccgcctacaattcattactttttctgctttctactctcctccctacaactcaatattgttcaaaggatttcccaccactattcaattttcacgatttttcgtgatgccctcaatttctcgttatcgtgggccttcaacacatcccacggggtaagttgcctcgtaccatcttggtggcaaaagcgtgcacacctcctttcattttccatctttcgcaagcttaaattccgcaatcgccacttttcaaattggaaagtggaagaagatccgtgtgcttttgccatcaagttggcacgaggcaattgtgcctgcaagtcaccattaaggcccacgataacaagaaatagagtgtattagtagaaatcgtgaaaactaaatagggatgggaaactgaaagagaaattaacttacgtggagtgttttgaacaataatagaattgtagagggaagagtagaaagagtagtgacttatacgtgtatttggatttaaccccaagagtaaatgtcccgttcccgttctcggtaggtttccgaatatatgttatcgaggacgtcactcctctcaagtctcaaccttctaaaccatagtatgtttttaagtgttaaacgggatgcaacatcctaacgagttaacatggatccatatagtcgtacaaaaatgaaaactaaaattaaaaaaaaaaagatccaaacaattattctaccacatggaaacaaaggttgttcaggtcaaaggaatagctacagtcaagttcatcccactgagaaggacaaatatattcatacttcacttgccctcaggcatttatctcttatccagcatatccattttgtttacagtaacacggtaaaatcatatcaaacaagcttggagcaagcaaaatggatagagtaggaaaggactagcagctttatgcactgtggttgtaagcaagccgccgccagagaaatgcacttgccgtgcatacacaaatgaggccaacttgatgtacagctctaccacttcatctacaatgtacaatctaccaatctgctaacacaagggcgcgtggcgtgtgcttgccttgcgcatgagcaatctgtacaaatcagcctaccattcggggctactgcaagacttcagggagtaactggagttaatcaggcttgtagctgcttggatcttcgaaaaactctgctggaattgatggtggagagtacttctttgctacgaatttgtactgagaacaaatagataggtgatagaaacaatttattaccaaatagaagtaaatgcgttccagcaacaatggccttattttgacttcactcaccttgtgttgactgtatttttctctaactgctcgaaggttgcctccagggccaaccaagaaaagccggtgtagtccttttgcacaattgcataggtcggatggtttgtattgtgtgtagaatgaaagtgttgaattctgtttccaatttaagagagaaagaaatcaatacatttagtctagtttgcagaatagcaataaaatctgcaaagtttaaagcattatacccaaggattctctgttggcttaaggataaacttcgccaagaaaatagaagacgcagctataagtgacggtacatagcaaattaagctgtactccagaagtgatagctccgcaatgtaattagctaggaactcaagatgcaaaactggagcctgcagaaggaaaggttgattgagtaagctacatgagaatgcaggagtggcagagtctgtaagctattgaagaaaacaagtacctcatggcatacttgagcagctcgtagaaatctcctattgtggaaccatgaacaatatttggtattagtaactataggcatgataataatcattgttgtaacagaaaatactacctcaaaaagcattttgttgtaggtgcagtcatctcaaacttcaagtatttcaggacagaagcttccattttcaaaacctgttcgttagaagatgagaataagagacaaggaaataaaaagaacaaagcccaatctatactgggacacagacctcatccttagtgtatgtattgtcagaaatatagcagagctcttctacttggggtgggcatatctcttcatacttactgaaatttgaccatatataaactgaatcagaataaaacataaaaaagaagataaaagaaaaacaagagaacataaacagaagcaaatgggatcttacgaagctataagcaggcaagcgacaccaagtaattgcattttccgccgattgatcaccttgctcgagagataccggtcaatgtaattgactgtgaggtataaggtttcaggtacaagccgatattcttctgtgacctgaattggtacgagtcatgaatgtaatagaaattaaatggatcatttgctgtgcctctagcttctgaaccctgtttttatcctgaaatagagtagcttacttccacaagccagtctattaacactgccctcatgcttgtgtcaatgttcttctgaatggtttccacaaaatctgttgaaggccttttcttggtctgctaaaatgcagcatcacagcacaacagcaacaaacataatatcagattcttttgtgagcaaaacaaacagggaataaccaagtcagtgatgctacgtagcattatattttacaataagaatatgctaagcaagaagctaaatcggaaagcagacaaggatgacgcaatgcatcactctatacaggtgacggaatatggcatgtaaaagaatctatcacctcagccactcgcaagtgcttgtaaatgtcaaaagcaagagttgcacacagctgtggatcctcatggttgttgtcaatgtcgacgatataatcaatttctactgaattacaaccatgcttcgtccatttggatgccacacctgtaaacaaaccgctaatcaccaattctttcataggatgcacaaatggccaaaacagaattgccaattccggcaagaaaacaaacctgcaacatccctgttgtcagaaatatgaagcttatcatctgccaaatgttgcaaggaagataccacttcggagtccccatcatcaaggcaatcaatatcaaggctttccgttgaatcaccagttgacatagcatcttccttagacatagaattgtcagataggccgggtgaacagtcatggtgccccactgacggcacaatggtgggcagataagggttacaagctaattctttctgaagggtactgcctcgatgtggtattgcttgatcaaactggccagaagttggttttgggacagaacccccttctgtgttccaattgcaaaggcttcccaaaaatcaggggcggatccaacttgggacatgggggttcagttgaacccccaaacttttgggtgaacaaacaaactgttattccttgaattatttaagagaggtttaaggctatcaaattaaggaggaggagaagatctagaagagaagcgcaagcaaattccagtcccggtggggtgggagagagagagagagagaggaatcagaaagaggacgcaccaggatcccctcccctccgctgcgatggagatcgccgcccggccctcccctgttcagccgcgactcgtcttggcggcggcgcaaggaggcaaggagcggaggagacaacgagaggtactcgactactctgcccttatctcaatatttttacttacctctccttc

SEQ ID NO: 60258 - DNA, 43662 bp, Oryza sativa
  unsure (1)..(43662): unsure at all n locations
ttggctggttttctcactaagcatcttgataagcattggtccacgttatcttgtgtttttccaaagtcatattttagtttatgcgtatcagcatagtcgcgtagaagtaaaccattatgccaagattgttctcctgctgtatcacggttcaacgagagtaccagttgaatagaacctgtctctattggtataatcgttgtattagctacctcagaagaaccgctattcaactgtctgtgcttggtgtaagtactaggtagttgtatatttacctgtccattcacatccaaatatgtgaacccgtcagaagatgggttaagtgtatacccttctagaacaatcacctattgtctatttagtagtgcaactgctctattttttttttaacgtaatggtgttagtggggggggcatcgtgctgcatcctcttaccgatggggctcgaaggccgccatgcgcaggcgctgcggatccaccaccaccactttcacctgcccactcaagaacacagcagagttcagcacattgcagtagctaataaagccaacgactcgaatcagcaagcacgcaactgcaactgcaacggccgtccgctcctccagcttccctccgccgcttttgtccctcgccacccgcacgcccctcgtcgctgcagagagagaaagagagagagagccggaaaatgtgatccgactgagggaaaaaaaatccagcggagaatgagctagcggcctcgcggggtggcagcgggagagcgtacctgaggcggatccggaggcggcagaggccacgcgaggggcggcggccggcattgggggtgggagtgcgtggcgaagctgcggaggtagcgagactgaagtgacgggggcagtggacactgtagttgtagagtagtggtggtttgggttggctggccagggctagagatggtaaattagtaatttcaccatgcaacctcattgggataaactaatcagggattatggatttagggagcaggaggggacgagatggtcatgcgggtgcgggctcgacggtcggcctcggtagcataggcccgaccacgtgtgctcgccacggcatgcgcgctcgctcgcccgcgtagctcggcccctcggcgcgcacggtgatgcggcgttttcttggtgcgggcggtgggccactgcgtggacagaggacgggagagaccgaggggagtcgggattttggactatctgccatctccttcaacggcgcactctcaaatgcgagtgaggggaggttttaaggaggtttttaccctttatatttggaaaaaagtccacataaactcctaaactttagatgaaagtctgtctagcactctaaactttaaaaccggacattcaaccccctaaattttacagtaccgtttatataaccctctaatatagttttgcatagtggtttgtatctaatttatatataagttggatgagtttgctcacatgtcattcactttggacatatatattaaaattttgacttaaatctttctttttctccttattaactcttacttccaaacaaataccaacataataatagtatgatatcaccgtataagaataaattgatgacttataactgatgatatgcaaatatgttatattaattattcaaactattcgtttaagcttctaaaatatgtaaaaccatcatccaaaactacctttggagagtaatatggatggtacggcaaagtttagggggttggatgtctagatttaaagttagacgaacttccatctaaagttaggggggtatttggacttttttcttatatttgggttaattaaattcctatataagatttaagatacaaaatttaatatcgagtacattttagactgttttatagatgttttatgagcatattttttctctttaaaaaaactttatgagaatgtagttttagtcatgtaggaagtttcagagcaagaaggttcattcatgtataaagttagcaagttgtacttcctgcaaaaagttctataatttggatgttatactgatgtaaacttcacaacctttgatgtaaacaaagtttatatatacaaattttatgtacaagtacacagtttttttttataaattttatgagcacaaagttttttttaccaagtttatgagtataaagttttataatttgaatgtctgtttacttcaaagttgtgaaaattttcaatataaagtttttcaatacaaggttatggtttaaaataaagttgtgacaacggaaagtttttcaatctaaacttttgtgtgtactaagtttctattccaccataaagtttcaaaagaaaatttatactcataaacttttgtgtgtactaagtttcaattccaccatagaattgagtcatttgccaggaggaaagacaactgatgacttttgttgctatgcaaatttacagtgcatttccaattcgtttgaagtatgtactagtcatcaccttcagcatggccaatcaatattttttcaaagtctctgggtcactggatgtcttctttcagtatttttggatgtttttttttgcaggagtttacatcttgtcacgtgtgtgttcctgacttgaattttcgcagagggcaaagcaaggcttcgccaattagaacattgtggtattgagatgtcatagctttttaatatgttggatgtgcattactctttagtttctcgttttaaggtaggcatcgtaatcctgagttaaaaaaatataatcacatcgggtatatgccatttactctatgaattgatttgtggacttcagtattggattctacaacggttgtttctcgtgcaagaattaaccttctgtacctggattgtgagtgttttcccattgtttgtatgatttagctaaaacatcatatagttgtgcatatacagtgatcaattttttttcttaaattattgcataaacttgcacattttttcacaaggacaacaacatacagggtgaactgccaccaaacaatctcatccgcatgtatgacttcttttttttaaaaaaaaatcccctattttttttctgaagtttaaaagttacggatctttgatgtcaaaagtactttttatcacctttgaaagttttattcatactagttgaaaactaactcccgacctatttattatccctatttaccccctcacagaaagtaaaggataactcccttaaaattgtgaaagttataggtcctactagttacttcctccgtttcacaatgtgcatttcccacattcatattgatgttaatgaatcttaaataaatatatatgtttagattcattaacatcaatatgaatgtgaaaaatgctgaaataacttatattgtgaaacggagggagtaagaagtttttgattgattagtggaaatgttttctccttatgggtcagaagtttctttctatgggcctggaaacgcataaaagtagacaaaaaaaatcgcgtgaggagcacctatgacatcactacgaaagggaaaacgcttggagaacgtgttcgcgcacgacgtggtcgcacgaacggtggcgcaatagcctcctcccccgacgctcttgatctatttttaattcccatcgtgtgcacaaatctcaatgcggatttgatggccgaaaattcaaaactttcttctctaattttcttgctacgaatagcaattccgaaagtttgaagaattaagaaaaatagtgtgcgctagttcgctaaatagcagtccccttaccatatctatcaaaataatattatttactatctcgccaaattcaaaactactaactcactcctattttaagcacggttatggatttctatgtctaacgtttgattgtccatcttatataaaaaaattataaacattacagaaccacggtctttttacagacttattaatgttgagattatgggcatataatgatttaatttattccataaataaatcatgacattacagatgaaaactagtatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgctggtgcacgccggcgagcgggatggagtagtctacgagcgacggcgcagtacagagtaggaggcaaaccctagattgattttcgcatatattgcgtgaagacggcgggtcggtttatatagagaagggtcgcttgatcagggcgcccgcacgatctctactgcgcgtaatcgaaccggataagtcgcgcgtaacttatccggactccacgccgtttgcacgcaccggatttttcggaacgtttccaaaacaaaaacgaatccgaatttgcagcaaaacaaaactgcaaaaggaggctgcatctgcgcaagggtgaggagccaatttttcggaccattcgacgcgtacgtcgtgcacgcgcgccgcctgccctgccaggccaggcgaggcgagcgagcgcgcgcgtgtttcccctcttctctccaccacacatgcttcaagtagctaggagggcatcctcccttttaaggaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccaattaaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttctgtcggtgacatgggaccgggagtatcatgactagaggcttgaggcagacacaatcgcccacgtggcctggcaccctcggggggcgtcgggcccgagggtgatgtgttcgccctcctctttgtctccccgagggggtcggaccgctcccgcctcggccccgagggccgaggcgccctgaccccttgtgggttttgcgccgcgtatatggggtaggtgagcatagcggggctcacctaaccgcatttattgcggtttggacgagcgcgtcacgccacatgtagcgcagtatggcacgctcgtttatccggtctgtgaccggtctcagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatataccaggcttcatcataaccattacaggcaagatattgtatgaagaagggcaaacatgcagattgttaaactgacacgtggtggacaagaatgaccggtttatgaccggtctgacaatggtcatgtcatcagcagacagccatgttcccacgtcgcgcctgcttccggcggaagtggaggtaggtataggccgtcccatcagaaggtcattcggacggcagccatacaaatctccgtccattaatgaagagaagtgaagttggagggaggagaggatgagtccccacacaaaagaaagagagggagagatggtgcatgtggtatccccttgagatataaaaggaggaccttgcccacttagagacgggaggaaacgatcccagaacgatcgggggctggctcgcactttgtagcttcttcatacacagatccaccaaaacacaggagtagggtattacgcttctcagcggcccgaacctgtatacatcgcccgtgtcttgtgctttttccactctcgcgaaccttccacacacagactaggagcttagaatctcacccagggcccccggccgaaccggcaaaggggggcctgcgcggtctcccggtgaggagccccaagctccgtcagcttcctagaagattcacccaaaatcttcatagactgcgaccaacagtcaagctcacaaaggtgagttccttcaagaatgctctgcaggacaacatctttgctaattaaagccaacagaactcattaaggcatagccaacctgccttgcagctcacgagagtatatgcatcttcacttggatagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaattgtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatctttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctgtcacctcccaagtcccgttagcgataatggaatccatttcactacggacagcctccttccagtagtctgcatcacgagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgtcaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcggttcttcctttcagcaatcccattagacgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctatagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacccgcttccatctccagtgttgccaatggtcacattagcagacttagaagtctgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagattattgctagcatcagtagcaccgaatttagtattcagtgcatcccacaactccttagcgtcggtcatatgcatatacatctcgaccagacgatcgccaagaacgctaagaatgcatcccacaaagagagtagtggcttcctcgaattgcttctgctgttcagcagtaagaactcgttcaggtttgccagtactcacccagaagcatttcatagctgtcagcgacagagtgaccctgatctgccatctcttaaaatgcacaccggtgaatttatccggcctcagtgcatcggcaaaaccagccatagtaaaatcacagtgcctatgataaggtttttggattgttgagattatgggcatataatgatttaatttattccataaataaatcatgacattacagatgaaaactagcatgaacgcatcattagatctacacatgtaaactacgcagaataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaaggcagaggttccggagacctgctctcccgatcgttggtgcacgccggcgagcgggatggagtagtctacgagcgacggcgcatttgcagcaaaacaaaactgcaaaaggaagacctgctctcccgatcgctggtgcacgccggcgagcgggatggagtagtctacgagcgacggcgcatttgcagcaaaacaaaactgcaaaaggaggctgcatctgcgcaagggtgaggagccaatttttcggaccattcgacgcgtacgtcatgcacgcgcgccgcctgccctgccaggccaggcgaggcgagcgagcgcgtgtgtttcccctcttctctccaccacacatgcttcaagtggctaggagggcatcctcccttttaaggaggtccccctctcctagaataagcaaggtggtactaaactccacatgcatgccatcccatgagatgggcttttgtgattttctaaagaattaatctttgagtgggctaagacccattcattaattgcaacaattaaaatatcgtatcataaaatggaatacaagagacagcgtaagaaggtggtacaccatgccgccgaacatcccagcgatcccgtaaacccggaagccacggccggccgtcgccgcggcgccggcggagctctccaccggagacgacgacgtccctcctacggctgcccccgagccaccgccagccgcagcgcacggcggcgcgcccaggtagctcgcctgcgcgccgccgtacctttcccggccgacgcacagcttgtcgttgccccgcacgtcgaggcgcctgcccagccgcgccacgaactccgccggcagcgcgatctccccggccagccggttctggctcaggttgagccgccccagccgcggcagcgcggcgaggctcgccgggatcggcccgtcgagcctgttccggtcgagcgacagcgccgccaggctggccagcgcggcgaacgcgccgcgcgggatcggccccgtcaggccgcacccggacatgcccaccacctgcagccgccggagcgacccgaccaccgccgccggcaccgccgtgccgatggggttctcctgcaggagcaggtactgcagcttccccagcccggccatcgacgccggcagcggcccggcgagctcgttgtggctcaggtccaggaacaccagctcccgcagcgacccgacctccgccggcaccctcccggcgagctcgttgtggctcaggtcggccttctccagcatcctcaggctccccagcgccgccggcaagccgccggcgaggctgttccagctcaggtccaggatggacaggctctccatgcctccgatctcctccggaatctgcgcgcgccgaacgtacacgtgtcaccaccacgacatgtacacgtcgtacgagctcagtgacatgacacctacctcgccggtgaggttgttgtagctgaggtcgagctgctgcagcggggcgaggcggccgagctccggcgggatctcgccgcggaagccgttctgggacaggctaagcacgcgcaggctcctcaggtcgctcagcgtcgccgggatccggccggtgaggccggggttagacttgagcacgagctgctcgagggaggaggcgttggtgaagagcgccggcgggagctcgacggcggcggcggcggcggcggcctgatcgtcgtcggtgttgggaatcaaagcaactcacgcgaatacaggctacactttctgaacgaggcagagaggaagaaacagagaggaagaaacacaaacacataagcaaacacacaggagctttgcggcaccaaaacaacttgtgcccttttcactggttttttctcttaactaaatgattacaatgagcagctatttataacacagcacatacacacacgaagctggttgttccgcttctcgagccacacacgacgcccacgtcctgtttacttggccgcaacttcacaagtactgagtcctcgccgacgtcgttgcttgcaccacccaactaacctgcatgcatgcaaactgaccacatcctactcataatcttgtgcaagactcggctaatcactagcccacaattatgcatggctaactaactaagctacatacatgtgctctcatctcctggctttttattggctcactactcactgccaaccactactcactaagccatgcagcacccacgtacatatagctagctctccaggccatgcaatacacacatgcatatagataaacatgctgaaattaagaaacaacaagattaatttctaacagtcggcgacgacgaagcagccgaagagggagagcgtcttgaggtgggggagtcccaggagcacgggcgcggcgagcctggcgccgggcctgcacggcggggtggcgacgtcggggccgaagtggagcctggtggcgcgcaggtggcgggcgtcgtcgggggcgagctcgcactggagtcccggccatggcgtgtccgtgcagggacgccggtggagctgcggccacgtcgggtcgccgaggaggtcagccatcaccctacagatggcagccagttctgaccttggcagctacgccggcggcgcctccccggcgagctgcgcggcggtggacatggccatggcgccatggaggaagaagaggaagaaggagatggtcagcgaggcgagccaagcagccattggatttggtcgatggtctaccctaggcttgcaaacctgagaatctgagatggattcatggttttatagtacgaccacactcaagagtgtcacacacagtcatactgccacacagtgtatctctctctaatggtaaaaaggaagatttacttggtatagtagccttttgtactgtgtaatgtacggtttggatgatttgttgatcggatctatggcccttcacagttcttctacatggaggagttacctactgcgccagctcagattcacgcgtacatggcgctgagacccgcaccttcgctcggccgctcgccccctaactgggagacgtgttttctcgctgcaacgagggcgcgtggcgaaggaaactcgcactgtggaagtcattgcttcgattcggcgcgacctcgcctcctcctctttctccaccttcgcctcctctttctccaccttcgccgccgctcgtccagagaggtgaggtgagaggggagccggcaagggaggagaagagagatcaatccgcctcggcctcctcgaccgtcgccgctccggatccacgccgccgcctcggcctcctcgccatcaccgctctggatccacgccgccgcctcggcctcctcaaacaccgccgctccggatccgactagatcgagacggacaaggaggagaggagagttgctacctggcggcggcggcgtcgtctccgtcctctcgccagcgaagggaggaggggaggcccgcggaggaaggaggggaggctggcgacggcggagggaggagaggagagctggagaagagaggaggggagccggcaccggcggagggaggaggtggcctagctcgtcgatggtgcggggatgacgagaaaaagctgcacgtggggatgacttccctaatggagataaaggatgaccataagttctcggtctcgttatctcgtgtcaaatagcatttcccaaagacttggcataaatctgtctctctaaatatttgtttgactagctctttataaatttgactcttcatttttttatgctccaagaaactctctatttaagttctccgatataaccgtgggacacacatgtaaggttgtgttattcccctttctttcccaacccaccttcatcttttccgcgcgcacgtgttttaaattcttaaacaatatgtttattaaaaagttatctatagaaaagttgctttaaaaaatcatattaatccatttttaagttttttaggctaatacttaattaacacgcattaatgggtagcgtcattttccgtgctaggaggtggagtctgtttactcttcttcttcccaacaccactaaccaaaatcttcaactaaccactatattgactagcgcctccacggtggagcagcaacaataacatctgtcaaacaacaccgaggacccttacacgaacaactatatgaaggagatccaaggcaacaaagagaagactcggccgaactctggactattgtaccataggattataggtggccataaggcccgaggcccgatggcctggcccaggcacggcacgccctggttggggtcatgcccaggctggcccgacccggcagctaggccatgcctgggccgatgccttggcatggtgggctggcccggcacggcccgattcaatgaggaaggaagaaaattagtttagggactaaaattagatttaatgcagccatataattgggatgcaaaataaacttattacaatcatttagacatggccaaggatggaaattagactttttttatgaagaagcatgatgggctgtcgtgccttcgggccgacacggcacggcccggtttgttggtcgggccgtgccggcccgatagattctggcctgagcacggccgtgccgcccatatggccatctatacataggatgatttggaggagccgaagctcgggactctacgctgctagccaatctagagctccaatgttggcatcagggcttttcttccacggagtggatgctgtggggggtagtgacgaggacattattagatacgctcgcaactccacaagttctaatgacagtttcaagtccagttcgtcctctagatacaacactacaacactgatttcaaatggacatagcaccttcatgctaactctgatttggatgatctttgacttttttttcgaaagcttgtgttgtcacctgttgttaacaacggaacgcatccggcattgtatcaaatttttttatgagtcaacgggaatcgtcaaaacaagacagtgctattgctggaactgaatttgagtctttcggtcttgtaatagactggacccatcttgagtgtgtgtctatcctcctccactatccataatctatcccaagctctttttttctctataaatatctatgtacacccccaaaaaaaattaggttttgtttagctgaattttaccaagtgtcattcggtttgtctctagtcctgttcgtttagtcgatgactataaatttagagccccaataggccaatagttggtgtgttgatttaccgagtcgattagatctatcacttcagttgcaactattcctttgtgcttagttacctattcacgacatttagattgcatcttaccttgttcttgtagtattcttttgattgaatttcagggatcatcaaccgcgcgtcacggttggtatgacatcatttgttgtgaagcgaatgcatgacgtcctggacttgttttggttggttgccaagttgcaaaagtcgtattcgatcaaagcgagcgttatcccctcaccagaagatcgggtcgcacgagagagtgtcatcaggtgggccttcttccactaggagccttctaggtggatgcaagcggtggagctgggaggccgagaaaggtgacaacaacacagacaacggacaagaaggatgcaaccgatcgtgatgacttgttcggtgtcaaacagaggagcgaggcaactctattagcaccaaatgagaggatggacggaaggagagctcgatacgagtaagagagatagggagatgagctgagaacaaatagtgctaggaggaggagagacaataatcataggcaatcttggcaccccttggcggtttggcattagcatcatttgcacctcacattcgaatgaagtcccctctcctcttccaaccttctttttaaatcatgttgatttggtatcgaaatttgtggtataccctacttcgtttgtcctaatttttatctttagaattaaactctagttttgagatgagggtaaggcgagacggacaaatgtccttctcttgatctcctccatccctctcttcgaaccatattgaattggcattggattttcatgggaagtagacaaatcaaagtagatttccggcaatttgttctcatttttaggattaagttgtgcaagcatgcatgggagggaggttagcgctaacgggactagcgtcaacccttatccattttatcgagcacgaagtattagggtcttagtgtcaagataatttgtatggagacatttaacatccgtgccaatgattcttgccccccgagcttcggatctatttataaaataagttttgcgggtctctattatagagtgggtttattttttacatcaaatgtgaaaaatatctgggattaatactcccataagtgtggatcataaatgtggatgtgtattgttgtccaaatctaatcatgcgaaaactattgataacatttacatttaagcaagaattttggtagtccataattttttctattgcaaattatgcatgattgtatcttcataaatgtcttctttaaaggatgaaacttcaaagtatagtatctttatatccactgacaagatatcattactcgttgttgtgtttagttcacactaaagtttagaagtttggttgaaattggtacgatatgatataaaagttgtgtgtgtatgaaaggtttgatgtgatggaaagttagaagtttggaaaaaaaaactttggaactaaacaggccttaagcagatgctggaccagcccggctgcctctattaacaaactctatgaccaaatcactgtaaggcccaagtttagaaataaacatttttgtacttggtcacgaggctctttttgtcttaaaagacagattttgttgtagtgcctgtcataaacaagataaactggcagcacagggtacggtctgacactgacactgtgtcaccaagaggcatgaaattgtactgcaaaaatcgtcggaactcgaagacttaacagcgagtcgatctggtcaaaatccgccatagtataaactagacgtatttataggtaatatagttaagttcttgtcatacattttatatcaatttaagtgatcaaagcttaacactatcacctaacgaccattttgcgttgctagtaccttaaaacaattgcgcctcaccaaagtttcgataggatagcaaacttaacaccagggcaaagccacgatgtgctccgctagtgcattgggcacataataataataacaaaaaatcaccaaagcatgttctttcattgcacgtgtaattgaagtatatatattagagaaaagtacattttacccccttaacaactgcagttgaccgaaaaaccccccgaactcaaaaaccggtcatttctcaccctcaactatcaatactggatgaaaaacctcctgagcagctttgcaaacggttttggtctacgtggcagcccagtcagcaattcttttctttttaaatcagcgggtcccacatgtcagtctctcaccctctcttttacccacacctctctatctctccaaaatcctctctcttctctcttcctcaccttgaggacggcgtcctctctcttctctggcagagctcaaggcgacgaagggggcggcagagctcggggctgcggaagggacggcggaggagccaaggccggtgggcgggcgcggaggcggctgtgggcggcgggcgaggagccgaggctggtgcgggggccgaggcggctacgggcggcactcgttcggacggctagttgcggcggccggctacggaggaggaggcgcacgcactcggacggccgtcggccgaggcggtgctcgcccatgcggcgggcgaccgaggcggagctcgcccgggtgtccggcggcggtccgtccgctctccccctctctatcccaatctctccccctctctatcccattctctccccctctctctcttctccctcccctcaccggtggcgggcaggcgaggcagagctgctcgggcactggcggcgacggcgggcggctgagacagaggcggagtgggcggccgacggcgaaggcggagctccctgggcagctgagacggaggcggagggggcagccggtagcgtaggcataaagcgctctccgacctcttggtcctccccgccgcgaccttgtccgtccggaccactgccgacgccgtcgccttctcctcccggaccgcctccttagcacctccatctcaagcttcgccgccgacacctgtgagtcgtgttcgtgcccaccgcgccctccccaccacgcccaccgcatcccccagcagcgaagagagaaaagagagagaggggtgagccgaccagaggcacccatccgtgcccgtcgccgctcatcgccgaccagttcgtcctccctaccgcgcctgctgcctgcctgcttgcccaaccgcgtcggtcttgccacgttggactgccatgtgctcaagtctccggtcaaaaccgcccaaaagtatggttaagggggttaagtgtccggttttattagttgggggtttgaaatgaccggtttttgagttcgagggggttttttaagccaaccgcaatagttgggggggggtaaaatgtacttttctctatatattaagagtgtgatataaagaatgaaacataggataattcatattctagcttcgcccgtgcctaacccttcaccaaaactttactttcaccgtaagaaaagcaattttttcagactgccaaaacatatttgtgtgtgtgtgggccgcccgcctactggaaagtgtatgcaaaaaatgctatttttacgtatgggtggcgcacccgtacacaaaaatctagtttttgtgtttggatgcttacgtcgtctgcacgcgtggcacatgtggttactttgttaatctcaagatataccggatataccggcccaatcttttaaagatgctcataaggatataatatgagtgtgtgcatttataaagatgagtgtgcgtgtgttacgagtatctgtgtttgtattggatttaaacaattgcggcgtgcaatgcaacccgaatacaaactgcactacagacattgcacaaacgccaacacagctgttgccatggtcattcgggtttgtgtgataccagtccacttggagtgcaatccaatgtctgtagtgcagtttgtgtgataccagtccacttggatggacgacgcagagagcaggcgtgcattcggtagatggtaattggtagtcatgcaaatcggtagatcgatgcgacgccatgcattttcttgtgctgctcgtgttacatatgtaatctcaccaagttactttcgtaaaattttaaatagttttatttagaataaaatcgaaacacctttacattctaaatgtaacgggtggagtattactgtacaagtgtatacgtgcgcgcgtgcgcgcgcgtccacggtatactgaagtactacttcatattctaatgtataacgccgttgacttttttccaacgtttgaccattcgtcttattaaaaaatttatataattattatttattttattatgatttgatttatcatcaaatattcttaagcatgacataaatattttcatatttacacaaaaattttaaataaaacgaatgactaaatattggtaaaaagtcaacgacgtcatccattggaataggagtattatatagcctagttgatgtgtttttgcacgggtccgcacggacgttgcgcgcaatggggcgtgatggtcgtgtcgtgtcccacgattccatcccatcccatggccacgcacggacgtgttggtaatacttggaaggctgcatgcagagagccctggtgcagaggtaggcctgtcccagcccacataaaactgtgtgttgcttgcagtaatcagggcctctttatatcctatcctaaaatttttcaccctattacagggaacgtttgatcacatacatatagtattaaatataggctaaaaaatactccttccgttttttaatagatgacgccgttaactttttcttacatgtttgaccattcgtcttattcaaaaattttatataaatgtataagatataaatcacacttaaagtactatgaatgataaaacaactcataacaaaataaattataattacgtaaatttttttgaataagacgaagggtcaaacatgtgagaaaaagtcaacggcgttatttattaaaaaaacggaggtagtaactaattgcacagattgcgactaatttatgagacgaatcttttaagcctaattactctatgatctgacaatgtaatgttacagtaaacatttattaatgatggattaattaggcttaataaatttatctcacgggttactgacggattctataattagtttttttattagtgcccgaacatcccatatgacattctatataatatctataatatctaatgtgacacgtgaaaactttacgcatcttataacaccccctcaccagtccatccgtagaaacaagtactgtacagtagtaatagtccacaaagaaacagtagaagctcttctctctctctcgtgtggactgtgtggtcaaacatgtgcatgaaaagaaaagacgggtaggctcaaggctggcggagttgcaggcgggggcggacgacgactagctttggctcggcgcgtgctgtgcagtgcagggcggcccaattgctcaacacaacagtggccactggccagccgtctgctgctgctgccgctgccgcacgcagagcaatcgcaagtgggcggcaaccaggcatgggctcccgttgttgtacttgtccaccagaccagcttaggtagcggcgagacggcgagagctcgtgctcgtcccacgcggacgcggctcccctttcccgtccaggaagatctctattcctctgccttgtaggcttgtgtgttcttaggtatggggttgggtactaataaaaaaaatcgaatattagagaatgacctaatatcaaataattagaaggggtgaggtttcaaatctagatcgtctagcccactatcttgtggagctagccggaagacacctaggtgtttttcagggttgggtactaatcaccatacatgaaaaatggagcggtagattcacgcataatcaattaagtattagctaaaaaaactttaaaattaatatgagttaatatgtttttctaaaagcaacttacctatagataatttttgtaaaagaaaatacttctactatttagtaatttggaaagtgtgcacgtgaaaaatgagggatgagaggttggaaaccaccacaaatgaactcagccttagggctacagtggatccataccaaagaggacccacgtaccagtaactcaaaattatgtaacttaagtcagagaatctcaattctctttccgtgatgtctaccaggcgaacttatgtaccgtgtgtttggttgctcgcatctctcttacttacctcatctccctcatatagggtaagtttagctaggctaggttaaggtaaccgcctctccgacggttacttggcgactggtgactagtgacgacgatttggtatgggactgtcatgaacgagtcggctggcgccctttgggcacgttgaatggttgtggatttatgcggatggcttgtgaaatcccaaaagcatgggataatagataactgttatcagattttttttattttcaaaataacaaagcgggttggatagtatgatctgatagaatgattgatcgggagtgggtttgaggggcgaattcatcgttggggcatgttggggcttcagccccagctcccctcgatgaaccccaggtgccactcttcatccgcagtagcgcctgcataggcagaagagaaaagggtgtgtagtagtagcagcacccagaggaggaagactattttctcttggttgggttgtgacaatcccgcgtaataggtgctcaatcaataagaccatacagattaacaagacgtgtcaattggttacgttatgatgtgccatttagtcaacacaaacacaccaatttatttaattattttttctttgtgaaatgttcctaatacttataaaatgattggtaatttggcatttggccggtttgatggtcttgacatgttcatagagatgaaaaaattggttttaatttgtattttggttagggcagcacgtatttgctttcactctatttatatattaatttaattaggttacctaaaatattaaatttgtttagcaaatgatcggcatacacatattttcatgttgttaggccttttaaggcaatgttggatggtaccggttagtaactaatccttcacgcacgtaaatatagcaacccattagcacatgattaattaggtattaggttaaaacccttaaaaatgaattaatatgattttttaaagcaagttttctataatttttttttaaaaaacacatcatttacaattcggggaacgtgcacggctgtgcgcggaacgatagagtaaaagtcaggagaaggtagtatcaaactcagcctaaactggcttacatggaggatggagcacccctcaacttttatcctagattcgccagtttgatatgtataattttatacatgtatgtatataaatatacgtataaacatataaatataaagtttatatgtatactccctccgtccaaaaaaaaacccaatccacatgtgtccaggtttaaatctaggattgggttttttttgggacggagggagtacgtataaaccttttacatatgtatagtacaaactttgattaaatgggtcaaacccacatgatgaaagtggataaaatacgtcaagcctatattttataaaaaaaaatgtaaacgggcttaagcccacatgacagaaatgggctaagtctacatttaataaagaaaagataaacgggctgaaaaaaaatcacctcgattaaaaatggcatataacgggctgcgccacgcgctactgatcgctaattagtgacccgcttgagaaccgctgatttgaaaactgcccgacccgattcttttctgggcaaactgcaaaagacacagatcaaacacatatagcctcgatttcatctcagccatccgattcatgatggccaaccaaagggatcgtaatgacgccaaccccaacgattacatgacgcatgcgatctaattgacagcaacaccaaagtctgaaacataatcatgaaggaggacacccttcatctgttggcatcgttgagaaggcacccaaggctagggcccagggacctaatctcatcctaactccagagtccaaacaaaacactactgtcgttcttggtgaggtgagcatatagctcaactactcgtagatttcttagggtgaaatcagctaattacggatgctcgtatttatggttaattatttttttagtggtaataggcagcatacccatcgatagtgaggtgtccgtaataattttgttaattttaagatatgtgagtttagtttttcggacgagattataggggtagggtgtgtatgtttacgtttataggagtaactattactgtgtttttttgaatgtactatattccttggtaatacttgctctgatcatcattaactgtattatattactgcaaattagggaacagataagacttagaattatgccaagagaagccggggaccggacaaatcgcaactttgcaagcagattgtatatcgttgccttttgggaaaggcatgcatacgaaactcgtgtctgatgcctgaccatggcatgatcaggcagtggaagctaattattactactacttcgtgcgatgatgactagattatctcactgagtacgtctcattctgccttaatataattggaaaagaactggactttggtattgttgtcaatatatcaagtcctgatggctactctcttcaatttcttgtccaattcgttaatagagtgcatatttaggctgtgttcaacacaggatgttcccaactcctctctcttgtgttccacgtgcacgctttttaaactgttaaacggtactttttttgcaaaaagtttatatatgaaagttgtttaaaaaaatcatattgatctattttttaaaaaaattagctaatacttaattaatcacgtgctaatggactgcttcgttttccgcgtgaaagataggttcccagcccatagaatcgaacacagcctattttgttaattaagagaagattagttcttgatttttttttgcattttccaatatatatgtacaacgtactgcaaattgaagtgaagtgaatgcatatcggttggtcctcaatataatatcctcactaatttctcttctgtttatttaacagaaataataccaaagaattatccattcattgtgacctgttgttatttaattttctaatagcttacttcggttttaagattggtagcaacaaactccgcagttggtcgtcaaattgtaatcattcagtggtaatagctgtgcaagtagccttttccacctgtatcaaggaaattaaccacggaacccagtaataatgcatatctgccttctagtaatctctaaccaaacgggttagcctcggagaaagaaaggaaatgattagctggctttgttcctttattttcgacgcttgatcgatctagttggtcacttccaaagcctggatttgaccaggtgaatatccatggcaactttactacgccacttgtctaggtctagggaaaagttcaacaaagatgaaggataatttatactcctcattttctccccttcctcattctctctccacaataatgaagggcttaatactttttaaccttatgttaatgtatttttcactagctaaaacaatagttttttttagaatagatggagtacctctgttcattaaattctttggataagcaaatgaactatgttttgccttaagttgtactccgtccgtcctagaatcatttttattcctcccatttgtttcaaaataagtttatttttaagcaatcattgcattgaagtaaatgaaagtaggggataaatgcatcaggatcaatggataaaaagaagaataattgcattgagatttgacgaagtgggagtattatatttttttggttttgtattggtatatgtggaataggtgaaaaataaacttattttgaggaaagattatgtactaatgacaaataaaagaccagagggagtaatataaatagctggatttatttttttttctttgcacatttgtaaatgaacttattttccctaaaagtttgaattgtactccactatgtaagaaaatgatgtggagacaatgatttgatattactggcatattgaattctaaaaatacaacacatgcttagctaatagatgatgatgttgcacacttacatgtgctttaaaatactctagataataacttgctactgaatgatgatgtgacacacttgcatgttgagttttaaaagttaatggacatcaactatatagacggtatagataagaatgtatagtatggatagtctaacccgaaccataaaagtcaaatgtggaacaaaagtaaaacaagcgagcttttcagaaggttgggtgcaacctaccgttgtctttgctacttgcgacactattgctgttagctacaccgcagtatcgctgaataacccacactattgctgttagctacaccgcactattgctgaataaccccaaggcatagattagtcttgtggttttccaaactacttttttagattaccactatccgatggtatatcatgattatcaggataaccgtgaaaaccgtaagtttaccatgaaaaattgtatggttaaaaatttaacaaggtaaccgcatataagtacctccgataatcgtgacgtaaccgtacaatattgtaatcgaggacattgttgtccctgtaggatggaacacgtggccatacatgaagccatcctagaatacaattcacgattcacgcactacaatgaatgtggatttcacccccaattattgaagaagattggaaacttatatgaagaatattttagcatatgacgagacgtacatcatgtttccatcaaagatgaacactgagcctgagcctgagtctgaatatttctggtgactgaagaatgagctggctagcaatcatagtgaagtaaaccattcttagctggcaggatctcgccgagtaaagcctgatgttttcaatcagcttcgattgcaaattcccgtgaaaaaaggaatgtttttaagttgctgtgccaggtgctgcccttgagcatcaccagtgtggtgtgtgggcaattgattgaaccgtacaaggttttgattggtgatttgccaattgattaataaattaatgcccgtagttgcatattgttccagagcttaattgggtacttgattacatcatcatatatagcggcagtggtatagtatactaggtatataaagtttctagatcgaaactccactaaacactgcagtctcatatggtactagaaatactatatatttctacctccgtttcgaaatgtttgacgcagttgacttttttaaacatgtttgaccgttcgtcttattcaaaaaatttaagtaattattaattcttttcctatcatttgattcattgttaaatatatttttatataggcatataattttacatatttcacaaaattttttaaataagacgaacagtcaaacatgtgctaaaaagtcaacggtgtcaaatatttcgaaacagagggagtatcataaatggaaactctttgaaattatacttgttcccggtacaaatctaaataagtgagaagtgaagcccttcatgctgaactactgagccacgtcagaagatatggacagtccgaattttgctgcagatgttactccccatcagatccttttattggtaaaatatcttctttttccttcaagaaacctctatctacttttactacttccacgtctctagataataaacttaaatcattttccatttcgctccttcccttccctagcggatcgcgatgactcctagctctctttgcacgcaaagcgccgccaccttcatctccatcccatcccgccggtctcagcctctttctccccatcccctctaccaaagccagtcctccccatccccatcgactcttctcttcttctccgtcctctccgccgctgcctcctattcatcaccgcatccagcagtgaaagaaggagagatagaggggaaatgatagacaaggaggagagggagatgaaggcagggacgtagatgaactagcagaccgtcgatccggcgtggaggaaacattattgttgaattctgataattcacataagttgacatatggaactcatatatggattgttaatgcagtaatcatttgtcctatatatgaattattgattcgatcatagaagcaatcaaattgtacaggatatataacaggaattgcagatatatattactagcaacacaattagttacaggaatcccagatattattactagctatacaattaggatcatccggagtagaaatatatagtacactaacaataaattccacaaccatatgctttgcatttactgaaacttataaaaggagacagcgaaattatatccagggtttgacattttggactaaaatttcggatccctccgatatgatattattttggccaaaatttttcatttttttaatttttcatgaattttggtaatatttgctcaaaattgactaaattttgttctaaattttggaccgaaatttctgaaattttgtcatatcggcactgcccgatacaaaggccaaaaacgaaaaagtgaaccctggttatatctacagtgttgccatgcaatttaatagcgttgttctttttctatgcactgttgtcttatcacaataggatgtagctgtatatatcttatttgttgatttttcagcaatcctggtatatataattctatcgatttatacaagaagaagaagaagctatgttcacgtaacatttgatcattgatcttattagaaaaatatttctttgatgataaaacaagtcagaacaaaataaataatatttatataatttttttaaataagatgaatggtcaaattttatataaaaagtcaacaatgtcatccattttgggacagagggagtatatatattttttctagattaatgaagttagcacgggtgtctcgttgttgacgggcatatcgtctatcactaaaataataattagttatagatgcgagcacccgtgtcagtctacaacttaaaaattcgagtggattcgttccaccataaaaactctagccagttgaactacgctcacctcacgacggagtatattactttgtatgtttgggtaggtatgctccggccgtgacctaccggctggctagcgcctgagcacccgcgcgttgctcggcacgcaggcgtgccccaccctagctgccctgccctcttcctcccggcaaaacatgtctgccacagtgcgtagctggaacgtgccaacgtacttgtgttactaggactctctagagtacacagatgcactcacgcgccaatcattattaaccactcgcgcccacgccacagcacaaaccatcattctcgaacacgtatcaatcagccttgctagctactacaagcagctataaaaagcgcagaggcaggcagacgagatgagatcgccacagccaagctctcgcacacaccgatcagtcggtcataaacgccattagaccaagctcaagaagaagaagaagaagaagaagaagaagaagatgcggcagcagcagcagaagaggaaggtggcgtccgtgtcgtcggcgctggtgatgtcgctgctgcccatcctctacgcgtcgctgctccgcctcccgccggccgcgctcgccagggacaccaccttctggttccttctctccaactgcatcatcgccatcatcgccgccgccgactccgccgccgccgcgccaataacaacttcgtcgtcgtcgtcccacggccacgacgacgttgacgaaccggccctcctcgccgccgccgtcgtccctgctgctcctcctcctgcagcgggtgatgatcagctccccgcagaagcgccggtggccgtacgaaacgacgatgagatcaacgagccgccgtcggcgccggcggtgacatcgtcggcgacgccgtcctccgacaacccgccggcgttcatcgcctccgacgatgtcgcaaccgagggtgaacggccagatcagcaaccacaagaagcagcaaccgacggcgaaacccacggagaggctgtcaaaggagacgacgacgaagacgaaacagcaagcgacaaaaccacgacgacgaacaagagcctcccctcgtcatcgtcagaggagcttgcgattgtcacctccaacaacgacgacgattacgacgacggcggtgactctgcgtcgtttggcgaggaagacgaagggaaagtagtgccgtggggcatgccggcgccggcgacgacgacaggcggcggcggcggcggcaagcagtactggcagctgagcgacgaggagctgaacaggaaggtggaggagttcatcacccggttcaaccgagagatgaggctgcagatcctgcaggaagccggtgtctgactcacccactcactcacagctacacctccatcacagtggcggatctgccgtgaggcggcgagggatcgagtctccactactgacaataggactatgagagtctttcgagtcctcctaaaattttctaccacatatatctattggaagaagttatgtacatgtgtagtttgttcagtctcctactatttcttcttggatatgatccaccttctagtatatatgttcatataatagcatgcaactattatatatttgtattgcatatagatgtacaggttatatataatacaagcgcatcatatatgttaattagtttgcttatgtacgtcgttaatttgtgatagagtatagtgtactccttatgtcctattaaaaaaacctaatcccccattctaatcctaagttttaattcggattaggttttttatgggacggatgattgagttttttaggggtagagggagtagtgtacatgcattttctttgtgcacagtgcacatgccatgtaatgcaggtttcaggcttgtttgcagtgttatacacaagactgttttgttcgatgagagcgacatgttagatatgacatggatcgagtcagctacctaaagaagcttcggatgataaatctacacgtacgtacggccgggccggccatggcgatatcaaacattaaggctggaattaaggtgacagttcactctggagtgtgaagtgatgtcacggatacaaatcagggcacgatttagtcatggatatcgagctatcgagagccgttcgtttactgtgctcggtgaaatcatgtccacatatatacgaaatctgcagcgagccagacatagcatcgatcagtcactccccaaaacctgcaaattaactcgtccactgatcattctgcggttcatctcacaagttctccttttctaagggagcctatgcatcgccagtcttatctaacagcttaacctcgagcacacaaaatattagtactaactccacttttaagtatatggattttttgaattttttacataacttatgaacttacggtttaataaaaatttactatggatataaaaaatataaatcatgattaaagtatatttaataatacaagatggtatagaaaaataaataacattcatgtgttgggtcttaaaagaacattttcaacacgattaagcctgttcaaacaaaacctggctcggcccacatacgcaccaggctgggcatgggcctccattttgtggtctgaaagcctgaaaaaaaaggaggaaaaagtacaccgaaggtccctcaacttgtcagtgagatacaaaaacatccttgaaccgcaaaaccagatatgcggggtcccttaactatataaaacggtcactcgaggtcccttggtggttttgacgcccgatttgacctacgtgacggctgagtcagcatgggccccacatttcagggtgccacctcatctcttccatcttatttccctcttctccctttctctcacttttctcaggctggtgacgggcggcgatgtggggaggaggccaccggggggaggggagagaaagaggtccggtagccggttggaggcaacgccaccgtcagcatcatcgttgccgccgccgtggcacaacgccgcccgtcgtcggctattttgccactgctgactccgtcgccttgggacactagccgcgctccggcggcggcctcgctagcgcgatatcgtcgatggcttccacccggaaaagctcatcgtcgccggctgtagtttaagacccgcgtgccgccgccacaaaaaaaactccgacgtccgcaccgaggaggacatgcggagagaggggttggagccgtgctggccggaggagcacgacggctaccgtggtgactcaccgccgctgttcccctccactcccctctttctctttctctgccctgagctcgccagtgccgcatctatctgcactgccgccaccgccgccgcatctatctctctctctctctctcatcaccgacacggattgctccttggagaggcgtagcttcttgcgccgctgcatccacggtggtagtcgtcgccgcggcgagcggcgccggcaagctgtcgctgtgggcgctggtgaaattgtggcgccgctccctcctctcccactaacgccgccgcacgctgctccctcctcttctgcttgtggccatcggggagaagggcggcggacttggtggggccgccacgtcgccgtcttgctccccctgcggccaccaagctcctctcgccgccgccgacgcccctcccctgctcccgcgtcgccgccttgctcccctcgccgccgccttgctctcctccccgctgccgccttgctctcctccctgtcgtcttgctccccccacggccgccaagcccttttcgctgccgtcgatgcccctcccctgctcccgcgtcgtcgccgccttgcttccctcgccgccgctttgctctcctccctgttagagttagagataatgtgtgcatgtgataatgcatgtgataacagaatagaagttagagataatcttggggttagtttggattgagatgtaattctgttatatatgtaaaaccacgttggaggttgtttccaacactaatcaatatatacgtgcggcctcgtacagaggtgataacgcttcctaaaagttttatatggtatcagagccatactagccacaaacagatcaatctggcgatggcgagttcctccagcagcgccgggagtcctttttccggtcaggcggtcgcagagaagctcacccggacgaacttccttctgtggaaggcgcaaatcctcccggtgatccgcggtgcccgcatggaagggtacttgacaggcgcgacacaggccccgctggctgtgatcgacgccaaagatggagaagcgaccgtcaaggcgtcgaagccggcgttcgagatgtggataacggcggaccaacaggtgctgggtttccttctttccacactttccaaagagatcctcacccaagtcatcagtatggaatctgccgcacaagtatggaaggccatcacggagatgttgtcttcccaatcacgtgcgcgtgctttgaacacgcggctggcgctcgcgacgaccctcaagggcgatctcagcgtctctgattacatcagtaagatgaaagtcctcgccgacgagatggcattcgccggcaagccgcttgatgacgaagaactcatttcctacgtcctggctggcctcgacgacgactacgagccggtcgtctcctctctcgtcggcaagtcggaggttgtctccctcgccgagtgctactctcaactcctgagcttcaagtccaggcagaagcttcgtcatgcggctgcacatcaggcttcgtccgtcaacgcggccaggcgcggtggcggaaagggcggtggatacactcccttcaatcgcggcgggcgcagcggtggcaacaacaacggcaggcgcagcaacaatggaggtggacgtggtggccgcggcaacaacaatggagaccggggtggcaaaccacatcctgtgtgccatctatgtggcaaaacggggcatgttgtcgccgattgttggtacaggtatgatgagaattttgtgcctgaaaataagatagctgctgcagcctcatatggtgtagacacaaattggtacgtggacactggagccacggatcatatcactggagaattggacaaattgacgactcgggagaagtataatggcaaggatcagatatatacggcaagtggtgcaggtatggacattaaacatattggtcattctgttatttgtacccctactcgcaatatatacttgaaaaacatccttcatgttcccaaagccaagaaaaatttactttttgctcatcgcttagcccttgataatcatgcctttgttgaagttcattctcgtttctttgccatcaaggatcaggtaacgaggaatcttcttcttagagggccttgccgcaacggtctctatcccataccaaaatcgtcgtcatcttcgtccaagcaagtcctcggagtcatcaaacccactatttccaagtagcatagtcgtttgggtcatccgtctttttctatagttcagagagttgtgaacaataataatctcccatgtttaggagatcttaatgagttaggtgtgtgtgatgcttgtcaaaaggctaagagtcatcaacttccctatcctaagtctttcagtgtgtttagtcatcccctagaacttgttttctcagatgtttggggtcctgctcctgattctgttggtggcagaaaatattatgttagttttatagatgattttagtaaatttacttggatctatttgcttaaaaagaagtctgaagttcttcagaaattctctgagtttcaacagcttgttgaaagactatttaatcgcaaaattattgctatgcaatctgattggggaggagagtatgaaaaacttaatgccatttttactaaaattgggatcactcatcatgtctcttgtccctatgctcaccaacagaacggttccgcagaacgtaaacatagacacattgttgaagttggtctctccttacttgctcatgcttccatgcctctcaagttttgggatgaggctttccttacagctacttatcttattaatcgcacaccaagtaaagttatacagtactcgacgcctttagagcgtctcttgaatcaaaaaccaaattactcctccttgagaacctttggatgtgcgtgttggccgaatcttcgaccctataataatcgcaaacttcagtttcgctcaaaacagtgtgtttttcttggctatagcaatattcataaagggttcaagtgtcttgatgttgcaactggcagagtttatatttctagagatgttgtgtttgatgaaaatatttttcccttctcacaacttcactctaatgccggggctagactacggtcagaaatcttgcttttgccatctacactgttgaatcctgaaattgctagtaggggtatgcaagtgaatgatcatatgtctaatgctccctctggagaatctaatattatttctgagcatgcacctgaacaggaagcaggaggttcaaatataaatgcacctacagatacacatgatacagaagatcctggtgctggcggcagtactggatttgatgaaaatactgctggaagtgatggacctgacggcagtgatggatttgatgggtcagctgctggctcagatcccggcgatggcagtacagaagttgggagcagcagcagcagcgctgtcggcagtcctagcactgggaacggcggcagtagtggtgcgtcagtcaatccaggaccagggagtgcatcggcaacagaaccagcccgtcatggtggtgcgacaggtgatgagacacatactaatcagattattcctgagcaggtgcaccagccaagtcgtccaaccacaaggttgcagaggggaataaggaaggaaaaagtctatactgacggaacagtaaggtataatcttctagcctgtactggtgaaccacagtttagatcaagtattagttgatcaaaattggaaacaagtcatggatgcagaatttacagtcttaattaataataaaacttggcacttagttccgcctcagagtggtagaaatattattgactgcaagtgggtttataaaattaaacggaaagctgatggtagcctggatagatataaagctcgtttggtagaaaaagggtttaaacaacgttatggaattgattatgaagatacttttagtcctttttgttaagactgctactattagagctatattatctattgctatatctagaggttggtgtcttcgacagtttgatgtacagaatgcctttcttcatggtgttcttgaagaagaggtgtatatgagacaaccgcctggctatgaggataagagtaagcctaattttgtttgcaagctagataaggctttatatggattaaaacatgcaccttgagcttggtattctaggctgagcagtaagttatgtgatcttggcttcaaggcatccaaggcatacactcattgttcttttacagaaaaggaaatgttactatttttgtacttatatatgttgatgatataattgtagcaagtgctacacagggtgctgctgaggctttgttgaaagatttaaaacaagagtttgctctcaaggatttaggtgatttacattatttccttggaatagaagttaacaaggtaagagatggtatcagatggtatcttgttaactcaagaaaaatatgcctctgatctactaaagagggcaggtatgtcagattgtaaacctgttgctacacctatgtccaatacagagaaaatgtcagttcatagtggttctgttctaggggaacatgatgcaactagatatagaagtattgttggagctttacagtacttgactttaactcgaccagatatttctttttcaataaataaggtttgtcagtttttacatagtcctaccacgcagcattggatggcagtcaagaggattttgagatatattaagtcttctgttggtcttggtcttaagattaacaggtcttcttctactcttgttagtgctttttctgatgcagattgggcaggatcagtagatgacagaagatcaacaggtggatttgcagtctttttgggatcaaatctggtatcatggagtgctagaaaataggctacagtttataggtcaagtacagaagctgaatataaagcggtagcaaatgctacagcagaggtaatgtggattcagattttacttcaggaaattggggttcaagttccgtcgacagctaagttgtggtgtgataatttaggagctacatatctgtcagtcaatcctgtgtttcatgccagaactaagcatatagaagtggattatcattttgttagagaaagagttgctaggaagcaactggagataaaatttatatcttctggtgatcaagtggcagatggttttactaaaccaatctctgttcaacagcttagagattttagaaacaatcttaacttagataagttatgattgaggggggctgttagagttagagataatgtgtgcatgtgataatgcatgtgataacagaatagaagttagagataatcttggggttagtttggattgagatgtaattctgttatatctgtaaaaccatgtgggaggttgtttccaacactaatcaatatatacatgcggcctcatacagaggtgataacgcttcctaaaagttttatactccccgccgccgccttgctctcctccccacccgtcctgcccagagccagagagagaagagtgggagagagaggaggaagggagagaagaggggaaagagaaagtaggatgacctagacaggctgacacgtggggcccatgctgactcagccgccacgtaggacaaaaccggcgtcaaaaccgccgagggaccttgggtgaccggttttgtatagttaagggaccccgcatatctgattttgcagttcgaggacgtttttgtatttcgctgacaagttgagggagcttcggtgtactttttccaaaaaaggaagaaacctgaacatgaatcaggtttaggcctgtttttatgtgctgaaaaggcttaggccgggcggaaaaactagctggcgtgcgcgccagcagcacgcgttttttgcgtgttaacgtaactaactcggttaattaaggataatgatagtaattaagaaaagttttttcttgttttcaatttatttactagcaggttgaaaactttcaacttaatatttaaactttgaagtcaaatttgaaaactttcaactcatatttgaaaactttcaactcgagatttgaaaattttcaagtccagatttgaaaagtttttagttaagatttgaaaattaaaaattttgaaaactttgaacttaaatttgaaaactttcaactcaagatttgaaaactttcaagtccagatttgaaaatttttaagttaaagatttaaaaattttcaagtcaagatttaaaactttcaactcaaaatatttgaaaatacgtgtgctaaagattacaaaaattattagaaaaaaaagtaaaaaggaaagaaaaaaatcgtggaaaaaaggaaagaaaaaagaaaccacgcggggaagcggcgccgtgtgcgcgccaattagcaacaccctagggcgggctcagctgtacatttttggcttaggtttttataggcccagtcttgcataaggtttgaacaagcccaaatacaagattttaaaatacaaaagggatattaggataaataaaagaagttaaaaattaatctgtcctattctaatatctttcgagctacgtataaaacatgttcgatatagaggttaaccggcaacgaccaatgaagacacaaagaatattataggctaggcaatgaccccaaggagcatatcaccacagagggcaaaccaatgagaaaatggacatttagccatcttcaaaacacggttttgctagaatgccatcttcaaaacgtgattcgataaaatgccaatatcaaggccatgcaactcgccagattgccattttcttattttctcttaattccgaaatcattttgcctcttctttgtggtgattagacggaaatgcccttggggccaatggcaagtccatctcttctctttctttctctccttcttcgttttgtgccgccggcggatatggtcgagcgcggcgaggtggtcgtcgtcgttgctgacgagggcatcgacctgtcggggatgcggcggaacaagttggcgacgatggtgtgggacagggcgaggccgagcaaaggccatggggcttggttgatggcagcgatgaagaaaacgtctcagcagcggctccgagctccggcgagacgatgccaactcattccattcgatatgaaggcatgcatgtgcatccatgaggttggttaggtcccagggatggtgcatgcgcaaagaatcgacgagggggtcaccggagcggagagaatcgaagattgacgccgacggccgaagttggagaagacgatgtcgatctccctcctcgatgctccattcttctcggttcttgaggggttttgaagaggacctcaagaaggagctgatggcgtggtggcttgctccgggatggatgaggatggccggacatcgacgatgccgaagcggcggcgctccaggacgacgatggcacgacggtgttcccgttgctacaatggatcaaacgcgatggcgtcaaaagaaagtttgttctgcaagatgaattgagtatggaacgcaaaagggataaggacgaccgtggcttggtgatgaatatgatcatcgtcttcatctcggctggcgatgggattgagaccaaagaggcagcccatgcttgttctctcgatgtggtcggcagtagggtggagagtgagatgggacgacggagttgggagaagaccatagctaccgccgccgccgccactcaatgcgccggcgaggccatggtattttgtcccctgctcgccgcgctcacgaggaagggcaatttcgtctcatcatccggtggaggagaaaaaaatgatttcgaaaatgcacaaaatggcaaaaatggcaaagtggcggtgagtgcgcgtttcatattggcattttagcgaaacgcgttttcgaaatggtattctagcgaaaccatgttttgaaagtggctaaatgtccattttctccaaacgaataggggtccttcccctttagaggtagctaatgatggtcgaaaatagaggcaaagtcggtgcactaggtagaggaagtgagggattagtgaagggtgttgcatgggataataaggaagaggtgagatgggctagccaccggtcatcaaacgcatgattaaattgaaggcctctagcttaaatatacttagtttgaaaaatgttgtgatgtctataagaccaaagaaagtgatgcttgtaagtcaaggtggctagttagggatcagggtcatgggtgaggtctacgatataccattgtctatccttgacaaaagacaaacaaaataaaaattggttgcccgaggagaatgctactcctggtggcagttatcttgatgaatgttcctggataagaaaacatatgtttgtgaatgttgatttatgtattgagtctcggtaggtttatataaactctaatttagatcataatactatctttatacatctctaaatgttatatactttttttttggaaatatacgactagcgtatatacaagaacttatattcgattccaaattttatcgtcattttaccacatttcatcaataccattattcttttgcaagtattctgacagtgacgtctctgaaatactacaggcacccccgtcatccgaatcatggatatctcggtctttttcctcacaagacaaccatacaaacaacttgcaccgcttatatgttaaatgaaagtgacgcataaagggcaaacaataataaaattcagcgactttttttttctgcgccgacaacgatttcacgtgcacgctaactgaaagcataaaagatattttttctgttttttttttgcaaactagcgtaaaaggtatttcctccggtcatgtttttgcttttatgaaacgaaaagaagatatttttttctaacaaaaatccaatttactttctccaactattttattggatcacttaaccacctaaaatatttttaaaatgtgacatggctacttaggttattatattttgagacgaagataataaaaatatatttaataaaaaaagaacacaaagatgtttgtgacttgtattctctgtttaggttttattattgtaacttaaggttataagaaacaaccatttgataactagtttttaaaaaatctggagaagctatgagtttaaactcatagtgtattttcttaattctatataatcacgtcatttcagaacataaataaaaaaattaaacgatttaaataaacttttgattatacgaaaaaccatacccgctgcctggaatccctcgcagataatcccaccaacaagcagaaacatacaaacatccagacggaacgcatgccgaacggtcgaacggatggctcggcccgggacttatcgcggggggagggggatcggatcctaacgggaaagacgggaaaatctccggcatcgccgccaatttctcccgcacgccgcggcgctgctcccccttccctacccacacactccaccaccatcaccaccaccaccaccacccgcacgcgcgccgcaacaacctcactactgcctatcctacctatatggcacggggtgtgggtccctccgattcccccggcacgccactcctctcccctccccacgcaaccgcctttctccgccgccgccgacgccgacgccgacgccgaccccttctcccaatctgcggattccagcgggggtcccccccccctcccaccggcggcgcccggtggtcgtggtcgtgggggaggggagtcaacgaacgagccgagccgcccgcttgccggagctctctatctatctctctatctctatctctatccctccagattccctcctccatcgaatctctgatatttggagggagcgactcgacgcagcatcgcatcgtaaggaaggtcccctccactgtcgatggatgtgaggtttctttccaattttttttcttcctttattattaattattaatctctctctcgctcacaagcataccatgcgtttcatgtgccattatgcctcatcagtttgatatgatatacggtatggatggtctctagtctctgtcatcaatcgatcgcatttactacatagatatggaactaacatggaagaaaaagttgtcagattcttttcctccaatctgtattaggaaaaataatttgtcatcagttgatcgcatttaatacatagatatggaactaacagggaagaaaaagatgtcaccagttgattcttttcctccaatctgtattaggaaaaataagttgtcatcagttaattatttgtatttttcgtaataagtgtgtgtgtggaaaggacattcctccaatttgtattaggaaaaataagttgtcatcagttaattatttgtatttttcgtaataaatgtgtgtgtggaaaggacagggaagaaaagaacttgcaaaagtgtaattgcaaggcaattgatttgatgctacttttgtgggggtgctcctgtttatttatatatatgcctattcttttgcactaagcagcagcaccagctcgacgaggagaaccagagagccgcgctcttccactcctctgccccatcttcctctttgggagctgacggggaggaggagagggagactgtgccgctgctgtcctgcaagatggccgacgataaatctgacactgtccaggtctccgaggatacggcgcaccagattagcattggtaatttttcatcaaccgttctttgttaatgtctaggcgaatgtcttatgaatgatcgtgtgatgtgttctctcctttcttttcataattgcgatccttaagtcttcctagcctcctagttgaacaccacggcgcctgcatatatttctcctttcttttgtcctcataacctatcggacaaatagacactggttgttccttagccacagataggtaaagaaaaagaagatctgattcatattcatcatcttgaggcctaattcattaaaagagctggaacatgaagcaatttccttttgtctttaatttcttacaattttcagttgtggctcttcttactgcttttagctgttccctctgaaaatataaacttgatgcagagccacagaccatgggttgtcattttggcttaaaaaaaacattgaccttatgtggtgcgtatgattattgattgacttacgaaacactttttttttcactttcagatccctggtatcaagttggattcattctgacaaccggggtgaatagtgcatatgttctgggatattctgcatcaatcatggtccctttaggctggattggtgggacatgtggcttgattctagctgctgcaatatccatgtatgcaaatgctcttcttgctcaccttcatgaagttggtgccaaacgccatatcagatacagagatcttgctgggcacatatatggtaaatattaatacactcagttccctcatttggcaaatattcgataaggaatagtttcattctcttccctttttttcttaacctgtgcatgttttttaatcattcccctccccccatattttttgttttctttgntgggtnctgcagagngctcacctnnnggggggcat

SEQ ID NO: 60259 - DNA, 3410 bp, Oryza sativa
ttaattataattatgtaaattttttgaataagacgagagatcaaaacatgtgagaaaaagtcaacggcgtcatctattaaaaaacggaggtagtatatgataactacattagtacgtatttctgtaattctttcatattgttttttattttctacatatatgttaatttggactaatatatttctcataattaaatagataatacatcatttttccatatttctcctataaaataaaatagggcattttataatttgaaaattatattataagtgtatgtaattaatgtgtaagatatggacttatagtataagatttaactttttctaaaaatgaatgccgcatcatggtagataggtagttaactgaacaaccatgaaaaatagagacaatccattgtgtgtcactgattttgtccctgctctacaatatgtcattgggtttgtcaagttctaatatggcatcgcattttgcttaacttctataatataccatcgtcatctagttagcctccgttagcattgtacaattttattatacagattgtaaaacttaaagaatttgagatgggcaatttctctgcctagtttataatatgatattttggaattttcggccaaattttggaaatttttgtcctagggatatttcaatcattagtacaaaattatacagtactaacagaatctaaatggacggcgatggtatattatagaatttaagcaaaatacaatgacatgctgtagaacttaacaaactcagtggcatattatagaacaaggacaaagtcagcggcacacaatggattctctctaaaactaatatagttaaattgtttcttttttatccaaaacaaaacatcttttacctaaatatgttcagagaacttcgaaagaagtaagaaaaagaggaggttagtcactagcccaaacacatgagggtggttgctgctcacaactatggtatggtatatactcacattaatcgataatacactagtattattaaaattgttctttgtagtgaatggtgtgaaactaaaaactttaaccttttatattcttctgttgttccatcttcttctttttttcttattcttatttatttttgataataatattgctacagaaaacactattacttgcacatgaatactaagcagctagctcatgtgtgtatgctccgtaatatatattacctatgtttttacatgaggaataataactattatttttgttaatgatattgtatttataaaaggtatctgactagttttttttaagagaaagatatttttgctaaatataatctagaatgctataaaggttaataatattaaacgatatagtcatataattttttttggataaactagtgatcaacacttgttatgaatccaatgatcataatgcactatatatattgttcaagtgagttgtgacattcactatttactagttacatgcgtatgcattacaatgagatctacatataaaaataagatttagtttatttctagtcttgtttttatgatgtattggattttttttacatttctttagaaataatattgtataacaactaaataatttattgttttataaataaattattttatcgtacccccatctataaaatcctacgtccgccactgccaaaaatcccttcttcacattagcaactctaccagtcaaactcgatttctgcaatataaacagaattgaattgccatcgaatttcagttcaatagtgccaccaaattcgtagtaaaaaaagatcatgaagcagtgtgtcatcgacataattatgacatacataatatgttaacagatggatgacccaaacataaagtaaaataaaatagagaaatgatggaacatgcatgaataagaagaacacatatagcctgatgcatggacgaaaatagagtatcagacaacaccgaatccaatcaaatgttgcatcaaagctggttggacaagcaaaatgaagtgacgcagacaccgaaataattatatgtttgttacgagaaactgatgcaggaaacggatgattcgttcatggtagtaaacactgcgaaatcgtataaatgctgcacaaaattgatcaagacgagggtaatattaataaatgcctaatcaaactgatccaataaaacatgctagaaatgccacgaactcatccccttctctacatttatactccatttccttcaacgaatgagaacccaaacaatcttaccgccaaagaaatcggccgagcaacataaccccccaaaatcccgcaacaagccataccgcacaaacctcggccttcgccgcgcgggccctcccgccgacaacattgctgaggttccagagcggcacgcgcctctccgacctggtggtgccgcccgctccggcgctcccagccacggccgacaccggcgagcggcggcggcccgcggcacagctcggcattggggcgaccggcggagtcggggaaaaacctagacctcgtccgactccgacgactactttgaccgcttgacgacgatgagggttagccctttttggaacctatctggtttgctcgtgaagggaaggaaccggatcctcggggaaatatcgattttgctatatctcactcgaaagattttttcttatttctcactcgattttctgacttaaatttacagtgtattttcaagttaccgtgtagtttatgatacttgcattgtaacttttatatgtttttttgtaatttttaaaatttatattggacttggttttttttcttaaaatatggtaatttagtgtccattatggtatttcttaattgtttttttaccttttacagtggctattgggttttaatccaaagattaaaaatatgtatgataagatcgtaaaaatctttcgaaagatgcataggtactcccgggaaatatttgtggcgctgggtgccgcaccgcgagctggcagttaccttaccatggcgcctggtcgcccgcacccacagtagaggcgagagcggcggggcgttgggtcggccgggcagagtagaacagggagggagaggggaacgagccggtcggctcagctcaacggtcagtgttgtgtatcgatggtaattaaatcataatatttgaccgtcaatacttatataacgaaataaaatatggtatccaaattagtggtagggtttattactgatcatttctactagtgttggcgaaatatgtgtacgtaggtattttgagaagaaaacacatctgttatacaacaaaatgcacctctgcgcattcaggagggcccatatgtcaaccaaaaccacttagaaattggaccaaaacattgtgcaagatgttgggggcccattaggcaacctaccggccaaaggagaggccgagaggacggtttttgggttcg

SEQ ID NO: 60260 - DNA, 17684 bp, Oryza sativa
aattcctgcagccctaataacaaaacaaattacataatccgcatgtaaactgtgagacaaatttattaatcctaattaatccataattagtaaatatttactgtagcaccatattgtcagatcataacacaattaggattaaaagattcgtctcgtaactcatacgcaaactgtgtaattatttttgggaattatatattttttaaaaatatttacgtgtgtttcgatgtgacgggacaaaaaaaattaccggttcgtttcctttgtttatgtagcctatagtggcaacgcatgctgacgttacggtgtaccgccgtcgaaaaccaccctcgctatctctccgcgttgtcagacgcacgcctcccaccccaccccaccccaccccaaaccaacaaacgccgtgacaaaccgattccacgcacagcacggaggtgggagaggacgacaccccgtcccccccgtgtccagccaccaccaccgcgtcgtcgtcgtcgacccagccatccatcccacccacacgtcaccacccgcgcatcctccccccgtgctgcggcggcggcggcggccggcggccatggacatggacagcgtggagtgcctctccctcccggactcgtccatggacgtggacgacgtcgacggcggcggctcggtgcaccaccaccaccaccaccaccacgccctcccgcctcacctccccgcgggggtcgccgtcggggtcggccccggggggcgcgcgttccccaaggcgaatgtcgctggggttggtggtggcggagccgccggggcccccgcggcggggggagcggtggccgaaggtgggggccccggcggcgggcctcccgccaccagcgtgcacgagctgctcgagtgccccgtatgcaccaactccatgttcccgcccatccaccaggtgggtttgcgcccctctctctctccccgcgccttcgatttggggggacgttctgttctgtagcgcgcctggatttgaattgaaatgggcttgcgcttgattcagttgggtgcggatttgtgggtttcgattcgcaaacgcgggatctttgcggtagcttgctgtcgtttcgagttaattggcgtgttgttcgccaatttgatgcagttcgaattggggaaattatcccctctatatgattgggttgtgcgatttgggtaatcttaggctggggatttgaattaggcccattcggtttcgtcgactctattttcctcagcgatttgggggctttttttgtgagacatccttgctgatgtggtttatttgagaaatattttaaatgaaacgtaatttccgttttggatctgaattcgtgcgcgctaatgtccatcgtattccttgtgtgctggttaatttggacccttttgtcgataatttattgcatttgttgtttacccaagctccaaatgccttggaatactgggaaagaattgtccctttgcatacttgttagcttatcgatgtcaatgttctgtcttgttgttagtaatagttgattcttctaattattgggacctcgttgagatgctcccttcacaaatgggtgattaaccagtcttgctgcaaatttaatgccacaaaattcttccatttgatgcctcgataccttagttagtgatagtgtagactgcattaacaagggagaacattcatcttgatggaggtgagctggatttctaaagataactacacaagattgtggtctgttagaagttagacaactatcccatggaagacgctaataatttattttacctgattaattgttattatggttagtctggcactcattttatcgacttgataggttggttgttctgctagcttctttaggatgaacttgtccttgtaattgattagtaactatattctttttcccctagtttgtcctagtgggtgtagcactgatagtaacgcaagggagtgaagtcgcatagctaatttccattgtaatttggatacagtgcactgggttcatctccctcaatggctaagttttatgaaacaagttggtttagggttcctcaatctatcatgtcttttctatatggtccatttgatctgagctcttcttgctgatgtggatggagcatatcaatcagccatagcggtcactgcatcttcactggccttctcccttgagcctggccttcttccttcagtccttgctggctctggcctcctgaatcatttctatatatttctctgtagccaatgaatgttttggagggctctaattgaagcataatcttgtgtatcatggacatggtgaggtatggtccaaggattgaggatatggggcaatgggatactgtaggattcctcttaggctgttaattctttgcttgatttgaaaacactgcatggcttgatctgcaaatactaaacgtcctataaaattgtagtggttatgatattgtgtcaacaactaaagaatgagaagccaacaaatttacatagggtgtgtttagttcacgccaaaattggaagtttggttgaaattggaatgatgtgatggaaaagttggaagtttatgtgtgtaagaaagttttgatgtgatggaaaagttggaagtttgaataaaaagtttggaactaaacaaggccataatgcctactagtgatctttatcttctgctgccgcatgggaatcttactgagttgctgtgactgctgctttgctaaacgcaccctctctttgtcctcgagctatgactaaggtggctgcgatggaagcatggcaccatgcactaaacctgtactgttgttggaagaggaaaaacaaagtttcaaggaatgatggcagttcaagggaacacctctaagtgtctagacattaagaactctaaattgacacagcgaagcaactgcacccttgctaccatagcgtggttgtggcagagctgtgatgatggcatgataccctagaaggtaccaatcatcttctacagtgaggcaggtgataatggatgacagtgaggcaaatactaaggaagctcttccggttgttacagcctcaccattgttatgacgccctgacatgatgctgcatggagaactgtcaaaattggccagttagtggagcatttttttgctccatctcatgattcaagacgccactgatctcaagattcaatcttcttttcaggaggtactccaaattggccaatccttgtgtcatgagaactactagcaaggtaggatgcttgctatttgtcagttggtacggatctctccccacatgatggcctacaactaaaactctataaggctctgattcatgggtggagaagagtagagtagataactcctgtgtattcaatgccacaaatttttctgtaagcacctgtcacctaacaaaatagtcacctaacaaaatagcaatcaataatgtaccatctgtctgtgccaacaactacacgataaaagccaacaaaataggaaaagaatccctaaagcactaataagtaataatctttatcttatcttccgttactgcgtggagttctttcatgtgattgctgtgcaccctttcttggtccttgtcgtagggcaagccatatcaccacccttactagtttggtacattgttaatcaatattagtataattttattttgttccccaatgattattggtgacatacattgtcttatatacattgcatctgaagtaatagatgagcaagaaactatgattgagggtatgcacctgatgtaaaaggtacatttcaattttcaatatgggctgttcattgtgagaaaaaaactagcatagctaatctagtttgggttgcgtgtgttttgatggtgttcttatgttgttcatgcttagagatgatcagaattaggactatgatcatgcaaaattataatgatggacagtacatcaaccagccatctactaaacatctagggcctatttggtagcccatgctgctgcagccctgcaggtgcactgcaacagccatagcactaaggtacagcgctggtatactagttactgttggtatagctgcagccacagccccatcaagctatgctgaacagccctctagtctgaatatccaaatactacattaagtcgaatggtacacatcatccaatatatgcatatacagttgtgtcaactcagcttatttgcctcatttacctgcatatatttacatctgctagctacagtcttattagttccctcgaacctataaaaatgattatatatgtatgcaacaatttatctggcaaatgatcattattgtctttcctcacaatagattgatatggtagtactcacagagtcacatattgttctcttacacggtattgtatgatctttattctacaatagctgtgctaggcacataccagagatgaattcaccattctttatgtttaaatcctgttgctgcgtacactcctttcttttcttttctttttctaaattatatgtactttttatgtatcgaattttggaaaactacattccaaaggacaagttccaatctattgtgctgctgtcgaagcatcttttacagaaaaatcgataacgattatgttgcactagaaatattgggcctcatctaatatgtactactggcatagttttgttacttggttgtcactaattttatttttttacagtgccaaaatggacacactttatgttcaacatgcaaggctagagtccacaaccggtgccctacctgcagacaagagctcggtgatattaggtgcttggcactggagaaagtagcagagtcactcgagcttccttgcaagtattgttctttaggttgcccagaaatttttccatactacagcaagataaagcatgaagcacagtgcagctttaggccatataactgcccttatgctggttctgaatgtgctgtggctggtgatattcctttccttgttgcacatttgagggacgaccacaaagttgatatgcacagtggctgcacattcaaccacagatatgtcaaatctaatccacgcgaggttgagaatgcgacctggatgctaacagtaagtactataatagctcatagtattcatttttggatacctatttacaaacactgttcttatgatctttcctctcaatcaggtgttccattgtttcgggcagtatttctgcctgcatttcgaggcgttccagcttggaatggcaccagtttatatggccttcctccgtttcatgggggatgagaatgaagcgaggaactacacctacagcctagaggttggtggtaatggcaggaagatggtgtgggaaggcacccctaggagcatccgcgacagccaccggaaggtgcgggacagccatgacggcctcatcatccagaggaacatggcactcttcttctccggcggtgacaggaaggagctgaagctgagggtgaccggccgtatctggaaagaacagacgaacccggatggggcctgcataccgaacctttgtagctgatgagcaaagcgtacgacagatgaaacgatttgttgctatttggctggcttgttatttttatccattgccatgtcctgttttcgatagtccagtgatcgtgccagtgctgttgtatgttaagaagcaaattttagaggtgtaaaacattactgtaaagtaatattgtgtatatcgaattcaagaaaatcccacaagttggccaataaacgtctgtcatccatctgttcttatgctgtttacatcctgcctcgtattcttgctttcttgaggtagaaaacaggacagttttgcaaggagactgaagttctggataatctctggtgtttatcttgcaagattggtctaaaataaccatgtacgtagaataacatttattggtatgtaaggaatttttgtcttctggaactctaaaatactcctaggaacaaagcatggccatgtggcctgtatctaaacttctgaagtcccaatccgtggtagctgaactgctacggcaaggcgctacagtgtattggagtagcaattgagcactcagattaaaaccctaaaaacaaacggttcagatcagccaggtactgtagcatcaatacttcacttttcagcttgtactgtcacatttatattgtagaggttgatcatatccctaggattgtgaagggatggtgcagatttctcataatttaatttactacctgtgccttttgtactctaatacagaggatcccaatccgtggtggcttttgagggttcgcatcttctgctaagagcaaccacaatgtggcatagaggctggtagtaagcaataaaataaccttactatttaggaacaaacattgtgaaagctagcaatagcaattactaggtagtatggctactaccagcaataagaaactaaactatattattagtacagtgaatagtgtaggtgcagggtgtgggaggctagggattggtctttttttctattgcggggcataccttatgttcaccttttgcattcacacattgtggcatatgtattagctactaccactgattcttgggcccaccttattaccaagtttagcaataagcatttctttttgcctctagggaagaatggcaaaggcgcacttatgaaatgtgaggagagttacatgctatgccataggtacagtgataaatattgtttgattaattttttgaggctgttgtaacgattgatctcgtgcatccaaacttgatacaactgctgtaaatagataatgacatggggcactgtagctctccgccattccaactcagggcatctacaatataaggcacgggtagtagtagccttacgtaggctatactgtctaaagccacatataggaaactctacccccaataaaggatactctcaaatggttctacaaaatctgagggtactagtatcccacaatacgtgtctcagcccacaaagccacagagttattttcctcttctatcctttttctatttagccttttcttcttttgttttctccacctccttgcctttttcctttcgtcaccgtctctctttctctttcatcgccgcctctctccctctctctcgttgccgcgcgtctctgccgttctcgtggccgcccgtctcctccgcttccgccgccgcccgtctctgcgtggtggccaacggagagccgcgcgcagacgcgttggtcgacggcgagcggcgcgaggggtggggtggccgacagcgagtagcgggtgactgacggcgcgagaatgcaggagcgggtggaagacagtgtcgaagcttctcttcactgcctctctcccagatctgtcatgccggcagccggatctggcatgccagcggtcggatctagccgacgtcgcctctctctctcctgctgcccgtcaccatccaccactccgacgagggcgcggggcctactccgactccgcccaccgttggctccgcttcaccatgcagaggtgagaggggcaagaagggaaaaagtagggggaggaggcgggggacggggcaccgagatcgcccaacggtagcatcgattcgtggctcaagaaaagaggattggaggaggtagaggcacccgttcccctcgtgaggatcgcacctccctccagtggcacggctagtggacgggagatgaacggcatgagcaaggatacgagttcaagctacgcattgaacatggcctcatgggatacgatcccggcttttgaacactgtgcagacagaaactgcacagtaagttccaaatacaatacccagcacaatcttcaccaagatctatggatagatgcattcctgcagtagaacatagtgctttacgctagagatgaaaatggccagaaatgaatattacttatatgaaagcagctgtcgggaatttactatatctataaatttaattatttattaacgtaaatttgacgttgacagtaattagaaaattaaagtttatatgtaactattactaaccaaaagatagaaacgatatatattttatattatgttttaaaaaaaccgtcttacatgaattttcgtactaactccatccccaaacatagtaattttaaatttatacccttgccctgtgcagccaaagattcgatgcactggaggcacttcagagttcagagttgcagtcattgtcctctactgagctgctccgccgttgactgcagcggtgacacaacgcagttacaggttcggacggcatgtcggcacatcaccacaagagctacaaccacaacaggtactcctccactacggacagtaggtacaagtacgtagtattgccttgtaagaaaaggttacacgcacacgaatactagcagtattcgtacaagccgtacaggtacagctcggtgtaaggttcgtttgccagtgcccactgcctagcggtgggcagcagacatgcgcaggtggatggatggctttttgttgttttgctctcatcagtgccagggaacctcacacgttcgcctcaacattgcaagcctcttggactctaatgtctcgtgccttatactagtaattactccctccgtcccataatataaagtattttgagttttcttttttactgtttgaccactcgccttattcaaaaattttaaaattattatttatttttttgacctattttattatccaaagtattttaagcacaactttacattttttatatttacacaaattttttaaataaaacgagtggtcaaacagtgcaagaaaaaactcaaaatcacttatattatgggacggagggagtactactctccccgtctcattttagtgtagctatgagctttagtaacaccaattattttataattagttttttcattgttattagatgataaagtataaatagtactttacgtatgatttattttgaaaaacattttaaataagatgtacggtcaaatgttgaacacgaaatctacaactacatttaaaatgggatgggggagaccccatcctagtatggactagataaggacggttcatttcatcaccaaaataaacccgattaaattttagctttactaaatatttgataaggtattaacaatctaaactttgttcgtattagcctccactactaaagtttgataattctatagcctttctcgcagaaaattgataaaagtagcaagccaaacataacttaaatatctcaacattattaaatattgacactggtaaaatttatcattgctgaaatttagtaggaataaatcatgcatgaaagtgagcaaccccatataataatagtaattgagcgtatgcaatgccgtagtatgccgacgttcaaatggtctgtccaatatttgtgacacttccaagtggaaaatgactcacatgtctcacatgtgaggaatctctttgactatggttgtgtttggatccagggactttgttcctatcatatcggatgaatttagagtattaaatatagactacttataaaactaattacataaatgagagctaattcgcgtgataaattttttaagcctaattaattcataattagcgcatgtttactctagcatcacataggctaatcatggattaattaggctcaatagattcgtctcgcgaattagttcagtgttatagaatgagttttattaatagtctacgtttaatatttataattaatgtccaaacatccgatatgatagagactccctatctaaatagggtctatggcaccataacgaagtagtcatttattaaaaaaaatgggattaacagcactatgtacatattaaaagttgagtaaattgagaaaagatgaaaattttcattttacagctatgtacttttgtgaaaaatctgaaaaccaatactgaacttcaaaaccaaataatatttatttagcctgtgtttacaatactttttcccctagcccaaaaattaactggttttgaatggtattgtgctaacatggctacgtgttcactactagtggtaaaatcaaaagaaaaaaaatgaaataatttcacatgagaaggaagaaaaaaaaattctccattgcaaaggcagcatgaatgttactactactccatccaaaaatacaagaggctttatgggtaaaatccctaatcttttagataagagatattaccatccaaatatcgtacctcttgtcaccgtatgatttaatcaacaagtttgatcattgggtaggattattattaccagagtaaatgaagatgagaaacgattggccgcactcgcacgtgctccatggttgacactatagtgagtgtagtgatcacccaagtgagtgaccagcaatgcactaaccactcccctcgtctgtatcctatcattgtctgatctctcaagatccaacaattatgctcaccaaacaattcaggctactaaagtaaattacagcaaactgccgcgagacacggttaaatgtccaatcatgtccactaaatatcagctcaatctggcgaatatgcgagaataacattttcaacttgcatttctgagaatatttcaacttgcatccaaagtcataagcatctaactggaactgattccgatgcaaaaatgtcacaattattctgcaagaatggataagattacaagtccaaaacataattttgataatacattgtaattataagctttaatttcctcactatggttgcttagcaaaacaaattgtccaactgaacatctcaagaaccaaatctttctttggcctggactctgaaaacacctagaaaatctattaaaattacaacaagaaggctgcagaaatctaccaaagatgagaagattcaagagaaaaatacacactcagaaaatcatcacagaaagaagaagaattctaagttacaaatcaaactaacttatcttacaaatttgacacgaattcactgaagagattgacaggggacaccaccgattaaccccaaaatgggcaaatggaggagagtcagatcttggcctggtcttggtcagcaccggaatccgagcacgcggccgtccgccggcgagacgccgatgcggcacaccttggcggcgacgacgtggtgggtgaacacccggaggatggtcaccttccctttcaccaccagcagcgagtccacctccatcaccggcagcgccgccacctgctgctgctgcggcggcggctgttcttgctgcagcgccaccgcgcccaccgccgccggtgaggggccggaggcggggacggtgattgtctgcgccggggaggaggaagcggcggcggtggcggaggaggtgacggcgaaggccgggacggtgaagctggtggccatgtactgcgtgcgccccccgtcgatctggccggcggggatgtacatcgagccgacctcgccgccggcgtaggcgacgcggagcgagctgtcgtagtgcgcgagcggggagcggttggggttgcggacggaggcgagctgctggaacgtgaaggcgacggtgccgttgcgggaggcgaaggaggggagctgcacggccgtcacggcgatggccggcgcctgcggccggtagagcaggaacagcgcagccgcggcgccgcccgcggcgagcaggatgaacagcgccgccacgacgcaggacgccgccacggaggagaagggcgaggggcggtggtagcccgcggcggcgtagtagcgcggcggctccggcgatctggccatggcgaatcttgcggtggttcttggccggcgaggcgaggaagggaagcgagctgagagagtgggagggtagtcgctagtcaggagtcggctaaagttcaccgcttcacacgacacgagcggaaaagcgatggaagcgaggttggtgtgttttgatggtgtttttagatggttttgggtggctgaaaaggtttgttttagtggtaccagtaatactgtagccgagcactttgactcgagttgacttgaattgacgctttaccaggttgctataactatatgttccttcttttcccttttccttcatttgtcttctacaaatcgaatgttcgatattaagagtgtgtttgattgtatctgtttagtctggctcatctttctcatccagattgagctcgtcctagttaaggggatacacatccaattgtttggttgtttgtattagtctagcctggcttgtatgagatattgtttggttgtctgcacgagagatacggttcagaggagaatttgtttggttggttgtatgatacgcatgtatgatgatccagaacttaacttttcatatatcaatcttcttattgttagtaaaacaattcatcaattgagctaatgtagtggcgaaccacgggtggtgttcttttctcctgaagatgaagataaagatgaagattaaatgttttacacaaaacaaggtggtattaacatataattaattgagttttaattattacaaacttgaaaaatatattaatttgatatttttagagcaactttcatatagaaagtttttgcacgaaacacaccgtttagcagtttgaaaaacgtaccacgagtatccaatttttgttggagaaaagaacgaggtttatattagtgactaattacgggcttagagaatgagaacggtagaaaaaaaagaaaaagcgctctcgcgtcccgtcgcactccttgccaccgagcatgacccccactggcagcctgctctggcgagcccgattgctcaccatcgtcgtaatcaccgcatccatcacttcctgccgctcgctgcacgtcttgctccactactctctagtcgcgccgacacgtcgctccctgtcatcgtcgtggtggcgatgattgccgctgttgctcgccgccgtcgtggtggtcgcgatggttgttgctgtgctcgccccgtcgccgtcgtggcaaccagatctgacgggaaatgctggaggtgtcagatgcgaaagggattatgtggcaatagcgcggacaccaaggaatggatgggggaagacatcggtgatcgcgagacaaggtcgattgtgagcttccaaatctagaatcctctcctagtcttctccttcctcccgcccatctccttcctctcgaatctagctgaggtcgagcccggcgatgagcaatgcagcagcaacaaaacctagccttttcgttttcggggagaaatgagaaaggggcaaggtggtgaccagtgaccccttcgcaccgcttgcacacgcggctgcaatacgtgcacgtgcgggtgcagcgttgctgcacgcgttgggccaggacaagcaacgaagctcaattcgcccgttcctacttagcatatctgagggggcacttttgcatctactcgtcctggctccaagacatttacaggcaaccaaataggctgcaagttgcgatgagggtgagattgcaatttgtgcaatctcactatgtggagaaagtcttagccagctcatactccttacgatattagtgtactattaaggaaaaacaaagaatagcatgggattaactgagatactgtaacgtcccgcctctcctaggccgggcccgcttacatctggcagctttcataggtcatagattgccctcacagaccaacacatgtcttttctgcacactttgtcctcactcgggaagaatttcccggtcaccctcacagaccaacacatgtcttttctgcacactttgtcctcactcgggaagaatttcccggtcagtcacccatcctaaattgcttcaggccaagcatgcttaaccctggagttctttgaaaatcggcttctggaaaagaagttacaacttgttgatatgagtattctattaatcctattaagccctgtgccggaatgttgcagatactcccaaatcattggttcattaatgtatttggctagtgcaacgaggcctcacatctcatttgctacgagcaagatgagccggttttatttcaaatccgggagatgatcactggcaatactctggaaaaggtaatgcgctatcttaaaagcacagtgggctatggaattcactatactaggtacccaaaagtactagagggttattgtgattcaaacttgacatatggtgctgatgagaaaaaccacaagtggatatgtgttcacacttggagttggcgttgttttctgtaagtcttgcaagcagaccatcttaacgaggttaacaatggaagcagaactcacaatattagacaccgccacgattgaggccgagtggctttcttgagctcctgatggatttgccggtggttgaaaaaccagtaccagctatcctgataaactgtgataatcaaacattgattattaaggtgaacagttcgaaggacaatatgaagtcatttaggcatttaaaaagaagactgaaatctgtcagcaagcagaaaaactcaggagtgatagcgttagactatgtccagatagctaaaaattggcagaccagtttagggactatcacgtaatgtgatagataatacatcgagggagatggacttaagacccacttgagttacacaatagtgataacctatcttatgtgatcggatatcctgtgaattaggatgacaaaacaaactattgagtgactgcgaggagagaccctgaaatgggtccatctctatgatgtacttctatccttttctgtacggcaggatggtgtataccttaatgtcatccgtgtggttttcttaggcagagatattgtcctacaaaacatcttacaagcaacacaactatataagttcgactgctagtcacagtctatgatgtttgcgtgatctccagagaaaggcttggaatttgaacataggggacgcaaatggtagcctagtatcagttaaggagttgagtaaagcctgactacacaagactaataattcaaggtatagcccattgttcagttgcggtctggtgtatctccttttctaggtagaagttcaacttaacagtctccaccgaaacactggtataacaaataagtgcagaactgagaacatttcctgtgagccctgaaatttagtagggattgttggaataaataggctaagcccaatttatttccagtaaatttcattggctcacaattaatgttatagcattaataccaccttagaaattcaagtgaaaaaatctcaacttaaatacggagttattagagagcccatattgaccaattgaggtggtggtaggactgctacacgtgcacgcgcgtgccgatccgggtcggccggggcgaggacgaggcttggcttgcgtggccgctctctcgttttgcaacggctgattaattctgtactaacaagcgacttgatttcgctattaaccatataattgaatcggattgattttgagattactcctgaacgttactcgttggtgcgcagtataaaaatgcccaccaggacagatagaagggctcatcccattctgctcagttcatctcttgcttgattctcctcgaactcttccttctctgtacatgtgtagccaccacgtccccggttctgatcacctgcacgtattggtgctcatgacgagcaggtgcctccagaactccgtccgcttgcatacctgcacgggtaggtgggcgatcaagtttttaggagtgtctgggcatgactgctcctattcccgatctgcttctacttcctcgactacattgcaacctcttcgtcggcctcttcttcctctacatcaacatgccgaacactggtactggtgctattggtggaagcataggaaacgacagtggcattgctggaagagacggcactgagaacgacaacaccaatggagacaatacaattgctttgtcatccactggagcgttctccaagtatttctcaattcttctattggtgctgaacatgttgttagaagcttttctctctttagcattttcatgtttatcaccatgatcgctttcttatatgaatgtcatgattattactcaaattttctagattaaaaataccaatttatgaccatattttcaacacagtattgatctacaacaggtagtatgtgtgtttatagatcttcagtgagttcaacatagaaaggcaggagtattggagtaagaagaggataagaaaaaaggaagatgaatcaggagaaaagaagttaacgggatgactggtgaccagtggcggaggacggcaaaaaatctaggtatggtggtgtgcccatgaactagcacgaaaattagatcatgacaagaagaaagggaaaaaaacaatcccaatgcacgaaattatatgacgcaatctcaattctcaagcatggcaataagcactagtcataagttcataattcatcacccatttgtaaaaagtgtaaatagaagaggcactcataaatacctcaagattgcagttgtcaacaatacatcacatgtaagaacgaactagtgaggatagatagacatgtagtgatgtagaaactgcaaaatactagtaaatagcaaagattgattagtatactatagtctcctctgcctgcctcactgcctggatgcctgctggctgctgcccttctgccgtgctgtgcagctcagcctgcgctggccgcctgcgggctgcggcctgcctcccgcggccgccgcaccgctgcccagtgcggccgcgggagatcaaggtatggcgagcgccatacctcgccataccgactcctccgccactgctggtgacgtttagtcttcgttaaacctccgttacatgataattacgtgcggttaccttgctacgtgcggtgcggtgccctgcacggctgcacctgagccgaactggtactacaagaggtcgacgcgacgcgctgtgcagaggaggcgccaaggagagccgcgtcgcgtcagggcgtgcaacaccggaaccaggacgaaggcgaggaaacgcggttcccttccctttctttggatggactggacggaggagagttgggcttatgggcaggatttcaacagtgaggacgtattgggcattggtaacatgggcctgcggccgagatattaaaactgggccacgattgagctgcatggtggaaagaagatcggacggaggctgatggctggaataattaacaatggcttactccatccgtcccataatatagtaatctaggcctggataggctatattatgggaacggagagagtagttatatatgtttagaaataatagatttatatgtttaaataatatgaaaatgatgttgatataataatttgacattgcttgcatattaagttctaaaaataaaaaaaatgtaaataatatgtcatgtttgcatgacatttaaaatactcgaggtaacaattgctaatggatgatgatgtggtacaattgcatcttgagctttaaaagttagtggatatcaattttatagtaagataggatgtggctgcacagaaaagagagagtcggtattgtatcagttagtgagaagttgtatagatatatagaattcctcattacataaccgcctgggaaaaccgtgtggccttattaaaaatcatgaccccgttcgtttcaggataaatttttggattaaaatgatacgctttttaaactgctaaacggtgtattttgtgtgaaaattttctatatgaaagttgttctaaaatatcagattaatcctttttcaagtttgtaataattaaagctcaattaatcacacgttattatcacatcgttttagctaaacacttaatttttatcttcaccttc

SEQ ID NO: 60261 - DNA, 721 bp, Oryza sativa
  unsure (1)..(721): unsure at all n locations
aggtgaccactattggacagnacntcatatgcttcgccgccttcttgaattcttcgacgatggtgtgctccatctcggcgaagctgttcaccaagaatccatccgctcgccggtatcgccgtacctcttcgaggatctaccaaaacacggggttggacctatcgaggtatccgtccggcatgtcggcgacgcggatcgtcatgtccccagcgagacggagggggtccggcaggtctagcttcgtcgcgggcgctgtcttcgacgccgcactcgccttcttcgtcgcaaagaggggataggccggtggcggtagagagggaagaggtggccggcgagctcggtcgagctccgccgcctcgagggcctctcgacgggaggagggagagggggagacggaaggcggtcgacaaatgatgaccccaaggtaaatcttttacttcttctggggttaaggcaacccatccagtttctccaccaacccaacgttttggttggttcggagttttagaagagtccacccagattaaaccaacagccggatttgttggtgctggtggggagtaaacccaagcaccttctttaccgtttatagctgtttcgaagtcttctggggcttttatccacggttggggattgttaccctttacttaccttggagaagacatatagtaagccaagttagggtctttccccccaggcttcccaccaataattactgatg

SEQ ID NO: 60262 - DNA, 24191 bp, Oryza sativa
tgcgagacgaatctattaagcctaattaatccatcattagcaaatatttactgtagcaccacattgttaaatcatggatcaattagctttaaaagatttgtctcacaatttacacgcaatctgtgtaattagttattttttcgtttatatttaatactttatgcatgtgttaaacactcaatgtgacagggtgaaaaattttaccggggatctaaacaggcccttattctatactactccctctgtcccaaaatataagggattttgagtttttgtttgtaacgtttgaccattcgtcttattcaaaatttttttgcaaatataaaaaacgaaaagttgtacttaaagtactgtaggtaagtcacaaataacataaataataatttcaaaaatttttgaataagatgagtggtcaaacattgtaagcaaaaactcaaaatctcttatattatgggacagagggagtaggttgttatattatgagatgaagaaagtgacaaagcatatgtttatatggcagagagataaagaaaaattaggttgctataatacgaaggaagtaacaaactactccctccatctacttttgataatcaatttttgataggcatatttcaatccaacaacttatcatcttaatgactttctcggatttaatgcgtgactctccattcttccacacaagattggctatatgggcatcgagaaatgtaaaatattaatgaatcgtagtactccctccatctacttttgatagtcatattttatcttcgcacacagaccaaggataaataattctacttatgatccatttaaacctgctactggttattggtaaccgtcttcatggtaactgttttcagagggtgtaaggaacgtgccaaactcagagatgatgacccccagaaggccgctgaactagccgggccaacatacttggtaactgacgattgcccggaaaagtacgaacatgggaaagcactcttgccggattgggcactaaacaaaggaccatgggagatgagaaggttacataccttctacatgcatgctagcaaaaaaggcttcggccatataactgctcgatcaccggcagattgtttcagcgccgaaggttacgtatggctagatttctcagatctccacgccatatatcatcaggataagatgaacgtcaactatgttggtgtttggtgcatgtgagtagatgagttttaattaattatatgaaaagtatgtacaatacaaatccatgtgattgttactaacaagcttcttttgtaggatgcaatacatggatgctaagaagaaaaaagaacctatcggcttctccaactcggatctgtcaaacacagcataccgtgaggctagcaccagggtcagaccagctgaagggcaagactccaaaagagatagctgaatacaagaagggcttgcacaaggagaaattgattactgtctgttgacgaaaaaatcgaacacaccggcctgggagatctgcttaactccagtgcaggtccaaagattggtgagatgtgagtgtgccagtcagtttgatcttgcaactgacaagatatgcaaatagtagatcaaaacagccgatcggctgacaagccgatggagtagttccagccgatgccgataatagtcgatgccgataccagccgatagcgatagggtttaagcaatcggctatatgtccaatgtagataatgatataaaggcaatcagctgacgacgatgtaataaaataacaatataatccagtataaaccaatcagcaaataatgatatgataaataagcatcgatccgaaggtcaaagcacacatcggcaggaggtccgatgtcatgaaatccacaagattagattaaacagtgaagcctttgttgtcatcggctaaatccaacttatatgtatatgcaatccttatgagccgatgcaacgtccagataaatcaccggctaaaaccccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctagtctaatctagcaacgcgatttagccgataccggcagaaaccctaaaacgagaagtagccgatagagctaaattgatatgctaagactagattaacagagacatatgataaataggcaggcaagtatatcatccaaaccagagtaatccaagaggtcgaatgtactgatgcagccttgaacgacgccgacgtaaacgatacaattgcctgggccggcggagcattggacttaccccttcgccggagatcgaacaccgatgcagccccgtgtcaggtgccaagtcccgccggatgataaaataaagtagaaaaggtaaaaggtggcgatgcgccgaattgtattgatcatgaagatagattacatagaccccgggtgtacatatttatacccatgggttgatacaagtccttgtcggacaagaaagaaactaacctaaagataaaagaaaactaacaaactattcctaattaatagataaactgccatgccgcatcctctttaaactcggtcacttagggataagcttcctttagtagattgatttccttaaccgaatatagcaggaacccgactattggtgacttgataactcccatcggctgattccaagatgctgcagtcgataatgattctaagccgatgacgtctttgccgattaccaaattttactgttaacactgtcgcacagaacattggactagccttcttgcactttcaaaataagagagtcgtcatggccgcttacttgcacgttaatatttgtttgtgataaaaattatggattgtaaaaaaaataaaattttccacgagacgatatattagacacactagcgacaagagacactagcggtggagctgtcgtgggactttgactcatttcacacataggataggataattgttcctgagatgtgcacgagatgcaaagatatgccatcagctcaattccacttattttcttcaggtaaatagttcagacctatcattacctggtgcaacgcatgggcattttgctagtgcttgataatcttccaatatatgtacataataatctacctgcaagaacttctattaaataatttaaaaataatttacgggcaaattattattaaaatttaaaattttctacctatcttcgcaggcggatgttttttttttgcaggcggccactttctattttcgtaggcggaccggactagccaacgtccgcctgcgaaaactatcttcgcagacggacggccgccccgcctgcgaagatcggcgatcttcacagtcgtttgcttacaggcggatggccgccccgcctgcgaagaccgttttcggccgcttgcgataatgtttttcctagtagtggaagaggatatggatcaatcaaattcattcaatccttgtaataccggggcaagagcaaaattgatgaatttgtctttttatgtggctaataatatgtgcgaaaaatcaaaaatggaaactagcatttcttcaagcctcactagtcgggttgcaactcatcaatttttctcatcacaagactcattatgacagagataataaatgaactttataatgtcactaatcatcaacaagcagttataagtagctgcttaaaaaactgaagctccagtataataaactaccgtatattgtcgtcgtgcatttgcgtgaatttaacctccttctataccgaatgtgtttacatgttattttttttataaacatacgttgaggttcaattgtattttctgaaagtagttcgtatgtaaacaaagatttcagctagtgcaatagatatggctagggtttgtgctcatcttatttgtcagagtttccctccccctattcgctcaaccctaaccgtctttttcgcttgtacttgagccaccgctttaccaccaaatcaccaatcatcatctacattgttgcatgaccttttatcttcctatatattatattctatccattctctattttagcaaattattttatgcacatacttggatatataggtgttcagattacctatttggcaggaaaccgaagtacaaaacaaatggaaaatactatgcatatgacttgaacgtcgtgtgttgcatcactagaaaacagttgaaaaacgctatgggctttcgctgggaaacgttagtcatacgagtatcgtacgtatagcagccctcaacacatagatttacatgatctataataaataaatgttatcatggaaataaatagtttacagtaattatgctaagcttgtgaaattaccctaagaacagaatttcataattttactactcctctattcccaaatattgttggtttacatttgttttaaactacgtatcatacccataactatataatataagctgttttcagatattgcttttattctttccactgttttcgtatattgaaatatatgcagattcaaatcaacgacagccctagagttgcagtttttcttctttctatttttcttttcatttgctctgtctctctcccacgtatgacggtacgagggaggagctggatgtacaactgcagaagacccaaaaaggaaaaaaaaaacagttttgctgtccttttaccgatctgatcctacggcttcctccttgctttttttcctccatctgatggtatatatgttttttttgctgatcaggtagtgttttggcattcaccattcacttatagagattattagctcattctttacatgaattttatttcagttctgttatctttattctgatagttgaggcagaacagccctgatggctctattttcaccaaaaatatttaagcttttgagtgcattgttccagcattttattctccatagccccctggcagagtagcatagccaattcaagctcgtattctgaaagtccaaaacaaacattttagatgttggtaaatagattttaggaaaaagtatgaattaccccctgaaccacaaaaccggacattcttcaccccaactatgcaaaccggacgcggtggttttggtctacgtggcgcacgtgtggcagtccggtcagcattctatttataaaaaaaatatgggacccacctatcatactcttcctctctctctcacgggtgcggcacgagcggcagcggcgggcgcggctggtggagggcggcggctgacgggcggacggcgcatgggggcggacggtggtcttacggggtggtgccgtgacatctcacttgggggaggtcgcgacggcggtgggtggcgtgctcgtcggcgtgggagtgggggggtcacggctccagctgagtaccaccggcacctccacggccggctgcggcggaggatgtccccggcgtgagcagcctaacaccgccagagatgcggcggcggagatcctgccacgtccacaccacggcgccgctccacgggaagcagccgtcgtcgtcgtcggcagcgccctagtagtacccaatcctcctctcccgccgccaccccttctcctcctcaccggaggagctcgccttggatccctcctcctcctcctcactgtcggtgccgtcagagtcggagtcatcgccagtggctcccacatctccaccagtagcgccgccatgctcggcccccgaaacctccccaccctggtctctagcatcgccgctgccgccgtctccatcgtcctcacctccgccaccaccgcccaccgctcgtccgcccccgcgcacacccaccgcccatgcgcccccgcgcacccctgccgcccgtccgctctcgcacaccgccgctcaccagcagccgagcctgccgccgctcgccgctagttgcaccggctgtcgctcaccaccagccgcgcccaccactcccgctcgcgccgctacccacttcctgcccctgcatcgccccatgagagagagagagagagtgaagagagagtggggaagaggggaagtggagttatgacatgtaggtcccacattttttaaaaattagaaaatgctgactagattgccacgtgtacgccacgtaggacaaaaccgctttgaattggatcgaggggggtaatttgtccggtattgaaagttcaggatgaacaatgtctggttttgtagttcaggggggtaattcggttgaccgtgatagttaggggggtaattcgtatcttttcctagattttatggtcacatataacttcacgggtgcatggatatcaacgtatcactttacctcagagcatttagaaatatcgaatcataaaaaatgtgtgcgtataattttataacggggcgacgggggtgagaatcgggatactgctcaactcggaggacatagcgccatgatggcgttgtagccctgcgctcgcactcaggcgatatggagagagacgaggcgcatcgttattttttccatgtgtttggtttagggatgaggtgggatgggttaggttcattcctctttttctgggatgggatgaacctagtctctgtttggttggagggatggagcgaaccctattttttgtttagtttgagggatacaatgggtcggaatgattctatcccttgtttggatgggggattgttggcggctgttaagtgccaaatatataccgccaacacctgcataatactcaaataatagaacatccgacatagtgatagggattatttctaacatattccacgagtgttggtgttttttcgatgcaggacataaacaccgaggttgggaggaaaatcagactaaaggtgaggaaggagtatatccatacaaggatgggatttgaactttatcaaaatagcagagaatcaactcaaaattcacagaaatagatagagcaagctcagagggagagatgggctaaaggccagaccaggaggccccagccagggttcggccgaaccaatacctccaccgttagatgtggggtttggcatggacgctcctgatcactccttgatggcggttggagggcacttcgagtatttccccttccacaaccgtcattaactgtcctataaatagacttcacttcttcactttcaagacacactcccaagcttgagctgaattataagaggctctattgtactatttgtatactacaattaggaagagcgtatagtagaagacgtcagagaaattccggagctgtcggtaatcctctcctatttattttgttctgtttattactctgatattaatagcattatcttcctgagtaatatagatttatcttgtgagaatcatctcttggctagttcctaatcagcatacgggattattgttcactataatcaactaaaatatagtgatttcttttgtgttttataaacactaaagtagataataattgtttagatgtggtgtttaggtaattattatccagtaattgttgcgtatcccatagtacatttgaggtgggtgtagaggtggtgatagccctcaagaacacttaagtcctctctatccgggtacatactagagcgacatctgagaacagtgggttgccaatgcctgaagtattgcgttaggattaaaattaagcttttcctatgtttctcagtagaaaattctctgtatcctttgcctatcttcgcttggtatccttggatgaaccggaggaagagctaatcacacacgttttcctagatttgatacccttggaatactccgtagggaaagtgctacatcggtatatccgtgcgcttgcggattttatctgtgatcgtaagaaataccaacagggataaaggtgggttgtctagatagagacacctcctggtgaggttacatctctcatactaggtgattccccgcgctttgctacggtaattactaagcaatttttaatatattttttcgacaatcaagctaggagtaaaaaagaaaaaaaaatgaaacgtcagaatttatcagtacttatcatgaactgatactcgtactttaatgtggaacatgttgataagtatgtgttaaatattataaaaatgatagatagactagttaaaatatcatagaaatgatgtgagaggtgatgattggatatgcttgcatattgatttgtttaattaaaaacaaatccaattttcatccttcaacaggaaaacctgatacaacaggtccctcaactgtgaaaccagtgcagatgaggtccctcggcggttttgacggtggttttggctgacgtggtgcctacgtggcaaatttgatttggtcttcatctgacgtggcgcttacgtggcaatttgatccagaaaaataataaacttcgtgggacccacatgtcagtctcacacataaattaataaaaaatggtggggcatatatgtcagtcaaacaaaaaaagtgggacccacaagtcagtggtcccacttcctctaccttatccttccaactcccaacctctatcttctcaccagcgctctatgctctccccacatcggcgagcgcgcatagaggacgaggcgggtaggccggcggggttgccggcgcttgggaggacaggagccccatcctcgctggtggtgtccgcgtgtctctacctatgcgactgccaccttgccgctgatgccacgtctttcctcctccagatctggtccgcctcacccgcgatgggcgaagatccggcagggtcccgccactagtagtgtgacgccgacgaagaccaaggttggctctcctcctccgctgccggccttggtgacgaccacttcgaccgcctacccaacccactcctactcgtcatcttatactttcttcccccagatcacacgcatcgtgctcggcggcatcgtcaaccccatccaggtgctcgcccaaatactttcgctgccaactccacctctatcctcgcggcatctgtaccctcttccccctcgtcatcgtcctgctccttctctttgccgcggcgacgggctctctcaccgccgtgtttcacctctccaaggccgacggagcgcacctgtcgggcacctcgccatccgtcaagccgataaagtaggccttgtccttgtcacccagccatggcggtcgaggagcatctcgaagatgaggtcggggaccgggagctcaccgtcgcgtaggtatggcaggaggaagagctccatgagcatctagtcgcccgcttcgaacatgaacctcggcgagaaccccctgcgacctcgccgccgcccgcttcctctcccatagcccgtaacccgccgcgcgccgctccttctccccatcacccatcgtgcccgcctccgcctccgctgctagctaggaggcgtcctcctgcgagtccgccaccacagcgtcgtcgcgacggcattcacgccgcaccccgctccatcagtagccgcgccgcgaagaacggagaaggaagaagagcagcaacaaccgtaggggattgaggatgacatgtggggcccaccattttttattattttgtggcgaaactggcaagtgggttccacgggttttattattttctagatcgaattgatacgtaagcgccacgtcagatgaagaccgagtcaaattagccacgtaggcgccacgtcagctaaaactgctatctaaaccgctgagggagctagtctgcaccggttttaataattgagagactcgttgtatctggtttctggttgaagaacggaaatcggattagttgacaagtcaagggaccacagatgaacttattccttatttttatgttgccttccgaggccttttaatcttccgggtgtattgggcctaatagctggaattttaattctaaaaacaaaaatcacccaagcagccatttttgcgcgacagaaatgaattcgcgggcctatttcggcccgaaaaccacccatcaaagcttgcccttacggataaaaatgttttttttaaaacacagtacaaaacgcaggcgctcacaacgtacgcacactcacccctatgaacgcacacacgcacaccctaccctatgagcacctccgaaagactaggcctcgctgtcgacgggtacgtcgcctaccactgaaagaataattagccgtaaatgcgagcacccgtgtattttgaatggatataaacatgcacaactctcattaacattcaactaattaaactgccgacccagaactcttttaacgcggttaaaatatttttctagttaacaatcggttagggatgggtttcatctcttttacggataagatcgtattttagacacggtttttacagataatttcccgagaccacgcgctcccctcgccgctatatatattttgcgttagcccttcatctcctcctcctccctacctagatcaccgacggaggtagttgccgccgccgccgccgccgccaccgccggcgaggaagaaccaagatgtcggcgacggaagtgatggaggagtgcacggagacggcgagggagcggcgggaggaggagcggctgaggaatgtgaacctcgacgactggctccccatcacctcgtcccgcaccgccaagtggtactactccgcgttccacaacgtcaccgccatggtcggcgccggcgtcctcggcctccccttcgccatgtcccagctcggctggcccaccggcgtcgccgccatcgcctcctccttcgccatcacgctctacacgctgtggcagctggtggagctccacgagccggcgcccggcggcgggaagcggttcgaccggtaccacgagctcggccaggcggcgttcggccggcgcctcggcgtctgcctcatcgtgccgctccagctcatcgtccaggtcggcaccgacatcgtctacatggtcaccggcggccagacgctgaagaagttcgtcgagctcgcctgcgacggccgctgcgccgacatccgcctcacgttctacatcatgatgttcgcgtcggcgcagttcgtgctctcgcagtgccccaacttcaactccatctccgccgtctccgccgccgccgccgccatgtcgctctgctactccatgatcgcgttcttcgcctcggtcctcaaggcccacccggccgccgccgccgccgtggactacgggttcaaggcgacgacggcggcggggcgggtgttcggcgcgttcaacgcgctgggcgcggtgtcgttcgcgttcgcggggcacaacgtggtgctggagatccaggccaccatcccgtcgacgccggagcggccgtcgaagaggcccatgtggcggggcgtcgtcgtcgcctacgccgtcgtggcgctctgctacttcaccgtggcgttcggcggctaccacgcgttcggcaacgccgtggcgcccaacgtgctcatctcgctggagaagccgcggtggctggtggcggcggcgaacctgatggtggtcgtgcacgtcatcggcgcgtaccaggtgtacgccatgccggtgttcgacatgatcgagacggtgctcgccaagaagctccacctccgccccggcctgccgctccgcgtcaccgcccgctccgcctacgtcggtaagacttcaccttttggatctaagattttataagatggtatactctcttcgggctaataatacttatcattttggacaaaagtgaggtcaaacattaaaatctctagttataaataatttataaaatatttgtctttgaaatatggtgactacatgtatatgtatagattagttttaaaaaatacttcaataaaatcatttattaagatttatatacatattataataaaaataatgattaaagttgttttttttaagatcgtgcctttgtctaaacgacaagtattattaatccgaaggaagtacttatgttgtatgagtgtatcaaaattttcaagaatttttcataaccgtttagatagcttttacactctctggagcgatcaaaacaatttaatgtgttttgatctgtcaactttgtgcagcattgaccatgttcatcgggataaccttccccttcttcgacggcctcctcggcttcttcggaggtttcggattcgcgccaacaacttacttcgtaagatttatttatatatccgatcaccattaatctccattaattaatttttatgttcttggttaatttgtttgcttattattatttgttcatgttatttaattagatcccctgcatcatatggctcataatgcgcaagcccgccaagtacagcctctcatggttaatgaactgggtaagtttcagttttcattacgctcctgaaaataaacaatcaaatcgattcttttaatcatgttgttcttacttcttaccgttcaatttggccagtgtttcatcatcatcggaatgctgctcatgctggtttcacccatcggaggattacggcagatcatccttgacgctagcaaatacaagttttactcttagtccgatccggcctagaagatgatagagtaggattagttgtcaaaagagctagtagtagtagtttttaagatttctttagcaatgcacggtgcaagttatcagtgtctagaagaccaggcatcagagatgtaatagagtgcctgagtttatctctattattattataaaaatttaagatgtttttatcaaattttcgtccgtcacatgtagtcaaattcaacccgtatggccgtattcaaagagcatgcgatttataatccacatccgattccgtttcttcccaccggtgtttttggttgtttggcagcacgagaaccaggcagtaggctgcgtagcatgggccactgctgcaatctcccacccaacgttggagaaaattgcaatgttgagactgcaaacatgggggcttggctgttttaacatttcgagtggatgacaaatggacccatctgtgtgtatgaaatgtgggtctagtgtctgtggggagatagaaaaaagaagttgcaatatatattcctcgtatcatttattaatatatatttttatttttaactgttagtgtgttactataatgttatcgttaaattttgttagattattcgtcttatttaacaaattatatatattattatttattttgttatgtcttgttttatcattaaagaaactctaagtcgatatggcttacactaaattttaaataaaataaatgatcaaacattattttaaatgttaacgattgtaatatagtatatcttagaatgtgcacatcaaatgtgtatatgactcaatgtcaatatgatcctgcttggatgagtcttgctatcttttttaaaatttgaaaacaaacatataaacagttgtgtcccggaacgttgcagtagataatttttttcattgcagacaaggtaacttgttaatcaaaatcaagcagatataacaggagttggaacagatacgattggattgggcggatcaatgcatccaataaacagatacgatatgttagattcgaaattttgcatttaccatttgactttattttaaatataattaaaatgcgattaaaattgtatttagggtaaaaacaaaattagcacgttgtattttaaatttgtactccacaaatatgcgatatcattcataaattactcccctcaccttattattaacgtgttccctgtattaatgaatattatttttctttccttattatgaggtcgatcttacctctagcaaggtaatagcgtgctttgacagttggatcttggtctaatggacggctggaaaaaaaaaacttagaacactttagataagtcctaacagaacacatcatggtctgaatagtcaatattccaggatgaattgtcgtgctatccttttggatctgggaagaccacatttcagccataagagcatgacatcgaacagaaataaatagcatccagataaaagatgaattactgcaaaacgaattaatggtggtgtaacctgcaactgtgtaatggttctcttttttgtttagagtactgtaaaattaaccaactagctagaagagttgagagggaaaccttcgatcggaggaaaaacttctacgattgtgacatgagatgagactacgatccagtaacatgctagtgagcggaaggagaatgcaagcaatgtttaacttagctcggtgatataaactcaccgttttctaattggatagtaaaagtggaatcgctgtcaccatgaggagattgctgaagacgacctgaccatgttgaaaagtgggagagttatcggggagtgtgcttaattgagagtgtacatgtgcctggctgctcgtggtgacgcgcgcaagtgcaaaggagatgttgcaagacatactgatcatggttaaactgactgttgtagaattggataagatggcatgcaattttagatcatggttaaactgactgttgtagagttggagaagatggcatgcgattttaggtgtaggagtgggggaatgaccctgcgcatcagtgtagggctgtaaaaaagggtcgaggctcgcgagcatgtctcataaaccagggccgaatctgagcccgaacaaaaactcacgaactttaacaaattgagctcaagcttctatcgagcttgactgtgtgtatagtttatattatttgttgaacttattgatttaataaattaatagataaatatataaatatatatatatatatattagtatctattcacacaagcatgttttagcacaatatgattattttaacacttttttactcttttattagtttggttgactagaaaataattatactaatcaagaaattatcatcaaaatatatattatactacttatgaccgagctcggtagttgagctcaatctcaaacgagctcgaaccgagcttgtctaaaagctcgaaggtgtaataggtgttggaaatatggtcataaatcggcatattttaatccaaaatattgagacaataatcatggcataaacaatgtagagtgatctagtgacaacatgtaacataaccagtagcatactaaaagcatcattcgcatcatgaacatagcagtaacgcagtagcatgctaaaggcatcatgaatatcaggaacaggaacatagcagtaaagcgctaacaacaggaacaggagaaggatatacctcgagaatggccctccgctggattgtgaggcagaattgcctccgttagtgttgttgttcgcggcatcggctcctggcgcaccacctccggctcctggcgcaccacctccggctccagctccaggcgcgctgtcacgcccagaaattcactagtaatttccgaactttttttgtgcataaaatcctcgtccaggaatcagccgaggtacacaaactgacaatttaatatacaaatccatcataataataacgtcacatacttacaaaagaaaagaaaaacagcagcggaattaacggtctagcgatggcttctgctccactcccacaagcagctcaactggggtataagccaaacgtcttctccttctggatcctttatcttcaactgaggtttgattgattattgcaagaatgagcatatgacatactcaacaagccacacagccaatatgcaagtgcacaaggattccaaatgatggcataatataggctcatttgcgaaagtagcatttagcaaagagttaagagtagtaaaatagtagagtaattaatcagaaattttaatcaacactgaacagcacacccatgctgtacaggcccaaccatcctgaacaaccatacccggctgaacagatctaactccaaaccaggagctaagcaaattattaccagttataatcatcaataattattgtgagaggtgtgagactaatcacgaaaaacattgctcaactcgcccataaccgcgggcacgactattcgaatagttttactctggccagaggtgtaccactgtacccacaagacacgattccgcacatgtcgccatgccccgaaataccaccacggcattgcaaagggggaaatcgtgacaataccctttgcacaacacaactcaaaacagtgcaccgttcccggatcatagtcacccccttataaacaaggcttggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcattgctaagcaattatatatatataacatttagctgaaccaaaccaatacataaggttcaagctaatcaattttattacccaaggtatcaaggaatagggcattcaatgcaaattggccataacaaagaaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaaactaacacgcaaaacgaagaaaaagactaataaaaaccaaataaacagtacataaaaagtaaacaaacacgtaggtcataattttagatgaattatgagacttgaacggcctcattctgacttcaaatgaatttattatgaattttacaagattaaatctaattaaagcccattaaaaaagaattaaataaatttaattcaatttatggacaattttaatatgtagatctttattttagaaaaatttagcaacttgaaccacctgaaacggatctacggttatttagttatgattttccgaagatttaatctattaaaagaaattggaaaaagaggagatgatgacgtcggcatgacgtcatccatagcggccggttagggtttgcgagctcgccggagctagggcgatcggccgggactttggaggacaccttcacgaagaggacgacgagacgaacccaacggtactcaccaacgcgacgaacggcgacggacgacggccggcgatgacgcaagaggcggcggcggctcggttgaacggcggcgacggctctacggtggccggcggcgaagaaggacgggcggccgggcttcctcactccacggcgcacctcttggcggcggcggcaagcggcggcgacggcagacgcggcggcgcggcgcgaccggaggatggccggcggcggcggcggcttgacacgcgcggcgcggcggctaggaggcacgggagaggacgggagagggggcaaacgaaagagggcgacgaggggatgctttatatagcattagattagagagattggactccaaacgagagaaatcgatccaagaaaatcaaaactcggttttggagataaactcgaaaacgagtttgattcgggcaagatacccaaccatttgctccaattcttgaggggaaagatagaggagaacgagaggataaaaacccctcaaacaatcggaagaaaaggggagagattggggaggaaacggcgcggcaaggcggcacggcgcacccggctcggctcggcttggccggcggctggaggaggaagatgggtccgacatgtgggtcccacatgtcggtgacccgaggaggagggggcgggcggcttggactgggccgacgggagagagagagtgttgggccgaattcggcccaacggcttagggaggggttctttttgaactttttcaaataaaacaatttgtgaaatgttgttgcaattattaaaaatacttcccttgctcaaataattcccagaaaattctagaaaatagaggagcaagcatagtatttaataaaattttatctagctcatttttatgttgagatttaacaaattaaaaaaaaaatagatcttctcttttaagcttttaaaaatcatttctaataattccttttaaacaacaatttataattttaggattgtaaacaagaaaatcacttaacaattataattagatcattatatgattaatttaatatttaaataattgctgaacttctctttgtatgattaaaattaataattgagctccgaaaaatccgaaaaaaattccagagagtataattaaccatggagaatttaataaaaattaaatccatccatgctttatatttaggaaattttatttcccacctttaacttcacttgttaattattgaacatttcatataaattctattagtaatttattaaataatttataaatcctaagacgaaaatcagggtgtgacacgcgccatctcctccagcagcagcggcgctggaggcagcttcggctccaggcgcagacatggtgggcgagcagtcatgcgggaagcactcccctaaaacctgatcacccgcctacccggtgcagatctcaggcgaaggtgtggttccggaggccctgctccttccgatctctcgtgtgcgcaagcgatcagaagcgaggaggcgagagtagcataggcgtggacgaggaggaactagcacccgggaaagaagcaagcgattcattctgatcggactcgcggcctccttatctatcaggagagaggcagtcggcagtcgtgggaacgtgggatcatggacgcgccgttgcggaggcagtcgtgggaatatgggttcgtggttgcaaaagagtagcgacgtgacgcccgcccgcccgccagccagccagccacgcccacgccctcgccctcggcctcggcccggccctgcgcgcgcgcgtgtggctttccgaccctcacctcaaccaatcaacagggagcctccaataactccctatttaggtgcctccaataactccctatttaggttgagatattcctcgcttaaatcctgaggtggtattattatccttaacacttattatgggcctttgagatttaataggataaattgggcctagcccaattctaacaatccccaccaaatttcaaggctcataagaaatgttctcaaggttgtgcctgtttgatataccagggttttggtggagactgttaagttgaacttccacctaggaaatgagctacatcagaccacaactgaataatggactatgccttgaattgtcagttttgtgtgatcaggtttcactcagacccttgactggcactgggctgccgttcgcatcccctctgtttggagcatataagtcaaactccaggcctttcatgagtatctagagatcgcccaaacctcatagactgtgactagcagtcgaactcatataggtgtgttcgttctgagatgttctgcaggtcaacatctctgcttggaaaagccactcgaatcacattaaggcatgagccatcctaccatgcaggaaagaagagaagtacatcatgaaaataagcccttttcaagggtctcttctctcagtcacacaatagtttgtttcgccatccaaattcacgggatctctgatcacaatggacaggtttccactattgtgcaaccttaggtgggtatcaagcccatttccctcaatgcattgtctatcacattacgtggtagccccttggtaaactgatctgccagatttctagccgtttggacatagtccaaagctatcactccggagtttttctgcttcctaacagatttcagtcttctcttgatatgcctagatgacttcatgttgtcctttgaactgttcactttaataatcactgtttgattatcacagttcattaggatagatggcacaggttattcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagggtaaacacatatccacttgtggcttttatctcatcagcatcagatatccagtttgagtcactatacccttctagtacttttggataaccggtatagtgaattccatagctcatagtgccctttagatagcgcattactctttccagagcctgccaatgatcatctcccggatttgagacaaaccggctcagcttgcttacagcaaatgagatgtcaggccttgttgcactagccaagtatatcaatgaaccaatgatttgagagtatctcagttgatcccttgctattcttcggtttttccttaatagcacactgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatcctttatttcaaaactcttggacagatagtccttgacctcctcaatcacattgaggctggtctcaaagatcaatatgtcatcgacatataagcacaagatcactccttctcccccaccatagcgatagtacacacatttgtcagcttcattcacgacaaagcctgtagatgtaagcgtggtgtcaaacttctcatgccattgcttaggtgcttacttgaggccatataaggatttcaacagtttacacaccattccctcctgaccttctagtatctacccgtctggttgatccatatagatctcctcctctagctctccgtttaggaaagctgtcttaacgtccatctgatggacgagaagaccatgagaggctgccagagcaagtagtactcgaatcgtggtcaagcgagcaactggtgagtatgtgtcaaaaaaagtcctcgccttccttttgggtataacccttggccacaagccttgccttgtacttttcaattgtaccatcaggcctaagctttttcttgaaaacccatttgcatcctacgggcttgcacccatatggatgctcaacgacttcccaagtaccattagacataatcgagtccatctcactatgtactgcttccttccagtagtctcgaacacataactgatcaatgctccacggaacaggcaatccgaagcctcgaacttagcctcttcctcaggagaaagaggtggttcacttcgtttgccccatgaaatatagaagcattgcaacgctgtcaaccataatagtgcacgtgctttccatctcttatagttagaaccatcaaaagcatatggtttcagtgcagcagcaaagccaactaccgaaaatgacctatcaggttttttggattgttggaaatatggtcataaatcggcatattttaatccaaaatgttgagacaataatcatggcataaacagtgtagggtgatctagtaacaatatgtaacataaccagtagcatactaaaagcatcattcgcatcatgaacatagcagcaacacagtagcatgctaaaggcatcatgaatatcagtaacaggaacatagcagtaaagcgctaacaacaggaacaggagaaggatatacccgagaatggccctccgctagattgtgaggcagaattgcctccgttggtgttgttgttcacggcaccggctcctggcgcaccacctccggctccagctccaggcgcgccatctcctccagcagcagcggcgccggcggcagctccggctccaggcgcagacatggtgggcgagcagtcgtgcgggaagcactccctaaaaacctgatcacccgcctacccggtgcagatctcaggccaaggtgtggttccggaggccctgctccttccgatctctcgtgcgcgcaagcgatcagaagcgaggaggcgagagcagcacaggcgcagaggaggaggaactaacacccgggaaagaagcaagtgattcattctgatcggactcgcggcctccttatctatcaggagagaggcagtcggcagtcgtgggaacgtgggatcatggacgcgccgttacggaggcagtcgtgggaacgtgggttcgtggttgcaaaagagtagcgacgtgacgccagtcagccatgccctcgccctcgcccacgccctcggcccggcgcgcgcgcgcgtgtggctttccgacccccacctcaaccagtcaatagggagcctccaataactccctatttaggttgagatattcctcgcttaaatcctgaggtggtattattatccttaacacttattatgggcctttgagatttaatagaataaattgggcctagcccaattctaacaataggcttatcacgagcttggctggagctcgagcctgagcagatgagcttgctcgagctcggctcattgacaaccctacattagtgactaatccatcataatgaacgagagaggggagaggtcagtcacggtgacttaactactctgttgttccattgtttggcctcatcattgatgggattgtaacctgggctttttgtcaatgttctttatcagtcttatggatcacgtaccacataaggcatacatttggtaatttctacatatagggccggctgtgttcgttagtatggcttcccaacccacacagcacaagtggaaagtccattagcacataattaattaagtatttgctaattttttcttcaaaaatggatcgatatgattttttttaagcaactttcgtatggaaacttcttgcaaaaaacgcaccgtttagcagtttgaaaagcttgcgcgtggaaaatgagagcagggagttggtaaccaagagttgcgaacagagccgggctgagttttatctctactttcccaactcatctacctcgtttttcacgcacatgtttttcaaactgctaaatggtgtgtttttttttaaaaattttctatatgaaagttacttgaaaaaaaatcatattaatctatttattttaatttcttttagctaatacttaattaatcatgcactaaacgctgcattgttttgtgtgctagagagtaaggcaagtttccggagtccaatccaacaattatgataacttatatgcccgtagtctacttgaaatccttgagttgtacatggaaaagggtttgcctatctgtataaatacaaagcctccgaggagggaagggcatcgaatcataagccatagccacaagtcacattgaatactagctaggagaacatccaaagctagccacagactccaagtcactacataggttagttcttgacaaaagctagttggtaggctagattaactagcttgctcccctcttggtaattggtgtgacagatctcgttgctatacatataaagggttatggctattacccacctcgggagtccgaaccaatgtaaaaactactctagtcacgtgtataccctggtatcaatgtcccctttagctataaaatactattgtcgggtccaacccttcgacacttttcatttcttgaggaaatatgatctaattgatcagatggctgaaaaaataatgttgatattaactatataaaaagagggattgcttctagacgttcagtgtttttcttttattagaggaaagatcattatatttgtcggtgatatgggcctaggggttccaagctcaggagagaaaggctctccccgtgggacacgtgtcataaattccctgaagggatcatgtccttgcgtggggagcggccgttttcccccctcggcctcgggcctcccccggtcccgaggggacgagccaccccgaggccctcgctcgggcgccgcatggccaccagacgagggcaattgggtgggcgtgaacgccgcccacctaatcacatctatggttagtagggcagccgccccccattgtatttaatgcgatagagcggggcgtgggacgtgcgcctgtgaccggtctgtgaccggttgatggatggatggaacagcggcaggcgcacccacgcccgagctcgtgtcaggcggcgtgagggcaggtatgccctgttccatcatgaatgatgggacaccctgtatccctcatctagttagcagctggcttgaccgaatggaatgtg

SEQ ID NO: 60263 - DNA, 1925 bp, Oryza sativa
  unsure (1)..(1925): unsure at all n locations
aataccaaaaagaancgttttttctataatatttgtcgccaatttttctcccaaaaatttgacagatgtaattacagtataatcgtagtataattacactgtaacttgcatgtaattacactgtaactatagtgtaacttgtatgtaactttcaaanatctctctgtaatatgtcttatttcggtaaaatagaggttgtgggaacaaatccttacacatatgtgtgtgctgtgattttttttcttcctcaccaaaacaaatcttgtaatagatttaacgattcaaaattacgtgaaacttatatacaagttacactgtagttacatgcaagttacagtgtaattacatataagttacagtgtaattacactacgattgtactataattacatctgtcaaatttttaggagaaaatttgtcgccaaatgtataggtggtcctaaaagaaaagtctatttacgtccctccaatcttgccctcgatccaatcacattcatcaaccacgaggtataagtttccctaacttcaaaaaccggtgcaaatacagtctctaaggtagtattgagcccggttatggcttaagtgacgtccactcggcatattggctagatcttcatctcgcataacatctttgtggcacttcaagtcagaaaaatgaagtgagacccacctggaaaacacatgtcaaagactatatcttcttcttccaacctcctctcttctccatctttccacctctcctctttcttcctcatgatctctatgctagcagctaactggagaggggcagcgtcaggcaggtgaggagtaaggcagcaacgacttatcctctttatcaagcggcccagacggcagcaaccatatttggagtagctctcagctgctctcgtgaccttgaactcaagatccacatccattgtagcatcgtcgagcttggtgacgctgctgccgctgctcgggagagaggagatgacacattgctccatgcagcccatgcacccgtctgtgccacctcaagctcgccgaccactaggttgttgcggccaccgcttgagagaggggagactgtggacgagggacccatagctcccctgccgcttaccatcgaggattgaggtggagtgcagtggcgcacatgagcagcaaggttaaggcagctagctcacgcgcacgttgaaggcgtcgatggcaggatctggcgtcatttccatctccttgagcgtaaacgggggccacccacccgatctagtaggtgaggcggggggccacggcgcgagcgggagctcgatgaggccatagtggcgcgagaggacatgtaatcttggggaggctgcggggacaacattctggctcgtccgcatcctctgcgacgaggggctcgacgaggtcgaccgggcctcggtcccgtcctcctgcgcatctgccgccaacgagctcatcatcgtggttctcgtattcttgatgcgtcgatggactcacggataggggagctcaacccttgggaggctcgtcaccttgagtttgtccgcttgactgactggatttgccttctgggctcagccccgacctccggctccttccccgtcgaccactgggtttacacaggcacgcttgagatggacaacatccacacactgctttgccaatgctgggcgcgcccctagtggcatttgcgtcctccggcctatcttgcctctacgattgcccgaggagagagaaagagatgggagaagaagaaaaggaatgtaacatggtcactagatatgttttgccacatttcacttacaatttggggttatgccctgactcaacgagtctgactgtagtcaatctaccacatcataaaaaaaaatcactaccctaactaccgaagaagttgatgaacgnctgtncctagtggtagagtcattctaannnngcccacg

SEQ ID NO: 60264 - DNA, 725 bp, Oryza sativa
gcagcaaattgaagcgtgaacgacctgggcggtaagcggaggtggatgtccgccggcgagaaggaaatggtatacttgcggattcggagccgacgcctggcggcgccgcagcagcagcgccgccagatccgcgctccccttcttccggggtcgcgttgccgccaccgatgcatgcccaggacatgcgcccgcgccgtcgaccgccccgggaaggcgcctcgtcgcgcgctgagccgccggcgacggccattgtctcatcgtcgcccgtggcctgccgactcaccctccccccacccagcgctcctgccgccgtcgtcgagtcgccggccgtcgctgcggcagaatcgccgactgccaaagatgccaggagagagaaggaagaagaggaagcctcctcccacgcagcgctctcgctacgccgcccgcctctcgccgcccgtagtcgctccgcccaccgcctgctgccgagccgcttccacccgccgcccctatggtccgccccccgcccgttgccgctcgccttctcctcgccgtgtagatgagacagagagagggggatagatagagaagggaggctgacatgtgggaccacatgggtccccccttttttccattattttttgtgcagctgacatgtggttcccacggttttttattattaaacagggatccaattgcacgtaagcgccacgtcaatgccacatgggacgagcacctagtcaaag

SEQ ID NO: 60265 - DNA, 1046 bp, Oryza sativa
aattcctgcagcccaacctctatgacatcattaagttttgtttttcggaaaaatcttaaccctgcaacattcgataggcagacaatttggtagcgctcacttgctcctcaggactggccacattttaagaactttttgattcattgattttagtcagagtgttcatatgatcctgcaaaggtggataaggatactgatagtcgtgtgtacgaccttcagccaaaatgtacccactttaggaatcacaaaacatggtgagacaaagcaaaaaaacacaacatctttccatttcaggcgaaaaactttgagcatcgcttgcaagaggtaaatatagtaatattcaaattgggggttgacgtgacagtatccataataaagcatttataatgaattaaatgtagaaatattcccctttccacagaatggattttatgccactgaataagaaagtatttttacacatccttgaagcaggaaaaattggcctatcaaacactaaaccaaagcatacctaattatatagggtcacataaaaattacttaattacttcatacatttcaaataattaaccatctgttcaaagaaaatacagataaatctggtgatactgctttactagtttttcttaaactgggagatatggatataaaaattcattagcaaaagaaattatttttgaggaagatttccagaaattagaatatgtgaaacagtcgaattaaattcttcaataggatacatgtacagtgtatatgttgtagaatgtagatcatcaaataaacttgaaatggtaaatggcaatacataattttatgtggttatgactggcgacttttgatgtcacagctgattcccaaactattaaccaaaataataattcagagattttgtaagaaaagatggaataattacatacacagtaaatacctcctgcctttgtgtaagatgaaatagtgaataattatacatgtaaatgtatatatatccatcgctttgtggtacaggtataataagtaagtttgacaccacaattatattttgattt

SEQ ID NO: 60266 - DNA, 6402 bp, Oryza sativa
aaagggctgaaaatataaggacaatgaaaaacagatgcataatggtgagcatgaaacatgtagagctttgttaacccaaagccgataagtttagtgacgttttattcgtatcttttgatccaaaatgctctgaattactaatacataagcagaaaaaacataaactattagaactataaatttgagtccatttctgttgcagtaaactgtgccgttcattaataagagtaatttaatagaaaataatcactgaagtctctaaattggcacgcatacaatggatgcatgtttggcaagtgaccgaccaggcagagaaacaaagaaagcaaccaaaagtgttaattccttaaaccacaataacatgtatacccaaacagacgtcaacaattgacaaattggaggtacgtgatagccaactccactcaatccttgttcataaatacacgactcagtaatccgcattttaaaaagttttatttacatgcaactgtatggcaagtaggggtcatgtttgatttagttaatacaaatttgcctcatatctttagagtactgtgacattatagagcatagctattccacaacacaaaaggaagtggataatcacgtcttccaaaatttaaaacgacacaaggtcactattagtgggaagtgaattttggaatagattacttatgtcaggttaacaaggtctagaaatagatttcgaattccttacacgtcatttgttcaacaaatcataaacgacaactccatgtaaatactagtcggcaaatatatacaaaaatcaattttattttatcattttgtaaattgtaggactttgtttagtattcttatttttttaaatattgaatgttatagtaaattcaatacttttaatgttttttcgtgttctaaacttacttgtagaagttaggctcgacattcaagcacatgtgctataatctggcccccggtcttttaccaaacaaaagtttatcttcatgtttatatgaagagctaggtagtacactctcaatgaaaactgctcaatgttgagtaaaatattactcttttaagtagttaaaaaggaaccgctcaacttttgagtaaactaaactcagcttgtgttgagtaaaaactctgctcatctattgagtagaaatagtactcaataaaagactaaatatctactcagtttgaatgagtcaacctttactcaatatatattcctttgttgagcggttccctttgttactcagcatttgggtagaaacgtacacaactcacgtcgagtaagaaactgctcatgagttgagccaaatcttacttaattaacgagtacatattttgactcaatttattttgactcaatttgtttgagcaattttttgctcaaatattgagtatcatgttttctgggtaacgcttagttgagtagatttttttgctcaatcaataatgagtaaaaacatgtactaagctatttaatacatgttattagtacatgtttttactcaatactgattaacacaaaggtggattcaaccagggttgtaactttttgactaaggggttaactaaaccgctgattaatattgttctttttttaacagctgttaagtaaccttttttttttaatagagaaaataaaccataattttgcctgatttctaaatttagcattgatttgaagttcttcactcacacactatgcaaatcacataaaattcacgacattttaaattaaataacataatatgtggactttaatttcccaaatcagtttgaatcacagtaaaaactcagagttctcccatcatacatgatattaaaaagtatgtagtttaacaatttcaattttaaaacaatgttactttacatcgcatcatcataatcagcatttaagtttttggcatcaattctgaatgttaaatatcagtaacataatttgtggactttaatttccaaaatcagtttgaatcacagtgaaaactctcatcatacatgatattaaaaaagtatgttgtttaaaaattgtttaaaaccttcaattttaaagcagtgttactttacatcgcatcatcataatcagcattcaagtttttggtatcaattctgaatgctaaatatcgcactcatcttgttatgattaacgccatcaatgaaagtcaggtaaacaaaaattaatacatgaatctcctgattacagagttacaaatttaaagatttaaaagccgtggtgccgtggtgctgagtgggcttttcccaattatcccggcgtttttatctgaccgttaggccgtagaaagcccgtaaagggcccgaatggcacctaatgggtcccgcgcgggctccagacggtgcccggatgccccctcacgatttttgggggccaattctcatgaaaaatcttcacgggcgccttgcgatgctcaagaactccatacgtgtaccctaatgctccctcacgggcccctcaagagccccttgtgatatgcataacaacaggcgtctagtgtctgggggccatttgaaattgatattgcccgtgcgggtccctcacggcggcatctcagaatgttcaacgcagattaaaatacaggaggtgcggatgccagaggacacatagttcagtgaaccgcgcggcacctggccgggcgccttgaggatcccggtcgggcgccgacagggcaccttccgggagccatggatgtccctgcttatcggacgccttgcatttcactcgaccaatttttaccgggcacctcccgggtgtggcagattatgtgaccatacatccggtagaaattaaaggttcccgtatggtctctatatcctcggcaagctgccgggtagggaaaatcttaccgggcccggttaatatgtgacctaggcattatggggcttttacatattcactccgcggcccgtacggcgagtaaaaacagacatttttgaaattttcggccggtgcccggctggatcccgtacagttcctacgggcgccgggacatgtttcacttgccttacgggcactgtggtgatgagttggctgctcctaattctcccggcattttcatctgagtgttaggccgtataaagcccgtaaaggacctgtggggtaccgaacgggtccgagcgggtttcggtcggtgcacagacggcccctcccgattttcttcttgtaattttcaatggaggcgcggatgtcaaaggacaaatagtttagtgcaccgcacggcacccagccgggcgccttgaggtccccgtctgggccccgggagccattaggtgcacctgctaatcggacggagcgcgatgccttacgggctccttgcattttcaccgggcacctcccgggcgccgcagaatatgtgaccgaacgtgctgtagaaatgaaaatcggaagggtcccgtacggtccctaaaattcacggcaagccgccgggtagggaaaatcgtacggggtccggtgtatatgtgacctaggcattaccgtgccacatctgaacgagcctcttaaccgatatccttctgccggaaccaaatgtcccctgaatcaatgctatacaagaggattcagtagtcagcatgttaaaacgagaaatatcgcaatctctattgccgcgcaatgcgaatgtacccctcggcagcgtcatttttttctgcggcacatattgaggcttttttttcaaagaggtcttgattttaaccctaaccctaaccctaaccctaaactttcccataggctcaacacgcacctaaccccaatctgtgccgcagaaagaaaaaaaaacgccccccccggcattggcagcgatttttatgtcatccttatccctgaaacaaaatgacgacgtagagattgccactagtggctcggactattgtcaagactaggaacagcatatcaccataataatatgtgtgtagattagagtataacgcacctctatggaaaatttgaaagaaatgtgtgcagaaatgtgacctgcaaagcgacacaggatatcaccttaagtacgacctttgaccctataacagacggaacacgggtggcagcatcaccaaacacttaagatgtgcagcttttactaagaaacacctcgatccatacaaaatttgaacgaaatccgttaagaaatgtggtagttatagagcgcataaaagacgtatgacctttgaccgtataaaggacggaacaatgagggtagcatttcattttgtggcatggtttacacaatgtaataaatgaatcaatcaataaattactttaattataaagaaattaaaaaataatatgtttactcaaaaaatcaaaaaaatcaatacaaatgcactctacatgtgctttatggtcagtaaaatatactgtaaaccaaattcgtatcttcacccctgagccagaggctacatacaaaccaatatataagcctaacctaaaacccagttgcaaccctaaccctatatctttgacaaatgttgccatagcaaatgtacatgcaaaagcacaatttatacacatcataatggcaagcatcaagactggccctatttcattcctctcgggtaccagctgcacacatccataaggtggacaggctagatgtttgggggaagggactacgtgttctacttcataataattcaaacttgcatcatgtaaacatgacaatgacaatgggccagtttatcatacttatagttcagaagcagagggagattaggaaggagaggcagatgaataattatgtcaaacttacggcatggaaacgacgtcgaaaaaccaagtctctttgaagtcctctcggactcttacatcaccattctgataaccaacacccccgcctgatcttcgcaaccttggtttatcagctaaacagtttactagataagtcggatcatacagacactgttgatctgtaggcaaattcatagaaaaataaacaggtaattttacttcttgtatagattgaaaatagaaatatgaagaaacaaaaattaacaaacaacacatgacataatgtacatgtatgttgtttacaatacacttgaacctattgtaggccaaaatatcttgtgaaaaatatcatatacatgaaatgttatgtgtatggaattgatttttagctttgtttcacttttaattctgtgtagctggtaaactttatttccaggatttccagtttctgcttgaaggcccggtcacacagaggggacgcatgggggacgcacgaccagcgcattggaaattgctaggcgtgcgtcatcattcgttactcgttcgtcgagcgcgctggaccaacgatggaccagcgctatgcattcgtcgttattcgctgtgtgcgtcgggtttttgttagcatgctccacaaaagtgtgcgcggagctcgatgcatgaatgtacacgccaaaggcacgccagccatgcgtggagcgcgctagaccagcgccagacatacgcggagcacacgccctgtatacgcacagcgcgctagatacacgctgtccattttgtgtcagctcgctagcttttccaaaatcatgacaaaagttaaggccaggtcacacagaggggacgcatggggaacgcacggccagcgcattggaaatttgcaattttggccagtgcgttgtcgtgcgcccaacttttgtcgaagctacagcgagctgacaccaaaacgcgccagcaacacgatgtgcattcgtggaagttgttatcaagtgcgctctggtacggcctgtatacgcactgtatgcgccctgtatgcgctcagcgcgctagcaacacgctatgcatttggtgtcagctcgctgtagctacgataacagttgggcgcacgtcctcattcgttactcattcgtcgagcacgctggacccacgctatgcattcgtcgtcattcgatgtgtgcgtcggaattttttgagcatgctcaaaagtgtgcgcggagctcgacgcatgaatgtacacgccaaaggcacgccatacatgcgtggagcgcgctagaccagcgccagacatacacggagcacacgccctgtatacgcacagtgcgctagctacacgctgcttgcattttgtgtcagctcgctagcttttccaaaatcatgacaaaagttaggcacacggccttttctgatttccaatgcgcgggtcgtgcgtcgtctatgtgtgaccagcgcgctagcaacacgctgtgtattcgtggaagttgttatcatgtgcgttatgtgtacgttctgtattagcactatgcgccctgtatgcgctcagcgcgctagcaacacgctatgcatttggtgtcagctcgctgtagcttcgacaaaagttgggcgcacgacaacgcactggcaaaaattgcaaatttccaatgcgctggtagtccagattcagtccgttcattctttttatcccc

SEQ ID NO: 60267 - DNA, 536 bp, Oryza sativa
ggcaccttcatccacttcggccgccgttccagtagtcgccgtcgacccgtggtgagccgaagaccgccgcttcgctccctcttctctcctctctctcgggcgccgctccgttgcgccggtggtcgccggcggtgaccatctaggcgcgggcgcgccgcctcccgtcggccgtgccggcgaggccgcctttgggcgcgccctgcggctgccaggtggggcccggccgtcagctgcccgcgcccgcgggtgcggctgacgcgtgggacccacggcgccagccgccgccagccgcgtgcacccggtccaccgtggaccgagaggctgacgcgtgggccccactccgtggacccggtccgcgcaccctctctctcggctgacgcaataaatgagtttttaattaaaatttaaatgaagaaattcgcaaatatccatttaaagagcatatccccttcaaatggccataacttggccatttgaactcggaattggaccgttcaagtctctaatttttccttaagaagtcaagaagggggatc

SEQ ID NO: 60268 - DNA, 725 bp, Oryza sativa
cggtatgtaaacgatatatggactgctttaacattcgagacatgcatggaagagtctatactggctgtcggtgacgttgcatcatgccatgactcctcggcacggatctgggtcatttgcaggatgcaacgtccacttgagcctatataaacatccatgcctatcatagcagtcaatatatctatactaatgagcggtcattagtaaaattacgtgttaggcaaaataaacgcacggtcacctgtacgctctcaaccaatcatttgattaggatctgcttcatcatctcataatttccattattgtatcgatttttaggtaggcgatccacagtagtgcgtggagaggttaatgcatgaacaccctgtgtgagtgaatgcatgaatagcattgcgcattgacgagtatacaggtaactgtgcacagctctctgttagcgttaaagtaaacctattaaacttggagtttatttgtcagcgataaaaaaaaatcaaaaacaatcttgaaatgaattctctttacatcaaataatacggatctagggctttgtttgtaaaaaaaaaaaaaatgatgcacgtttttatttgttcataacagtatatatatgcactcttgttgaggctgttaatgcacctatcgaaagaagtcgtcaggcttcgtccgatagatgtatacagcctcaaaccgagtgcagatagatcatagaatgaactcattcgcatgca

SEQ ID NO: 60269 - DNA, 28768 bp, Oryza sativa
ggccgatattcgatccggcatcttggcattctctttcccttctttccttaactgtgcatgtttactaatcattcccctcacaccatagtttttgtatcacatactattggaatatatgtccttttttttctctaactgggcatgtttcttaatcattcccctcacaccatattttttgtatttcatactatttgaattggttatgaaaaacttgctctgggttttgtttattaataaaaaaatggtaattttgcttttgcagtatgactgaattacctttatttcaggtagaaaaatgtattcgcttacatgggctctgcaatatgttaatctattcatgatcaacactggccttatcattttagctggtcaagccctgaaggtacagagcaatcaccatcacccaactcttcttatggtgaaatgccgtgttatttcataacaagagttgggcccttctattcattatctcagtatctaagtttagatttttttttctttttgggaatacacatgttgaatttcactgggaaatctttttccctcctggactcatttgtgaacttcctttctgcaggcaatatatgtattatttagggacgatggagttctaaagctaccctactgcatagcattatctgggtttgtctgtgctctttttgcctttggaatcccttatctgtctgctctcaggatttggttgggattatcaacagttttcagtctcatctatataatgatagcatttgtcatgtcgcttagagatggtattatactttggttccttgttcatctgtccttaatttcttgtgcatttccatttgttggcataacaagctactcgtacaaaaatttcattactggttttcttttgaagggattaccacacctgcaaaggattatactattcctggatcacattcagatagaatcttcactacgataggtgctgtagcaaaccttgtgttcgcttacaacactggaatgctcccagaaattcaagttagtcagtttagtacatatggccagtgactagtttatttaccatgatattaccttatgtgtattatatattgcaggcaaccataaggcctcctgtggtcaagaatatggagaaggctctatggttccagttcactgttggttcgttgcctctttatgctgtcacctttatggggtattgggcgtacgggtcctcaacatcaagctatctactgaatagtgtgaagggaccaatttggataaaaactgtggcaaatttatcggcgtttcttcagactgtcatagcattacatgtatgtccaccttactatatatctagtccaagctacattattgtcaattagtaatggttatttctttttcaatttgatttgtttataatcaaattgacactcaatgaagtaacatgaggtcgttttctatatatgccagatatttgcaagcccaatgtacgaattcttggacacaagattcggcagtggacatggtggtccttttgcaatccacaacataatgttcagagtgggtgtcagaggaggctacctgaccgtcaacaccttggtggccgcgatgctccccttccttggcgacttcatgagcctgacgggtgcactcagcacctttcccctgacattcgttcttgcaaatcacatgtacctcacggtgaagcagaacaagatgtccatcttcaggaaatgctggcactggctgaacgttgttggcttcagctgcttgtccgtcgcagctgcggttgctgcggtgaggctaatcacggtcgactacagtacataccatttgtttgctgatatgtgaggctggaaagtgcaagcatgcagccctggatcagctgtaaattcgtcctcttcttttttatttttttggttaggggatgcatgtaggtcgatagaatgatggagattgcaataaataatttggctaaaatgttgtccagatttggttgtttgaggtgcaagatgtttgcctcaaaacgtaccgctatggttcactttttaagaactgtactgctacctctgtttgcggagatttttgtctgcaggcatgcaggatgaatattattcaagtgctctaatagtttgatctcagcaacatcaaactgtccttagatatagacatagataaacccaccttttaattttgtgaattttaatcttaattcggagaatttggcactaaacaattttcctttttgtttacaaattaggccctgtttagtttagcggtgaaaagttgttgtgtgtcacatcggatatatggacacacatttgaagtattaaacgtagtctaataacaaaacaagttaaaaattccacctgtaaactgcgagacggatttattaagcctaattaatccgtcattagtaactgtggcaccacattttcaaatcatggagcaattaggtttaaaagattcgtctcgcaatttacacgcaatctgtataattaggttttttttctatatttaatacttcatgcatgtgtttttttctatatttaatacttcatgcatgtgtctaaacattcgatgtgtcagggtgacgagttttttttgcgtagaactaaacagggcttaaatgcctctgtgacggtatttcaagaaaaatctacaattcttccaaaaccactccatatcctaattttagtggatggtccgcatcatgtaaaaaataatcactaattatgattataatcagtttctaaattttagaattaattttgtagcatttttgtcactttcattgcccgcgctcttaacttaattgctaaaaagacaagtaataaatctaactaaaaaatattctttgaaatcaaactttaaaaattcaacatgcttacagctatttttagcttctaatgatgaagagtataaatagatcactctagagcttttctttggtttgcttatccttatgcttataaaccttttgatttttaaaaattaattttgaagttgattttatggtttttccttttattgtactttatcttataacattttattttgaatcgattaggacacggatacaaaaatttcacccacaactgtttttttattgctaatatactatacatatacatataagtacaagcataagcaaaataatgaagctgttattataatccgaataaagatatggtcatcgtggccattcacagtacaagacactactatgagtacaagacactactatgaggagcatcagactcccacataggatgaagatagaggtcctaaatcagtttctctcacagtgcaaagtggttctaggggtgttttaattttgcatgtcaacctatgtcattttctattttagtcctcatattttgtaatttttaggggacccaatattttacaccaaacaccctagaaataaaaataaataaattcgccctccatcctcatccagtcatcccgcactccctctaacatttcccctctccatcgctctccccccacaccagcgccgctctccatccccatctctgccacttcctcttccccaccgctagtggagctccctttccactccaccgccggcaccgcttccccttcccctaccggtggcgccgctctctctcgcaccccaaagttggcaccactctctctctctctcttccaccggcaccactccctccactttcctccactattgctcgactgagccacgctgatggccacccctgcgccccctcctcgttagatccagcctaagactcaccggatctggccttgggagacaacgacgagagccatgcgaacttctccttgacccgggccaaggtctgtgtgagcatggtttctaggaagaagatcttggggatggagagaaggtcgtgctctagtgcttggcagggagcggaggagcgcacgggtgatgaagacacggtggctagcattggctggtcgaggggattgttgggcctatttggttctctaccctaccaattcaatggtagtgccaaaatctaggcaaattttggcgctaccaattctttggtagggtagagttcatataaatgtgtttggtttgctactatttgctatcaatatgctttttatagtgaagaaagttctagagtactaccaaattaggtatgagcattgccgatgctttggctctaatccaaaccaatcaaactactatttgaattgtcaaacaattggcagggcacattttggcatcaatctaaaatggcccgttgtcgctccatttgcctaaccaccttcctccttctggtcctcgttgtggtggtaaataggagttcacgaggttggagaacatatcagagagacggagatgcttcttgcagttggtggcttggaccttgggtcccacatgtttagacggtggtggtagaacaaacaccaccactaggaacattttaaaggagtatagataattgcttttttaacataatatgatatagattttacctcgattttcattagcacacttttcaaactactaaacgatatgttccgtgtgaaaactttctatatagaagctgctttaaaatatcatatgctaatagttttctcattttatgtgcaaacttaatcttcatcttcatcagtttcaaacaccaccaataagttgcaatgttcattttatattataagtcattttagtctcgtcctaagtcaaatttttatagaaaaaatatagatgttgctaggttttttttatgaacttgtcaaacttggacaaccccccaaaaaaaaattataatatgaaatggacatttaccgggcaagattattaaaatccaccgggccctcaattacattcgttagtgtttgtattttgtatatgtgcctctgtcttagttacggcgctgggcaccctcttctgctgtaagcaacaaaagtaaatttcacaaaactacagatactatgtccaattattaaaagccaactcttgacgagtttctgaacggttgccaatgatttgaatagtcactactagaaaaacaatcttttatcctagtccccaaagcataaatatctcgattagattaaaaaccgttattaaagatgttttagtaccggttctaaaagtccaagtccctagaaacatctttagttccggttggtgttaccaacagatactaaagatgcctccagggttagttcaaaaagaaagcatctctttccaagtcatatgtgtgtagtacgtgggatggtaacgcgcgtaagggctgaggtgagagattttgagtttgaatctcgatttactggtctcggttgctacaaccggtaataaaaggggttgttaaccggtagtaaaaatgagttctcttgtagtgagttgaacgaccatgacaagatttattggtactaccgatgagtctagtaggcccaatcctaaaatcaaaggatcatgaacttcctaaaaagtgttaagtgaatcagaaaatgaggcatgccactattgtaagttatgtgagaaagaagaacatatgaaagttaagttgccatcgccaagtgcaactgcacatcaagaactaatgcaaatgtagaaagttcaatgcaacacgagttaaggaagaaaaaggtgcacctagaattccatgtatgacttgatgcttgggttaggcattttgacataaaaaagtgcatggtgcttagactaccagtagttgtgggttgtggcaaccaccatagatctcattcgttggtagaagggaagagggttctccaccatacatggagaacatcaacaatggcaacaggggcgtggatcctaagattctggtggagaggtggggagatgcggcgtgggcaagggaaggggaaccaggaaggagggatcgatgtggggtgcggaaagggggaagggtaagggagagggtttggagcattcgtttaggtgcatgcaaaggggagagggttccatgcgaaggttgagggaggtacgtgggttgatttgagccgttcgattcaatgatttttggatcgttggatttgatgaatacggtttgtagtagtacagttggtgaactatatataaataaataggaaggaaggatagaagaatagataaattagtcacaatatactcccttcatcccacaaaactggtcgttttactccttcgcgattgtcccataaagctggtcgttttatcatttggagtagaaaagtgggcacatctaatatgaggctatcatgtactactattagttgtttttgcttcacaagactttatgcccgagaagttgtaggatggtggtgtagtgcaggagaagggggacagtgaaatagttttagtacctgcaaccggtaataatttagggtatgttgataattttcctccaaagctaatttagctgcacatttctaggacttccagaattttgggacgaagggaatatcatttaggatgaaaggatagaagaatagatagattagtcacaatatgtcattttgaacttagtttacacacattagataagtttgtgcaccataataaataatttacaaatttgtacactataaactacacccatctaatccatagctgaaagcctctgtttggatttctactgtgaaattcaaaacaaaaaagtgttagaaaaatactcctactgggctcgtacaggcgcccatcttttgtcccctcgcccgcaatccacccacctctcgagctcacaaaaatcgctcgccccccttcaccttcacctcgctcccgccgccttcaccacccatctccgccctcgtccgctcgccggcaagccgctgctgctgcagctgcttgctcgtctcgtctccccatccctgggcggggcgcggtgggaggggggcgggggactcgccaccgctctccgttccgtgggtgtctctgcactctgctttgctcctcttcttccccccctctggttccacccccgcgcggcggagcgcgggggaagggatccacagatgctgttctgctgccctgcttctcctccccctccaatccaagcttcttctctcccgccgttccggacgaacagcttgtctccgaccgtacgtggcgggaatgccgcgccacgacgccctctcgcgcggtctttctcggccaagaaccggtccccgcgagcgcggaaccgccacgcggcagcaggtgatggtggtggttatgggtctccggagcaagaggggcgtggggaatcgtccctcccgaacgccgaggcgctcgcgtcctcgctgcgtgattgcggcggcgcggacggcgtccggcgggtgcacgcggttgctgtccggtcgctcgacagcctggggacgttcgtcgccaacaatttgatcagcgcgtatgccaggttcgacgaggtttcggatgccagggaggtgttcgacgaaatgccggagaggagtgttgtgtcgtggacggcgatgatgaatgtgtatctgaaactaggacactacggcgaggttgtgaggctcttctttgatatggtgggaagcggagtgcaaggtaacagcttgacttttgtttgcttgctgaaatcatgcggcgagcgttgcgatgctaagctagggcagcaggtccactgttgtattgtcaaaggtgggtggagcaatgtgatagtggacagtgctattgcacacttctatgctcaatgcggtgatgttgctagtgcttcagccatatttgataagatggcctatcgtgatgtcatctcatggacaacaatgatcacagcttatgtgcagcatgggcatgggggccaagctcttagaatgttttcagaaatggtgtcagaaggatttcgaccaaatgagttcactgtgtgcagtgtcctcaaggcttgtgcagaagagaaagctgtgagatttgggaagcagctgcattgtgctgttttgaagaaaatgtacaaaaatgacatccatatcggcagtgcccttgtcaccatgtatgctagatgcggtgaagtttttgatgctcaggcagtgtttgatatgatgccacgaagaaacactattacatggacttctatgatctctggctatgcacaaagtggccatggagaaaaggctatcttgttgttcagaaagatgaagatgcgccgagtatttgttaacaacctcaccattgttggtctcctaagtgcctgtggctccttacagtcgccttatcttggaaaggaattgcatgctcagataataaagaattctatggaagaaaatcttcaaattgggagtacacttgtttggttctactgtaaatgtggagagtacacatatgctgcaagaattcttgaagcgatgcctgaccgtgatgctatctcatggactgctctgatttccggctacaataatctaggtcataatgttgaagcacttaaatcattagatgatatgctatgggatggtgtaaaaccaaatacatacacttactcctcggctctgaaagcttgtgcaaaattggaggctctgcaatatggaaggaagatccatggttttgttaacaagactcaagatttctccaatgtgtttgtgggaagctcacttatcgatatgtacatgaggtgtggaaaagtcgacgaagcccgaagtgtctttgatgccatgccagaacataaccttgtgacatggaaagtgattattacaggatttgctcagaatggcctctgtgaagaggctttgaagtacatgtacctaatgcaacaagaagggcatgaggttgatgattttgtgctctcaacagttctgacatcatgtggagatcttcaatggaaatccatctccttctctgactcagttgctggttcagtttcagctaggcagtagattagttctcccgtggcaaagaagctagcacttctgtacagttacagagatttgttattgtgcaagatcagaagacatgtagcacaaaaaggtaactcaaggagtgcatacgtgtatatgtacttttaagagtaccactaccttcactaaccatttgccttttgggttcattacaaaccatgcatatcttcagaagaaaaattgtgaaaactttagaatgttttttatgcctgttttaattcccactatggttatctctatcattacaattgcattaacatatgatctgcataataagcataatgcttgcacgcattagcagctaaatcattcttccatatcatccacttatccacttaggctgtgttcggaatcggacgttcccagcgtgcacagtaagtacggaaaacgaagcggttcattagcgtgtgattaattaagtattggctatttttttttcaaaaatggatcaatatgattttttaagcaactttcatatagaaacttttttgcaaaaaacgcaccgtttagtagtttgaaaagagtgcgcgcggaatacaatggagaggggttgggaaccttgagttccaaacacagccttagagttcatgctgtgactgcaaaaaattaaagttcatttggtaattgaattcattatagcaagtgtatgtttttttttcatgaaattgatatattttaacttaaatatgggttttaacatctttatttcatacattctctatttgtttttttattaatctaaaccatcacagtaattcacattcactacaatatgagggcatcttgttcttaaagatcgtaacatgttcttattttatcttgtttctccacaattttcctagtttattttcaacagggatttgaagtgctgtcctaaatttaacaaactgaagactctggtacttaatgattggtgtgtggcttctgacctcaatgcactaatttattttctgcaacactcaccagttctggagaagcttacactacagctttccaaggtacaaattttgtatatggatagctgtctgttatcaagttatcgtccacgatttatttagttaaatatcattttctatagacatgaaaagattcattgcaaacaactggaaattacaagtatcttaagaaggttccatttgaccttaagaaggttgaaagcaaatgtgatgaagttgatgaaagagtttgtgaagttctcaagatcttgagtgcttatgtaacaccgctccaaattgatatgagagatatatgtgagttaaatatttaataccactcctttcaatttatcaaaatatctataaattgtaaccatgcagtgaggaaaatatttggctaattagagggaagcaattgttcaggacaggtagaaactctccccatatttcatgaacagaaagtgaaagcaattgtcaagcatcatcatacataagcatataaaatgagtttcgtttgaattacaatgtacaatcaaattatacattcagtagtttcgagttttataaagttatacattcagtagtttcgagttttataaagtgatggcattatcaggcgctgttctctctaatttctgttctggcaaactgtaagcaaacatcctcaatcctcataggcaaaataacaccctctgtctgacctttgatggaacatgatgactgtgagtgccatcaaaggttcgacagagggtgaatctatgtttctccatgattatttagtgaatatatgtttctccatggacaaatagcacatcctatacaatccttgcatatgcagataaggtaaactaaagtgattcctattaaattttggaattatggcggttgaaaatataaaaggtggaaatttcctgtattcagtcctggaaagggaaaataaaaacgcatcactaaatttttttcagtttccggattgattgatatctatcaaactagtgtccctgaaactggtttacattggcacgcatcatgtatcatgtatgcactagaatactagatgtagttagtcaggaactatcaagcacatcttgcaatttcactcatgcctattttatctgcttcgtatagttgataagatttgggttgttaattcatctactatttgttgattattcagaaatagagcatctccctgagtttcgcaagataactttagtttcatctcaagtatgtgttgctgaagacatttcatctcttataaatcttaatgttgattggatatgctgttgattgcaccatcacaaactcacctaaccagagctgcatgaattgctctaggatctcgtatcactcgcattttctgtcacacatggctaaataattacatgaataatgatcaagccgactataagctgagttgcaccatcatctgcaatttctcctgtgcagatttcaaccatatatactccccccgtttcacaatgtaagtcattctagcatttcctatattcatattgacgttaataaatctagacatatatatctatatagattcattaacatcattataaatatgggaaatgctatgatgacttacattgtgaaacggaggaagtacaactgaaggcggccaaaaggaaaaaaaaaactagctgtatgtactactgtaaattacaaacgagcctagtcaatgccatttgccaatatgcgcttataatcagcatcacaagccagtgacttcatcccttggaagactgtgctacgtgtaaagatccagagggtggggcaaaacttgtattgccgataaaccagtagagaacccacttcaagttgcacagcatgtattttagtgcttttgtccaattgtcaagtttattgaaacttaagaagattgtatagctccctactttgtcaccttcaatcctgcaagcgaagttattcaagtaaagagcggcacaagcaacgttgtgtatataagatatatccaactgtcaaaatactagtcatatgaacaaaagagaaaccataaccgcataacttactaacctgtcttaattattttgttttatcactagtaaaacctaaagtatttacattgatttcacttaggtgatgttcaatgatggctaatttgtgtcttagcatgaaccatgcaattcatatactaagagatcatagtataggaaagttgcaataaaacttacttatatgggagcttcaatgacttgtcaggtggtacattgttctctttatccaaactaacagcaaaatcagcaaattcttgcaagcaagtcagaaaccatgtcatggctttgtcaaatcgggtactccagaataaattcacaggaccgaacctgaacattaacagtgcagcctattaacttggtataatgtaattccactgtgcaagataagaataaatatacaaagtaaacccccagagtgaattttccaaaattagaacggccgccaaatgatgattttataccagtcccaaataattgcaccactcaacataacatgtgctcagtgaaagcgaattgacaacatgatttatttaaaagtttgtggatgtgttaaccaatgtaaaagaaaattattaccaccaggaaagtgatcaggtatgacaaaataagcataagttgcctatttcatgagggacatcctagattccttactagcagcagaatttgttcttcagaaaaaaatataatatacattatgaaaataaggaatattacagtaccaatattttacaagtttttgaaaagagaataacaaagggagtacaatttccagcaggaagcttacagttcatatgtattttggttgatgtctgtaacttttggatagcttcccatagggtgaattttgatccggtatctagataaatgttcaggtagcacaattatcatttcgtcaacaattgtagagtattaggatttgtccttttcaatgtacatacacatttttaatgctacttatgagagaagatctgctaaaaacacatcatgcaatccaataaaagactataatatgcaattatgcattcaccctaaccaataaccatccaacactatctttccaacttgttataacatatagacaagctcgattcatatagaataaacatattttgaacacagagccatacagaaagaacaaagcaaacaactacatggagtaacaactaaaatgcactgaaacatgtatgtcgtaatgttgtataactagttgatggaggtaaatgccatgtatgaattacttctcaagagaatgaccagcaaataaactgtagcaaaaataatgtcactgtataaaggatactcaaattttgggaagaagtactgagccatggtatgcaacagaagagcagcctggccccaagcagcatttatctcatcccactccacctaagaaaagagtaacacagttgttacattaacacaaaggatcaacatgaacattccatgtacatcttgaatagaattcaaggaaagcactaaaagatagtgaatggacgtgatatctgcacattttgcataattacctgtacattaggaaggcggccaagacgaaagttgtttattgttccgatcaccccatcatgtgaaatatagaatgcatcattgagaacatttgtacgctttaacaattctagatgaacctgcgaaacttctatcttggccaaaaccgcatctctttcttcctgaaagtgacaaaaaaatgagttattgacaggcaaatgcttgcaaacagcccagacattatgaagcttatgtataaggaaccaatacatattataatatctatgctcctataatagaaggtagtggtgaactggtgatggcagtgaatctgccaacccacttagtcccattgaaaattttataaattactccttgagcgtcttcatgttaaaagacaaccaaatctaaatggatagccacatataaaatcaaattaaggtgaatattccttataacaaaaggatgggcaacacatttcatgtaaaatatatttttatttattttaggcaatactatagtataacgtagcaaggcatgggcattcagctagttattttctattatgaaggcagcgcaaaacatgatagtacagacacagagcattattcacaaacaatgttaatttttaaagaggtttatttataccaacaaaagtacaaaacatggcagctatagacttagtttatatagctttagctattgagtatatgacaaatctggaatatagtgcatttggttgtttctatgttctgctagaaaataacaatgtttttaggtttttgtgctaacaagaagtcaaaacatgacatcaagaaaatagtgctaagtaaatatttatagggcctgtagtaggtatttacctggtgagatatccactgaaactgaaagctattgagatcatggcaatacctgtttcaaaaatatgataaatcagatttgtttaacaagtaactgtagaacttcacaaataacatgagccaaccaaatatttcagattgcacaaaaccactagcaattgttgtagcgatataacaaaacatgtgtgggatgtattatgttattattcccaaataatgatactcctattttctgatgtcgaattgccaattatattgaatagcacactgacactctgttgaataatgtctagtttcaggtgacaaatataggtacacattaatgttttcaatataacagttgtattcatagcctataacaatgttacgactcatcagaaaaaaaagagagacagagaagagtcgagagcctcctgcaagtatgcacatgcacacccaaaagcaaattataaatcactgaagactctatatcactgattcttgtagagaaacttcagagttaataataagaacattcaagaaaggacaaaatgaaaaggttaattaaaattttaacctttcttccagttcttcgaactgtttagattttgtttcaaggcacttcatctcggaacaaatttctgaatattgcttttcagcttcctcaattgcagctttaagtttcttttcttcttcctcaatctgaaatggcagaacacataatacatttagttccatgaaaatcatggccactgaccagtcagaggtgcttattcttttttttttcacataagaaaggtcaagtaggcaacttcttcaggaactgttgcacttcaacatttttataagtgggcaagaattctcttacagagaagttacaagggaattatttgttcatttaaaacattgctcactacctatgtgtttcatctatcaaaagaaacttctgccttacttatttttgtccaaagcagcaggctgtcatgcactttaggatctcattaatcacgatatgaccataaatatgtaagaaagattaccaccttttgtctctccttctgaaagtcagtttcactgaggatgttataggtttcctgctccagacgttgaagacaggcctcataagctttattgtcagtattaacatcttcaatttccttctccattttatcagacagcaacctcatacagtccagacagagtggctgttcaatctacaagtatattccagattatcagcggtcttgacattgttcctctcaaaatactaacagatggcaatgaaccctcaacatatagtagcaaaaacatgcaaatctgatgcaataactagcaactgcacaagctaataaatgggaaacaaaggtaaaatgacagaaatggcaaaagcacgtgttctcattcaatacagaggcatcttacagaagtcattgtagtacctgtgtttgtgatgtagcaatctcaaatgcccgttttaatacagtcacgctagagtgaaaattatttcctggtaaagggctaccggggttcatacttgttggtgacaactgcgcaccacctccttcagaggcagatgtcttgtatatggaagcggcagcaggtggaagcactatatatgatccctccattgctcttgttggttggttcggctcggcacgcgggatccctgcgcttggcgggcgtgggggaattccatggctatgtgatctattttgcttcgatagcacgacataagagttgtccatcctgctagcacccataacgctgccctgaacagaggacacgttcatacctgcattgataaaaagctcttgtaacaaatagtgcagcaattcctagcatttttcaaccaatcatgccccaatttcctggctcatgcgatgctaataccataccaaaaccgaataaattttctacctatcgattccgattcgagtcgatggaattacgacgagccaacaaagggaaaagggagctaatcggttgaggaggcaagggttaccggagacggcatgagcggggagcttatcggtgaaggactcgacgccgacgacgacgagcgcgcgttggcactcctggcacttgaaccgcggcagagacgggtcgaccccgccgcccttgtcgccggcagcggcggcggaggatgcagggggcttcatatcgccgcccgacagagcaggacgcgagcgctacctgcatccacgaatccggcatcattcacctcaccagaaacaacggatcaaacgaaaatccctccaatcaaaaccctatagacagctcacgagctccagcacgcgggctcaccaatccaacgccgatccggagagcacggctccagcctccaggggcggtggagtaccccgcaggaaaatcgcggctaggcggcgtcgcggggtgggggtttgaggcgtaggagatgagattccggcgggggcagagtccgtgcgaggaaggcgacggggggctcacgtgcgcggcgcggagagacggcggtcggagcggcggaatcgccggggagggaggagtcgcctgctcgggagtcgagagagagagaggtagcgtgcgtgtgggcgtacgtttgcgtagcgtgtaaactgtaaagtttgtgtgggtgggctcaggcctgtggttgtatgcgtgtgggctacgtgggccgcgcggggaagaagagccgattgagctactccctccgtttaaatattggaaaaagtacaccgaaggtccctcaacttgtcatcgggataaaaaacgtcctcgaaccgcaaaaccagatacgtaaggtctcttaactatataaaaccggtcacccgaggttcttagatggttttgaccccagttttatcctacgtggctgctgagtcagcgtgggacccacatgtcaggatgccaactcatcacatctctctatttcccctcctctccctttctctctctctctctcacttttctcaggccgggcggcgggtgcggactgcggaggaggctggcggggcagccggcgatgggcggactgcggaggacggaggcggtgcctcgttttggcaggtcctccccttttctctcccttcttcctctctctctctctctcttactcgttttggtgggccggtcggcgggagcggaagaggtctggtggccggtgacgagctacacgatggcggcagcgactttgtgtggcggcgacaaggatggagttgacctgcagatagagcgctgcctttccccacaactcccgcaccgagcgcacgtgaagagggaggaggcgggaaggccagcagcggcctgttcctcgtcgtcgtcgttctgcggcaacaccagctgccggacctcttcctctcccctccccccagcggcgcgcggcggaggaagccgcggcgccgtcctcctcctctcccgtctcaccccatcgacgcccgcgccatcccgccgcccgtcgatgcccgcgcctccccattgacgatgggggcgaggttgacggcgatgggggcgacggaggcgccactctccccagcgccaacaagtccccctcatcctcgtcctccggggcgctcgacggagacgcggcggaggccgaggcgcgccgccggctgacgagctcgctgcgggaggcactcgggctgtaccgggacatcctccgggtcacgtggctgttcgagtggcccgacgaccgtggcgattacgacggcatcgtgacggagtacgacgtggagtgcggtgtgctggtgtgggagcgcgacgagcacgaggggcggcgggtgtgggcgacggcgcggcatcgccccgtcctcttcgcgctcaccctggccaccgccgcagtcgccctacccttctcccccagggcgccggccgccgtcgcgccgccgccgccctcctctctcccgtctcgcctgccgacgtcgcgccgccgctttgcctcaccgagaaaccgcctagaaagagagaagtggaaaaggagggaagtgatgatgtggcttcctagcatgtggggcccacgtgggtcccacgctgactcagcagccacgtaggacaaaaccggggtcaaaaccacctaaggacctcgggtgaccggttttatatagttaagggacctcgtgtatctggttttgcggttcgaggacgtttttgtatcccgatgacaagttgagggacctttggtgtactttttccttaaatattatttcctccgttttacatatatatgtctagattcattaacatcaatatgaatgtgggaaatgctagaatgatttacattgtgaaacggagggagtacaagacattttaatttatgtcaaacttaacttcaatcatatctctatctttttatctctactataaaaatttaaagatgttttcacaaaaattttgatatgtcatccgtgtttgagttggtttttagtttgttatatgtcactcgtattcaattcaacatgagtctagaataactattgtacactcatatcccaacccaacccctccccctcccagcccaaaccatcccgttgccccatcctacgtgccaccactcggtgctatgcgcgtccttcctcgattggtgtcttttttttctttttagtcttcttttctcccgataattttgatcctctcctccttccaatctcctctcttctctcctcctttctctttttttcctcttttttctctcctcataaatattttccttttgaatttatcattgtttaaggtgtgcatgcggcaagccctatcccgcgcccctccactcagcatcgtgcatgcccttccccgaccggcgtattgtttgtctccttttctttctcccgataatcctaatcctctccctctccttccaatctcctcttttctcctccttttctcttttttcctcatttttctctcctcaaaaatattttccttttgaattctcattgtttaatttgttactttgcaaatatttttcatctacagtgaaaaaactttactaattgaatagtcaaaatttcaacatttgatctatgaggttgttgatgaaaaaatcaaacacactggcctgggagatctgcttagctcctgtgcaggtccaaatcttgatgagatacgagcgtgccagtcagtttgatcctgcaactgacaagatatgcaaatagtagattaaaacagtcgatcggctgacaagccgatggagtagttccagcctatagccgataatagccgatgccgatactagccgatagcgatagggtttaagcaatcagctatatgtccaatgtagataatgatataaaggcaatcggctgatgacgatgtaatgaaataacaatataatccagtataaaccaatcggcaaataatgatatgataaataaacatcgatccgaacgttaaagcatacatcggctggaggtccgatgtcatgaaatcaacaagattagattaaacaataaaacctttgttttcacaggctaaatccaacttatatatatatgcaattcttatgagccgatgcaacgtccagataactcatcggctgaaaccccgatgaaacccttattggcaatcaagaagtaggctagagattatggttctaagcatgacttagtagatcaaacttaactgatgcaacactaagtatgaaaagaaacataatatctagacaatcaagccgatgactgattttcagggtggtagatgcctaggctaatctaatctagcaaggcgatttagccgataccagcataaaccctaaagcgagaagcagctgatagagctaaattgatatgctaagactagattaacagagacatatgataaataggtaggcaaatatattatccataccagagtaatccaagaggtcgaatgtactgatgcagccttaaacgacgtcagcgtagacgatacaattggctggaccggcgaaacattggacttatcccttcgccggtgatcaaaaatgatgcagcctcgcgtcgggtgccaagttccgccagaacgtaaaaacaaaagtagaagtaaaaaggttggcgatgcgccgaattgtattgatcgtagcgattacacagaccccgggtgtacatatttatacccatgggttgataaagtccttgtcggacaagaaagaaactttcctaaatataaaaggtaaagataaagtccttataagacactaaacacactttcctaaagataaaaagaaactaacaaactattcctaattaatagataacttgccatgccgcattctttttgaactcggtctcttctggataagcttcctttagtagatcaatttccttaaccgaatatagcaagaatccgacaactgacgacttgacaactctcatcagctaatctcaggacttcgaagccgatgctgactctaagccgatgactacttcgggcttaccaaatttcactgttaacagaggtatagcaaaatacacaggcgccaacttatggaataaccacccaatcattttgtgaggctatagaaaggtgtacataaacgattcttcgtgtgatgacatgacacatgaagcgagcacaaccaggttcaatcctatatgtgatttatgactttctttttataatgttttgtttcagtttgtcatttaaatttgtaaagtttttatcaattatgaaaattgtcttcacctgttgcaactcacatgtatttttgctagtttatagaaaaatataacgacatctacaaaaataaattatatttattaaatatagctttatatatatatatattttttgaaacctaagctttaaatatattttaatactatatttgtttcatgttaaaattattattattattattttctttaaatctggttaaaattaaggaagtttgactttgaaagttccactagagagtagaacctcttgtgtgctggcacatagagcgtgtttggctaggtgcaccggggatcatcccgcgtgcagccagcaacatatttggttgtctacatggacatgtaagccaggattcgctagtgcaaaaaggcctccaagccaagctgagaggaaccgtagaaatcagtcgtacctcctcatgtaggcccgactctcatgtgggcacggagatgggcaggtacaggcgatgcacaaagagttgacacatccaatcatccccttcgctcatttgatagctgtcatcttcgtcaatgcatatcttcttcagcaactccaaccgcgcctacaagctatgtcatcagatctagcagccaagagctcgatgccaccatatatagcctttaaagagctcgagctcgcccatccaatttaactttctcgcacggaggatgtacatgaacacatgcacatgccattatgcacacataccacacgagtgtccttttttaaaaaaaaaacatacaagagatatatgcctttaaaattagatgatcacctttaaatattgtatgatgatgatgatgatgatggtttaggtaaagaatggacttagcatgcaatttacgcttttgattaatcatcgagaggttaaaaataattgaaattaaattaatatcatgtagctttatgtgatacaagtaagagtaatttatactccctaagtttcatactataagcccgctttgacttttttatagtcaaatttatttaagtttgatcaagtttatagaataatagaataatatagtagcatttccaatccaaattaaacatatcatccaaatgtattcaatgttagatttaataaaattaatttgatgttttagatgttactaaatttttatataaacttgattaaacttaaaaagaaaaaaagtcaaaacgacttataacgtgaaatagagggagtattagccaattccaaagatcagaaacgtacaaagtttaagatggtgtagctttgtgtgacaaaaaaaagaagaaaaaaatatgaattacccctccgaactatcgcggtcgtccgaactacccctgaatcatgaaaccggacattcttcacccccaactatgtaaaccggacgaattacccccatcgaatcaattcagagcggtttgatccaacgtggcacacacgtggcaatccagtcagcgtttttttaataaaaaattgtgggacccgcctgccatactcttctcttcttcctctctctcttctctctctctctctcttctctctcacggctcgcgctacgcgcacggtgaggactgcgcggggacgggcggtcggcgactgcggaggcagcgagcgcggggaggcgagcggcgggggtagggcagtggtggaggcaagcggcagcgggagctcgtgctgctcgcacaggaagcgaagtggcggctgctgacgaagccaacggctgccaggtgccgcggaagacgcagcggcagcgtcgaggcgaggcggccgccgacaccatgcgcgacaaccagccccagcccgcagccgcaccttcctccgcttagtcgcgggcgctgccttctttttcaaatggtggttcaaatcatcatccaaactcaaaccaaatttgtttacaaacagcgacatttcatcgctcctcctacacggcgttcttccacttgccgaccaccaccatgagcgcgcggcgcgatgccccttccggcaaccacgccgcctcctgcagcaccctcgcccagcgacgcgcggcgctccccttctcccctggatccatgagctccttcaccgccgccgcgacctcctctcgtgtcaccaccccgtcgccgtcgccgggcgtagcgcaaccccgaccacctccgttaggatgaccgcgttcaccttctgctccacgtacagtggcaccaccatcggcatgccggcggcacgctctccagcgccgagttccacccgtagtgcgacacgaacgccaccatcgccgggtgtgacagcacgcgcacctgcggcgcccatgacgcgacggcgaggccccggcccctcgtcctctccaagaacccatcgggaaggcacgccagtgggtcgtcgtcgttgcggtggtccgttccgaagtcgtaggagtaggactcgccgtcgtggctcggcatgcgcacgacccagaggaacctgtggccgctcatctccagcccggcggcgagctcgcgggtctgctcaacggacaggatgccgccgctcccgaaggagacgaacaccaccgaccctgccggctggcgatccagccactccaagcacgccgactcaccggccttgtcggagcttgaccggacgaacggacccaccgggtaaaccggcgggaacgcgccttgcttcgccgccttcttgaattcttcgacgatggtgtgctccatctcggcgaagctgttcaccaagaatccatccgctcgccggtatcgccgtacctcttcgaggatctaccaaaacacggggttggacctatcgaggtatccgtccggcatgtcggcgacgcggatcgtcatgtccccagcgagacggagggggtccggcaggtctagcttcgtcgcgggcgctgcctccgccgccgcactcgcctcctccgcagaaaagagggaataggccggtggcggtagagaggaaagaggtgaccggcaagctcggtcgagctccgccgcctcgagggcctctcaacgggaggaggaagagggggaccgggaagccgccgacgaaagatggggaaggggagaggcgcgccggtcggcgtcgccaccggtgggtctgccgcaaaggaggcacgccgatgtcgtgctcaacctcctctccctctctcccgccgccgctctgctccactctaccggcggccgcgcgcttgcccacttgctacggtcgctcaccaccgcccgctccactccgcctgccacgcgcttgcccgttgcccctcgccgcgggcactttgctccacttcaccggccgtcgccgccgttgcctcctccgccgcgctcgctgcctccgccgtcgccgaccgcccgtccccgcaccgtcctcgccgtgcacgcagcgcgagccgagagagagaggagagagggggggaagaagagaagagtatggcaggcgggtcccacaattttttattaaagaaacgctgactggattgccacgtgtgcgccacgttggacaaaaccgctctgaattggttcgagggggtaattcatccggtttgcatagttaggggtaaagaatgtccggttttgtggttcaggggtgtaattcggacgactgcgatagttggaggggtaattcgtactttttcaaaaaaaaaagacaagctagattggattaatcatctaaaggccacaaacaactaacattgggtcttcatgagagaagggatggatgacaataactctacttggtggggttgacattatcaaattactatattatcaaattactattgagagtatataaaccatgacagttggaatcgtaataattggctgtagctcgtttgagtaaaggctgggatattatattccatcttttagatacttaattaagctttgagaatttctcaaaatctaagtaagcagtgacgttttttctcctttccaatccatgattttaattcagtgagaatcgctaaactgagggcatgcgtttggctcctggttgactttataatcctagccaaattttaaaattagaattaatttatatagtttccccccctttttcagtagccaaatttaaaaattagaatctactccctctattctataatataaggcacaaccacttttcttagatgttctaaatataaggcatgcatacaagcatataattaattatggcatcttctctatttaattattactttttaaaatcctccactctcatgttatctaatcctattggatgcatgcattatatttattagaatgatccaaactacaagatgataataattatttcttggtatttgggttaagagtggttgtgacttatattttggaatggagggagtaattagttttagaactaattaggattttttttccctgttttcagtcctatatgtactgtgcatctcccgtttaggaaaaatgggggtttcgatggtcatgtaggaaatctccgttcaggtgttcagagttcagacgtttgttgacggacaagcggacgtcgatctgggccgtcaacagccagatggacgtccagaactcctcaaggccgtaccctgtgacgtaggcggtgactaagcgggaccttagcttccccaacgcgtgcggcaccgccgtcctgtagcccaccgtgcggaaccaaacaaatcaatccagcatataagctgttatacaaagcttcccaaacacagccaaggccacatcgagcagcgtcgtacaaaccaaagcccctctagactaacaagttaaaaatacagtttgtcaacggtgcaaacaatggcttcacatcgatgagaccaattggcatatgctaataatacatagcagaaataaatttaaacttcaaatccacaagaaaaaaattgcatctctcttacgaggagtatatatatatatatatatatatatatatatatatatatatatatatatatatatatatataattgttgcatatacatgcattagaaaatgtactcatccgtgtgtgtataaatatgggctgtgcaggcgccagaggaagacgcccaagctaatcagctaattaacccgatcacatctagctagctaactaagagtaattaggggctaattagtttcaaagtgaagtgaggcgatatggagggagagaagaagagcgtggtgctgatcaactgcgcggtgagcatgtacggcaaccgcgtccgcatcgcgctggcgaggaagggcgtggcgtacgaggagaagccggagaacctcgccgccaagagcgccctgctcctctcctccaaccccgtccacggccaggtccccgtcctcctcgtcggcggcaagccggtgtgcgagtccctcgtcatcctcgagttcatcgacgaggagttcgccggcgtcggcgagccgctgctgcccgcggggccctacgagcgcgcccaggccaggttctgggcgtcctacatcgacgccaagctggcgccgtgcgccgggagggtgtggcggtcgccggcgggcgccgcgggcgcggcggcggtggaggcggcgaggggcgagctggtggcggcgatgcggacgcttgaggcggagctcggcgggaggaggtacttcggcggcggcggcgaggcgctgggctacgtggacgtggcgctggcgccgttcacggcgtggttcgcgacgtacgagcggttcggcgggttcagcgtggcggcggagtgcccggagctggcggcgtgggcggcacggtgcgtccgggagaacgcgtgcgtggcggcgtcgctgccggatcccgagttcgtgtaccagttcgcatgcggcatgaggaagcacttcggcctcgacggctgagatcaaaatgagctcgccggcgccgcgattggccggccggtgcaaataagcgaaaccatcgcgcgtgcatgcatgcctgcatgggaaactatcatttccccgttttcgcggcaaggtctttggctatttttgtgtgcttcgcttgcgtgtgtactccctccgtctcaaaaactaataaatgaatcgaatatcacatagtataacgaatctgactatagatttgttatacatgttctagttaatcttagattggttttgtgggacggagagtacatgcgtgtgttttttttcgcaatagctttttatgtgccttttaatttgcttggcgattcgacattgacatatcgatgtgtgtgtttcttttgtggtggtgtgtgggcgtggcgatcgactgcaattcctgagttttgtcctaggtgaaatgttgtctgcttgcgtggatgctgtttttggagtttaaagtgctctgaatatgctgtaatgtacttctgtatgtgtgctgtattcagaggtggggaaaaaatatcgtgctatgtatgtcgttgttttcctttcacagaataaaagtggagtacacaagttgttacgttattgctaccgactattcatgcgtagtactcccaattattgatagcaaacaaaagtaccaaacaacggccaaagtatagtattgttgcattgtcaatatgttactgaattcagatcagcttggcagttagcacttttttttttttgggttgctggcattgtagctgtaacctgtaggggaaaaaaattctctggggcagggccgcagctcccacaccatgaggccccactgtagatgttagccacgtggatgagcacgaatcttggaacagtttcatcttctttctcttctccccccatctcccgtatttccgacctcctcccgggtcccggcggcgtccacgcaatcagcagttcagcacggcaacatcattaatcttaaaagatagaagtaaaatctattacttgcatatttcttcaccgtgatgatcgatttccattgctagctgctttgctgcttccctcccttcccatttctctattgcacggaatctcactagccatggctaatcaaggcaggacttttctcaacgttcatatttgatgtatgcatttttgaggaaggaggctaggagcagcacagaagatgcatcccaggtcgcacgtctccaggcccgtagatcgatctgatcacgcaccggcagggcggtagtccggaaccacaacgcgatcctaaaatcccagcaaccctagtgtaggttagtggcggcgatgcctacaaattcctgtgacgagatgggaggggcagagaaaggtgagcgaccgacagaagcaactcggcgaccgtggcggaaagtagcatcgacgccgccgggaggaggtcgggaatacgggagatggggggagaagaagaaagaagatgaaactgttccaagattcgtgctcatccacgtggctaacatctacagtggggcctcatggggtgggagctgcggccctgccccagagaatttttttccgcctgtaggtccttcgattcggaaggtagcaaatcaaatcactgacgggtgaccgcctaagtactactctatttggcccacacaaacaaggcccaaacaagagcacatacggcctgttggaagtggattttgatccattgagggaaggaataagttttatttgatccacctatttgtcccccaggactactttcatcccattatcacaaaaccggatacaaattatccctgatcttactaaaccgagcagaaaaagtccctcactattgctgatcccggattttatattacgtggcgcctacccacatctcttttaattaggtttaacaccatatgggcttgacctaacgcttacatgccatatgataccttgccaataatgcatacacttaggacacacatttacggtttcacataatattatttgaatgggtgcgaccctatgcggagccacagttcgtccacatactcagccattcgacttgttgtttttcatatacaccgtatacaacaagtatgccagtacaaacaggttgcattccacatggactcttgttggaacctgatccaacaggtgaaatatgctggataaatagttacgtttacaggactctgcatatcctgagaactaaacggagaaggtttactaacactacataattttcacggaattcatgcgatggtaataaggtgacaggaaagtgctggactattctatggag

SEQ ID NO: 60270 - DNA, 28343 bp, Oryza sativa
  unsure (1)..(28343): unsure at all n locations
gttccatcatgaatgatgggacaccctgtatccctcatctagttagcagctggcttgaccgaatggaatgtgtctaggtcgccggcccggtgcatgcatgcccacgaagttgcctttcattcaatgccgaatgacgggagatgtccccggtgtcagctagagagacttgatgggaaccacacggcagctggcgtgcgggtcgcttccggaccagggcacaagacgcgtattaaatgtagacaatatttgctctctcccctagggaggtctaacggcatgtgtggtatccccttggaccataaaaggaggaccatacctagcaggagaggggttggatggctagatccatgagccaaagcttgtctaaccctagcttgtacaccagggattcaggggctttctaagctcaggaaaatcatcatgcacacaggagtagggtattacgcttcatagcggtccgaacctgtataatcatctttgtctcactttcgcaagtagccaagctcctctagagttaaccgcttccccggccgaactcacaaaggggggcctcacaatcccccgctggagggaatcactcttcgacaatattgataatgaccaagccttgtcgagaaagccgaaacaaagtttgaaagaaagggaaaacaaacacacacacttgacaatatcataatgtttgcacctctagattactagcacgccaatttttggcattcactaacaacaatgtggcacaaatttcactaacctgatagttttcttacctatatatagttgactaaacaaccagcaagatcatttctataacatcgatgccatcatattaatcttagtgatccagccacaatatgtttgagtgtaggggcaaaaagggatcacatatgaccattgttggaaaggaagaaaatataatgcttgtgtcatatgactatgttgtagaagacttctctgagagtgtttaccccttcctctggaggtaaatcgagctggtataccttgttttttttagcacaccctctactttgacttttgagtagccctatggtatcggattgcaatgtatgcatccccttctattacgggatgtgccatgccacatgccaccttcaagtgatggtttgtaggggcacatgccacatgtacagagttcgtatagtgatgtcatccacgacataatacaccatgtctgattcttgagtgatgtgtctaagtgtccggtcttcctataggtttgatttggcaacgtgatactttcacagtttgaggtttctgatcagagatcatcaccttgcaactgctacacccacacatctagttgttataaaccatgctcgtggtcgacctcaccatgaaggttttatccatgcaagtaatcgaagaaattcacaagaacaagaaagaacatgatccgaattgtaggtgaatgattagcactcaaagttggggtttcacaaatcggacttgttaacggagaaaccgtggcatatggcgatagactaatataagcaaaacccaactctaaacaatgatggctactgaatatatataagttgggatgttctagggttaacctaagggcgaacaccccttaggcctagcccacgatacaattacaaggcctaaggcccacaacagactcggatttgatgagatacatagctggtttggattattccaaacaactcataaggaattttgacatgagatcaaaaacatatgaaggtatactccaaaagctaacaaacacgcactcatgggatccgagagtccttctaggttagttctaggcctatttgaagttgatgcttttacgaggcccgaacatgaatctaaatcatttagaattttatctcttcgtttttttgacccaaaagtgacgtggtcgcatggaagtagactgaaggactttatatggttcccaatcaacttgatcatctgttgtctccttatgcttgcttgtctttgccttatccacgcaaagcaaacctttgttaaaatataaaacaagtaaatcttatatagaaatgttgcacctttgctttattgatgtgtaatatatgcatggttgtatccaagccaataatgtcctcatcattaagggacatcaattgacacaaagctgcttcgcctcctgcatgatgcatttatatgtggtgatttattagttgaattggtacagatgacttggcgggattattggtgccagcaatttcttaattcaggtgggtagaaacacctcatatgtgctggtcttaagtgaaccggcacatatgaggatttacctatggggtgttctgtagtattggatctgacaagtctatcaaattctttggtagaatgtttagtggatgatccgaatttatatactccatacaacatccgctgatgaatccaatagcccaacccatcagctaacctagactcgttgttaatatgttctcacatcacgtatcagtcgcatgtctgcctccacattccgattcaagcacatagtgggtgatgcatcgatgcttgttgcttcacatggtgtcggctcaccatatgccattgccccttcttttgttcaacatatatgccaccatatgttcaacatctataggccgtcacgacttgatgtgaggatgttgtattgttagctttgctaacttttgcattgttgagttgatgttatattgagtgcatatacaaataacatccaacaattttaataatgtttcgagcagagtcgactctgcaccatttttacatatgtaaacaattcactcaacatctgcacactatcaacactcgctcccacttgcatacttcatagaaaaagcgatggaaaaagtgtaagtgaggtgttgtgtaaacttgggctatttccagagaagtgtacatacattttctacaacattgatgacatcgtataaatataagtgttcctaccacaacatgtacaagtgaaccattttatacaaagcgagggaaaaaatgtaagtaggtgcatacgttggcttgttctatagaagagttgtgctaatgcggattttggaattgtgggtgttgcactatttatgttaaccttctctgaccatattcactagatcctgtatctcctgcagtcttatttcctctgtatttaagtaggataacatagttattcttttccaaaattatttataaccttgcaaatccttgtgcctactgaatatgtaccttgtgtattaaatgtatttaagtaggataacatagttattcttggactagtagcgatacttttgtttatacaaaaaaggaagtttctcacttagttagttgaatatttcctatggttttattggagatgctacaaattttttatcataatttgttaaatttcttaatattcatttgtttgggatgatgtgttgatttaactgtttatatgcttttctttgatgagaaagaatcaataaaaaatgcatctatatactatataaaatatgtatggaccttgttctttttaagtcctttataaaaacaatgttgatttattttactaaaggctctggacaaaatttcttcatgacaggtgtatgatggttgtcaaagctgggaaacatcttttattgttcaagcttattgttcaacagaccttgttaatgagtttagtcaaacactcataaaagcacatgagttcataaaaatgtcacaggttatgtgttcttctctacttttgattcttgtacaatgcaaaatgaaacaatattttcaaagttgattttgatgtccttttttttcaattttaggtccttgaaaacactccagacaatgaagcttattaccgccatagatcaaaaggttcgtggacactatcaacagcagataatggatggtgtgtatctgattgtactgctgaagcacttaaggtaaatgtatattagttgttacattatttttctttagaaatttgagaaactttatttcctaatgaaaaatagaatatataatggaagtaaaactctttgattttttggtaaaaaaatatagttgtgccattctaattgcttcggggaaatattgattttgttatcttatgcctctagaagtgttgtacagatcaaaacaccaccctacgttcaaatagttaggtggctttgttttgtgttaattggatgactgagcggtctaaacgagccagttactaagaccaggccttcatagatgggcgagataggttagcaaaacatatagatcactggtttacaaacaagcccttctagattaacccttttacacaaagaaaattttgtgcatttatgggcttgccgcattgatgggttgccttgcgcattaagcataagttagaagttgcggaattacatcctacttgatgtaaaggtccaattctgcataataattggaggcgatagaattgttgctactgcaatgtcaagtgaatatgttttaactatcatagatgagtttaaagaaaagggaacatctactacctccatccaaaaatatagcaacttctagctatgaatctaggaacacagttgtccagactcatagctagaaatgcttttattttggaacagagggagtaggtgttacagtaatatctctgaaactatcaaaataccaataaatgtgaattaaagaaagagatacatataggcaaaactcatatgcatagtaaaatgttcatggtgttgaatatcgatgccttcaaatttatatattgaatatgttatcacattgtagcaaaaaagtctattggtgtacttgcacaactgcaatgatgatacattatatttgttgaattgctaaactgtacaaacttttacagttcatcatttgttgattccaatatatgtacatgttacattttttttcctgctaatgcttgcttttttattctttaggccttacttatgctatcaaagatctctccagatctcgcaggagatgccataaatggagaaaggttgtatgatgcagtggatggcatgctctctttcatggtataacttgtacttgaattgttcgccatgttcatatatctagttttctgaatttatcctcccatctttgtcattgtttcccaaattcggacgaataagggaataatttgagcaaagaatactttagggacaatcttgtgtgggccattttatatcatatatggacatttagatattttagtactagcatataagctcacctattccgacaacaactctaagactaaacatttcacaacacattaagtgtaagcgacgggctatgtgtatgtgggcctacagctacggaaagggttgagttgatgcagattttgaagcaatgtttttctcatgtgttattagtgtaaattttattacatggatgattgtggttatggaccttttgaccatgggtttgtggtgcggtctgggacaagaacatccacccttaattaatagagtaggtgaatgcaatacacttgctcattagtggaggtatttgtgcttcaccggcatataaacccatgtgttgtcaccacaccacatgcaagtatacacatatgtgagctagaacctaccaatttttttgggttattgcaaattttggaagctgggaagttaggaaagtcattcaaaatatgttcaaaatattgatgtgtaactttgaccctatggttgttagggcccagtctatacaatacatgagtcatattttcttgtacttgctttgctgaaacattcctttatgcggggccaatattactgggacaagtgtaaaaaaaattgctcatatcttccttcatgcatttcgtaaaacatgagaaaatatatcctatgccattgactatgtcatgttctattttataccatcaaattttccatatattatatgctatccccataagtgacaacgaaaaaagttgttattaatgcatcagaaaagaccatatcgcccttcgtttgcagtgttaatcctcgcaaatcaaatttcatcttaagaaatagttccaggagcgatggtggtacactagtttcattaatccataagaaaagacttggtatcattgagttcaactgtcctcatagtatcattctttccccatgtaaaatgatacttttatatttttgccacgatttttccaacactcactcaggtttaattaatcaggtctttcctctgggctaaatcaacccctttagtggacgctaaacggggatggtataaaatagaagttaagggaaaacttgatgctatgatgtagaaccgtaacaaagtcgatggtgtatgatagatttctctatcaacattattagggaaaaattggtgttgtttgcagcagcaacatgaatatgatgttgcttacttctgcatatcggtcatatattgttgtaacttgtcaagtaattttagcccgggtaactaaggttaataataatcttagctacaaaagtgtttctcaactttctcatctcgaatttatgatctttgagcaaagtttaagtggcaaacaggagtaccacaatcactcatgcaaatatttgttaggtttaaattattatgcattttggtttctttgctaatgattttctaaattttgtacatttctgtcctctactaaaacagtgcaattcaagtggataacatttcatgccattgttttgatccctattttgtttcattgaagaataaagatggcaccttttcaacatatgagtgcgagagaactacacattggttagaggtaagtactatatagtcctacttcggttttaggtaattaaagtgataaaccaagtgcatccatcatatttaaatcacgtaaaaatgctcatataagactaagaagaatgaaaacccataagcaaacataaaacttcagctccatattacaaatgaaattataaaaaaatgatagggtttagaggtacttcttttcatccattcaaatttatttttgaggtaaaatggtctaattacaacataatagtacttcctagaccatttatgaaaacaataacttagtttcactcactacaataatagcttagaagcaataaatgggtctagttgttgcaaatggtatactccataaaaaagcattaactctgtggatgcaaactcttcttttgtaagggcaaaatatattttcattataaggatttacattctattgctttgccacacatccacctcatctaaattactacctccatttcatattataagtcgctttgacctttttcctaggcaaactttgttaggtttgaccaaggttattatcaaaatatatccaatattaaatttaatgatacgtatttggtgtcacaaatgttgctaaaattttctataaacctggtcaaacccaaagcagttagactaggaaaaaggttacaacgacttaagtgttatatctattgagaattgtccaaatgttatatacttgttttactgatgttatacttaagtgtacactagtctattttttaagagagaaatgtaagaatgctcttgattttcttttcataggttctcaacccgtctaaaacttttctgaacattattgttgattatccgtaagtgtgctctcttgtttgaagaaaataccattggtttcacctcacaacatgtgtagagagctaactcaactgccttgaatgaattaatagatctgttgaatgcacatcatcggtacttcaagctctaatcatgtttagtgagtgctatccagtgtaccgcaaagaagagattggaaaatgtattaaaaatgcttccaagtttattgagaacaaacaaaggaaggatggatcatggtttgttgttcttatttgttgctacatattattatttttttatgtttacaatcaaccgtttgattactttttaactatgtcacaggtttggtacttggggtatatgtttcacttatggaacattctttgccataaaaggattagttgctgctggaagaacatatgaaaatagctcttccattaaaaaagcatgcaactttattttgtcaaaacaacttagtacaggtggatggggagagacatacctttcaagtgaaaccgaggtaattcttaccattcattttcacataattgacatagttacctcaaaagttgtgaccaaatatatttttgcaacacatatataatgtttagttccgcatttttccttacatttaacaaatatatccatcgaatctaaaacaactaagaaaatgaagcagacctatataaatttcatttagttaagtgctaggtctggcaacataaaaatatctaacaccccactcatcagcctgcatgcatatgtaattgtagcaaacaaatgtaacaagggtgtcacgcccggaatttctatccaaaattccaaacgcttacatgtgtgtgaaccctcgtccaggaatcagccgaggcacacaataacaaattgataatagagtacaaatattactctaatcaataggcgaataaaatgtcattacagaggtagatagttcctctcaatcaataaagatctaagcagcggaaaataagataaacggcgcagacggctccacttcacaggcagcttgaccaaggctacacctaatcctccacaccttcggcaacattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttagtaaaacagttaagtaattaaacaatattaatccaacgctatacaacataccctgttgtataggcccaaccattttgaacaaccatcccggctgtacagttctatctccaaaccaggaatataccattccaaaccaggagctaatcaaattattaccaattatagcatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttatagacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcatgaactatcatttagcagggctaagcaattatacctaatatctagctgaaccaatatatataaagctcaactagtcaagttttaataacccaaggtatcaaggaataaagtaatcaagaacaaaagggctataacaaagaataggttaattccacccaatgacattcgaaaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaaacaccaaaacagcacataaacaagcatgaacagtacatgtggatatttttaacatgtagatctcaattttagaaaaatttagagacttgaaccaactaaaacggagctaagatgaattagttatgaatttttgaagattaaatcggattaaaacacttatattgattttaattgaattatgacgcaataatgaattatttttgaaaaggaaaaagggaattattgcgtcagcggctagggtttcgcggtggaccgggcgcacggcggcggttcacgcgaacggacggccgaaatcgatccatccaaaacggacggccgagatcgatcgggtccacggcggctcacgacgaacgaccacgatgacgtcggcgatgacgtcacctaccggcggcggtggctcggcggttcgtacgcgcaagcccgccggtgaacggcggcgcttcggcacgaacggaggacaccaacgggtagcggacggcacggcgaactcaccggcgaccaaagcgacggcggaagatcaacggacggcgacggcgacgaagaaagaacggcggcggtcttcgggtcgatggcggcgacggtgctccggcggtctccggcggcggcgaaggggtggacgaggacggcgacaacttggcgatcacgacggtggccttcccgagggacgacgacgaccgagacggcggcggcgcacggctggagcgacggcggcgacggcggagctagggcacacggcgctagggcgtttccgacgacgagaggcgaaggcgagggtggcggcgggtagaggagacaccggggatccttttaaaggggctaggaggcaacggcgaaggcccacggcggccggcgacgagaaggaaagttcgggaaaaacgaatccgaaacaaactcgaatccacgaatttccaaacgattttagccggtgtttccaaaggagaaaaggtagaggagatcccgaagatcatttcccctctattgattcggccggagaaggaaaggatcggccgaattggaaagcggcggcggcggcacggcgctagggtttcggccggaggaagacgatgatcccgacaggtgggacccacctgtcagcgacagcgcgctcgcgcgggcggctgcggctgcggactgggccggctgggccgaggagagagagaggggttttgggccgactttcggcccaaagccaaaagagactttttaaaacctttttcaatttaaattatttcttaaatgcaattccatttattaaaaatacttcctcaactcaaataaatcccagaaaaatctaggaattatagaattaagcaaagtatttaatgaaattttatctggccccattttatattggaatttattaattaaaattagatcttctcttctaggcttttacaataaattctaaaaattcgatttaaacaacaatttatatattttgaattttcagggtgtgacaaagggccaaatggtcacattgattgagcaatataattgtctttgttctgtgccctggccatagctgttaactagttaaagtacaaaacctatgtatgtttgcaggtcttgagaaatgcacttgatttttttcgtcaatccctgtcacgcccgaaaattacctttcccgaatgctagtgtattaatccttgtcccagaaaaagccggggtataccgcaagaaacatgatagaaaagacacatctttaataattatcatgatagtatttacactattttaaacgcacattaagcctaacaacgaaagataaacaacagcggacaagcgggcctacgactccatattcacagacgctcaactagggtttgatcctatactccacctaacacttcttctgcaaagcttctttaactggagtgggaaagattaaacaagaaagagtacaactactatactcagcaagccacaccggaatatgcacataatacaagggggtactaggagtaatctattaggggttaagttttttgtaaaaccatctttcaaatagttaaagtataatgcacatttcaaagcacgatactaatctagtcaaaatattaatcaagccgcacacctgtaggaacttgccttaacccagcccatcaggtcatagttccaagcaatccagtttaacagagtaaaatatctaacctggatatattgctaagcttgctagtaatgggcacacggagagagggcagagaggataaggatgacggaagagaggagatcggcttggcgtataggtggctcggtgtttttttccacatatgtgttggtttaattaaaaaccgagacgaatggtaattttataggattcaacatgcttagattatgatatgactttccatgctcaacgatacggattgccaagacttctatgacggatttgaactgcacaacagaaacatttgaaactactgcacctacatgaacaagaaaacaagctacaactgaatataaagacaacatttaagttataacataaattgagcaacttaaacgggccaatttggagctcgtatggctgagaaactacaatccaaaattatatgcaattcaagtgaatatttctgaactacttaattatgattataccattaaattatgtccaatgcatcagcgctcgaggaaaggaaggatcaagcgaccagtagccaagtcccatgggtcaaatggctagttcatcatacacataaatattcactgagacggtccactaaaaaagcagagtgagacccatgtgtaagcctcagagaagagaccaacaagtggatcccatgggacaccaaacaagaggccacatgcacaaacacgcggctatgcgcaggagggatgcactgaccggtgccggtggcccatgacagaggtcaacgatgcacagaagcatggcaaaaggcgagggcaatgggagggagatattggaaaatagatcctcgccacgaaaatgaagatgaccgaatagtgaggaggggactggcggtgtggtcttgaaggcgatgaactcggggcagcgacgatgcttcagcttgacagcgatgatgtagcttcggtgatcttctcgcttgctaaagaggcagacagtggagggcttggcattgcagacttcatgacgacaatgacagacgaggacgtcaacagttggcgcttcgacaaagcgggagagatggtcatggaagcttcgagttgacgactcacgtcgctcctatgggcttcgggtcatgaggaggtcaggctgggaactagctcgacaaggagaaccgaacgcaacgacggtgtagcgagatgatgcatatagttgtagagttcattgacgagtacaacccagcataatcgaaatcgtttgtgtgcttcagaagagagtcggggaggtccaaagtgcaacaagggtgagattaccctgtcaaaagtgaaaacatcggttaaagggtggtacaaaatgaaacatcagtaataaaatgtggcccaaagtaaaatttactctaaatttccatatgtgctagttggtcctaaataatcggtgaatcaataatcaaccaaacctgatctaaacaaaaagtaacataatgcacacaatgccttgaaattgatgtattggtcattctctctcagtcatgcattcacagccatggatgtcctagtcaacacgactttgtatttgcatgcagacacacacaagtcacacaacataggtactagcatatgaacataagtcttgataatgttagattacattcttttattgaacaagtttatgttggggctagtagatctcatgttgtgaacactgcttgggcaatgttagctttaatatatgctggttaggtgtgttttgttcattattcattttagtaggtactaattgtctattatattatttattgtactacaatgttatttcataatgcctcaatgaaaatcaggttgaaagagatccatcgccactatatcatgcagcaaaagaattgattaatatgcaactagaaacgggcgagtttccacaacaagtgagtattcaattgattaaatgattttctattttctttagcacaaacatgttcagtatatggattttctatttcttgtaacacaaacatacatagtcaataatgaattaatatactaactgcacataaatattatttttggattgctcatcacttcattttatttggattgttgttttggtatccacaagaatgaaatgggaaaaaatagaatcatcaagttatgtagtttgtggcctggcatttatggcatgcatgaatactctaccatccactcttgatagataatagtagtctaatattccaactttaattacaggaacacgttggatgcttcaacagctccatttatttcaattacagcaattatcgcaatttattccccatttgggctcttggggagtttcgtcgtcgattggttctacgaaagaactgagcctcataaaatgacataattatttgatgccgaacaaaagtttgaactatttaaatatgcaaatgttttaagtgtaaaaatatcatatacaaaaaataaattgctatctgatgtagcaaaactactgtggagattatggataccccatacccacacggcatgtatatccgactaggtataagggtaccatatttacatagaatatctttaaaggacttgggataaattcgtaacttgtgtatcaaggaaatatccgagatcctagtcggttacaattgtattttatctttacttgcctattccgttaggaatatgggttgtatcttgtaatacggacacctccccatatataaggaggggtccgagtgcctcttggggtataacttttcctctagatcatacgatcaataacacactcggcggatcaatccccggacaggagtaggatattacttatcattgagagggcctgaacctctctgatcccaagattaccaccagccaagcctctctgcacggcacaagccaagccttagcgttgctgcctcgggatccaatcgcaggagcagggatcatgcaaaatgctctgttcactcgccagctaatgaacatagagatcgccgcgctgagcagcctcactctccgcgtcgccggcaacccatcgatcttcgtgatacactcaatcaacgccatgcagaaagaggccaccaaccacactgttcaccaaatcgacatcacgacgacgaagttggcgttgtagcttttacaagcgacctgcgtcgagtggattggctggctagcttcaagccgactggtatcgagaagtatgacggcaaaaccaatcccgagtcatggcttgtcatgcccagaaattcactcgtaatttctgaacttatcacgcccagaaatttactagtaattactaaacttttttgtgcgtaaaatcctcgtccaggaatcagccgaggtacacaaactgacaatttaatatacatattcatcaaaataactaaagcatctaatacttactgaagaggtacttagtcctcacaacgaagaaaactgtagcggaaaaataaaatctagcaaagctccggctccactcccacaggcaactcaactggggtataagccaaacgtcttctccttctggatcatttttcttcaactgaggttgcttgattattgcaaggtgagcatatgacatactcaacaagccacactgcaaatatgcaagtgtacaggataacaaaggatggcataatatagnnnnnnnnnnnnnnnnnnnnnnnnnnnnnnatttaagaacaataaaaaagtagaataatcatcaattctaatcaacactgaacagcacacccatactgctcaggcccaaccatcctgaacaaccatacccggctgtacagatctaactccaaaccaggagctaattattgtgagaggtgtgagactaatcacgaaaaacattgctcaacctgcctatgaccgtgggcacggctattcaaatagttttactctggccagaggtgtaccactgtacccacaagacacagccccaaaacatgtcaccatgctctcagtaccaccacggtacctcgaaacgggattgtgacagtacccctcgtacaacacaactcaccacagtgcgccattcctggatcataatcaccccctcaataaccagaggcatggactccccaacgacccccatggacttctcgccgcttctcagtctggcaccctgtaatgaaccatactatacgaaaggtaaagccattgcccacgctagcttgtggttggcacggttaatgtttctcaacagtaacattgcagtcatgagcacgtccatcaaaaccatgtgctcacaacccaccattaatcaaattttaattatcaattgattatcataacacgattaaccatcgtgagctaccattaaatataatcataagtaataatatagtatgattcatcttattaatgagctaatgtttctaagcatggctaagcaattatatatatatatatatatatatatatatatatatatatatatatatatatatatatatatatatatatatatatatatgatttagctgaaccaaaccaatatataaggttcaagctaatcaatttattacccgaggtatcaaggaatagggcattcaatgcaaattgaccataacaaaggaataggttcacaccacccggtgacattcgaaaataaatacacagttgaaataaatagagaatttgaatataggatcaacatgctcaaaggattgtgtttgggatctccttgcaataatcggtcttcaattagtcttctgaacaacttccgacgcactcacgatccttcgcaatgacagaaacgacaagctaacacgccaaaccgagaaaaagactaataaaaacaaaatatacagcacataaaaataaacaaacatggagatcatgattttagatgaattagagacttgaatggcctcatgtgaattagttatgaattttacaagattaaactgattttagccttatacagaaaaggattcacgatttattttagaaaagaaaagggctttatgacatcattgatgacgtcatcaccggcgggaggctcgggttccaacgtttgccggcaacctagggcacgacgtcgcgaaccgaaggcaccggaagaaagagcacgacgaggagaactcactgaggggcggcacgacgacgaccgacgacgggagacagccggcgacgaactccgaagggcggtgaggtactggtcgacgatgacagcggcgttccggcaatctttagcggaggaaaaccagtggacgggcttcaccttggctctgcgatgccgaagaaagcgacgacgacgtccagaaaccacggagtcgacggcgaggctcggccggaggtggagtagatcggattcacgccgtcgaggggcttccagcgggttacggcgaaaaggaactagtggccgggcttcttctcctccttgcgaacccggtggtgatgacggcgaccggaggcgacggctacaccggatgctagggacggctggagcggctgccggcggcggagagagaaggcggctgcggggagagacggctagggaacgggagctcgagctaggggttggaaacgaaagaggaggtcttgggggttctatttatagccaaagctggaggagatcggctcggacccgagaggatttggcggcggattggttaaggttcgccggttcggggataaggtttatccgaccgatttgaactcgaatcaaagggataaaatccgattccttagaagaaacggaagagaagaaaaagggaaacaaatcccctcaactaattctggaaaagatcgaaaggggaggccggatttggagggaaaagcggcggctgcacaggcacaggacggctgggtcgggctctgtctggagctggaagatgatactgtagcgcgggggaagcaaaacagattttttgctgggctaaaaacaaaagaagggagggataagaaatagacttccccggaagacaaagagacaggaagcaggcaaagaggaagaataggccgaggataaataaatagacttttccagtttcagcccaaaaaggaaaagggaatttaatttactttttcaaataaattaaccaccgaaatgatctttgaattgttaaaaatacttccatttcccgaataatttcaagaaaaatcatgaaaccaattggacactcaaaatacttaacaagattataatcagaccatttaatgactaatttaatatgtgaataattactgaaatgttctttgtatgattaaaattaagaattgagctccgaaaaatccgagaaaatttcagagagtataattaatcatggagaatttaataaaacataaatcctatatttagaaaattttatttcccacatttagcttcacttgtaaattaatgaacattcaatataaattctaataataatttattaaataatttataaatccttagacgaaaatcaggatgtgacacggcttaccgtctacggcctcgcaatccgcgcagcaggaggagacagtaaagctatggcaaattatttgccggcggcccttgctaactctgcccgatcctggctccatgggttaaccagtggtacaattggatcttgggcagagctccgtgagcacttcatcgccaattttcaaggcactttcgaacgtccgggcacctacttcaacctctacaatgcgatccagaagctcggtgaatcccttcgggactacatccggtttttttctgagcaacacaacaagatttcaaacatcaccgatgacgtcatcatagctacattcaccaagggtgtttgtcataagctcttggttggcaaatttggacgcaaacctcccaggacagttaagcaaatgtttgaaaaagccaacgagtatgccaagtctgatgatgccgtcaacgcctctaagcagtcgagcatcaattggaagtccaagaaagatacgccagccgtcagggggaatggaagtaacaacaataaggatctcaagcgtaagcttgaagaccttgtggcacttgcatcaccatcttcccgacagcgttcgcgtatcaacacttttgacaaggtcatgaacgcccaatgttcacatcatccaaattccaaccatgcagccaaagattgtttcatctacaagtagtttgtggagcaatacaccaagcaagcaaagaagccgacagatcgggagcaaagaacctcaaagaagaaggatgacgaagacgatggtccgactggttttcaagattctcgcaaagagctcaatcctatcttcggtgggccgcaagcttacgagtccaagcggaaacaaaagctgactgatagggagatcaacgtcgtccagcccgacacgccacaataccttcgctgatcagaaacaacaatcaagtttgaccgctcggatcatcctgaccgagtggtccacctggggcggtatcccctggtactagacctggtggttcgcaatgtcaagctccgacgatcactaatcgacggtggcagtgcactcaatatcctttttgacaaaactctggacgatatgtagatcccgcgcactaagctgaagccgagtagcgctcccttccatggaatcatcccagggctgtcttctactccactcggccagatcaccttgcctatcaccttcggcactcgggagaactttcgcacagagaatatttgctttgaggttgctgactttgaaacggcataccatgccatactcggacgcccggcgttagccaaattcatggcagtcccacattacacctacatgatgatgaagatgccacgacctcgaggagtcatatctttgcggagcgacatcaagcaagccgtcacctacgataaggaaagctgtgagatggcccagacccgtgagattgcacttgctcggaatgagatccgactggctgcatcaaccgcaaccgaaggagaagtgcttgtgaccaagtcaccgaagactggagaaggcgataccaagaccaagaaaattcccctagatccatctgatccatccaaaactgttgtaataggtgctgagttagattgtaaataggaaagcacgctcatcacctttcttcaagctaataaagatatttttgcatggaaaccatcggatatgcctggtattcctagagagatgattgagcactccttaaatgttaaagaagatgctagacctatcaaacaacgactccgccgtttcgcacaagacaggaaagacgcaatcaaggaagaattaaccaagctgttagcagcaggcttcattatggaagttttacatcccgactggctggcaaacccagttttggtttggaagaagacaggacaatggcgcatgtgtgttgactacatcgacctcaacaaatcgtgtcgtaaggatccctttgggttaccttgcattgaccaggtggttgattcaacagccggctgtaagctactcagctttttggattgctactcgggttatcaccagatcagtttgaaggaattcgactgcttgaagacctcgttcatcacaccatttggagcttactgctattcaccatgcctttcggattaaagaacgctggggcaacctatcaacgcatgattcagagatgtttttcaactcagattggtcgcaatgttgaagcctacgttgatgatgtagctgtcaaaaccatacaaaaagatgacctaatcgctgatctggaagaaacctttgctagcatctgcgcttttaggatgaagttgaatcccgaaaagtgcaccttcggagtatcgtcagggaagccgcttggctttatggtgtctcgtaggggcatacaagccaacccggaaaaaatcaatgacatcctcaacatgaaaccgcctagttcccagaaagatgtccagaagctgtctgggtgtatggcggcgctcgaccggtttatttcaagactcggcgagcgggggatgccatttttcaagctactcaagaagactgacaatttccagtggggacccgaagcccagcaagcttttggtgatttcaaaaaacttctcacaactccactagtcatggcatcaccacatccgcaagagctgctattattatatgtgtcggcaacatcgcaagttgtgagcacggtcttagttgtggaccgagaggaagacagccatgttcaaaaagttcaacagccaatctactttgttagcgaggtcttggccgactccaaaacaggatatcccttggtatagaagttgttatatggtgttttaattaccgtcaggaaattatcccattattttcagagtcacttggtcacggtggtcacatcgtttccactcagagacatacttcataatcgcgaggcaaacgggcgaatcacgaagtgggccctagagttgatgtctttggatttatccttcaagccacgcacttcaatcaagtcccaagccttagcagatttcgttgccgaatggactgagtgtcaagaagatacacttgtggagaagctggagtattggactatgcattttgacgggtcaaagaggctatcaggcactggagctggggttgtgttgatttccccgactggagagagattgagctatgtattatggatacacttttctgcgtcgcacaatgtggcagaatatgaagcacttctccatggactaaggattgttgtttctctagggattcggtgtctggtggttcctggcgattcccagttggtcctcaatcaagttatgaaagagtggtcctgcctagatgataatatggctgcatattgacaagaagtccataaattggaagacaaatttgatggtttagagttaactcatgtgcttcggcacgacaacgaagcggccgacagactagccaattttggttcaaagcgagaagcggctccttcagatgtttttgttgagcacctttatgagccaacagtaccaagaaaggatgtaatcgagaaggtagggacccaagaagtcagcgtgattgataccgattggagagaacccttcatcaaatttttgactaagcaagagcttcctcaagacaaagacaaagccgagcggatttgtcgacgtagcaggctttatgttatgattgagaccgagttatacaagaaaagtccgtcaggaattctgcaacgctgtttctctttagatgaaggaaggcaattgttacaggacatacattctggcatttgtggaaatcacgctgccgcacgaacaatcgttggcaaagcttacagatagggttttttctgccccaccgcagtatccgatgctgagaaggttgtgcgaacatgtgaaggttgtcaattctttgctagacaaattcatctaccagctcaaaagttgaaaactatccctctttcctgtccttttgcggtttgggggctcgatatggttggtcctttcaaaagggctaccggtggtttcactcatctttctgtatcagtggataaattttccaagtggatcgaagctaagccggttgttacaatcactgccgacaatgctcgagattttttcatcaacatagtgcatcggtttggggttcctaatcgtatcattacagataatggcacccaatttactggtggagtgtttaaagacttctgcgaagattttggtatcaagatttgttacacatctatagcacatcctatgagcaatggacaggttgaacacgccaatggtatggtacttcaaggcatcaaagcatgagtttttgactgactgcgtccctatgccagcaaatgggctgatcagctgccataagttctttggtctcttcgcactacacccagtcggcctatgggccaatcaccgtttttcttagtctatggtgcagaagcaatgttgccaagtgaggtggaatttgaatctctgtgatttcgtaatttcaaagaggagcgctacgaagacgaccgagtaaatgatctcaaccgactggaagaagcccgagaagcagcattaattcagtcggctcggtatttacaaggattgcggcgctatcacaatcgcaatgtcagatcacgcacatttttagtcggagatatggttttgaggaagattcaatctacgcgagataggcataagttatctccctcatgggaaggaccatttatcatctcccatctaaatccgaccttttctcttgtgttttcctaaaattagttgaggggaaatatttcctttatcttcctctctcgttttccctaagaatcggaacctaaatccttgtattttatccgaatcaaactcgttttcgagtttatctctccaaactaaccctcggattttccggttaaaatcctctcattttgagttcaatctctctcacccgtgcctatataaagcatcccttagtcgtcctcttccgtttgcctcaagttccaagctctaccgttgcccgtagcgccgtcgctgtcattgtcgtcgttccagccgcgccgggccgtggttgtggtcgccgtcgccgcttagcgtcgtcgccgttgggttcgcgcggaggaggagcacctcggccgcccctttgcagccgctgaagaccatcggagagccgtcgtcgctgtcaagtcaagtcgagccgccgttggagttcgtcgccggccttcgttcgtcgtcgtccgtcgttgtttttcgcaccggtgagttcacgtcgccgtcctcttcgcatgggtgtcctcggaagacccagccgagtcctctagctccggcgacctcatggttcagagccatggccggcgatgtgatgacgtcataaatccttttattagtttttctgtattagataaaatcttattaaacttcggaaattcataactaaatcatcgtaactcggattcaagtggttcaagttgctaaattcatctaaaatcgagatctacatgttaaaaatatccacatgtactgtttatgcttttttttgtactgttttgttgattttgttcatttcctttagtttccgacgttccggaggagagcgtttatgttgaggaaggttcagaagcgtttgaggaagctcaaggcaagtcacacagatcccaaacaaccctttgagcatgttgaacccgtttaaagctaatgttttatttcaacttatgcatttttttcgaatgtcatcgggtggtgagcctttcccaattaattatggccgaagatgactttattttcctatgggttataatttgatttgctagaaccttatatattggtttggttcagctaaatgctacatatgataagctcattaatgggatgaatcatatatactgcgttattatttatggttatatttaatggtagctcacgatggttaatcgtgttatgataattaattgataattaaaacttgattaatggtgggttgtgagcacatggttttgatggtcgtgctcatgacaattaaggaccggttcgcgagctactgttgtgaaacatttaccgtgccaaccacaagccagcgtgggcaacggctttaccttttgtatagcatgattcattatggggtgccagactgaaaagcggcgagaagtccgtgggggtcgctagggagtccatgcctctggttttgagggggagattatgatccaggaacggtgcactgtggtgagttgtgttgtgcgaggagtattgtcacagttcctttccgaggtaccgtggtggtattgaggcgcatggtgacatatcgtggagctgtgtcttgtgggtacagtggtacatctctggccagagtaaaactattcgaatagccgtgcccgcggttatgggtgggttaacaatgtttttcgtgattagtcccacactactcattattggtgataatttgtgataattaaattgactcctggtttggaatggtatattcctggtgtggaggtttgatttgtacaaccggggttggttgttcagatgaggttaggcctatgcaacacgggtgtgttgtatggtgtttatttaatattgcgtaattacttaactgttttactattctcttaaatgtttattaaatgttgtttaagcacataagctatattataccatcctttgttatcctgtgcacttgcatatttgctgtgtggcttgttgagtatgtcatatgctcattcttgcaatattcattcatcagaggaggagtatttcagtgaaggtgatgatctggaggattaggctttgtacgggtcaagttgcttgtggagtggagtcgccatagctgtttagtctttttttgtaaggaagctgtttagtcttttgtttttccgctgcgtagaattttattcttttgagaggaactatccacctctgtaataatttattattttgcgaatattaattagtagtttgatagtactctattatcaatttgttattgtgtgcctcagctgattcctggacgaggatttaacacacatgtaagcgtttggaattttggatagaaattccgggcgtgacattccatgaggtaataaattgttgtacataaatggtataattccaacataaacaactttataatattatttaatggcatgtcaatcaagacatttttctgtattgttaacaaatgttactcacctaagtgcacagtgagcccaaaactcctatcacaaaggtgctggtgaaggatagatgatcacaaaatggtgtcaaacgattccggtcacccaacttcaccaagacaagccaaatcgaggaggtgccctttcctagcccagccaacctagcccaatcctcaatcgactttggccacacgtggggagtattcgagaagcgataccgacttcaaggtgcgattggaaccgtctatgacaccaatcgacctaatgaagggatccaaccagtgccacatgctcagatgacctaacccaggtaggccagaccactaacctaggtcgaccgagaaatcgacttacccccaggctataaattacccctcccctccacattatttgcaaaacaccggtagctaaagatcaagctctagttagcaccatgttgtccaaatagagtagaaatgtaatactccaacccattttaagcctatagttataggtgtggtggtggttcaataccacctaggaagtttaggtgggtaaaggtttgcttataagcatttgtgctccaaccatggtacccctagtcaacctttttacacgaaacgaggacgaaattataagcagggtaccatatgagcgtggcccgctcaatgtgtagagcaaacaactgtagatgttggagatacggtgttacaggaaataggggagtggggagtttggatgagaacgctacggttgtcggacttcgccgactctctaatgcgaagaagttgggaaattttggcctcgtcaacattcggtggttgatctctggtttgtcagtagtcgaattttgatcggtcgatggtcgtcatccaatcaaaatgaccgtcttcatcttcctggttcgacaatgtgaatcttactgttttgcattacttatcaagtcatcttaatgattccatacttatcgattcttgcttcaatttatataaaggtcttactttatttatctttattgctttgctagtatgtgcacttgagcaaagtagtagcatgatacgttagcgtggggcttagctacaagtttatttgggaaggtagtctagatcaacgggggaccataggcgacaagttgtgacaaccctatccatcccttatagttagccaagttagactagatcccttcccaatcaatattccctcatgtctaggcataagtatcccaatggcatttacatccttatgtaacatatacaacactcaattacctctttggttgtgcatccttctaggtgtgcccgattgtgcacatactctttgattgtgcacgattgagcttgtttcggacgtcgaggattgcatgtggtttatggaggaagcttcactttggtcgtgaagattaagtctagtttattttgtttttccgctgcgtatgtgagtttctttttgttatttttgtaagacgtggatctgtctatcaaattgtcgtttatgtactctgactgatcctggacagagatttaatatagattctgcttgaaattcgggttagcgaatttctgggcgtgacaaacagcgtcatacatttttcgatggagggagtatcaatcaatattagtagccatcaggtttccaatcaactcaattgttgtttggtgacgcaaagtccgaaattagaccatactcaaatgcaaagtcaacttcctttaaggtaatttgtctaaattactagtactaaccgtgacatccaataatatatatgaaggaaaaactatggtggctattaattttaactacttataactcaagtaacatccatatcaccgtcggccagaattcttcatttcaaatagagtttgtgctgccaacagcacctcaaggtcaatatccctgatttccaactgtacaccctccataactacctccactccatgatgtggctccggcgcacctccctggacaccagtctccccggccatgacggccgctatctccagctcgacagcgctaaccacgtggctcctcctgtggcaaagcctccgtaaccgcatcatgcgatgaggactcaccctcatgttttttcttcctcttcttgggcgcaagcagtagtagctcctcgttggccttgaaggcggcgtcagcatgtggagcatcacctttgaagtagtgcaccataaccagcccgaggcggccgtcattgtggtcgtctttgccatggctcaacttctgagaacgaaacacccatagatcgatcatggcctcgttagcaatggcaacctttttcacctttttgatggccttcttaccctttttcttggcgtcttcttggagggtaagactgcaattcttcagaaatgtcttccatggacgacccatgagacgatacgagttattagctttaatgtacttcagcgtgaggatgtactcctcgccggtgcggtcgtaggcctgcacgaacagcccatcatcaccattgttaggctcattgttaggcttgttcgtgccattgtcattgtactctttatgctcatccttcttctctttagactcaccgttcttcttatttttaggcttgctggatttctttttgcgcttacttgtggcggctgacttctccgccagcgttaggatgctatcaaacggggataactcgccatccttcttgcgtgatatttgtaaacggttttggcttttcaaacggtcggaacgccacatcatcttgccgtagacgcgcaccggcggcgagacggcgccgaggccgttgaggaggctgcgcagccggtcgtggacgacggcaatgtcgtcaagcggcacgaccatgtcggaccctgccgaagacgtcgacgcgccgtctctgcctaggctggcccagaacttgccgtggccgcgccgcttggtgttcttgcaggttccgatcgctgtcgtcacgtgctgtcgtcggccacctcggatggcgtcacccatgagcttgtcggcggcgggcaggccgattggcatgccgccgccactggcggttgatgggctctctt

SEQ ID NO: 60271 - DNA, 28654 bp, Oryza sativa
tggatgatgatgtggtacaattgcatcttgagctttaaaagttagtggatatcaattttatagtaagataggatgtggctgcacagaaaagagagagtcggtattgtatcagttagtgagaagttgtatagatatatagaattcctcattacataaccgcctgggaaaaccgtgtggccttattaaaaatcatgaccccgttcgtttcaggataaatttttggattaaaatgatacgctttttaaactgctaaacggtgtattttgtgtgaaaattttctatatgaaagttgttctaaaatatcagattaatcctttttcaagtttgtaataattaaagctcaattaatcacacgttattatcacatcgttttacgctaaacacttaatttttatcttcaccttcagaagattcaagaaccactccaagtgtccacgttcactatacagctctcttgcttgtctgttctctctctccacacttcctctctccctcaactcctcttcgcctctcgctttcctgatcttttcctgcattgaccttgattctggtgacgagatagcggcaccaaaggggaggttcatataggcggcgtaggggaggggcacccgtgtccaaggagagggccgacagtggtggaggaacaggactgtggcagcatgagagttccagcacccgaccactcctgctcgttggtttcgtcggtgacgatatggcttgggcccgacggtggggacgatgagagttcttgttttttttttttgtggattttttatttgtggattgtggcttccctcgttgtgattgtggctctttttgttggatttgtggatttgctagaaattgatgtactgatctagaaatcgatttgcatatggatttttttgatttggcgggaattctcaggtttggtatgaattttattatttgttcggcaaaaagaactttgcacatcggttctcttaaccaagccgtttgaaaaaaaatcaatctattaggtgttcctttcaaagaatcacatttaaaaatttaaatcgatttttaaatacggtttgttattaagagggctgtgtgaaaaaaaaatcaatttccaaatgcaggtgtcgaaccgccggtgaaaatattgatttctaaagtcgttggctcattgcagagggggacggtaaaacccgcctcaacaaatcggttttgcccacccaaagaaatcacatttgtagtgtaggattgataaaaaccaaataaacctaccagaggaggagggggtgaatggtagggaaacaaaaacccaaaatcttttgcgaaataaaatatttatctcaaacggagtagatgacgaagtcctgtcaccgccagtcatactgcccactacccaccgatcagatcatcgttgtatgactggtcagaccgtgcgcacacctgcggtcagaccgccgcactctcgccggtcaaatcgctaccttgcctgctgttaaaccgtcggaaactagaaaaaactggtagatgataaactcaaagatgtagattgaatcttgactttattgcattaactagtgtttacaaagtgcaccaacagtagtcctcactaaaatctcgaactaaactcgaaatcctaactttctctcaactcaagtctctccaaaaccgatactggaaggctacaccctcactatctatttatacacgaggtaggttgtgcaaagcccacgaatctaacacaacttaggactcccaaccacgtgggaaaccctctcttgcaagtatacaacttatccctttacttatctccatcaatcttcccaaatttagactcccttccaaattcgactcctctttctatacacacacaatccctcttatataccatatggattcttcatcaccacgtgcattgttctccagccttttagcatcccgcatgatctcttgatctctagacgtctacttctcccaagtcaactctaatctatcaccgacaacactctcccaaggcctcaagcaacacctgcacatacaacaaccaagaacccaacttaactgacattagtataacaatattatccatatgcataggaaccatctataagtcaaatccctgaaggaaacatccaaaaccgataagacaacctgaaaccgacaatgaacaggaatctgccggttaggccgtcaggctggccagtctgaccggcggcaccacccggggtcaacaacaacatcacttcacaaaagcaatcatctatataactctgaaatatcatcgcaagaaaccaatctttcacacatgaaacattaaaaccaccaatgctttcatcacacaaaatctaaatcaactccttgattttacatatagtagggcatgtcgatagcacctgctgttacggtagatgtcatgcgtccatccgctgtcaacgtgtttagggtgtgtttggaaaatgggttaggagaggtgggattgggaaatggaaatgaatagagacatagtatgaaatagggtgagaagaataaatggcttaccctttaagggatgggaaatcatatcccaaagtcccaaacccatgtcccaaagacaaccttacagcttagtgaccaacagtaaaagaagacaccaaggacaagcccatgttggatggctataaagaaggaaacttgattatcttccgatacgaggagcaaagcgaaagtttagaatctaacaaaaaaaaatctaagcaagcaagtttagaatcgaacagatcaccaccaaagcatgcattggatccatgcatggcataaggtacttgcttgcagcatgcaactcatgtcggcctactgagcacaatatattatactatatattttttcaaaaggaaaagcagcctccaactctttttcttccttcttcctctacgttgtcgtagtgtcatcgatatgatgtttgggccaccgccgtccgccggtgatagcattaatatccccgacatgccaaccattcgtaccattttccctttcaagtaaccccacttacggccttacgggcatctggagccgaacaagctattgtgcgcattattcgtgaagcatttgaagtcgtacatatcatatccttggtttgaatctgtctttcctcttggttccattccattcggcatgcacattggtctcagtgattctctggctgcttaatttgttgcaggcggcggaatgaataatcgcaggagcgagctgggaggatcggcgatgcagagcgtaccgcggacatggagtcatcagcggtctgattcgaccatcaacgatgtcgcgataacccaggcagtgatcgggaagctcgtcaccggtgtgggctacctgtcgctgacgtggtcgacggtggtcctcctcggcggcttcgtctccacggtgcccattaacgagttttggttcctcacagctatcagcctagtgcttgcatccacgtaagtggcctctcattcatttgaaagcccagccattcgtatatgcctgtgattcgtgctttgacaaatgttcagctgatttatttaaacatatatatacgcctatgatacatcttttttaggcaaaacaagtacttcctccgtttcacaatgtaagactttccagtatttcctccattcatttagatgtatgttaagattcattaacatctaaatatacgtgagttcttacattgtgaaacggaggaagtaacaaatataatcggcaataatgctttctgttagcaacttttttttttgtcacgccgagcaatcacattaatgttgacacctaatgctttgcattgttacggagttatcaacagcctcgaactaaaccaaatcaaatcaagatgggttttgtaaaattaaaccagctagcggagcttcttagttgggatagggataaccactcgtctcatgggcaaacggaatattttttgaacaaacctacgaacgggtaatcacactctcgtgacaaggacggacggctttcaacataaaccgatgaagatggatgaaaactagactagaactaagtaaaaagtagatgtgataatgaaaaatgattcaattggctaattgtgttaaaattagattggtgtctcaattgaatgggccttggcccttataaagaggttggtcttgtctcctacaagacctcctccatgttaaaatcaaggtagagaccaattagaacttagaaagtactttcccaagcaagaaaaaccaagacccgatgatattctagtcggagtaagactcagccggtcttattggccagatgccgctggtcagaccgaccacatacctgcggtctgactagcctcaaggcaatgggcagatcggcctcccgtggtggaaaccgggtacttccaaatctggccatgttttcctatttcgtgtttaggtgtcaaatttgggcgttaacacttccatcgagtgttagatgagaggcacacgagcggatgtcacgcccagaaattcattatccgaatttcaagcagaatatgtattaaaatctctgtccaggaccagccagagtacataaacgacaaattaataaacagatccacatcttacaaaaatagtaaataatgcttacaaactcagcagaaataaagaaataatctagacttaatcttcacgaccaaaagcgttgcatcctccataaaaccacaggcatcctcaatgtccggaacaagctcaatcctcatagaactcaccatgtgaaccattctctgtctctgtattaggaaaaataaagcaagactgagtaccaaccaccgtactcaacaagtcataccaacgggaaggtatgatgcaagatattcacaaaggaatggccataagatatttgtaataaaagcagcatttataaatcataatttgaatacagtaaaacaatatataattaagcaatattaaaatatcactgcccaacgctaaaccacattgcaataggcccaaccaaaccacctaaactacaccagttcattaagtcatattattaagaatgagactaatcacggtgagctggttgaccgcccaataaccggcacgactattcgaatagttttaactctgatcagaggtgtacaattttatccacaagacacgattccacacatgttaccatgcgctgaagactaccgcgatactgcaaagggagaaaccgtgacaaaacccttcatataactctccctaaccgaacatacccacctcagctttcaccccctcctttttagccaagtcgggcagtcccctctcgtgcctaggtaaattcggaaacaacagagaccagagctaggtctgaacttcaccatcgcctctacccttgccatggtatgtcagctaggttaagttatactctagatttagcttggagcccacgctagcctgtgataagtacggttatatcttccagggattcccgagaaccaatccttaattgtcatggcacgacttccaaaaccatacacccacaacccaccattaaagcatatttttgtttaattaaaccttaaccatggtggtacatcatcatatagttaaggactaattatagtgaatctcattatgaactaattgatctaagcatggctaagcattcctaaaccaatcatctagtcaattatatcccaagctatcaatggcataagatatcaacaggctgagtacgataggcatccatcccacatgacattctaaaataatgcaatttaatagaaagcatgggattttataaaataggttcaacatgatcaatgttgtatgtatgacttgcattgctcttgagctgacggaaccgcagcaaccacttcaaaataaactggagcgtcggaactgtcggaatctaaacgacaaacaaagcatacaataatacatcaaataagtctgtggtggatattttaatgaattcactgcaactttaatggattaaaacggagctcagattatttagatatgaattttagaatatgagatgtgtatttactattaaccgaaaaaccttagtccattattacacattaagagaaataagtcaatgagtcaacaccagtaagcaagcctcacgggatatcaactcaatgagtcaacccaccgtgacatgggaccactcaaacggtcaactgaaccgacgaacggaactgatggcttagaacgactctaaaactaaagaacgactcgggacgaccgaacgaacgaggctttggactatacttcatgcgaacgaacgattaacgactagcgaatggctgcggcaagaccggtagacttaactcggtttgcggcaacgacccggtacggcaaacggtaggccggtagcgactcgggttgacgactgcggctaggcaactcggctaccgagcgacaagtggcggtgtcacgatctagcagcgatacgactatggcaaacggtgataaccggcggcagcggtggcagcgcgggacagcggcgacgctcagcggctggcacgacagtgggcggcagcggcgcacggtggtggcactcggcagcgggtggctgcggctagtggttgcggcagcacagcacagcggcggcgcgactgcggctagcggctgcggtggcacggcacagcggcggcggcttgacagtggtgcagcagcggcggcggcacaattaggattagacccactacgcaaataggaaattaaaaacctaaactaggagatcacggttaggaacctcaccaaacctagatgatcggggaggaggagatggcaacgatgatccggcggcacacacggagatgacagcgacgctagacaatgagggattaggttagattaaaccctaggaacctcacacaatgacaaaccataccggcgggagaggaggacggctcaccagcgacgcaatgacgacgacggcgggaggcagctagcggtggcgacacagcgacggtggtggctagggcgtaggggaggcgatggctagggttttgcggtgaaggaaaatagaaaaaaacggaggggtatgggaacttaaataagaggatgcggaattagagtaggtttagattaggtgggcccggcggcgcgcaaggggagggggaaggcggcagccggccgagactgggaggggagacgcgcacgtttagtaagagggggagagggactcagctagggaaaggggatgggatttggatacgaataagaggggaccaaaaaaggaaaggaaaggaaaaccaatgcggtgccattttgggaaaggaaaaggaaacaggaccggaaaaagaatatgactcggttcaacatacaaaacgaaaccgtggcggcaacggggttggtggatactgtcgacgagtgatactcgcagaccggaggaatagggtattggggtacgttggaacagggatctacgtagtatgatatcaaaacagacaaaagacaaggattatactggttcaggccccttatcaggtaatagccctagtccagtttatatgggattgatgatgatgagaacagattacaattcaaagagagtaaccgaacaggtgataccgatgagatcgtagtcgagggattcgacgagatctcctggtgagttggctctgtggactccggcttcgtaaactttggtgggtgtgttggcgatgagatgcgatgcccatagcctatccctaggggtcccttttataccgtgggataccttgaccctcaagtaagacttggagattatgtaaaccgacacgatatactagagattttaccccttccgagtaagatttcagcaattccttaactcgtagagatatttccgataatttgaggtaaatttctaacggcatatccggaaaccaaccgtatacgtgagggtataccttattggtatattccgtaagtcgtaggacagagggtatgccttatccttaacactgacagatacagcataccacaaacggggagagtgaactggggacggttcacaaccaaagaagagtggggaaagaattattaattcaactcctaacattttaaattaacttcattaattcctttgctctgaatattctgttgaacatcctgttagtgatttaaagcaaagaaaattcgaaaaaaaatctccgtgacaattctgattattaaacacattgttatttagagtttcctcctggttaagaaagtaatttctatagatgatttagcaatgatttagcaaatacggaaaaggggaaaactccgggtgtgacagcggtcgccctgaccaacgcaacaatgcttgtccgcttggggccgacttacaatagactcattagcgtcaactaacaagatgttatatatctatcaagatttcttgttaaactttttatgtacccaaggttaccctatcatgggtgatattagttagtgatattggtgaactacttttctagctagttccgcccagggttcccctaaccgttttcggggtggttaccaacccccccctatgagggatgttcggttccgatcttccgataggtattaataaacagtcgatttgggcggagtcgtgacacaactcgatccggcttctgaacgaacacgctactgagccccgcaatcgcagcaccacgtctcttctggttatcaaccatgtcgaaacctggttgacctcgccgagaaggctaatccctgcaagcgaatcgaagaacacaaccaagaacaggatagattgcaaccaaattgcatatgaatgattaagcactcgaatttggggttccacaaaccgatctagcggcgaaattgttcttgacagaataatctaagcaaaactcaactctaaacgatgacggctaccgaattaatatgattaggaacgtcctagggttgccctagggcgcacacccccttgggctaagcccacgacacaattacaaggcccaaaacccgagtcagattccgtctggatgagatacgtggcttgttttgcagattcctggcagctcggtaggtattttgacgtgggacaaaaaccatctgaaagtagactccataagctttccaacaagtactcgtgaacaccgaaattccttctagatcagcggctatgtttgtttgaagttgatgctgttaggaggcccaaatccgaatacaaaacgtgtacaacttgatctcttgtcttctatggaccaaaagtgacgtggtgaggtagaagtagacttggagaacgtcttggttttggtccccaatcaacttctttaatcatccatgcatcagttacgctcggtctcttttccttcgcccaagcaagtacctctgcaaacgaaaacacacaaaactcattgtgtagcaacgtttgttcaaatatataacaagtaaatctaatgtagaacatatgcacctttatttgattaatacataaggtagtcatggttatatccgagctagttatatcctcatcacccccctcccgcggtaaccgtgaaaaaaccgcgtaaatttcggtttcaaaaatttgaattcaaaatctgtggtagcacggttttggcacggttaccgcatggtttggagcgattaccgtggtattttcgtggtaaccgtgagatgtttggacgaaagaagaacaaaatgaaaaaaaaatgtaaaaagaattggagaaacacttaaatgtgtgtagaatttggggataataacaaaaaaaatagagagatgagagtacttggtgatattttctccacgtatgggtcttaatgggccacatgaccagtgcaagcttaggcccacttcattatttctttttcctatgtcctaattgactctttttcatgaaatttcttcaccataatacactacaaatcaagcactacattgctttttttttgatttttttcgaatttttgaatttgctcaaaatttggcaaaccctactgccggtaagggttaccgaacccccatggtaagcctggtaaccgcggttaccggcggttttgcaaaccctggttccaccaagcatttcttatctttcccaccacctgctcttattcaaatactatggactcctttggcaaataggatacggaaatgatattccactctccaaagggtaaacattttaggggcaattgcaaatttaccactactttgaattgttattgcaaaactgccactagaaaattgcaaaaatgacactagaactgtcattcgagtggcatccttacaatattgaaaaaaccggtggcaaatttgcaaatgccccatatcctagtgttgacacgaaattttccgtccgacgtgccggatgtgcatcgatcacaccaacaatgaggcatgagagatctacttagttccaatacaggtcctagatcttgatgagtgtcacgcccggaaattcactagtaatttctgaacttatttgtgcataaaatcctcgtccaggaatcagccgagatacacaaactgacaatttaatatacaaatccatcataataataacgttacatacttagaaaagaaaagaaaaacagcagcggaattaacggtctagcgatggctttagctccactcccacaagcagctcaactggggtataagccaaacgtcttctccttccggatcctttttcttcaactaaggtttgatgattattgcaaggtgagcatatgacatactccgcaagccatacagcaaatatgcaagtgcacaagtataccaaaggatggcataatataggctcatttgcgaaagcagcatttagcaaagagttaagagtagtaaaacagtagagtaattaatcagaaattttaatcaacactgaacagcacacccatgctgctcaggcccaaccaaacctgaacaaccaaccccggtcgtacagatcaaacctccaaaccaggaattatccattccaaaccaggagtcaaatttattatcacattattattattaatgagtagtgtgagactaatcacgaaaaacattgctcaacccgcccataaccgcgggcacggctattcgaatagttttactctggccagagatgtaccactgtacccacaagacatgattccacacatgttaccatgccccgaagtaccaccaaaggggggaatcgtgacagtaccttttgcacaatacaactcaccacagtgcactatttctggatcataatcactccctcaaaaaccagaggcatggactccccagcgacccccacggacttctcgccgcttctcagtctggcaccctgtaatgaactatgctataaaaaagataaagccgttgcccacgctggcttatggttagcacggtaaatgtttcacaacagtagctcgcgaaccggtccttaattgtcatgagcacaaccatcaaaaccatatgctcacaacccacctttaattaggttttaattatcaattaattaacataacacgattaaccatcgtgagctaccattaaatataaccataattaataatgtagtatgattcatcccattaatgagctaatgtttctaagcatggctaagcaattatatatatagcatttagctgaaccaaaccaatatataaggttctagctaattaaattataacccataggaaaataaagtcatcttcggccattaattaattgggaaaggctcaccacccgatgacatttgaaaataatgcataagttgaaataaaacaatagctttaaataagttcaatatgctccaagggttgtttgggatctgtgtgacttgccttgagcttcttcaaacgcttccgaaccttcctcaacgaaaacgctctcttccggaacgtcggaaactaaagcaaatgaacaaaattaacaaaacagtacaaaaacaagcataaacagtacacatagatatttttaacatgtagatcttgattttagaaaaatttagcaacttgaaccactcaaatccgagttacgatgatttagttatgaatttccaaagtttaatcgattttcatctaataaagaaaactaagaaaagggattaatgacgtcatcgctgacgtcatcgccgtccatggcacggcttccacacgaccaccggcaaaagaaggctcggttgggctaacggaggacatctacgcgtagaggacgatgacgcgaactcaccggtgcaaagaacaacgacggacgacgacgaacgacggccggcgacgaggttcgacggcggctcggctcgggtcaacaatggcgacggcgctccggctgtcttcggcggctgcgaaggggcggccggggttcctctcctccgtgcgcacccaacggcttcgacggatggcaacggcgacggctaccgcggcggcgcgacgcggctggaaggtcgccggcgacggcggcggctagggcaacgtggcggcagcgctacgggcgacgagggagctcgggacttggggcaaacggaagaggacgactaggggatgctatttataggcatgggtggaggagatcggctcaggaacggatggatttggtgaaggaagttaggatttatccgagttcacccgaataaaaacggccaaaattcgtgagatagataacgaatttgatgggggtttcttcgggattaggtagaggagatagagaggaatccgtttttgcaatcaattttggaaggggatcaacagttcggccggatcgaacggagaaggtggcgttgcaacgcacggcatcgggcagaacaggggctctggaggaagaagatgacactgttgtgagagggaggtaatgcagactttaggatgggctgaggaagggagagagaagaggaaggaatgggctgaaaagggcccaagctgaggaggaggatttttattacttttccaaattaagagttgagctccgaaaaatccgagaaaattccagagagtataattaaccatggagaatttaataaaacttaaatccagccatgctttatatttaggaaattttatttctcacatttaacttcacttgtaaattaatgaacatttaatataaattctaataataatttattaaataatttataaatcctaaaacgaaaatcaggatgtgacaatgaggtacgggcatgccagtcagtttaattctgcaactgacaagagatgtcaagtagcagcaattagctgatagattgaacgatcggttgttggagactaggagacccgggcgcggatcatgataatctcaagtgggccaaaagtgtgtgtcagccgatagcggataaatgatggtttggtgtagaatcagttgaaggatccaatgctagtacttagcactgaatgcatttggtcattgaggccagccgatgttgatgggactgaacggtcggttgtaagcttgttgcagaattggatcggttggaaatccgacacaaatagactcaaatagttagataaacaatgaagcctttgttacaatcagttagcgaacttttcattatcaaagacaatcgtaatagattagacttaaccgagacggtataagattgaagttgatatagatagatttatccaacaactaactaatccatataagccgatgtaacacttagaactagtaaccagataactcatcggttagcactccaatgaaacataagcaagaaacgtatcggcttaacaagacttagattatcaatacaatctaaaagatcagacctaaccgagacagtacaaaattgcgtgtgataatctaaactcgatgaatcgatagatctatgcaaacctgatggatataacaaatctatcttaaaatagcattatctttaaagagacgccaacttgatcagaatatcggaccgaacgaaggaagtcctaactaagtcaatgtgactctaaacaataatgcaatcaaaagtagagacgatataccagataggcaacacttgcttcggtccgaatagaatatcggacctaaccgaggaagtcctagccacgccgatgcaagcgaagatgacggaacttacttctcgccagaggtctcggactaaaccgatgcagcccatgctcgaaattaagaactcgacaggagtaaattagggtggcgatatgttgaaagttgtattgatctagagatagattagaagaaccctagatgtacatatttataacatatttataacctcgagccaatatgaatccccatcataaatgactcatgtttcctaaagataaaacacaagtcctaatcagacactaaccaaactttttaaagataaaaagaaaaaaaatactaaaccctgcataattaatagataaattaagctgccatgccatggtcttcacgactccttcttgaacttggtctcttctggacagactttccatcggttgattgtgttctttccctaaccaaatccactaaagaatcttaccatattttggcattaacacctagccatccttttttttacacctcaatcttagccatttacccatttccctttctcaatcccatgtctcataatccttttgccaaaatatgccctatatgcatctctctatgatctcttatcacgttgttgtgcctctttccccatctttacaaactcgcttcccaatctcgccatgttctctctctcctaaggtgtgtcactctctctatgtgctttttatctgctcttcagtgccttacaacctataaagtgaatattggactctatgctggtccttgggcaagcaagtaaacccctttctcattgaaaaccaaccatgtgcctttgctacaactcatgttttgcaaattacatagagtccatgtcgtttgcatctctgtcacgaatcatggcaattgctttggcatctcgccaattggtagagatttcatggggatttcatggagaaaggagaaagcaagacaaggaagctagaggcagaggtaagcggagatcggtaggggtattcaattttctcttcttcgataccatagcccgtcgagtcaataggtcttttaccatttacaactgggtttcgcccaagacaacccacgaggcccatggcccatacatcatttgaccccaacaacacaactcatgcttccaaggacacaaaaattcccccctcataagaaccggcttgtccctaagctggtgcatcttggaatcgttgtcatagctggcacaggttttcccaggttgccaactccattggcagtctggtccattgtatcaagacatgaggaatcattgccctaccactcttgatcagttggtgttgaagcacttcttcaggcacgacttcagctgtagtatcaacataatttagggagatcagtaattacttgcgttccaaccttcaatgccttttttagcaaccacaaatgaacaaccagatgtatctgactacacactaggagctccaatttgtatgccacagctctcacccaatctaacactctgtaggggccatagtatttgaaactgagtttatgataggaacgtcatgctacagttatctgcatatagggttggtgtatcaagagttggtgtttcaggtatactagatcccccaattctaaccacctctcagttctgtgtttgttggcttgatgaaccaccattgttgtgccttgatcagttgatgacgtagaaccacattcaactgtgagtattcctgtagccaaacctgcacatcaggcattatgctctgccccagattcacttcaccaaaataagtgtgctttctggcaaataaaatttcatatggttattttccaagggctctatggaaatcagtgttgtatcaatgttgagcttgagagagctattgtgatcatttagtcaggcaagcatgaacatcacaccacaaaaatgcttcaacgcattgatttagcatttctgattgcccatctgtctagggatgataggatgagctcatgttcaatttcacatatgccaatttaaatagttctttttttacgggaagtttaaatagtccttgccacacctatctctattagatataataattttaggcatgtcaaagtctcataaatattggacatgaaagcttgggctacagtaagtgttgtgaaaggatgagataggggaatcaactaggcaaactttgtgaatttatcaatgaccactagaataatataaaatctgcctgacttaggtatttcccaaacttgtaggggaacatggagtggtcgtaacaaatctggagccatgccatgttcagcttttgcttgttggaaaacttcacattgttctaaacatccttcttaaaccctggccatgtaaactttgatcctttggtaagctgctgccatgatagagtggccaccaattccacttttcatgtggagacatcataacatcatgtttagcctctgtatgtgcacctagccagattttaccatggaacctaatcacccttttgaccaactgaaaccaatcctttcccacaggactcaaactcaattcaatcagcaattgttttgtcactagatccttaatgtatccttctatcacactctctagtcatttaggattcatgctttccgcgtgtcctcccctctctctctctccatcttatctcctcacacaatcacacgcacccttccctatctctctccacacaagcccgacgatgacacccctcctccggtgatggccttccagcgagtctcctcctcctccttattgcgagctccatcgttggagaaaaggaatcacagtcgagttgccttcctccttcgatgacggcggctgcaaagacctctatctagcgatccccctccttcctccctccgaaaagcttcctcaatcaaccaagtcagttccttttctcgctgtcgatcctcactatgccatcgcctggtatcaccggcgccaaaaggcatcaaaatgatggtgctgtcccgctcagctggcctcctccccccccccctccacctcgctttgcccttgccaccaacactagcctactgcccgttgccgaccccacggctccggcgatgccgctgccgccgccttgcaggccaatactctaagcccgatcccccacttacccctccctaacaaaacccttcgctcaccccaccctgaaaccctaaccctacccctacccctacccctaccctgagcttgttgtcacacagcagaaaactgtgcgcaacttgcgccccttgcgtgcacacgaattaggattcctggaacgcgactacaaactatgcatcttcctcctagaagaggggtcggaggtgatggaactatgtttttcaatcctaccgcctcgagagttcgagctacctcacgtgggtttcttcccaccatctctcgttcatgttgtggtgtgcctgttcatcaaaatacaagaattaatgaagtgcatatgttgtgcttgtcgtatcgttaaaattcaccactacaaaaacattttttctgcacaagaacccttataagttgcaggtggactgtaaataaacctgcctccagctcgggaggggcggatctagagcctggtggaggaggcaaggggcgacggcaacagcgacgggccctcccccgcgcggatctgacggtggcggtcgtcccctaagcggatccggtggtgtgcacgggagaggccaaccacgagcaggagcagcgacagtaggctcgggagcagccgaccgcaggtgggagcggctgcctccgggttcgggagggacggatcgagagcttgatggaggaggcgtggggcagcagcggtggggccctccctcatgcggccctacgtggatcctgcgatggtggcaggaggagcctgacagaggaggtgagggcgacaaagaggagcggtggtggactgttgcgacgatgtcgccggcggatagcacctagctagggtttggagttttgatttttggggatttttattttttttattttatttttacgtgcagacgacataaacacttgtacgcaaaaatagtgattttcatagacactttcgggtagacgagcggcccacccacacgcaaaaataggttttggccgtatgaaaaaaaaaacttttttagtagtgactctcactaagttaacttacgagtgttagcaaatatatatggtctgacctgtttaggaggcttatttaacatgcccccacaacttatgaagcattttggcctcactggcaaaaaaaaaaaaaaacttgcgaagcatttttcccagtcttgttatttatcagttacctggttttctttccctacatgtccggcatttcaacatacgcaaagtatagcctaaacttgcacggtttgaaaaactcttttgtttcctttgtatttttatttcctgcattgaactaaatgcgtttttatgcttattaagatcaaattgtttattcatgccggtaaggatccaccaaaatacaatctttgaattttgagctatagcatgttttgttttgtaaaaaaaagaatggcatatgattcattagtttgttggatgtcgatcaaatataacagttgaagaaaaacgattgatagctaatgatgttcctcgctaaacccaatgcaacagggtcttgaccgtccacgattacagcatcgagagtgttgaggcagtgttgaactccacaactagtatgattgaaacctttacggctttccaaaagtctgcgaaaaagcattccactgctgccttcgtgttcagttcgatgtgtggtattgtgctgatggtgctcgcgcaaatagtagtggtattcctcgcacttttaattgaagctgtgctgatcatcaatatgcttgggccgatggcatccatggtgatctcaatgacccgcctaatacggcacgattatggtgatgacaatggaaatctcagagcagccttgttcatattttactccctagctctggctcatagtgtgtgcttctactgctggttcctgcttcagtatttccttgagaagttgtccaagtcggcaagcaaagaattcggccttaacaaggactttgggggccaaaaattgctccttcaatacctccgagaaaccaaagccaagtgtgcagatgatctgagcttgcccggtggctggaacatggtcacatatgctgtcggattgctgaaatccgtgtcccgggatgatcatctggatggtttacggatgcttgatgcattcgtcgtcaacaagaggccatccataagactggagctactgtcctccagcgaatccatccagaatctgatcaaaatgcttcagtggactgacccggcactggaggaccaagagatgagagaacgcgccgcaaggatcgtggcagatgttgccacgggtgcattacacattgttcagataccaggtgccctgcagtgcatatcttctctgcttcaagtatctccactaagacaatactgccaagaggttgaaaaaggtccacagaaacaggatcaagacaaggaaggaggagaagaagaaaaagacaagaacatgaatactgcaatagatgagcagataactgacaggcttctaaggatggacagaagagcgaagaaattcttatttgggacgatggatgacaagagctccttcaagccccaaggcactagagagttgattcatcagggcctacagatacttgagaggctcgcatgtgacgaccaaaactgcagagagatctgctgcaaccaacggctgcttaccaagatcattgcgccaatcacttctcctgctttacttcacacagattatgacaatgcatgggttgatatactgagcattttgctgaagctggtgaggctgctcatcagtgctcctggagaagctggcacaagggtatgccatgatatctcggcttgtgaggacgcggtccgcaacttgttggggattcttggccaaaatgcaacttatcccatgcaacttcaggaaaatgccatggagattcttacagaaatagcaattggtagccctgcaatcatggcggaggatttcatcaggaagctgtggtgcatcttcctttccaacagaggaacaagcagattgaggagaaaagcaggagaacaacttgcaaaactgctttctgctcaaggtgcaaatgggcaggtatttgtcaaggatgtattttgtgaaaatgatacagttgttgctcaactcattgatatacttgttcaagacaaggagtgccagataagtgcggcagcaatattggagcacttatgttgccattttgttaggtacaatgaactatcagagctatgtgtggttaaactgttgagaatggtaaacttctactattttcttttactaaaaccattaacacgaattaaccaaatgcagttatatgacacttgattataagtatactgttaatatattattattcctgcagatacttgatctaattagtaaaatggaaataaaggaggaaactgtaccaggggcaggggaaagcaatagttttgacgtacataacgatgaagaaagcaagcctccaaaacaatctggtccgaagaagccctgggttccgaaaaatgatgagctatctgaagaaacgaaatttctagcagctctgatgtcccttcttgtggtgatatgcaacaaaatggttgatgcacatgtattttgttatgtcacatcagtggatgcagcactggtgaagaagctcaagaagataatcgaagcaaataacaaaaacacagctgactgtctaagaatagtgaaacttgcctgtcaggtggttatagcgataattcatctcaaacctagctgcatcaaagacttcaatggaaatcatttcgatgctgtactgtccacggctttgaagaacatgtcagacatcgataactgcatgctctttgcagtccaagattgtcagataacaaagcctgccagaactctctcttctcttgtaaaagaagcccagggactcctccagaatgcacaagatgtaacagtcctatctgattaaaatcatgtattgcatctccaagaataacagatcatcgagtgtactacttgtcatctgaagactgaagttatctattttctgaactacacgagcaaatggagtgtgctgccgtgtctattttctgtacctagtgtgcaaatggagtgtaccttctatattctgtactatgcatgtcaattgtcgaacattgtatgaatactttaaaagtgtagtatctctgaaacatttattgacataagtactgttatatgtttggaatggcaatgttattattgattgtttcaaaactatggtctgaagttcatgttgagctcaaatctaaattggtggatccagcccataattgtaagtatgccatagcagtgagtgagtcaatatgcattctgtaagatatataacagaaattcttacagacagagcggaagatcatttcatatattcaacacatgtattctctcttacggaaattcttacagttagagcactagatccatttcagtccagaaattctgtcttattcgaaacaaaagcaatagatcatttcatatattcaacacatgtacttagaatttgaaacaatttaggattaaaaatacaccgtgctaggacgtacttacagttaacgcctgctgctgcggcttcttcacctgttgcccgatgcttttgtcgacgggcacggcaagccgtccgcaaaccaccaccgcatgctacaagcctacaaaggatgataattaagggaagtacgaacataaggcaccaactgatacacattacgcagccagcgcacacactacatgcaatgtcaggtacaactctgatggcatactacagacaaagcgtacataacaacatgaaagagttaacagagttcaatacaacaaattacaccctaggaggataagctcagatcacaatcagttcataatccctgcctaaaatacacataagatgctgttgcttcacaaaaagggggaatcacggcgagcctatgctgcatccaccttgaccagcgctgtactcggtgcctccggggtagctggtaaatactgaagccagtctttggcacaaacgagcgcctccacaatttctggacgcgatgagcttctgtagtcatcaagcatgcgagttccagttccagcagagaaaatagagttgccgctgctcaccatcgacatcggaatggccaagatatcccgggccatctttgagagagtagggtacttgagagtgttgagcttccaccagttcagaatgtcaaattcctggatgcgcggagtgagggactcatccaggtactgttccagttcagattttgttggctggcttgtagctatctcagaaaggtacatatcgaagtccacaagtccatcgccggttgaaggagcagttgcttgagtactattctcgctagcaggtgcattattacctcccccttgctcaacgtaagccggcgttaaggggaggggctgtgcaacatactcgttgtagagctcatgaacagcatcatccaccaccttaacatatttcgcagcttcaacaccataaattttcgagtagctgaactcaacgagcttcatcttgaagcgcggatccatcacaacagcaatagctaacacaaggttgcaatctttccagtacttgtcaaatctctcgtgcatatccttggcaatgctgctgaaaacagggtcttcacgccctgtggcatttgacagctcgagctgaagtttccatgcctcatggaaaaagagatttgaagttggatttgctgcagccatgatgctatgtgctgagtcatacaatagcttcaagtaattgcaggcagcctcaacttttttccagtcctcagcggacggtgcctcgttgtagttatcatcacttgtctctagagtagaaaaggcctgcttataatccaaggcagccagcagcatgagataggtagtgttccactgtgtcgtaacatccagacaaagggtcttggtacttgggatctctagttgcagagcaatctctgcaaacttctcctcacagctaggagaagcttttatgaacttaatgctttcgcggatattatagatgacaccatgaattgaagcaatgacatcctgagcaactgcattcaggatatgggcataacaccttacaacaaatagttggcccttgagcatgaggttgttcttgttggagagataatccctcagattcgcactgtatatatcatgtgatgagcaatcattgtccaatgtgatggtgaatagtttgtccttcatattccagtctgaaaggcttgtactaatagcttcactaagtgcattctctgaatgaggagaagacaccatcatgaagtttagcattcttcgatgcatcttccactcagagtcaataaactgcccagcaagtgaaacatagccaagagtttggctagttgtccacaatccaatagcgaggctgatccttccaggcatagtgttgaatgcttgcatgaggttttccttttctttctggtaaacagcatacacctcccactccattgtctcaacatctacaaccctgaaacgtggctgcagactgtcaataaaggtagtgaaggctggctgttgaacaatgtgaagtggatagtcatgcaaaatgatcatcttcgccagatatgagcaactgcgttcttgatcaaaagcagcatttgcataaccagtatatctgtaacgcctcttagacgggcgctccacagtaccctcaccatcattgtcagtccctccagctggagtcagtaatagcttgtgctcttggttcttaattttaggacatgaacccaaggtaatgtgcctcttgagatggctagtgcccgcaatttttgaaccagagctgtaagcaaaagtttgcttgcacagtttgcagcacgcccgtgtagcccctccagagacagcttcaatagtgaagtgctcccacactagagacttcttcctacggcgccttgatgttggagggatactcatctcagcactgaccaattcatttccttggacctcgtcaccttgaattaagtcctccgcaaggaccaattcatcaccctgaacttcctcagctagagcttccccattgcttggaacaatctcgttgccttgaaccaccaggttgtcgttgctggtttcctcagccatgcttcttggctagtagctagaactcacaaaatctattaaatagtaacatggtaacagcagaagtcagtataacaatcatttggccaaaaaaaaattatcgaaattgacttatacacggttgtttcaataacaaaccagtgtcactacagtggcctatttaacaaaacaggaagacaaaagaaagacaacacgatttcttgataacaaattagcaaaccaggttatagcaactggagcacagatgaaacaacaaaaatatagatgtcataggaatatatggaaacttagactgggaaacatctcttctcactcctcagtaaaaatgcttaaagtacacaatttaaattaaattttatttgccaccgaaagtgcaaacttcatgagcagatacatgtgctacgttgtttccacagttgagatatattgacccaaccattaacttcacctatcaagttcataacctgagcaccacatgtgtttagcagaacacagtggctgctgataatgaattgcagtagttgaatagcactgataatgatatctcactaatgaactgcattccccaaccaacctgatgaataaactgaaacaaatcaagaccaaatatgataggaataggttcatgagtgctataaccacacagcactataaatcttttttgagtttctagtttcatgaaaacaaaaacatctagtctaagatgatgaaaaacaaaaagtaaggacaataaatttaaacctatttccaacttatttttcatacttgaaatgcatcgcttgggtaataaaacttcggatggtttctttatttataaacttgtaaaaattccaggcatgattaaaattaactcttcatttataaaaacatctcattgcaagttaaacactgaactaacaacttagagttctatgatatataccatttctgagtttttcttttctttgatcagacttttaagatcttaacttagcaacagatgaactaacatacgctctgaatagtgaaagaatcaagaaaatcactttgcagcgaacttaaccatacaagttctaacagcaggagaaaagatatccatgtacatatatggaactagacaagacattgattgaaaagtatatacagttaaaatgcagtagaaatcaagcatctcaaacagaatgtatcaagccattccaccaaagaaccccaaagaaggcatgtatggcatatcaactgctatgcttctgtccacacacgagaagcgggtgaggagaggatcaaggtgtacctggtgccgtggatctgggcttgaagaagactgtttcgactctgtgcagcactgtacagcggggatgaagggaggaggcgcctgcaccgaggatggaagggaggcggcgccggcactgggaaggaaggggatgcggtgccttaggggaagcaggcggatgcggtgggaggcgctggcgccgccgccggtgcgcgacgagaggaggcgccggcgcgcgacgagacaacaaggagaggcggcgcgggagccgctcgagaagagaagacgggaggcggcccggagtggtggatttccaccggttaagttagtggatggatttctctagggtttggggtgtaatgggccggcatatccaccttccggggccgaaattttaccaggattaagttcaccggtagtacctcaacttttatattgagttgtttgacgtcccttatctccaataccagaaatcttcagccctaacatatacaataccgtgtattttgggtcgtgtagcagtatggatagctggtttcgctgacgtgatatcctagtcagcaaaataaaaatagagtaaaagttgcagtcttgtgataatttccccacgctattgttgcagcaaaccgaaatatattacatgttacagcaaactgatagttttatcactatagttgcagttttctgaaatacactcataaaaataatatgtgagtcccacatgtaagtgaagtgagaagaaaaaatacggggtctgcttgtcaatcccatcatcttagagagggggaggtcggcaagcctgggagagagaggaggatagaggcggctggcgatcctggcagccatgttcactgccacacccgatgacaacaaagatgacgatgcacatgtaccattgcagcgcccacccttccagcaccagcccatgcacatgaaggcggtgtcactcagcttcatcctcgcgcgtgttgacgagaaacacggtagtctgggagatatgcttaacttcagtgcaggtccaagacttgtcttgagtgtgctaagggcgtgtcagctggtttgatcctgcaacaagcaaggaaaaaataagcaaagtgagttagccaatagccgatcagccgataggtcgatgacgtattgttgatggactcagccaatatagttagaccaaatcggctataggctaagtaggtcaaagaatataaaaccctaaatatgtcgcatcggctgtaatatcatctacttagcttgataaatagatttcaaatgatatcatgaaaatagttgatggaacaatatttagagcaagatatagttaaaaataatgtaccagctagtactctattacatacttatataaacaaatcaatctatagaattatatcaaatagagatcaattaccaggtattatgaatgaaagtgttgataacgtattatgagtcattcatttattgatcaatgtggtacaatttatagatgggaaaggggtggcaaccgtagacgcgatggttgttgccaaggagtgccaagtggggagaaggcgcggttgcgatcctatctttatatggacgagatcaccctatagctagtttcttaacacatttgaaagattatttacattaaaaacaataaaacaaaaatattttgtatagcatataatagataaattatatttttaaaaaggtaaaatgaaaaatctaaaacttatatacgaactttcatattgtgtaaggaggccatatgaaaaaatttaaacttggatatatcaattgttaagcttatatattcataaggcaattttgggttttttgaaaaaaggcccaacccaatgatgcactgtaaaacaatcttcagaaaaagctaataattgttgaactaagataaactcagttgtataagataatccactcctataatttttataagagttattctttatatgcggtaagacctatactacaattgcaacattagatatataacaaaaaaaaaactcagcctaaagttgaaccacagccaccgaaagggcgggatccatggcatagtctttgcttcattatccaacaagagaaagaactcagtgctgggtccactggaagaataaagaaaaaggaaaaaagagcattgctcttctttgtcggttcgttgcttgagcagtgagccagtgagtacatgttcctctttctcctcttcacgatctaacgccatggcacgatggcttggccttggggatggtagacggcagacctgtatccatattgaatgagggtctgtttgagggagctgagattctgagaagctagctggagattctgagaagctgacctgagcctgattggggagcttctatgggtttgctgattggtgtgctaagatgctgaattccctgaaatacccctgaagtagatgatcctgattgtttgataactatttgttgtgtagggtaaacccatgtacatacaaatttttaaaagtactgttgtgaatactgaactctcataattgtagctaataaaaaagtcattgctccaattttttaaggcaataaggagggtcaaattaatcacttaatgcaaacacatacattgtacttttccacctaaatgtgttcatcaagcacatacaaaagcctaatttgccatcgctatatatgcaaataacaaagtactaattaattaaccactaccatatatacatcaaccacatagcaaaatacaacctgaaccatatgcatagttttatgtaccgcgtcgtctatttgccatcagagagtttgcaattaaatcccgaaaggtgcacatgtcaccatcatctggtgctgtgctaacatacggttcttcttcttcttcagatgaatcgattggtggcatatagtcttcatcattgtcactcactgtgcagcagtggggaatagggtgctgtagctcggcagggaggagggggatccctcacggcgacgttggaccggcgagctgatgggggcgtcgcgcgaggagggacagaggagctgacggacgcgaggagggacagaggagctgacgacgagccgaaacggaggggaggaagggccgtccgccgggctccggcaaggaaggaccgcaggagggcgttggtgcggacctctcacatctggcgcggcgtcggcgtcggcgccgccccccacgtgcgcgcggcgacctggggctcggcctgggcgcgacgaaggacagctcggcggcgactccggcgagcgcgcgggggctggttccggcggggaggcgctgcgccgcgccgctcgcccctgcctcgtctctctctctcgcgcggctcggtgtgttcgacagggaagcgttggatgagggggagaggggtgtacctcagtggcaaaggtgggtaatttcctacaactttaatgggctcatcccttagaatctcgggaagctgagaaaag

SEQ ID NO: 60272 - DNA, 2501 bp, Oryza sativa
cggggggcgggagtgcgcacgtatttatttttaattttttgttggccggggggcacgtccctgtttgccagtacatttttggcgcaatttggggctgatttcaagattattttttttgcacgtgccccctgtgccccccccccggatccgccactgtagaaggctcatagtggttcgaaaatgtggccagcgctcgtacgtacgtgatcacgtgatatccgccatctttgttagtcctctttttgtgttggccgcatttttctcaacgacagttcaggctggaattctcgaaatttgtgagctgaaaagatcgagcactaagcaaaatggcggcgtgtgcactcgagcggatctcacagcgcgttcaacggccacacgtctaatcgtgcattgtgaattgggatgagcactctacgtattttacagttctgtgcacttgatcgacccatgcactcaacgctgtgagttatggtcgacttcttttatgagacaaatccaagcaaacgtttccatatgctcaggttattgcaaacaatagactcccgttacaatgtaccaatcaaattgtgtgcagtaagaatgtacaaaatcgacttcctcaataaaaatctactaagctttctatggaccaacatataaggaccatgaagaaaataaagaataacatgaaaccaagctcatggaatccaagtcggacttgagttacgtgcggtccatattttttgtaagttctaactaaacgcttgattacaggtgggccgagtaatctactcattggttgcctttaggttgggtgagagtgcatttaactcctatctaatctctttaagctcttattctgaatatagttttaagacatggaactactagcatacaagacaaaactgttttttcgtcgataagtatatttcaagtgataggagcctacagataaaatgcacatataaaggggcatgttcccgccagtgcagttatcgctgctctagtcatcgccatcttggttccgaaggtcgacttctaatttgcatacagctgtcaatcaaagtacgcgcggcctggcctgccttcgccaagccagctgattgctgccgatcgcgacgtcacgaaagtgggcggaaacagcagccgaatcttagagccgaactgcgattggtattacttcggcacatgtatgtgataatcggcattgtccgggcattcggaacatgccatctgcgtaagagccgtattctgttgatgtcaataggcagctagcaccgtccgccagcgggtacgtattttgaacgccctctggaatacggggaacatgcccctttaagtgaaatcaggaaacccatattggtatctttaaacaaaataaaagaagatttagcctatatacatatgtgttggagaaagtaaaaagggcacttaaatatcaaaaggaaaaggacacctgttagaatagaaaaggagcacatgtcaaattacaaagggtaaacagaggtgaaaatgtgcacttcttgcacctaaaaaggggcactcacaagatagtgaaaatagggcgcttttgagaatggaaaaggggcatctatcagagcatttctgagcattcctgtccaatacatgaatacaaaagtcaaatatttagtcaattagatatgaaaatatcatacataaaattatctggtgcccggatgtgacaatattcaggcacatgactgtcaaagagatattctggcacctcgttgacgacctgggtattcaggcacttcactggctataatcatactgtttctaaatgtagcgagcgagtgaagcgagcaaggaaaaaacatttaattgctcttaaaatgttacttctttaggaaaatatgaagtctctaatattttgttaccatgaaattgacctttatctttcaatggatcctaaaatagatctttaattaatttctgtcgcggcacccctagagacttctcgaaaagggtgccgttacgataaaaaggttgaaaaacgctgcttttatatgacgtttcttttacgatatttaagtcttctagtctgtaagctcttttcgccttagatgatactttatgtttctttataacatagtttcagataaatttccttcagtctgaaaggataaagtaaagtaatgtacataattacctcgggtccgtagaaagccgaaacggtccatatacctaaggctggatgactatggaacctatactcgcctgataggaacccggaaggcagggcttgagtctgtctgagtctttttacactggtcccacttggatcaattatttcgacgtggagctataaaaacaagaatgagaaaaagatgattggagttgaaaaaaggaagattaaaaagggaaatatcattgctttgctgctttagaaaccgtaaggtaatgacactatactgtcgctagtttaacgaaattctcaactttaaaaccctggtcagtacacacctaacctgaaactctatggcccgaattcacaaaggagg

SEQ ID NO: 60273 - DNA, 3001 bp, Oryza sativa
ccgatccagcggcccgttgattggctgagtaccgtatgcgtcggcaaataggcctggtgtattagccgaaccagcggccgaatccagcggcctggtgattggtcgatcaccgtgtgcgtcgaccaataggcattgtgcgttattgttccaattatcgatcgaattatggaccgctccgcacggtcctcccgtagagtataaaagacccttgcttacagtagtttttatcacctgacgaagtatcgcagtagcatacgaaacgtcgtgatcttttagattccttattgaccacattgcgagacaaacgaatatcactagcgatattattttcgatactatatccgcaatgagtaatatatttagcaagggaaaagttgcttgaatgacttaatagtgacattatcaacttactagtaattcagaattccagtacgactatcacttgaatttataattattttttttagattgtatcccgtaatagcggaaatatttaaaatttgacatttttagtagtttccctctttattatcttggctaaatgcaactcgaacaaaaaaaaaatcttccttgaatacaattaagctacaatttcatttaaaataaaaatcgtataaatgcatatgattattacagtatagtaacattaaaaagtagtaacaaagcaataaattacgtacagaacaaaatttaaataaaggaaaatacaatgggtatttcaaatacagcataacagaaatatggacaaacgcatacatataaagagaaaagttacaatgtatacgttgatcaacagaacaaaagtgagggaaactaaataacaaataaaaaaaagtttaaatttatacaatatataaatgcataaagacaaactaaaatgttatatgtatgtgatgacctaaacaacagctttccaattgtgcccaattgctgtcctcccttttggggaattgtttgcaaaaaaggttgaaaaaatgtacccaccgggaaccgaactggcttaaaacaccaattggttgaaaatacatgtatgagtcagaatagctgtaaataaagctaataacctatacaacagcttggcaactctcgaggaaatatttataatgtaaaaggaaatgagagaatcaatggatgcgcagcaaaaaaaaatcaaaatggagtacaatctaataatttgcaattaacaattacaaagtgtcttaacaatttcttctagaatacggaggattactttttctcgagtttttttacatctagtaaaaatgtgagtactatgcaaatattgattgcaagcgttattttcttcaaacataacttcttacttttaacagaaactaaacttttattcatggtaaagagtaaatcttttgaggagagccctatacaggaatttatcttcttttggtgattaacaggctttatagctgataggttccatttttgtttgttattttaggcctactttgttttatgtattctatattatggttataatccattttgttcatgggaataagataagatgagatgtatattatataaataattgaaacaatgaattacgtaactaaccgaataactaactgactaaaaataatgttaaaaataccgtaccgtcttggttaggggtgtagattggcttgtccgtctgtacgaagacgtaaccagattgaagagtgaccaggatttctgtttccttttggaatgggtagctagggtccagagattcagcctttaagaccatgtgttggaaatctccttcatttctcatcaaattatcggcttgaatttcgaccgtaaaaagttgagatgaacctagatcaaagcaaaggggtatagtcagtggtattttctatggagctcgttcagaagtaaacggctttttctcatttccaccatgtccatgtgtgcataaatggcaactgcgcaacatagttcactacgcgtctcagctctgtgtttgctaaagattttaagtcattgaagaaaattgaaactgccgcagttgaaatctgattgatgcttaatcgtatttcaccattcatgtttaacagagttggtgtgaccatatggaaatcacaacataaggctcatttacacatccaaaataccattttgaagaaaaaaaatcatcgatattttgaactaccatttacaatactggaaaaaccaatgaaaaaccttcgaagtttgctcatacctgttttttttttggtgagtagtgctcatgtgcgactcgttggtgccccgtatgccctgtatgaaaaaatgacccctaaaaatctaaaaaaaccataaatttctcataccaactctgtttcgtctcaatttcttacagtatctttatatcataattgagcatacccatgcagaatttcacgctctaatggctatgcacaaaataaatagcgccctctataaatttctgaaattggttttctttctgtggccgtagcttcatcgtgtctggccgaacccggagccattttggatttagatacttgaatatcaagacttccagcaaaatatacaaatatataccctaacgctgaccgactttttaaaaaattgccctctaaatttgcaggtttcaagaaaattgcgaaataacttcaacttcctcaaaaatggcgatcttgatacctacgtcaacgaaacttagcagacaaatgtaaccatacacctgacaatggtttgtcaagtttggtaaaaattgatgacgatatgatgattgatatttactatgcaacacgtaacagcccgttaaatgcgtggagtacattatgtgtatattaaaatggtttcagactgaccgcaatgaagtgcccttttgaatgataccaagtacggtatatgttcacgcagacaattttgagtaaatcgcatttgaacaagggttactgtacgtattccgctgagtatccgcctagttataacacgtatcggctatgacgtcatttttacagactgcttttcccaatccatgttggcccgaattcac

SEQ ID NO: 60274 - DNA, 6701 bp, Oryza sativa
aataaatgtctcatagtctggcttacagtgcttcttatttaaagcgactgagagcaatctttctcaaatttgctccaaaactcgctagcttcactcgatcgcatatatgattgattaactagcatattaggggtcttattcattgttttattgtgagattgtgcttaaaacccaccagagtccgttattttaatgacaacaaatcggtcgcagtgaggccttaaaattatattaacattcttgctcgcttgctttgctcactttcaaataaatattcacccaatcacacaaaacagcaaagtatggtgctcaagcaggatcttggaccacgtaacgagtcaatcttgaagatcatccctgatataaattacaatttaggatgtatacgatgtttaaaaatggttatttatggctttgaggttaccccttgtaggtgcacttttttaagtttgaagtttgaagtttaaattattccacattttacatagaaaaacagtttatattcttttcttttttatacaggcgtatattatattgagaaatgatttcacacaagagactgcacatttttattagtgccccaacctctatgaaagaccctctgtcgcccttgctattaaggttggaatttcgtttactacctgggctgacagctcttgtatcttccgaaaaatgtacacccgaaccaggccgcctcaaagagactctcacttgaacattctgaacgtttggtgtggatctgatgagggttacgacgacgctctcgggcacatcaacccgaaacacgttgggagaggtcacgaaaaaggtgctgtataagagagaagaaggaatatagagaataaagagagacgtatgagagagagagagtgaaagagaaagagaagagatgtgataaggagaggtaaaagagagagatagacatagacagacagagagagagagagagagagaaggagacagaaagaatgggtagagtgagagagagagagagagagaggggggggggaagaagaagataaagagagagagggtaaaaaagaaggagagaaagttataaagagagagagagagagagagcggatatgaactaagaagagctggtatggtgtggtattcattttcaaaatcataattaaaaaagcccacaatacacacaaaatggaaagtacgtgtaaaatcaaaattatatagaaaacggattgatagcggcccactctttgtaaaaacgagttgatacaaatacaacttgaacgtacattaaaaagaaaagaaacccaaataattatactcttaatcggaaattaaggacatctagagctcatagtacacatctattattgtaaccccccccccctctcccgccaaacttaattggcataaaagatacatcctttaaagatcacagcaaaaatgatttcgtatattcaaatgtttgcagaaagtgctcgagttcttcgataatttaatataaaatggtaggtcattgtattgacgtgaccctcggttaaaacatcacgaaaaagtgagagggagagagagagagagaaagagcatcttactccaatgacatgactttagaatgtaaaataaaacactacataaaattatgcctaatgtgtgctgacgatgatgcaggttaccctggtggcaataagatttataacggatgtttgacgacataaaaggtgaatggaaaagtaactttttgaataattatgacaaagacctcacgtaaatgacgtaaaaagaaatgtccatgtaaaaatgataataaccacatttgattgattttggattatatacatacattgtaaaaagttttagaagaaaaacaaacccatagaaaacgttaatgcacagtttctgtaaaaccactctaatcgacagagaaatactttttaaaagtgagaaagagaatactctcattatattaatcctatattttgtaataccttgtggcttctggttctttgttgatggtgccacttcctatttatttgcgtaacaaaatatgctagtgcacatcaacattttacaccaaatacgacattttgcgtaaacacaggtacaaaatattttgtttatactttttcggcttatcgattacacacaaactaaaagtaaccatttccacggaagaaaaaagattcatacgcctgcataatcatgtttgcaaacatgaaacagagggagagagagagaaataggggagagggggggggggggggaggagaggagcgaggggagggggaggggggggggagaagaaaccgaaaatgaaaataatcgagagggaaacgaattgaaattcaaaagaacttgtacaagtgaaacgcctttggcgaaatcctgcatttttagacgtgttttaggtaagcctatatgccaagagacataaaatgcttcgggccatcaaggctacatggagtttggtccgaaagttcagtaatccgaagtttcacgtttcatgtatttcgaattctgttactacgaatgctcgtttgttccaaaggttcgttattccgaaaatggaatagggttcaaggatagaatggggtctcaagtgttcacaaggttcttaatttcgaaacgcaatagaattaagaaccatcttcacaagattttggaaagattcggaataatacccacatcatcctcgatattatcaactttcggattaagaaaatttctgaatataacgaaactttggaacttaccatgaaccttcatagaaatatacaccaattgcttgaaattatgaaacctattcatttcttcaaaagtattaacgcctggtggaagaaatggggaattacaaaaatacatacaatagaagtatacagtgcgtataaaaaaaaatgtacccagctttagtagctcctgattaacaattcataaccaatatgattttgaacttgatttcatattgaagagtaccttatttttcgtccgatgatgacctatttataatatttttgccacggatgaatgagcaccagggtctttaaaaagtgttgtcgaaatcgccttgtaccaagtttgggcttaaggaacgaatatgggtcaggccattatatgcatgtgcttatttggtcttaaatccttttaaaagttaaatttatgcctcatgcttcagtgcttcagtgtttaaaatgatgcgttttatctagtctttttaagaaccttgttacaggataacctttaattattttgaacagcctcataacttcttgtctcatgacatctaaattctctgtgctcacttttccgctgcgccatttgtttatctcgaatagcgaatgaaaactcaaacttgactaaacccatatgcaacacagaacacatatgatgataaatatcaaataaattgacaggagactttcatgaaaaaatataacatcccccaaaaaaattatccattttgtatcacttaatgagaaggtttaccttaaacaagggatgcgaatgaagtcaaaattgtaatcatcgtaacgaagagaatatcataaatgtttacgtgtaataagcatttccttgagtttgagttgttattaatacctttttttattccactgtctaaaagtcaatgtaaataaatgagcatttgcttttggaatgagataacactctcataataccttttgacccccattcatttacaagaggattttgaaaatacttttaaaaagcctgttgttcaataatcctcggcagtagaattatgaacatgtattattttacagggtattggttcctctttacgatgaaatatgatacaaggtcacatactcataactttgaaataagaaagctacctaagtagggtacattatttgttatgcacactgtacaataaggaaggtgaaaacaaatagttataaaaagacggacggaatagataaaaaacatgggagattgtgagaaaagaatacgtaaataaatatttgtaataatatcaaaactggaaggaggccattgttacttacgcaggtgaactttgagtcacccctcccggtacaagtgatgcactaatcgcgattacaaagatgagaacaaacgaccccatggtgatcgagacacccattcattgacaacgtcttcggcaaggtgtttcgtcttcaccaaatctaggaggaatctgcagcaccttgactgatcatgcagtaggttagaattcaaaaggggtgccacaccgacgacggcaaacgctcaattgacgttcgtatcaggcagcaacgagttttattgcgcccaatgttgtgaacttctagttccttaaagtaaaccggtaacattgttgaaggttgatgaaaaaatgcgtaactttggtatgaaatgttacttgttatcttccttctactgtacttactctctaacatgccacaaatcctgacaaaattctcaaacctcaaagatatttatggttttctttgaaggcgtagatatgtaacccccattctaacagtaagttttcccaaccaatcttttaattttccaaaccgtttttccatgaatggaatggtatatagagccaattcattgctttgtgacgatttacattcacctaaaatgtaatcaaattataataatatagctgggagaattaaggaatccatcagataatttttttctaatttttatcattaataatgttctgctttcactcaaactttcagattatctttaattgtacatctagcattgtagttaccaaacggaaaagtcatcaaactactactcctactaatactttagcaccattttccctcatttgaacaacgttaccaagtccctttaattggtcttttatgtcgaggtctgagaaatcgtataacttccaggtgtttgtataactaggaattgacagctactttcaatgtattgattccttgtcttaacccataacgagaaatacccctccccttgaaaaagaagaaggaaaaaaagaccgttttgattcatatccgtttctatcataacatgtaatttagaggaatacgaccaatattaatttgttctgactaggtagacattgtcagaggcagtatttcctttctctttctctctctctctgaccctctctctctctctctatctcctctctcttactctcactctctttctctttctccctcttcctctcctccaacttcttcccccttttctctctctttctgactcaccctctccacccctctcttaatctctctctctctatccctcttttttatataaacttttttaatagttctctgggacttttgtagagtctgttggtccctagatcatctgaggtgacctcttttcctggatgaggaaagaaagatcatgagggatcaaaataacaggaaatgaatcccacctcgtattcgacctaggtctgcttgtcgaaaacatagaaaaagaccccaaacatgatttcgcaatgaaagtatgctatcttttactaggcagatttcctgatagtttacagacaaaaagcctttttaatcgctgtgcgtatcagagtctgcacagtgagactaggctgaaagcttactgtaaaggctctacttgctgatttgatgcagccagatgtggtaacgtgtcaaatttgagtggattccttgactatgacaacagtaagaaaggcattaataatctgtttaagtaggcctgtgtaagtaaaaatccctctggttcaagttttattataatatccatagtgttaggaataacgatagattcatgtgtttaaagataaagttgagttctggtcaccctgcagcattgtgaaagaaacagtgtggcatcgatcagaaaaagttgatgatgtagcatgtaagtattgatgtgtactgcaagtttctggaatcatcaacatgataagaaatttggctcagtcttggtaaaagtaacaagcactgtacacagaaaaaatgtatatgggactacacaaacacgtggcaaaaaaatagaatatgaaggtatttgacgagccatgcttttcagggaaaatttgtttctctgatgttcttccacacttgcataataacaatgaaatcgctaacaaattattttcccctcaccccacaaatcaactttctcgttaagcaattttttcttgtgccaaaagagtgtggctcgcagtcgtgtagtgaccaagataagagctggggtctcacagagtcctacctttccccttcttctcgttggcctgcgagcgggcggtaaagggacgtttcgtccaaggtgctacacatcccacccttaccccactttcaaagatcgagtcgatattgtatggtttgttggtttgatatttgtgttttcatttgtttgtattgtcactttgtttgattcattttcgttttgatttgttctgttttcgcttgatctggaattttcgaacacaaagtgtgatccctatcaggtgattaccttataccctcgactcccctagtaacaaaaagaaaaatatcacccccacagggcctgcctgtcccatcttcctatcaatgctaacaatataataatattcactatagggaatatgaataatttaaaacctttctatttcacgtgagaatgtacgtacttgtttcgtgaaacaatttgttttattaattccttgttgctttagaatatggaggattttggacccaggatagtcttatgtttttttcttatcttagtggatgttggaccccccccctccc

SEQ ID NO: 60275 - DNA, 12141 bp, Oryza sativa
ttgaaattattaggattgagacggatattgatagcttcttttaccctccgtgtataccaatgccgttcttgggaaaggcactgaaccccgtcccagtctggttgatgctggttgtcccaagcatgttcggctacggctgagttgtcagttcgacggagtctgacgtccctcttatgctcagtgattctttcttttatcggacgggcagtttcaccgatgtaggatctatcacatcctttacaagggatgttgtacacaatgccgtcccgtctatgtggaggaattggatccttggggcgtgtaagttgttgacgtagggtggtatctgatctgaaaaccgttcgaatgccatggcgttattgttccaattatcgatcgaattttagaccgctttacggtcctcccgtaaagtataaaagacccttgcttacaacagtttttatcacctgacgaagtattgcagtagcatacgaaacgtcgtgatcttttagattccttattgaccacattgcgagacaaacgaatatcactagcgatattattttcgatataatagtatagttgggaaaatttaggaatcgatcagattacttttccacaattgttataattaatactggtccgtttttactcaaattttcaaattatctttaattgtacattttacatttaagtcactaccttaaggcccggtcacacagaggggacgcatggggaacgcacggccagcgcattggaaatttgcaattttggccagtgcgttgtcgtgcgcccaacttttgtcgtagctgacaccaaattcatagcgtgttgctagcgcgctgagcgcatacagggcgcatacagtgcgcatacagaccgtacccagagcgcacatgataacaacttccacgaatgcacagcgtgttgctagcgcgctggacgaatggtccacgcatgcaccgcgttctacgacgcacggccagcgcattgggaatcggaaaaggccgtgtgcctaacttttgtcatgattttggaaaagctagcgagctgacacaaaatgcacagcgtgtagctagcgcgctgtgcgtatacagggcgtgtgctccgcgtatgtctggcgctggactagcgcgctcaacgcacgtctgggtgccttcggcgtgtacattcatgcgtcgagctccgcgcacacttttgagcatgctcaaaaaatcccgacgcacacagcgaatgacgacgaatgcatagcgctggtccagcgttgttccagcgcgctcgacgaacgagtaacgaatgatgacgcacgcctagcgaaggacaacgcactggcccaaattgcaaatttccaatgcgctggccgtgcgtcccccatgcgtcccctctgtgtgaccgggcctttagcaccattttctcttatctgaacaatgttacttggtccctgtaattggtcttttatgtcggagatccgggattttgcataactttcatgtgtttgtataagtaggaagcgacaaccgcgttcacttaattgatttattttctttatccatagcgagaatcctggcaaaaaatattaccccccccccccacaaaacaaataaaacaaatattagtttgggtttatatccgtatctattataacatttaatttagaggaatacgaccaatattaatttgttctgaccacgtgtaccgctttctctctctctctctctgtgactatctctctatctccctctctctcactttcaccctctctctctctcattctcccttcctcccccttcttccccctctctcccttttttctatatattgtttaatatagttccctgggatttttgtagagtctgttgatcctttaattatctgaggtgaactctgctcatggatgaggaaagaaagatcatgagagttcaaaataataagcaaataattaccgttggtgaaggtgatgggacaaactatcatttccgaggcgatctggatgtagctatatttccgaagcggagctgaggaaagatagcgtatacattctgatcgaaaaggaagtgatagtttgccatcgcctgaaaccaaaaggtcattatttgctttataatccccattaaaacaatttatctacaaaaagaaaaggacgtgtatgcatttacataaaagacacctaggcccaaattcacacccaaaaggtttaagttaaaccaaaccccttgagggtacggtgcgcgcatgtgttttctttaattgcgctcaatggtaatgcgcgcctaattacgcctgttttagtgcgcttttggataatctttagtgaaagtgagttgccctgtgtagatagtacctctatcttcagtgaaagtgcgttgcactgtgtagatagtagtactatctacacagtgtaacgaactttttgcttctcccttcaataatgggcgaactatctttcatcacgtgatttacttttgaccaatcgtagagcaatattcttagtatgtggaatataacaagaaataataaccatctcttgatgcagccagagactgacagagcttcccctctctttcccctccctctcttccttttttctatatactttttaaatagttccctaggatttttgtagagtctgtttatcctttgattatccgaggtgaactctgctcatggatgaggaaagaaagatcatgagagttcaaaataacaggaaataatacccatctcttgatgcagccagagactgacagagcttcccatctctctcccctctctctcccttttttatatatacattttaaatagttccctgggatttgtgcagagtctgttgataccttgattatctgaggtaaactctgctcatggttgaggaaagaaagatcatgagagttcaaaataacaggaaataatacccatctcttgatgcagccagagactgacagagcttcccctctctttcccctctctctctcccttttttctatatactttttaaatagttccctgggatttgtgtagagtctgttgataccttgattatatgaggtaacctctgctcatggttgaggaaagaaagatcatgagagttcaaaataacaggaaataatacccatctcttgatgcagccagagactgacagagcttcccctctctctctttttttctatatactttttaaatagttccctgggatttgtgtagagtctgttgatcccttgattatctgaggtaaactctgctcctggatgacgaaagaaagatcaggcccccccccaaaaaaaaaaaaataataataatttggttatcctcgaccgcctgctcgtcatttttgggctgctcgtattattattattatttttttttaattctatttttttttgtatttgattttttgttctgggggggggggggggagtaatcttaaatgccaaacataccattttgcaaggatcaaaacgcgtcctgttgccagtttggtcttttcagtacgcaattctgtatttattaaacttgtcatttttatttttatatgtcaaaaatgccgttcatttaaatcaggttctgagcattcttaaattcattttaaagcacatctgtactagtttacaggagggattagaccaccctgcaaggtcactggacaggtggttatctcatcaaatcagctctaagttaccaaaatataaagaggatcatgggggaccaatggccaccgattaggcattgtttggaatattatgggcgcaagtaccgataagtagtacagtgggaatttaaaaggtgctgtatttcaaagccaaaaatactttctgtattggatttgctattcattgtacatcaaactagtcttttaccatattaaagtgttgtatagactttgttgttgaaatgcttgacatccaaatgactttttttttgttagggaaaaatatttataaaacaaataataacaaaataaaaaaaatccacccgcccgcccctactccagaaaagcaatcgagaacaaccaaatgattttttttgttgggcctcatgagagttcaaaataacaggaaataaaacccatctctcctggatgaggaaagaaagatcatgagagttcaaactaacaggaaataatacccatctcttgatgcagccagagactgaaagagcttcccctctctctcccctctctctcccttttttctatatactttttaaatagttcgctgggatttttgtcgagtctgtttatcctttgattatccgaggtgaagtctgctcatggatgaggaaagaaagatcatgagagttcaaaataacaggaaataatacccatctctgtatgcagccagagactgacagagcttcccctctctctcccttttttctatatactttttaaatagttccctgggatttttgtagagtctgttgatcctttgattatctgaggtgaactctgctcatggttgaggaaagaaagatcatgagagttcaaaataacaggaaataataccaatctcttgatgcagccagagactgacagagctagactctactcaatgcatgctttaggatttgtgtcaattcggagtgtgtgcttgctgactggtttccttgagtagataatagtaagaagggcatttatgctcttttcaggtgggctgtataacgtacagaccacctaataatttcgttagaattgcctttatttatttattatatatttttcttatttctaaccacttttttgttggcaagataacttgaaaatggctcaatcaaatgccttgaaatttggcacacatatgtataggcatatgtacaaagcacaataacgttttcaacattgaccttcactgatgacgtcatctaggcgccattttgtaaaatgttacgaaaatcaactcatgatcatatcttcataaccaaaagatatttctcattcatatttaccatgatcaaggtcaatatccgtccggtcaatttcaggtcaaataacgcgcgcgtgcgcgtacgtccgcgcgtcaatgcgcgcgcaaaattttgaaatgctcaaaatcgtctcaaaatcattttgcatacattttaggccattctaagcattttataaaaaaatcgcgcacacacgcattcgcgcgcgttttcgcgcgtaaaactattgcacaacatagaattgcctttttttttctttcataatattccacatatatttacaaacaaattgacaccacgtttgtctctttatgactattaataagggattgatcgaccgtttaacaaaaatttccgtgcgcgcgagctcttgtaatacatagcatatatgggcaaaaacatgcctatacaaaatccattgtagctctttaggatgcaaggtgaccccaatttgttttcatattttaatagagtatgattcgaagatattgtttcatgtctcatttgaccctcaattaactcatgacgtcatcataatggcctccgaactcaaaattccaatttgcatattatgacttcagcatatttatggaaaattgattgaatctctgtaaatattgatcgattttcttccaaattttgatatgttctagctgagacgattttctacaaatgcagttactattattcttcattttgacaaaggcatcatggcgtgtttttgcggttgaaggaggcatgtcaattttttacattttgcgtgtattctttatgggacatgactttttctcaaaactcgattctacattcccgtctttcgcgagcaatatctacgtcgttttagcttcgtttatgctgaacttcgagtatgttgtagatgagacaaaaatttatctcaaatgtaccctttattttgttttaattctttgttggatcagcccacctatacttgttccaaacaagtattacaaatctagttaagtagtctaatccctctggttaatctttgttttggtttgttctgttttcgcttgacctggaattttgggacgccagttgtgatccccatcagggcattaccttataccctcaactccccaagtgatgaaaagaaaaaaaatcacccccacatttaagtaactacattagcaccattttctcttatctatttttttaaattttagtccctttaattggtattttatatcaaggtctctgacttcgcataattttaatgtgttggcataattaggaagcgacaaacgctttcatttatttgattccttgtctttatccatatcaacaatcctgaatttgtaaaaaaattcctccccaacaaagttttggcaaggtttatatccatatctatgataaaattacatttaaaggaatatgaccaatattagttttgttctgactacgtagaatttgtcagaggcaatactttcttgatatttctctcttttccctctctttttgaccatctctctatctcctcctctctctctctcattcactctctctctctctctctccctctctccctctctctctctccccctcctcacctcctcccccttctcccctctctccctttgttctatatacttgtttagcaattcctttggacttttgtagagtctgttgatcctttgattatcggaggtgaactctgctcatggatgagaaaagaaagatcacgagagttcaaaataacaggaaataatacccatctctcctggatgaggaaagaaagatcacgagagttcaaaataacaggaaaaatacgcatatcttgatgcagccagaaaccgacagagcttcccctctctctcccttttttctttatactttttaaatagttccctgggacttttgtagagtctgtagatcccttgattatctgaggtgaactctgctcatggatgaggaaagaaagatcgtgagagttcaaaataacaggaaataatacccatctcccctggatgaggaaagaaagatcacgagagttcaaaataacagggaaaaatacccatctcttgatgcagccagagactggcagagcttcccctctctctcccctctctctcccatctctctcccatctctctcccttttttctatatactttttaaagagttccctgggacttttgtagagtctgttgatcctttgattatccgaggtgaactctgctaatggatgaggaaagaaagctcatgagagttcaaaataacaggaaataataccaatctctttatgcagccagagactgacagagctagactctactcaatgcatgctttaggatttgtgtcaattcggagtgtgtgcctgcagcctagtttccttgagtagattccttaaccatgataataataagaagggcatttatactcttttgaagtaggcctgtgtattaagtcaaaatccctctggttcaagttgtatgttaattaatatccatagtgttatgaataacgatagagtcatgtgttaaagaattccccttttttattttgccatatgatctaatcggtcgaaatgcgacctcttcaattttttgactcgttcccttagctcgcgtccgacgatcacactcaactgcaaggcattgtggtgaagcattatcttagaccacgtcgagagaaaatctttaaagtcatccctgagaatgtagtaggagtatatataaatgtttaaaaaatggaattcttctccagtgcaggtgcacgttcccccacccagaaagtaccatctttgttggagcccccccccccccctcacgttacaagatgctccgccaccactggatcatagtcgaccaaaggttgataccccctcccccatgcctgagcctacactacgccactgtctatcattataatttataataattacagaaagagagagagaaagagaggacaaaagagagagagagagagagagagggaggggggggggggttggggtagggagagagaaagggggccatgtctttgtagtttaaaagtcattcattaggacgaattatttttgttttaatcgccattttcatgtttctggaataaagacaaaataatgctatcaatatgtgtataatatgttttagaataaaatgagacaatacagaaaacagatctatgaaattgtctttaaaggtaggtatcccttttgcagccaacagccaacatgaattatgaatttgtcacgtatgtcctatctgagaaatgttaactttagcagtgccctactattcaaatttacccgtttactttttagacttcactgtcagacactattgagtgactgactgaccttttttctttggtaataacatacataaaatgagctgtaaatgatatgagcttttgtacacatcactaacccgcttcttgtaatggtcaaaattaagctgcttaaatctttgcgcagctcaaaacgtaagaccgcacgtaacaaggctctgaaaatcagactattttcgacgcattaatttaaggagcgcgtttcgtaaattcctaccggtcgatagatttcaataaagcggcaattaccagttctaatcttttaagatgagttttaatttggtattatattttgtttaccccaggatttacataattctatattttcagcttgcaaaagggacacacctcctttaagagagaaggagagatgatttctatcgaaatgaaatgattgtttgtttgtttgtttattttattttagcacggtagcacttcagccaatggctgttcttcagcatggccgtgcatataaaaagcaatcacaattttacaaagaaacatacatataaatatagattaacatgatttacatacaaagttaaataaaaacatacacatatatataaacaaataggttagaaggcgagaaataaagaaacgagccctaatttagaaaagaatacgaacagaaaaaaacaaaaacataataggatattattttttttaaagaagaaaaacaaatcagttgtttttgtttgctattaaaagtaaacatgacattacaaatattatattataaactgcttttgaaagtatagtaagtttgtttatatttagtttctaccggtaattcattccatagttttgcaccataataacttagacttttcttttaaaagcaggttttgattcttggtaaagtaaatatacgaggagcatttcttaagctataggaagtgtatttaaaattaaatttacttaaaagataatccggggttgattggtctgcaattttatacattatacatagaacatggttgttacgtctttgtagaatttgtagttttttaatattttgtttcttcatattattccaaacaacatcacaataatctaatttaatttgagcaattgacttataaaaaagtaatgccgttttttgcgagatgcaatgttttattctttttagcaaatacaaattcttcacagtacttttacacaaatgtttcacatgtttatcccaatctaacgagttatcaatgtataccccaaggtatttacacacagtaacctggttcagttttttgttatcaataaaaacatctactttttttagatccaattagcattgtttcacatttctttgtatttagtgccaatcgattacatgaaagcaaatcagaagtattccgtaagtcttgattcaaatgattttcaatatcttatacagtattactagcataataaatgcaggtatcgtcggcatataatgaaacaaaacaatttttaagacagtttggtaagtcgttaataaagattaaaaatgaaagggtgtgtgtgaattttaaggataaatttacaattgatatcgatcatgagggccatattgaaggttttgaacaaaactcatgagcttcaggggacctgggtattaactaacataattattgtttcacttcattattactaaaatctatgaaagttatatctggtcccaacatgggtaagttcctaccgctggtctaattatactgctttgaacaaacaatagaatgctaataagagttgacaactttgaaatccattaccactagtgaaataacgaaataagccttcactgtaaaaaagaatttgttcattggtaatttttacgtattttttccatgtagaatttacttgaaaacattacttttgccacttacgcactaaatttaagtcttgctaactcaaactttcaatttagtagaacatacgtggaatatttaagtaaaatcaaatacataagaactttaagtaatttcagcttgtattaatttagtaattttaactcaaaatcagaaattatacgtattactcaaacaatttatgttgattattcttatctttttaaagtaaggaccgatgcagtgcgtaatagaaatatttacataatttatgaatattcattaagaccaaattaaactcttttttaaataaaaaacaattcttttttgtggttgaatgaaaatttaaggactttaaaacatttactaattcatttaacatggctaagcaaagacaagacaatttttaattgttacccagttcaaaacaaatcaaaacttgatatttcaggaaattgtcaaccaattttccttttaagatgctacgatcaagtatatataaaatttggagcctttcaatatgtgtcgaattgaagcgtatgtaatagtttgtgatggtggtagatatatatatacggttaaatcttaaatagaagtagtgaatgattagtggatgttacttgttagattagatggataccaaatcgtgcaatatgtaatcctatcatagcttttttttaattatctaaaatgattacaatacttaaattatttacgttaatgtaactcgatttaactgagtaaaaatgtattcagcaaaataagtaaattctacttaagatgccgtaggtaatatttacttaataaaaataaggcaattcttttcctcaattttattgagttatttcgactattattttttttacagtgttggagaagctgcagtgagtgaattaaggcagattatacgcaaatgatcggtttattattcaaagccattaaacaaatatgcagaaaagggttacattatccatgtcgtacacaaacattttgttaaaattattaatgtcatgtttttatttgtttatatacacatcatgataacggtcttttaaaatcgatgttcgtgtgtttttattttcgtaagagaaaaaaataaatgatataacaataataactagcacaacataattcgtaaacatatacattcaatattattgttttaattcatgtctctgttataaaagaaaaggtcatattcaagtaatattcaacgatgtataaacatacgattcaaacaaagaacaatcaggaaactcaagtgcaggaatggactttcgtttcaaggacattcatgaaggttactgaaacaatgagggccgattataatcaacgttttgccaaaagagtaatcttcttccggcttctttttcttcttaagcttttttataatcacgaacagtacttgcagctgctagattagagccatatataaacaatatttgaaaacaagaaactgcgcattataagttcagcatactcagtggcatttatttatgagaaatatcgtttttgttcctctcaatcatgaattgtacagattcgtttattgtggagggggtggttaatacaaaggataagtgcctcatatgttgtattgtaacgggttatgttttatacacaaggaaatgagggtaatatacagtagtaatatatcgtgattttttttctattactacgtgttttatatttgctaggtcctatgtaacattttgacatcacctatatcatttacatttgttcaagtagtaacagacttctaacaaattgctcttgatagtcctagagacgctctttcctctaccacgtaaaacacgggcgccaatgcatgcacatcgtcctaatatgattgtagttctagtattcttctttttcttcccctaaatcccattcgtttagcaaatagtgcttgttactcctattaaggtcccttccttgatcccgattcctttcaaaatgtgtaggcttaatctccagcttctaatgtagggcacttaatactctttattttccaaaatcactcacgcataaccgtccaggcgccattttgtccgttttaaccctaaaaaggccgggctatttgaggtcttgatacggctgggggggggggg

SEQ ID NO: 60276 - DNA, 2781 bp, Oryza sativa
ccacggaactatattctatctgaataaagtttgtcatgaccttgtcaggattgtatattataattaaaagaggttacaactaagaaatttaaaatgatttatatttcctgaattaaaagcgaaaaaacatctggatttcttgcaaaaaggtcggtcgatatgactttgtttctgaccccatcccactcccatgaaatcatgaactaaaaaaaaatgtttattgatcttcggtttaaagtccattaattaacaatttttcaggacaatgtttggatgtggttatctaagtatagttgagtgaaaagatgtccctatacccccgctttaatttctacaagtatcgcccactctctaccaaggttcaagaaaacaacggaaccaatgtctacttcttggaattgttccaagtaacgaaacaaacaatacaaaaatgaaaaggagggaatgttgacctttagtatttgatgagaatacctcgctgcacctcaagctacaaaagggtagggacacgtaccacaccaacaaaatggcggaataaggaagaagaaaaaacagagaaagaattaaagaagaacacgtgaaacgtgaaaagtaaatggtatgacccactcccagaacccatataaactttaaagccacgttatcttgaattgtatacacatagttggatcgatcccccccccccccacatcattggggcatgtaactcatacaaaaattgcaaacagatcacctatcccccccccccacaaaaagagagagagagagagagggtgagggaaagagagaggggtgatcaaaagaaaatgcaacccgatactaagacctactcccagaccttttggtggctctgttgccatgttccttgtatttcatacacacgactggtgcccctttaaatggctaaacccaggctgcgccactgccgcgacggacttaaaaatagatttaccgatttattgttcactttcacctcgagggctgccgcaacaagacgtgttttttccgctgtctgggcaacaattcgcttcttggagtaagaaattatattttacttctagtttgattgctggtgctttttctcttcttacttgtattatttccgtattttggtttggggtacgattttggacagtcattatgcatttgtttttgtcgcttgaaccctataccattaatcaaaagctgtttatgaatagcgcccctacagataaaactagctgatacaagcgcttcacattgtaataactaatgttgttttaacatttcagatattttgaatttaagcctgtcaaaagtgttgggaaccccaaaaacttgatagcaaaatttcacttaaattgtatcataatctgaaagaggatgtcatttgagacacattttttgaaggattttcaacaaaaaaatgtgtttggaatcgaatattgaagaaagactacaacatttaggtttcctgcgggggggggggggatctttacagaagtgtatcttaaatgaaatcctctttcatattatgattatttaagtgaaattttgacatcaaaacttcggcgaatttggggctcccaacactttaaagggtccttaaatggtgataatatggtacatgtattgtattgtatttattaaacttcattgacatacatcaataatctgtttataaaaaagaaaatcatataaatcaatttacaatttacaatgcaatgtaacgaaacattatactttttgtaaacattatatcatatcaatcaattcacaatgcagtgtagcaaaacagaaggaaaattgtatacagcagaaaaactcttttttcttcttgtaatcacatgacacatagtgcataaagtaaataatacaatgtaccataatacatatataaaacctaatatagcaagtttctaaataaattattactcatgctatacaaaataggcaaatcaggtacatggaatgcaatagataatcgtttcgcctaaaatgaatgacgtaatagtacctatatatatatatatacatatatgcgacctactgtgaaattaaaccaaacacgtaaggttttaaaacaaaaattgccttgtttatataggcggggtcattgtcgtttaatacagaaaagaaatatagaggaaataatagggttgtttacttgttatttaaataattgtataaggagtttttttaacttagtagttacatagtatctaacagttacccttcactgcaattatgtatttggtgatcgaagagaaaatatctattatatctttattgtctaatctcattatatatatcaattattcttggcattctaaatcactaacatcttcttcaaaattgctaatttttttcaagaaaatctattcgtaaatcgttatatttatcacatttcataatcaaatggaattcatctcctacttgattcatattgcagtcttcacagaatcgtagataagggggcgtttttctcgtcttttatattcctatgggtaagttgtgtgcgctcagtcgtagtttggtcatattttttctttaatttatatttggtatatgagatgaatgcttttcttgcttgattgtctgaaggttctgagtttatttccgttacgggtttccctatcatcgaataaatctagttttaaatgttcatcaattcgtctttccaaacaaagtttacatagctcgacagcatgttgttgacaaattggtatatttttagggtctaatacggtctcatttccattattactacaaatattaagtaaacttaatatatcccgaatt

SEQ ID NO: 60277 - DNA, 13907 bp, Oryza sativa
ccccccccccccccccaaaacagggcctgggaatcctccgccacgtatggctggttcattttttttatgaagtaaattttagaaaaactgtaactttggcgataaaactatcagtttgatgtaacattagcgacatatttcagtttgttacaataatggcgtaagaatttatcacaaaactataatttttacattatatgctgctacagtacatataggtgacaactgtagcagcatataacgtaaaagttacagcaaactgaaacatgtcactaatattacagcaaaagttacaattttctaaaatttactttattttccgtaattgattataaatcataatacttattaataacttaaaatatattgttcttaacgagtttaaagataataataaaaaatagactgcggtagaaaagatatcaaatcagcaataacattaaattttaatatttaatttttggctacgattgataagctgaagagtgtccattaatcccttacacaagggttgaaagagatttggaggagaataattctacaccgattaattcccttaatctcctcccatctcttcaatctttgagcgatgctctggttctctctaatactaccggtattattaggggtaaattagtaatttactataatatcatgtcacttattattaggggtaaattaggagtacctgtcacttatttatgtttctccccacctaaatcaatctacgatcatccattgcaccgccatcgctcatgttccataaaaaaatctaaaaaagaaggaaacaatatttattcactactaaatgacgattatacccctccgcacatttttttgacaataatgtccctccatatttctactactactaactgaaatggtagtataaatagatctaaaccctttgatcaaattagatcgaaagtctactagtgaaaagcattgtactggggctcaatctttaggccatttccaacccaagacattagacatagtttctataagctccacatcatcaaactactattccaatacaaacaccactatttcatacttaaatttaatactacttatctcacatgatgtcttggatattgcgtagaaaccatgtctcatgcaagacatggtttccttctcttttctcattttttcgcttgccacatcattttctattctaggtagcagcttatttaatactatagacaccattctagtcattgagttaggaatgacattagggctcatcgaacaagcccttgctacataataaattgagcacaaaaaccacagctgtgttcggatatagggagttgggaactaaactccccgcacggaaaacggagcggtccattaactcgtgattaattaaatatttgctaatttttttaaaaaaaatagatcaatatgttttttaagtaacttttgtatagaaacttttgcaaaaaacacatcgtttagtagtttaataaacgtgcgcgtgaaaaaggagaggggtgagttgggaactctaagttccgaatacacctggctaaccgaatcttgtgcaacgaggaccgaggaacaagctttgggcgtttccatcctcattgcgccacatcctcatgcaatggctgcaatgccgaccttagctcgaactatcaagtactccctccgtttcaaaatgtttgacactgttaactttttagcacatgtttgaccgttcgtcttattgaaaaacttttgtgaaatatgtaaaattatatgcctacataaaaatatatttaataatgaatcaaatgataggaaaataattaataattacttaaatttttttaataagacgaacggtcaaatatatttaaaaaagtcaacggcgtcaaacattttgaaacggagggagtagagttttcgccgttggttcgatatatatatataggtgcagtatttggttggaacttaacccatgccaacttcttctctctctctctcttctcgcttggttatatcgggcatcatatcccactagagatagccgctacatattacagctacctattcgattgcaggagaagatatatatagaagcaattagcagggggaagatcgatcaaatgagagagagcaacaacaacaacaacagtgtcatacaagggcagcatgagggaggatcatcggcggcggcgctgcaggcagggaggccggagccggacgccctcatcaacagcatcgcgataatccgggcgttcacggcgaaggtcgtcgccggcgtgggcttcctggcgctgacgtggtcgacggtcgtcctcctcggcggcttcgtctccgcgctgcccatcaaggagttttggtttctcacgtttatcagcatgattcttgcctccacgtaagtcatcgacgaaattaaccctccccttttaacatatcgacgaaattccctagcacaaaactgcttatttagcatgagtgctagccagggttcactctatcggttgagtccttttgatcgagggtcatcgaaatcccgaaatttctgaatttagttaaattaatttgaacaaatattacctaaatttataaaaaaaattgaaaaatttcagccgaagttatatcgtatcggaggtgcggaaatttcggtccgaaatttccaaccctgctgctagcacggatgccggttaattagtgagtggtctaattccatcacagttcagtcttcgctattgacatgattagatattagtacacgttagtttatcactaatcgttaaataaattgtgactacgtcataagttatcacacatgagtcgtcacagtcgatatgtttaataaaacatttttttatcactagtaatacgataaaaatgattgaagaatatctagtcactagatatatctaaaatataatggtgacaacaagataattagtcactataaagacgcttactagctagtgaggatcaatggcttcatcgcacataaagaaatcactggtaatgcaggagtggtccaagggggaggacaaaggaaaaaggagagatgctacggatacgagggagagagagagagagagagtgcatggtcacaagaagaaataaggattaggcttcagctagctcatgatgaattgtatcatttgtgatttcgcccggttcttccgtccaggaatggggccaggtgaacccgcaagggagcggcgcggtgccattcccgtcgaattgatctcctgttccatcccattaccaaccctagtccacaatatatagatcttgaattcaagaagacactatttcatccttttttgacaaattgatcttttcaaaaatttattccgaaactagactgtgaaaaaactttaaccaaaaatagatcgtcggcttaatgccaaccgccttagcgctgaggttagacaactcagcgccatgcccgttggcactgagcaacctatccacgtggcagccaagccgatccccaagtgtacatggcagcggatcagcgtcaatcggaatggcgttgagtcaataatctcagcgccactgtgattggcgtggaactctgggacttagccgcttgcgccctgtccgcccaacacagctcctgtgttgggcggcctgcatccgctgagccgtcaaacctcagagccagggtaaatggcactgacactttggaccttagcgctagctaatttggcgctgagctatgggacttagggacttagacgtcacttgcgcttgggctacccaacacagctcctatgttggagctctgttgggctctgctctagcgctgagggtcaacgccaatatctttggtgctgagtttgtttgtttgaggaggtagggccctaggcagagagatgacattctaggtctttgtccagccttcatctaaaacctcacaaacagaaatgcatgccggccaaaatcatccccaagaatcaaaagtcatttgcctatcatcaggttcatctaccatcttattctccatttgagtcacatccaagccatcatctgacaaatccttccctacgttcacatccttctcatccggtacttccgaccatacctctgcattctcctcaacctgtacttcctctcctacctccacttcttccttaattgattctaacaaagccttcctacctccacatccttctcatctggtacttctacccatacatccacatcctcctaaaccctacctccatatcttaattaattaattcttccttccgatcaaccacaaacacatcattcttcggttcatgactgtatgcgtggattttcattgaggtctgaaatttcttttttcgattcactgtggtctatctttcaagcaaacacctcaagcgatttaaactgtgagcccaatattatatctacatatgttttccattccacctgtccattcaaatctaacacatacttatgtgatatgggatcggcgcccacatcgtgtctcccttgcataccaaccgactcatgctccaatccaattcatccttcatgcggaaaattaactcctcaaatgtaggtttggcacgaaacactaacggcctaattaagagtcatcctctcaaattggcttccaccgatactttcgtcaaccacacaaccaccaaaatggagtcgtaccaatcacatcaattaactgataaataagagtgcatgattctaaaatagtatgtcgtttcaaagatagaaaaatgacatgggtaccccaaaactacctacaatttttttgaaattttaacgactaaccaccggccagaatattcctaggatctatacctatcaacatgaacatgaatcaatatgaatccccaaaatatttcacaatacaaaggcactatacatccctcccaaattcacccgtagcaaaagagtacaaaacttgcaaatcaatacgaatcctctataccaacatcaatatacaactacaacatgacatacttacccacattccctaattcaaccacatcccgagccacattcaataacccacggtttcaaccaaaatactcaacaaaaatgagggaaacattgaggaaattagggtttttggagaggatttaccttacaaatcaacctccaaaagcaatgcccacaaaataacgttcgatttgagggagatttgagaagattttgggagggaggagagagggctatgtggggtacgaacgaaccctagccgggcctggaaaaataagagaggagtgcctaggccggggcgactcagccacgaggtataggccgctaggttagcgccaacgcggttggcgcggagattagtgggcttagcgccaaggcagttggcgctaaccacctcccacgccagcaggggatcggcttggccgcaacattggcaagggggtcagcgccaaccgttttggtgttaagccggctaatctcaacgccaacatccctggcgctgacctagggacctatttttagttgaagttttttaaacgggttagtttcaaaataagtttttagaaaggaccaatttgtcaaaaagaaaaaaaaatggcaagcctcgcctcactatggaacacagccttatgaatcatttattttcatattcatgtgttttattagtagctaattaatgatcttcctcgctgcatttactccatttctcaatacctgactttttttttaccttccccttaattgcccttagaccaaagtgaataaaagttttatgcttatatttagggcatacctcactttagtgtttacaaattttaaaaaaataagttgttaaagtttgaaaatatataatgtttgatgtcagttattaatgatcttaatcgcggtaacccaatgcaacagggtcttgagcgtctacgattacgttaacgagacttacgcggcacgagtgaatcctacgtttggtatgataaccgggggatacttcacgttcctctcgaagttcgaagccaacctctccgctggctgcgccgtgcgctgctggaggctgtgtgtcatgctcttggtcctgctcatcgcgatggcactgcttataggactgcttctgatcgacgccgtgttcatcgtaagcttggttgggccgatggcaacaatggcgatctcgctgacgcgcctgatacagcacgactacgatggctcagacgcgtcgagcaaaggaaagctcagggcagccctgttcatcttctactctctggctctgctccatagcctgtgcttctacttctggctcctgctgcatttgtccctcgaaatgttgccgattccggcgagcatagaggagtatgggcacggcgacggcggctactaccagatgctgcttcgtcagtacctccaggaaaccaaaaccaagtgtgcgaatgatcccaagctgccaggtgactggaacctggtgacatacgccgttgggttgctggattctgcatccccggatgatcatctggatgggctaaggatgctcgacgtcttggccatcaacaagcagcgctctgtacggcttgagctgctgtcctcgagacactctgtccagaatctcatcgagatgcttgagtgggatggtccggaccaggagatgagagagcgtgccgcgaggattgtcgccgatgtcgctgctgcgctgcgcgtagcccagatgccagcgggagctctgcactgcatatcttctctgctagaagcctcaccaagatctgacaccttgaagaagccgaaaggcggtaaggagttgattcatcggggcctgcagattcttgagaggctcgcacgcgacgagcacaactgcagggagatgtgcaaaaccaatggctgctccccaagatcacagcaccaatcacttctcccgcgttcctcgagacagaatatgacagtgaatgggttgatatcctaagcattttgttgaggctggtgatgcggcttatcagtgctcctggagaagccggcacagtgctgtgccatgaaatctcagctagcaatgatgcagtccacaacttgctggggatccttgacggccaaatcaagttttccttgcaacttcaggaaaacgccatggatgttctttcagaaatatcaataggtttatctgcagccatgaccgagaatttagttaagaagttgtaccacatcttccttgccaacagtggtatgagatgattgaggccaaaagcaggggaagcgctcgtgaaattgatttctactcaaggtgcaagtggacaggtacctgttatggagatattctgcaaaagcatgtccatggagcaaatctgtgaaagcgagtccacagatgcactggatgtgaagagatatggaacagttgttgatcaactcactgatatacttgttaaagacaaggaatgccagataagtgcagcagcaatattacagcacttatgttctcgttttacaaggagctacgaactattagagcaagatgtggttaagctgctgatgtcggtaaacctcaattgctttctctttctaacatcattagcatgaatcaaccatatgcagttatctgaataattcagttaatgtgatgcccgatcaaacaatattaaccctaaattagtagttcgctctagattgtttgtttttagaaatttgaatagtgggaggttatctatatcagatttgctatttatcaatcatctagcattcccctaaacttgcataatgcataggctaaacttatatactttagaaaagtacaactttagtctagatgcatatttatgcttacatagaccataaacgttttctccatttcagtgggggataaacagcaaattacttttttttcaatgtttaggttagaatattctttgtttgacagaataaaggaaaaatatgagttattggacattgacctagtgttggaaaaaaagtgattgatagcgatatagatacactcacatggttataacttatactaagtacattgctaatatttagttccttcgatataaattttattatttacaatacatggttataacttatactaaatatatttgctagaagtcagttcctgtgagatgaattatattattgtaactgttgcggattcttgatcttatcctatacggtaaaacggaaggagatgaggaaactgtatcagaggcaagggaaagcaataattctgaaatgcataatgatgaagaaagcaaacctccaaaaccagctggtctgaagaagtccttggtggagaaaaatgatgagctatctgaagagaggaaacatctagcagctctgctatcccttcttgtggtgatatgcgacaatttggttgatgcagatcttttttctaatgtcacatctgtgaatgatgaactggcgaagaagctcaagaagataatagaagcaaataatgaaaacacagctgactgtctgagaatagtgaaacttacctgtcaggtggttatagcgataattcatctcaaacctagctccctcaaagacttcaatgaaagtaatttcaatgatgtagtgtccacggctttcaagaacatgtcagatatcgaaaactgcatgctctttgcagtcaaagatcgtcagataacaaagcctgccaaaactctctcttctcttgtaaaagaaacccagggactcctccacaatgcacaagaaacaggtaacaattctatctgactaaaatcatgtactgtatctccaagagtaacattgtacttcttgtcatctgaaaatattttctgaaatacgcgtgcaaatggattgtgcagtcatgtctattttatgtactaagtgtgcgaatggagtgcgccttctatgttctgtactatgtgtgccgattgtcgaacattgtatgaatactttaaaagtatagtatctctgaaacatttattggcacaagtactgttatatgttaggaatggcaatgttaatatgttattattgattacttcaaaactatggtttgaagttcatgttgagctcaaatctaatttggtggatacagcccataattgtaagtatgtcatagtgagtgagtcgatatgcattctgtaagatataacagaaaatcttaaagatagagcggtagatcattacatatattcaacacatgtattctctcttaacggaaattcttacagttagagcactagatcccacaatttttgataatttgaccctttgcaaaaactaattttacaaatgaaccgccgccaaaacttttttaaaaaatgacccttttgttcagtgccaaatcgtgtggcgctgaacttagacacctcagcgccaaatagcatggcgctgaatgtacgttggcacactaactcagccttccatccgcgttggcacagcattcagcgccagttgacgtggcgctgaagtgtctaagttcagctccatagaattatttggcgttgaaaaaatggtcattttttaaataagttttggcgaaggttcatttgtaaaattagttttttcaaaaggtcaaattgtcaaaatttgtgactaggtccagtccagcccagaaattctgtcttattcgaaacaaaagcaataaatcatttcatatattcaacacatcagaaaacataatgttgggcgggtgctgctgccgctcaggcatgccacgtaggataaaaatagtgcgcgggggtggaaattttgccaaaaaaaaccctctgttttgtgtgtaatttgatgtaggttcctcctacgtggaaacccttctaaaagctgtatattccatgaaaaggagagaaagatcacgaattaggaccgcgctgtgataaatggaagcataggggcttttacgcaaaacgacacccactaaccttaacctcaccccaaaaccctagccgccgccgccacccacgtccccttctcccactcgtcctactctctctgtctccgtctcgtgccgccactgggcgccgcctccaccgttgccaagcgccttcccctcgtggcacgttgtcgtcgtcaccaccgagcgcgccacctctacctctgcctcgcgttgcctcaggccgtctccgacggccgatgtccggatccgatctccatgtggtcggggcaggcggatttgaccgtccacgtcccctcctcgcctcactctctcgctcaccttctccttctccctctgaccacccccgtccagatcccattcgttgccgctccaggtgctgcggatcaaggggcagctcaagacagcaagcttcgtggtggcacacatcggcattgacttgggcagacaacatccatgatagcatgggctattggcggcggcaaccgagctctaaatcttgtagtggcgaagtcttccttgtggcggcagcgaccgcatcttcctggcagcgacgggatcacgggatgttcctggcaacaacagcggcggcaacttctcggaagcagcggtgtgttcccggtgacagcagcggctgcatcttccctgcagcgacggtgtcttccctgcgacggcaacgtcggcgatgacatctctcctggtgcaagttcttccttcatccacaagagaaatttgcatatttaccatcgcataaaagtggcttcgctagtataacatcacttaaatagtctttgctggaataccattctcaactgggtgcggtctgacactttgcctttttcatcgtttttggctaatgaaaaagattttgctcgctttcaagttttttttttttttgccgaaactgcccttggattttgttttcctctctatccaaaccataccgttcttttttttccaagttctttcgctcgctcgcatctcctcctgtcgaccgagcggaggcggaggcgcggtcttgccggcgtcgagccacctcaccgccgccgtcctcgccttctcttgccccgtcccccatccgccccacatcccgctctctccttcctgtcgaccgagcggaagcgcggtctcgccggcgtcgccttcctgtcgccccgttctgctcccgccgccgcttcccgtcccccatctaccccaaaagcgccgccggggaacggggagaggcggcgcggcggtagctgactcggcagctagcggcggcggtgatgcctgcgaggggagcagcgggattcgggggtggtggggagagaggcggtgcagctggcggcatggtggggtaacggggagaggcggcgcgacggcggcagtggtgggcggcaccagcgtcgccgcttcactttctcctcacgcctccgtcctcaagcaaccgaagtctcgaagcagcaagaggtagagagattcagcatgttgaccccgggcccggggcataaacgtccgagaaaaagtgtaattgagaaaaaataataatttcgaaatgcaaaaaaccacaaaaatggcatcgcagcgaatacccacgacttaggagtagcattccagcaaagcccttttaagttatggtattctagcaaagccatttttatactatggtagatatgcaattttctccctccctgcatggaccaccttagcaccgtgtgacccccaactctgaggacgactagcggcggcggaggatggggtcgtcacggcagaaggccttccacatggtccggaagcgtggcaggcggcagcatgtcgatttccggtacccggcggccatgtcaatcgaggaagtctgtgatcccgacgaggaacgcgtcgtcgccgtgttccacgattgcctcgccgcgcacggcctgctcctggacaaccacgatgactaccatattatgctaaaggttcaccaaaagttgctttgctaatggtgactttgccttctcttctgatgcaggtttctgaaggttaatcgaagacgatgcaaatgtgggcagagatgctgagatggaggaaagagataggagtcgacatgatgttgaaggtgaccagataacaaagcgcatttgatttaataagttacagtgtctgaataatatttggtttgatatattgatgaactccagtgctatgttcttgtggttaggagttctgctatgttcttatggtcaggagttccgaacagggataccatgctgttgatcaggaaggccagccgatgtacatcaagaagcttggcaagatcaatcgaaacaagctgatgcagatcaccacagtggacagttacaacttacatcaattagcatgttgtagagatttaattgcaggttatttgccgattgccattaataggtttttttttggcagattttttgctacctacagttcagttgacatgctttcttacagctaatgttcagactacaaccactaccagttcaactagcctgtttcttgcttcttttcataaagttacacatatctacatggattaagtgtattgtcagaatcaaaacctggtaatttttttagcctttaaaccatttatctactcctagctattttgctcatgctcgatgtattctaaaagcaagattgcaacctttgtctttgttgctattctagggtcatggtagtgaattcatggtaacacacttgatcgttaattttcaatttcgggacttactttcttaattgagtcgtcctgtcaattggtttccagggaattgatggggatttcataagtagtcaagctcgcctgcctttaattctaattattgtatccatgacgaatggtgcggctttgtgcacacattgatggccatctccagcatcattcgtgttctttgtgcatcacacatacatacccctcatcttattctgtctgcatccaaacaaattgaggtttggattgtaggtcatttctatcatcttaacaaatacaactatatttatctaaaaaagtgaattcaactatattggataggtaattctatgtgtgtattgacctcattttcaatggtttacatgcaaaggtgaacaccaattcttagtttaatacaattatgcctgtttgatgaagctactgaataataaaacagtccattttaagcgcaataaaacaagccattttcaattttctagcacatcatgcaggtataggacaagcatttcttgtgttaatcactagattatgtttacttctggtggctcggctgttttggtctttcatatcttacagcaagcagctcgctaagttttttttttcctttgcagccctatttacagaagaaagatcagagtggtgtttctaatatgactgcaaagatgagctattttatcatatggtaagagcaaagtataaggtctaatctatctagccttgcagagcacattgccgatttctactaatgtatttttcttttcgttggtggtcacagagtgtccataggagcatagttgcagtgttccttcagttatgaacaggaacatgcttatctaagctgttctattttagctctctttgtatgacttgatttcttttatctagcatgatttatttgttctaccattctttaaaacttgttttttgcctattttttggtgattgacaaataccacagacataagaccaattcaatatacaccatgctgcatacaggtaaatgttaaaggctttcttctctaatttagtttcctcttcttaagtttgagattttctaagagatactaatacattatctcctcctggccattaatacatttaggccccttaaggaatgctaagttaactctttaggggcattgatgtgttctgtttttcaagttcgctttaaaaaaaacttatgcttttgttggcattttttttcattatacagatgataaaatatgttttataacataaatatgcttgcaattctacatcacaaaccataaagcctctcaggatgtgcccttttttagctatgacacgtcaggttactgtagtagaagcacactaggattatacggtgccattaactgttgttgtgtgcttgcatgtgcagctcttgttggatcgtgtctgccccgctgcacggcgccgcccctccgctcctgcttgctgcgcctgcactcaccagcaacccaccgcaaccacccc

SEQ ID NO: 60278 - DNA, 19000 bp, Oryza sativa
  unsure (1)..(19000): unsure at all n locations
ataactaattaaccgtagctccgattcaagtggttcaagttgctaaattcatctaaaatctagatctacatgttaaaaatatccacatgtattgttcatgcttgtttttgtactgttttgttgattttgtttatttgctttagtttccgacgtttcgttggagggcgtttcagttgaggaaggtttagaggtttttgtggaagctcaagacaagtcacacagatcccaaacaaacctttgagcatgttgaacccgtttaaaactaatgttttatttcaacttatgcattattttcgaatgccatcgggtggtgagccttttcccatttaattatggccgaagatgactgtattttcctatgggttataatttgattagctagaaccttatatattggtttggttcagctaaatgctatatatgtataattgcttagccatgcttagaaacataagctcattaatgggatgaatcatactacattattacttatggttatacttaatggtagctcacgatggttaatcgtgttatgttaattaattaataattaaaacctgattaaaggtgggttgtgagcgcatggttttgatggtcgtgctcatgacaattaaggaccggttcacgagctactgttgtgaaacatttaccgtgccaaccacaagccagcgtgggcaacggctttaccttttgtatagcatggttcattatggggtgccagactgagaagcggcgagaagtccgtggggggtcgctggggagtccatgcctctggttgtagagggggtgattatgatccaggtatggtgcactgtggtgagttgtgttgtgcgaggggtattgtcacagttcctttccgaggtaccgtggtggtattgaggcgcatggtgacatatcgtggagctgtgtcttgtgggtacagtggtacatctctggccagagtaaaactattcgaatagccgtgcccgcggttatgggtgggttaacaatgtttttcgtgattagtcccacactactcattattggtgataatttgtgataattaaattgactcctggtttggaatggtatattcctggtgtggaggtttgatttgtacaaccggggttggttgttcagatgaggttaggcctatgcaacacgggtgtgttgtatggtgtttatttaatattgcgtaattacttaactgttttactattctcttaaatgtttattaaatgttgtttaagcacataagctatattataccatcctttgttatcctgtgcacttgcatatttgctgtgtggcttgttgagtatgtcatatgctcattcttgcaatattcattcatcagaggaggagtatttcagtgaaggtgatgatctggaggattaggctttgtacgggtcaagttgcttgtggagtggagtcgccatagctgtttagtctttttttgtaaggaagctgtttagtcttttgtttttccgctgcgtagaattttattcttttgagaggaactatccacctctgtaataatttattattttgcgaatattaattagtagtttgatagtactctattatcaatttgttattgtgtgcctcagctgattcctggacgaggatttaacacacatgtaagcgtttggaattttggatagaaattccgggcgtgacattccatgaggtaataaattgttgtacataaatggtataattccaacataaacaactttataatattatttaatggcatgtcaatcaagacatttttctgtattgttaacaaatgttactcacctaagtgcacagtgagcccaaaactcctatcacaaaggtgctggtgaaggatagatgatcacaaaatggtgtcaaacgattccggtcacccaacttcaccaagacaagccaaatcgaggaggtgccctttcctagcccagccaacctagcccaatcctcaatcgactttggccacacgtggggagtattcgagaagcgataccgacttcaaggtgcgattggaaccgtctatgacaccaatcgacctaatgaagggatccaaccagtgccacatgctcagatgacctaacccaggtaggccagaccactaacctaggtcgaccgagaaatcgacttacccccaggctataaattacccctcccctccacattatttgcaaaacaccggtagctaaagatcaagctctagttagcaccatgttgtccaaatagagtagaaatgtaatactccaacccattttaagcctatagttataggtgtggtggtggttcaataccacctaggaagtttaggtgggtaaaggtttgcttataagcatttgtgctccaaccatggtacccctagtcaacctttttacacgaaacgaggacgaaattataagcagggtaccatatgagcgtggcccgctcaatgtgtagagcaaacaactgtagatgttggagatacggtgttacaggaaataggggagtggggagtttggatgagaacgctacggttgtcggacttcgccgactctctaatgcgaagaagttgggaaattttggcctcgtcaacattcggtggttgatctctggtttgtcagtagtcgaattttgatcggtcgatggtcgtcatccaatcaaaatgaccgtcttcatcttcctggttcgacaatgtgaatcttactgttttgcattacttatcaagtcatcttaatgattccatacttatcgattcttgcttcaatttagataaaggtcttactttatttatctttattgctttgctagtatgtgcacttgagcaaagtagtagcatgatacgttagcgtggggcttagctacaagtttatttgggaaggtagtctagatcaacgggggaccataggcgacaagttgtgacaaccctatccatcccttatagttagccaagttagactagatcccttcccaatcaatattccctcatgtctaggcataagtatcccaatggcatttacatccttatgtaacatatacaacactcaattacctctttggttgtgcatccttctaggtgtgcccgattgtgcacatactctttgattgtgcacgattgagcttgtttcggacgtcgaggattgcatgtggtttatggaggaagcttcactttggtcgtgaagattaagtctagtttattttgtttttccgctgcgtatgtgagtttctttttgttatttttgtaagacgtggatctgtctatcaaattgtcgtttatgtactctgactgatcctggacagagatttaatatagattctgcttgaaattcgggttagcgaatttctgggcgtgacaaacagcgtcatacatttttcgatggagggagtatcaatcaatattagtagccatcaggtttccaatcaactcaattgttgtttggtgacgcaaagtccgaaattagaccatactcaaatgcaaagtcaacttcctttaaggtaatttgtctaaattactagtactaaccgtgacatccaataatatatatgaaggaaaaactatggtggctattaattttaactacttataactcaagtaacatccatatcaccgtcggccagaattcttcatttcaaatagagtttgtgctgccaacagcacctcaaggtcaatatccctgatttccaactgtacaccctccataactacctccactccatgatgtggctccggcgcacctccctggacaccagtctccccggccatgacggccgctatctccagctcgacagcgctaaccacgtggctcctcctgtggcaaagcctccgtaaccgcatcatgcgatgaggactcaccctcatgttttttcttcctcttcttgggcgcaagcagtagtagctcctcgttggccttgaaggcggcgtcagcatgtggagcatcacctttgaagtagtgcaccataaccagcccgaggcggccgtcattgtggtcgtctttgccatggctcaacttctgagaacgaaacacccatagatcgatcatggcctcgttagcaatggcaacctttttcacctttttgatggccttcttaccctttttcttggcgtcttcttggagggtaagactgcaattcttcagaaatgtcttccatggacgacccatgagacgatacgagttattagctttaatgtacttcagcgtgaggatgtactcctcgccggtgcggtcgtaggcctgcacgaacagcccatcatcaccattgttaggctcattgttaggcttgttcgtgccattgtcattgtactctttatgctcatccttcttctctttagactcaccgttcttcttatttttaggcttgctggatttctttttgcgcttacttgtggcggctgacttctccgccagcgttaggatgctatcaaacggggataactcgccatccttcttgcgtgatatttgtaaacggttttggcttttcaaacggtcggaacgccacatcatcttgccgtagacgcgcaccggcggcgagacggcgccgaggccgttgaggaggctgcgcagccggtcgtggacgacggcaatgtcgtcaagcggcacgaccatgtcggaccctgccgaagacgtcgacgcgccgtctctgcctaggctggcccagaacttgccgtggccgcgccgcttggtgttcttgcaggttccgatcgctgtcgtcacgtgctgtcgtcggccacctcggatggcgtcacccatgagcttgtcggcggcgggcaggccgattggcatgccgccgccactggcggttgatgggctctcttcctcggcgaccatcttccccttgcgccgccgctctctatcgaattcctccttgcgccgctgctccttttcggcattgttggagtcgccgtcggccacgtcaacactgccgccaccgttgccgccgagcacgctacggtcagcggccgccgctaccgtcgtcgtctccctcgggcgaactcgcggcgttctatttctgtccgacgacgtggtcgacaccaccagagctccatctccatctccattgccagtactcccggatggcgtcaagaccaccacttggccctccgtgcgttccatcgactcctcacgccgcgacctctgccgcctcggaacctgcgcagcggcgaacatgcctgatgtatccatccgccggggtggcacgcacgatcgacacgaggatcgatcgatcgatcaatttcgaagagggcggtatgcatgggaggctcttcgtgtttgatatggattctactttggtaattcatacgaactctggcgcgtataccaaaccaaaccatcgcggtttcctcttccctacgagccggagactcctcctcgcacgcgaatacgcgatcaccttccctctcagcggtcggcggcggcggcgcggcgctcctcctccctaccctccctctcgcgtcgtgcgtcctgcagtcttcccaggcagtgtgatgcagatccgatcgcccattgatcggagaagccgatgtggcaccaagttgatcgaacacgctagctaggagatggatttgaacggaaggtattttcatcttcttcttcgatctgctgttgctttggagtggagatgtttcttttctgttcttgcacatttgttttgtcagaaagatgcattgaaggtgtttgtgtttatgcctgactactgtacttctgtcgtcccaaattaaattatttcatggattaataatgttcactttcatatttctagaggaattggaagcagatcttttttttttcttgtttgatcaacgttcccttcgaatcaattaattttctgatggtatacgtgctgatattcatgcattgtcgatgggtttaaccggtgtcattgtttgaattcagaattatctctctaattcattgcgtccaaatagacctattctaaagtttttcattgtgtctactgtattagaattttcagatatacaggagtacgtaaattacactgttcattgctgaaaatatcagaaatattgttgatatctaactgacttgccactaatgaggacacaatctttaagatgtaaagtacaccatctgtgtcaaaaccagtgccatgtaatttgaaggttgtggcagtccatgattaatgaaatcttgaagtacattgaaaagtttggagagtgcaattgtttctagaatcttgacaaatgatatgctccagaaatacagagatctggtgctagcagaataggtgaatttgcttggtttattagatttttctgttgctaatcacatacctgcttcatactgtgaggaataagaacgtttctgttactctatggaaaaatagtatgaattgtcttggggagtcaagtatagtggtgcatctaaaaaggatctctggaggaaggagcagccatatctaaagtatggtttgagagaatatataattgcacagattttgctaaaaggtgtgtttaattgaactgtatcgtgaaagggcatgtagcctagtggttgcagtgacctgagtagcaccctgagttcaaatctccataggagcgaatttcagattggattatttgagagctaagttccctattcgataggctaagttcctaatttaaaaaaactatatatatccggttggatatagaggccgggtaaaaatacccttctctaaaaaagataaaaaaaaattgaactgtatcagtgcatatatttcctaattgcggatattagttgtataaatatgcatataattcttgttataaatctacatgaaacactgtaataaaagattgaacaaaagtgcaaaacttaactttcttaattttgtcctgtcactcaacctggtattattcattgtatatttagagctgtattataagctccctgacaagccatatgttttttttcatccattgcatatttgcataacaaaattcgcatagctgttgatttgcaattgcactcagtgatggcaacttggtaggactcgactccatggatttactactctctatggatcaataatacagaacgaggttttcgtggacagagggatcacttgcactccaccacaccaataagtttttaactaacattttgctttttttatattttatttttttagagaatggtattttttacccggcctctacatccaactggatatatacggcttgctgcaagttagtcccttcaaaagaagtgcatgcttggttcatagacattaatcggcttatggaagtttaaaggtacattaagaatatgaagatgcattatttagtaggtagctatgagccatatatatattgctttgagttggctagaattagatgtcatttctatatatactgttaaggtcatcttatcggttttaacctgtggtttatatcttctaaaatcctgatcatgcccatattatatcctgtaattgaagcgttttcttcagatatatcacctgtctcaagaaacttcagttcaattatttgccttcgactttatctctctctataatatgtcatcgactttatcaaatttttatataatatgctattgggggtggatacttttcaaaaaacacctaaaatgcccttcgaacatataagggtcgacaattgattgacatactagaagtatcgaaaaatatgaaaatgttcacatagcattcgcacataatatagaagtctatgtatatttcaagattttcaatttgcaaaatgaaatttatgtttcatatgctaatagaatattcttgtattgatgctctttacgtaaatcatccttcatatgctacataaaattatttttctaatccagctatcttttgtgtatgtggttcctctttcacatgccacataaaaatagtttttcaaaagaaatcatgacagaaaatcttaaaatatatacacaaacttttatattgtgtaagaaagctaacaaaaacttttatacttttttgaaacttctaattagtcaatcaattgtgaaagagaatggcttgaaggaaattttaggcattttttgagaagtacccaccccagtggtatattctagaaaaaaattacaaagtcggtggcttattatagagggagacaaagtcgatggcaaattgttgaactagtataaaaaattaggggtatataatagattctctcatttttataatgatttataatttgaataattaaacaaaatattggtcattgtaggaaaattaagccaaaaattagcaccaagtatactatcattttgtatcaatacagtaatgaaggcactattcttcagtgtgaaatatttagaattacaggggtatcgtccattgtacttaaggcttacgaatttagttgtgctcagtaattgtgaaagtcccttgctatttttttccccttatttatgaataatgtcagttatactcattcaagaatgtatatatgacatgttaggcatgattttcttcccaaagatattattctttagagtatacaaaatcagttggatagtgaaaattttgatgctcttgccttagctgccctttttctctaggtgttgattactgaatttagaaatggcttagagttgacgctgtttgataacggctattttttttaatggtagaacactcatgttatgtgttgcgaaaacgattctagtcatgtagctgtatatgaagcttctaatgtacaattgttagcgacacggtggcaagtcccaacccagccgccaccctcccctcatccgcctcgccagcagccaccggcaaagctgggcagcagtgtggccttctagctcgctccaagacccggtggctggggcatcaacgggacacgggcggaggggccgcgatgtgtcgacgacgggttctgacgccgtttgggctggacacggccgatccggtgctgacggaggtagaattggccccctcgcgaccggatcgagagggagcacaccggccgcgccgcattcaggaccggcggaggaggtcatggtgtcggtggaggagatcatggcaccggcagaggagaccatggcgtgctcgcgcggaggaggcgcgggatggccaggttcggctcctccgagaaggacgaggtggtgaggaggccgtggaggtgcgggcagcctgggagaagcaggcggcacagctggtggcgacggtaggccggcatggcgcgagatgcgtggcggcagcaacgtgaggctggcgtggcgtgagatgcgcggccggaggcagcgggaagtcagcgcggtgcgagttgcgcagccggcggcggaaggtccgtgcggcgcgaggatgcgcgtaggaggccggtctggcgtggaggcacagccgacgccggtgggaggccggcgcaagacagggaggctgacctagccaacgccacggaaggacgcaacgatggcagggaggccagagtggcgagtgtgccatagaggcatgcggtggctgtccggcgggagggcatcgggtcagcggtgtcctcacgctgatggcggatggtcggtagtggagcaatggagcaattagttgtggatagacagtgacaggcgacagccgcaaaacctagctcggtgttagttgttccaaaaaacaaaaataatacctatgaacttgaggagcaattgattatttcttagaggacgtaggataaatattgacaaaaaaaaatctcttgcccagagaaatatcaagatagaacccgtgcttacatcaaatccaatttaacttgaaaacctacctttgctcaaaatagcatatgaaatctaacaattaaactgaagtatatacacgtactaaaatcacgtgttagtttgaacatatactacaataacaagtaacagatgttcacatataacaaaccaatcaaatgaaatcgctacattttcatatgaattttaggtttacaatgaatctaccatagtccaagaatgagttagtacaacttaattatcacgaatcgagttctcatacttcacaaccatcgatcaaaacaatctggtgtgcacaacaatattgtcaggaataaatatatagtactaattaaaaatactcaaagtcagtgtaggactcgccggtgctcgagttggccgcgccgccaccatccgccgcggcgggggcggcggcggcggcggcgttctccggcggcttcttgtccttgggagtggtggcggacgcggcggcggcgtactgccggaagtcgaccggctccggcaccgacggcggcgtgaggctcctgacgagcgcccagttgacgccgtcgaagaaggggtgctgcttgatctcggtggcgcccctggtgaaggcgatccgcttgtggggctccttgacgagcaggccgcggatgaggtcacgcgcgacggcgctggcgccgccgtcggaggggaagcggagcggctgctcgatgacgttgcagagcgtggcgcggttgccggcgcccttgaacggggtggcgccgtggatgagctcgtagaggaagattcccagcgtccaccagtcgacggcgctgccgtggccctcgccgcggatgatctccggggccaggtactcgtgcgtgcccacgaacgacatggaccgcgcctccgtcggctccgcgttgaactccaccgccgccgcgccgttgagcagcaggcccatgtcgctcttggacgccttgcggctgcgccgcggcaggatgcgcgggaagaaggaggagggctggatgcagccctggttcgccggcatgctctcgccgccgtcgatggcgtctcctctgctgcctatgccgccgccgctgccggtggcgtggacggaggaggacttgacgagggtggggcagacggtgcagcggagggagaggtcgaagtcggagagcatgatgtggccgtcgtccctcaccaggacgttctccggcttgaggtccctgtacacgatccccagcatgtgcaggtactccagcgccagtagcacctctgccacgtaaaacctgacgacgcatcaaagttcaaattttcccacgtaagtttcatattttttttagatcaaattatcggacgcaagtttcaattttcagatcaaatctacaatagaatgatgatacatgaggtacaggcaatagatatattttgttgtcaatcgtgatacatgactatagataaatgtaccaaaatttatactagaaaatagtgtgcttcatggtacatcctcgagcgtaggaaaatcactcgttgatttttcaagcaactaataaggttagtattgtgcaaattccttctaaaattattctgcaaattttagcacctcctgccagggctggaaatttcccctacaatacaatattacttcggctgaaatttttaaacttttcaattttttcattaattttagtaatatttatttaaattcaactaaattttggaaatttcggtgacctccgatcaaaaggggttaaccgatggagtgaaccctgcctcctggtaccaaagttactgctgtctaaatttgttcaaacttgacggaggttaatttcctcaaactgctccaagctccgtggaaacaatttgttaaaattccgaagtggaacctgacctggcggcgggctcggagaagtgcttggagggctgcttctgccggagggaatggaggttgccgccggagcagtactccatgacgaggcagtagaacttgtcggtctcgaagtgggtgtagagcgtggggaggaaggggtggtcgaggaggcccaggatctcgcgctccgtctccgcgcgcgccatcttgttccggctcgcgatcgacgccttgtccatcaccttcatggcgaagaaggccgacgtgccgcggagctccaccaggtacacgctcccgatgtcgccgtaccccagccgcttcagcagccggaagtgcgccaggctcagcggcgccggcgcgtcgcgcgccgtcgccgcctggaccgcctcccaccggctgtccccgccggtgtgccgcttcacgttctgccccgacgccgacaccgacgccgtcgacgcnnnnnnnnnnnnnnnnnnnnnnnncgccgcggcgccggtgctgctgctctccaggctgttgctccgtgtgctgccgctgctgatgctgtccaggctgccgttgctgacggcctcgccacggtttgttcctgctgttgctgctgctgcggtcgtcgtcaccagcgccgccgtcgtctcgggcctctgcggcggcgggttcgccgtcttgtcggagtgatgattcggcttgttcttgggcttcgatttcttgtctggagatggtttggagggtgctgatcgaatgctgaattgatcatcttcttcaaagctggttcgattctgttctgtgctatttttatgagggctgaaatccatgccgtcctccatcgttgttagtttattgaaagcttgagtttctaggtaatctgaaacttcacagggcagaatgtcaaaatttgataggtaatttgagtgaaagtgtaaaaactggaaaatgaaaaaaaaattacaatgcaggtaaaactgaagaagaaaacgagtcttggagttttactctacttttggttggaattttagaagaagaatcgaagcttaatcttttgttcttctttccggatctgttaaacttagttttttttcccatgtaatggcaaaatcttacgtactcgtgactttgtttggctgtatataccccacaaaggtgcagaggccggatttaatctaatctattttttttaaaaaaaaggaaaaacttaaattaggagtagtcttagtataattttatcaccgggatgaaattgtctgagattaagaaagcttcatttatcaaaaagaaatgaaaaaaaatgttctgctactctcaggcctccttgacaagttgctagccacttgatgaacagtttaggttgattgtgcttattctttgtttattgaaatctaaaatgaatttgaaactgaacatttagcaagcttttacaactttaaatgtattaaactcataatttcgaaacttttaggtcatttgcactatggtgaatcctgtaagggatgttgaaattgcattgcgctaagactactcattatggaggaaattctgaaaggctatggctatcaacatcaaataaaaccggtaccacagcatggggaacctcattatcagaagaaaacaacttgaagatcagatagggaaatacaaacctggaatcaaatcttgataagggcttcagacaacaaataatctgaacaatgcttcatgtcataccaggaaaatcaaagctgaaagggaatgatcaaacaaaattaaggaaaagggtctcttattcgtcttgccatgcttgaaagctgcaattggcagcaaaacaggggaatgattgctttgttgggaggaaaagagtaaaaatgcgtgcagacttcgcgttgaatggttcgtggggttgagagaataatccgttaggatggagggcatgaatggaccaagaatgcacttctaagtttagtgcaaaacaagggagttattctgggtcatccatggtctctccctattcttgttctggttgggtcttccgttacagagttgattcgaaacgtgaggaattgtcaattgtgcatgaattttgggtgacccatggaaacataggttagctacagtaaaaaatttgatcatataccttctccttatatctcaattgaggaaggagtctcagcgacctcacatgacctcacatgtcaacttttttaaaatctaaacggaggttatatgatccaaatctcccaagaaggttaactagaaacaattcccctccatgcgttggtccaacgacttagacatgatatattttggttgtaataatccagttttacttaaacttgagttttgtcctggttttacgagaaattactactccctttgtttcatattataattcgttttgactttttttttatagtcaacttttttaagtttgatcagtctgtagaaaaatatagaaatattttcaacacaaaacaaatgtattatcaatatatattgcatattagttttaatgaaactaattaggtattataaatgttgctaaatttttctataaactaattaggaaataggtcaaaacgacttataataagaaacagaggtagtacataccaatattggtcgttctgttgttcacttaccggtcaagagtatcaaaggccatcacaagagttatcgatgcagttatgttcaaaaaatcctttcctggttgaacaactgtctccagagtacagacatcagtgctgatatctttttggttgatccttcttgttcaagttcttgacctctttcatttccttgttgtgacttgtgagccttctctctttcatgcctggaacctggctaattcagagaggcagcattatccagcccttcttgtttttctccatcttccttctaatatacccaatatgcagagagattccaagaataatgcatcaatgatcatgtcgttttcatccctataatcatgcgatgatagaatacctaagggtaaactgtcacattgctacagcttgctttcttgctggttactgccgccattgattgtgcaagcgaaatccaactacaatattgcagaaaaaccacttttgatcacttccattccacacctggtggctggtgttaccatgagccattttccatctcagctgaagaagtacgatgcaaggtaggcttttagcattcttttagaaaagtagccatgatggctccaaccaccataaccaccattgcaaactacccagcttttctcttcctcccactcaaagcatcagtccagaaatatagaatcaatcatcatgcaacaactccacatgagcccattacttcatcccaacagtagggttcattgctcctatgatcttattgtaacatcctctacctctagctggtagttgctcctttctctacatcaacatagatggctgtgccaaggcgagttcatgtcgtcttgtttgtgtacatcacagtgatcctcactgcagtggccgtccatgcacagagggatacctgtggtgccgagctgaacactttccttcccgcgcctttcaattcatccgcgctcctctgcaaatcagtctggaacagcttcatactccgggtaacattccttatctagccaaagttatcatctgtaaaagaaaaatgaattcaaaaaagattgttgtagcttcctaacatagatattcctgacttattgtcaaatgttaatcacaatttttaccatcaaatgtagagaaaaaggcaagaatcagcaaagttctagtatgcttagttataataaaagtatcagtgcctcttaatggtacaaaggttgtctctctgcattgtgcatacatttgtatctgaatccataatcctaatcgatcatcatcacttttgctggaatgaccgaaggaggtcattcaatgtaattaagataggaagaaaaatgttacaagaaaagttttacatcgacagctggctgtcgaggaaggatgtgcaccagagcacacgccccgaaccatatgccaaccgcccaaacacacgctacagagagggaagccaagcaccgaaccggccatcgctatgcgagaccgatcgccaccgggccaacaacaccaccacgacacgaatactctaaaacgacgccttcacgagggttgcgacgccgaaagacgccgtcgtcatccgtccaaggaattggacaaggttttcacccagagctccttgccgagggaggatgggtacctcaacagtgccctcaggagggttaccacgcctgaaggcgaagtcactgttggcccaaagaaattgggctaagctttcgctcagaaccccctaccgccgtggtccgtcgcccaatccgaaaccaccatctaaacatcggcggcacatggcttccgccacacttgaccgacgcccctccgctggccagcttccagtcctgccaacaacaggactgccaccacacagcaccgacgccccaccatcgactgacttcaacgaacctccatccctgagaactggcccaggacccttccgatccaccacccgccagtctcctcgccaattctgcccaaaggagaaccctggactgggtggcattgcttcagcaacctgggcttcccccgttgacaagctgccgcctcaatctaacctagaaactccccacaaagaaggggaggagctccaagaagggcgagggtgccgaccggcaacgaggaagacgacccactgccgccagctccctttgcactaccatctaggcctgcgccgacgccggaaacgctgccgctccgtctccggcgccacctttgtccagcctccttgcctcacctagccacgcataggccaccacgggcgaagagggagctcacccgcattggtcagcgctggtgatagccaccccgcacacgcctgaccgtacgcgtgctgccggccgccgcagcgcctccaccacggtgctggcctccgcagccgccagcctccgccgtcgccggccagccacctccgcacgagctccgccgctgcacagcggaagccacctccgcgcgcctccgtcggccgccgtcgccgcgagctgccaccacctcccctcgccggccgcagccgacgcgctgcccgcctccactggcagccggacgcagagcaccgtcatcggccacatccgcgcccgggggggtcggatccgtctccggcgtgcccggatccgtcgcagccacctccatcgaccgccgcctccgtcgaccaccgccccgtcgacgctgctccgcctccaacgccgaggaagggctccccgaggatgttctccccgccgccgccttcccggccggccgcgcggtttccggcggctggctccggcggcggcgaggcggctagaggccggcgaggtggcggcgcgggcggctagggttttctcccccgagccgcccgcgtgagggcgacgtgagggtcaccatcgatcatcatcacacaactttagtaccatatatgtgctgaatgaaagcaggatagaaataaattggcatttttgttatcaacatagctattgttaggttccttgaatactgaaagttcatactttgatcttcagataatggtgagtaatttcttctgaatgctcttcaattacaaaataaaaaattaagttactctgatactcaaatttttacatggttacttttttctttgttgtgcattgtgaacccctgttagtaacttataaccattgaaatatcttatacaaatggtagtcagtgagcaagtcagtcaaaaaataatctccatatatgttccagcaaatacttgggctgcccaagtccgttagttcttgtcccttgcacatgttcacactagtccaagatgtgaatccgatcttgtactttggttttctcttccctcgtttcacagactagtaccacggccaccaagaaaatagtggaaagcagaactattgatctttaaattgtgcaaacttactctgcagaagatatctgcgggagaattaaaattgaacactttgaaagtataatatatagccacaggtaatgaattgaaaattctgaaagcattttctaagaaacaaatttagagagaaagatattgtactagacaggaatatccaaaaatgttcagatattgaacatttcattctcaaagagaagtatctgactgtcattactgaaaaacatattacgaaacatgcacatgtttctaggaaaaaaattactggccatgtaaaatttgatattattcttctttcaacatcaatatttgtttattttaaacaaatactgtaaagtgctatgttccgctttcttcataataaaaagtcgccaaatctattcttagttcatgtggtctctgcacatcttgcagtattcaaaattgaagagtgaagataacatcaccagcattgtactttcagcaccctattcatctggatgggttgggattggtttctcaaatgacggaaagatggttgggtcaagtgctatggttggctggattgataatcaagggagagcatacatcaagcaatactacttaagtaatcagactagctcaggagttaaagtagatgaaggcaagttgctcacaacagacgttccttctgcagctgtgctctatggagacaatatttacttagtatttcaagtcaaattccctcttcacattgctcgacagtccgtaattttggctttttcgaagatatcaccaaataagttccacctcgcagaacatgatgacaaaacgactctgtcttttgacttctcatcaggtacagttatgttctagcacaactgaattggttttccattggagttttgtttttatgcttcattggtaacagactaatggtacatgctatgttggagtattgaacgcagcccaagaatcaactaccctgtacctaattccactccactggagattgataatatctagtatgccaatataaatatgtttcagctcaaaaggatgctaaactgcttgagcatgctctgttacgattaagaaatacaattatgaagattaattttcctacattgtgtatctggcgcccccacaaaacagaaaatattagaaaagttaaccaaaaaccgggcatttgcatttctgaatattacctacatatgtaaatacgatttaaattctgatctcagaaggatgcattagactttttttttgggaatacacagggagcgcatctttgtattaaggggaatatgcattagacttttgagaccgctgaacagaatctgatcagtgatacctgaagataacgccagaaaaatagaagtagaaaaattagcagagacaattttagccccacttggaatgtcacaagaaatttgcaggaacttgaactccatctggaatgcaggaatttgaactccatcacaggaaaccgttgttctacaggagtggagtaatttttacatgcaataaatggggccttcacataaatggctaaattcctggggtgtttgatagcagacagcaaaggaatagggtatgtattgagcagttgagaagagggtgatta

SEQ ID NO: 60279 - DNA, 7602 bp, Oryza sativa
  unsure (1)..(7602): unsure at all n locations
tggggnnntaagctccgatcacttgtcagnagcncatcaattaatttgtgctaatctttcgccatttcaaaccaaacaaaattcgtacgtattgcgcatgtttcttactccctccgttttaaaatatttgacaccgttgactttttagcacatgtttgaccgctcgtcttattcaaaattttttgtgaaatatgttaactatatgtgtacatgaaagtatatttaataataaatcaaatgatatgaaaagaataaataattatttaaattttttgaataagacaattggtcaaacacgtacttaaaaagtcaacggtgtcaaacattttgaaacggagggagtatatgtgccactgcgcaattataccaactaagaatctccaaaaactctgatctcaactggaacatcattacaacctctgtaccaccactgaacatcacaaataaactctttgctgaacaaaacgagatggagaaatgggtagagaaaagttatgctctttatcacagaggaatttgttcgatctgtttgcttaaattcgatcggatttggaacctgaaaatcgatcgagaacaaaagctttacaacgatggcaacatggtgggacaaaggtacgcgctggttacctgcaaaattaggtagggtcggccagtcaggggagtattatcttttacgcacaccaccgaacctctacagatgatcatggccagaaaaactactcccaagatcatcaattgtagagtacatagcttgacagacagatcagcactgaaagccttggttggtagtcatacaggtcaatcatgttttcatggctgcaggcaacttctttcctatggctttcaccttggcaaacgagtcactgttaagattagttcttttgagctttttgggctgaccagtgctttgttttctactagcatgcttttttaactgataaacaatatttttaaaagaaattgtttacaagtttctttaaagaattaaatagatatttttttaaaacacttaattaattatatgctaatagctttctcggctttttttttctcaatgagctctaaagaactcagcataatcggtggaaacttctgtcagggaactttcaccgtgccactgagtcactctcatgtctgaaaattctgaatctctctctctctccctgtcttgttcttagcttctcttccttgacacaggaaactaataattcaagtatatatgcatccctctcacacatacacacacactaatgtgccaatgacaaacaaacacatctgtcctctgagacagctctaaatataacttgtttggagtgactttatctgacctgttgtatttggactagtccttataattgcattctgattcttccaatgtgtaagaagagaggaattaattcctacgggtgaagttgataattctgacgcaactaacttactagtactgtgttaatgtatacgcaagcagagattaataatatgaaaaactccgtactgtgttaattacaactccttaattctgcgagtgtaaatttagctgcaagcaagagtccatcatgtgcactctctgaccgtgcatgagtaggtacaggaccgtgcatgagtaattggactaatttatttacgttttgcttaaatctgggagctttcgtaataacaaatctctgaaatagtaaggagagaaaaaaaattgatataattaactggttcaataaaaactctcattataaaaaaaaacaaaattaggaagaacgaatctgtgttggtgaagttggttatctgcaaaaggcagatcaattatttctctccttatcatattactgttgttatacccaccaaacctgaagatgataaaatataggaacacactagaagaaccaagatgcatatcgacaaacagtgactacagatctgcaatgcagtgatgacacgttgacaccacgaccttaattttaatttctcaattattaaaatcttcaggtggcatatctataacttggatgattaattcaatatatctataataatgaaaccagttgatcaaaatgtaattaagcaggccaatcaccactgcatattgttaactccttttctgaaatcctgcatgaataatgttctcttcagtgtcaccaccatccaaccacccccaatgtctgaagaatcttagctagtcgcagtcagtctgccttaacaccgactactcccagttttcaggtacaaacaattcacatgcttaacattcttccctgctactatcagcctgtcactaacaataattaatagttgcttactaaataaatattacagcactataaagtatagcttgcttaattagctaatgagatgtgcacgcgtaatgcaatttactaacctgacgagtccacgctaaaaaagggtaacttcttggtggtagtggcatgaattgtactactgacactactagtgtactattaaggactaatcacctcattagtctatacacattctccgttttctaatgtgtgacgttaattatcgatttctgaacatagaattttactatttatcttgctaaaagaactatataagcattatttcttttgttgcgacttgttttataccacatccatcccaaaatattaggatttttagggttgaacacaattattaacaaaacagatagaattaaatagggaagattgtgattggatgcaagtgaagataagtgaggaaattgatttgtggagtgttgtaattagttgggaagagaacatggataaagatgttgttatatttttaaataaactttgaagactaaacgttactattttaggacgaatgaaatacacggctcaagtatatatgacttatattttctatatatttgtacttattttattttaaataagatgaatgatgaattgttaggtgttgacaatgtctcattaaaaacgaagggagtatttataatagaaaaaaagacagaataattaaacagagaaatgctaactataggctaattaaggagatgctaaatataggttaaatcaaggagatggctacttcacataccaaccccattagaaaagggaaaaagctctaccacgtgcatgctgcttcatcacttcatctcctacaccaaccactcccatcgcattatatccattgcttccctttcatcttaaatacttcatctgtcccacgaaaactcaacctaagaaaaaatatgatctcttttaatataacaaatttggataactaagatgtgccacatctccttctaagttaagttttttttaggacggaaggagtacagcagtagtagctacattaattatatattagcagcactcatcctctcactagctcctccttcagcttgctcgatcagctcaagctccagctgcagccatggcgaaggcggctctccagctgcttctgttactgtgcgtggcggcggtggcgtgggcgatggacgacggcggcggcggcggcgccgggatgacaaagatcaaggtgtactggcacgacgtggtggcggggccgaacccgacggcgatccgggtggcgcaggcggcgtcgacgaacgcgtcgtcgacctacttcggcgcggtggtggccatcgacgacccgctgacgagctctccggcggcggcggcggcgggggaggtggtggggcgcgcgcaggggacgtacacgttcgccgaccagagggtgatcggcctcctgatgaacatgaatttggtgttcaccgcgggcgaccacaacggcaccagcttggcgatcatggggcggaacgaggtaatgtcgccggtgaggaagatgagcgtcgtcggcggctccggcaagttccgcatggcgagggggtacgccgaggcccgcaccgtcgactccggcttcaagtccggcgagaccatcgtcgagtacaccctcttcgtcaaggcgtagctagaagatgatgagcgacatacataagcacatttatgtttgttaaacatcgtttgttgttgtaacatgcttgatttatcgattgtttatcaagcttacaataagataagcagctccgacttgctacgacggatcttaacctaaacagttgacttcactgaccaagaaagccccaaaggatcacataggagacagcttaatcggaagctttaagaggaaaagaggtccagccactacagtagtccagatcaacagtgacaggcccaaaacatcacctctgacggatttaacctttgtcaaagatgagtggtcagtgttgtctcctctcgcctctaacgggtggaggcatcctttagtgatgactatcatatgtgacgggtcgtaaaatttcactcatcacatgtgacagatcgtaaaatttcacccgtcacaggtgatattgttctctaacggactacatattatcacccatcaatgagctgcttaatagggaaaaaaatcagttcacatgttagcacccgtcacttatatgcactaatgtgaaaaagcaaaaaataaaaagttaatccttgttcatcgttgtcgtatcaacacagtgtcaaaaaactacaaacagaaaggaatcaatcatttggatctctcactgcaaactaaatgcaataaaatctcttgcggaaaaaaacatggaagatctcgatcatcacaatcacataatctcacatctcacatgaggaaccataagaaatttctgtggaaacaatactcttcggaaggggctcataaggtagacaagacctaggatggccgataggggctcgcatggctagatctggcagcttgccgacaaggattgcaactagccgccaggacctcctcctccaccgctaccaccatccgtcgtggtcttttgcaagttgaacaacaagcttggagggggcaggtggagcttggggtggaagaggcggtagccagagctcgaggatggacaggcgtccactggctcttgggggcaaaggagacgatgatcgtggcagccagagcttgaggtagaggcgtagggacgggggtgctcgtgggtgggagagatcacatgaccaataccggatccagccactacggtgttgggggcggtcaaatccagtgtccccccgacctcctgacctcaaggaggctggatatggcacccctgtggctcgatgaagaaggtggtggtgtcggtgccaaaccgagcttgtaggtgaagaggttaccgccggcgcttgggggcggccgaagctcaaggtgaaggtggtggcgatgctcgtgagtggagagaaaactcaaccaacgccgaatcgacccaccacgaggttggggccgatcagatctggcgtccccccacctggggacgccggatctggcatccctagggctcgaggatggtgtcgatagtgacaacgatggtggctgcacatactaaaaatttcttacaaatttcttagtaacaaaaatcccatacaaacttctttctaacaaaaaatcttaaccatttgatttagtcaactgaaaattgtaaaaaataataatcaagatttaaccgtaatgtgatacctcaatgtctgtaaaaagttcaaaagtgtactacctccattttagattataagactttctagcattgtccatattcatgtctagattaattaatgcatatataaatgtgggcaatactagaaagtcttataatctgaaaatatctagattcattaacacctatataaatgtgggcaatatttgaaagtcttataatctaaaatgaaagaagtagtacacatatcgttgcccgtctaattcatagacagttaatctaagttgcctcaagagcaacagctcccaatctgcaggtacaaactacacatctgcttccctgtacaaagtagcttatactactacaattagtatagtacaagaaagtaggttaattagttagctgacgagttgggcacgcatgagctcattaactaacctcatgacagcccacgctacaaaaggtcacttcttggtggtagtagctggccttcactatacggaactcccagtactaatatactaggactaatcacctcattagtctggacattaattaggtatattagttaattattaataaattaattaagcagaaaacttaattgccaaatttatactccctccgtactaaatgtttgacgccgttaacctttttaaacatgtttgaccgttcatcttattaaaaaaaatttaagtaattattaattatttttcctattatttgatttattgttaaatatacttttatgcatatatatagttttacatatttcacaaaaattttggaataagacgaacgataaatatattttaaaaagtcaacggtgataaatatttagcaatgaagtgagtactataattaagtactgcttggccaccacttctcacctcacctaccgaccccattagaaaaggcaacctgcatatgcttgctctgccacatccactctatctcactgaatttcatcatctcctacaccaaccactctccaatctccatttcttgcttcataagtactcgatctctcactagctctagctacctcctccctcctcctcatcttgctcagctccggccatggcggcgtcaccggctttcctcgttcttgccgtgcttctgtgcgcggtcgctgtggtggcgctggcggcggacgagggtgccgcggggatgaccaagttcaaggtgtactttcacgacgtggtgggcgggacgaaaccgacggcgatcagggtggcgcatgcggcgttgacgaacggctcctccacctttttttgcgccgtggtggccatcgacgacccgctgacgaccgacgcggcgtcgtcctcgtcggaggtggggcgcgcccaggggagctacacgttcgccgaccagaagacgttcggcctcctcatgaacatgaacttcgcgttcaccgccggcgaccacaaggggagcaccctcgccatcgtcggccggaacgaggtgctctcggcggtgagggagatgagcatcgtcggcggctcccgcaagttccgcatggcgaggggctacgtcgaggcccgcaccgtctactccggcgccaacttcggcgagaccatcggcgagtacaccgtcttcgtcaaggcgttgagaagagagatctacctgcaaattaaaacgctactggcaattattgagcgccgtgtttgtacgtgcttaattaattgattaggcttttcattccgagtgcattaaatattgtttatcatcatctttggttgattttccgattgggtttcagttgatctaattggagggcgaatcgattttggttgaataaattgaataggtcgatttataagtgtttggtagagtacggaattaactaattaattagctagtcaatggaagaacaattcaaggtgggagtaggaatactaataaacttattaagagtaatagaattattgaagaatacttcaatggagtaggattcgattcgttgggttgtccgtgtccagattcttttgtgggggggggggggggggggttcacttttttaatccccaatttttcggatcctcggtatatagcctggctctgttatctggggccctttgttcattcgtcacttccatcctctccttccc

SEQ ID NO: 60280 - DNA, 8134 bp, Oryza sativa
ctgtgaacaaaaaacatctaaggaggaggatgctcatttatagttaaaggaaacaatgcaacgatgcaaacaacataggtaggacacatttacgagctgaaaccgttgcggtgttcaaattgtatctaaaacttgatttcagacaggaaaatgccaaagtgttttacttaccctgggagggggaacaccagaaccggcgctcctggatcacctctgaaaaaattgctgtttttactttgacgcttgctccttttcttttcttataaagtcctttccccggaaaatgaacccccggaaaactacccccaaggacaattaccccccccccccggtgaattacaccccgaggacaactaccccaaggacaattaccccccggaaattacccccggagaattaccccctgaggacaactactcccccccccccgattaggcaagacattaggcaagagttaccgtctgtgtatcactagctagcacccccctccctctccccgttgtgcgttaggcaagagttaccgtctgtgtttctgagaagattgataaacggttctattatttatttccctataccagacggttatttctgtctcattcatctccaaaacgaagtgatcattgatgtgacatataagagagtggatttccactactatccatttagagctgggctcatattaacaaatcattactataagcctagttgtcaactagtatataatagttgtcaacttgctgagtaaggatatgaatatgagcccaagtggtgtttcacaaagacttagattgccttaagttggacttgaactacagcaggccattcatgccactggttgctctcaccattcgtctctcaagggaaatcccgaatctacataatttacattttttgatagttcattgttgaaaaaaagaagttacattgtaaacttaagttttttaagacttggacatatcctacggtaggcgatctttgcccttaaaaggtcttgaaccagatgtaaaattagaggaaaaaaccttataaattgtgatctttagatgatatattttttttccttcaataatcaaaaaatgtaaattctgtagatttgtgaccacgatgtgtacgttccttgagagactaatgccaggaatggtgagatcaacaagtggcattaaagggcttgccacagttccagtccaacttaagtcgatcaggtatacaataatgatggctttactctagcttttggtaaattcctagaaatatttgatgaatcgttcaattccaacttaccattacagtgtcttgctcgagcttaccacaacaaggtgcctagatccccttggatttcgaaaactcttttaaggtccataaatagaaaaaaacagattattatatatatagaaagctgaaccaaacgaaaagaataaaagtaaatatactcatctatcggaataagctaactgttatacttcgcatagcaaaaaaaacaatattattaccgtcaattcgatatattcaagtccgacatcaaaagtacgtcgaaggtaatcaaccaatctgactattacaaaaaaatgtatgttgatggtgaacatatacacaataatactagcgttgcaaatgcgtacactaaaaattcatttttcgttaacatacgccccaatcttgcccgcaacattcccgattccaattcaccattccatttttatttatgaggcaacattccaaatagtattttctttttatagttcaggttatgatggtatcactaatgttttactaactaaaaaaaaatcatccatgtaatagtttctcctatatttgtaatctatcactaacaaccggcactgtccctgataaaaaaaaaagatcgcaacggttatacccattttttaagaaaggtgatcaacaggacgtagcaaattaccgctccatttcacttctaactattttctcaaagatcctcgaatttgttttttgtttattctcgccttattgcttttttttaaattttaatcatgttctctcctgctcccaatttggtttttgcaagaagcactcatccgcgtacgcacttctattatttatcaataagattgcaaatgctatcgatgccatgttgccatgaagaggaaatcactctgttaaaggagaagccctctccgatgtccagttggttttgccgggaacgggaattattttgaaagaaatagatcagtaaaagtttcaccaaaatcctattagaaataagaaagttaagacttttgaaattgtaatcatgcaaataaaaattgacaaccctgtgacgtatcttccaaattactctcccgtttgctctgtcttataacatatcatagatttataatttctttgatggcagttttaactcaattacactcatcctagataataattgcaaatacgattttcatcaataagaaaatagaagtatttgtgttcgttgattacggcataaaaaacttaaaaactttctaatacttgttagaatcggatcatttcgcgcaagaaattcccgctatctctcggagagacttcgggtgagggagatgctaaagaatatcaagacaatttaccattccttactttcgtagtacgttcggcaggtaaaattgcttcgtgaagaaaacgggctcgacaaattacgttcgcaataggttaacacgtgaaaacagttttcgttttcctagagatttcatacctcattttatctcaaagtctgatttttgcacgagagcaaggaaaaagcgttcgaaaactctaaacaaaaaattcatctccaaaaaatgtccgcatcaatcccagtgaatatgcatgattgtatgccacaagttaacgcgcgaaacacaaggattactagcatttccttcagattatgtaaaatgtgacttatataaaatttgagggtatggagcggatcaatgaaagaccccggggaataaggttctctttggccttggacaaaaatccccacaaaaaaaatgttataggccctaatcaagtagaggtggatttatctgatatatatatatatatatatgaaatagagtggttttcaacaagtatcaagtgcaaagtgttctttccgagtggcacatttctttcaaaattaatgacaaaacatcttaatttgctacacagctctttccgtgtcacttatctttttattattcacatgacagaaatcatacactctaaaaaccatctgctcttttttgtaacagccccactcatcaccctatcacttttccgtatgtgtctgtccatcgtccgtggtccgtctgtctttctgtatgtttaactgaaaggagctcgttgccaaagctcgtcatatcaccacttggtggttctgtgctggaacgcagggttattaactatcacatacatgcatttctgagtttcattggttgtcatttttctctgcagctcgctcgctcggccagactcacttcagtttgtctgagaaggctatctacgaagtattgaaatgaagttttcggcgatcatcgtagccgccattataggagttctctgttcctgtgcaggtaaggcaaagtttaacattttatatatgataatacgataagttagtgtttattgtgaaaatagtttctttctaattattttaaactgtttcagaaaataaaagttgtcatcgaccatggcgttttacggaaatggcatatcagaacaaaacagactggattgacgcagttttacgtcagacagatgacgcctcgtgtttaataagaattaaagaatgttgttgttcgctcttagtagcatgggccatggcccctggacccacctatcgttaaataagtgtttttaagcatttttttaccgaaatatttgacattctttcagagggtactagctgtcgtccaccgaggagtttacggaaaggacgttacgaatatcagcacagtacaggctatggattgacgcatctacctgtgaattacatggtgcgcgcagtgtgtgagcctgacgcagcgcttgtaggagatgaattcatcatctgccaggacaatggacaatggagcgattacccatattgccatggtaagtgaaaggtggttctaccttttattttcgttgatttttaacaaaagcttgactagcatttttgtattattagttactacacgataagtgtgtccatcgctaagtcagtaagttgcgagacactattctggcggtaaacaaatgccaatctattcatgtattcaattttttaaagaatttaaacaattaaaaaaaaatcacagaaatacatgaaagtagaggtgttgtggtataagcataatggataagtcaccgaactgtagaccacaaggttcggggttcgatttattgccgcggcatttactcgatttggcaatacatgaatctaaatttgccacactcgaatagactcgacccctatgtatttagtgagtacatagtacatagtaggattaatcccgtgagtacaatcagcgctactgctgcaggagctcgagccggggtaataatatgcaaattgcaacttaggctaaaatatctgtcagcataattggtctgttttgcaaatcaaatgtattccttatttttcctcatgaactgaattttcttctaaactctcgatttctttcctttgacttacatacaaaacaaattgatataacaatgttctttcaatataagcctaacttttaatgttcatggctttcccaattaagctccttcattcggggttttgctctcaattctacaatatttactgtactcatttctatattaaacattttataatattaggcagtaagaaaggagaaaataaatatagatatcactttctacaaagaagaggtcaatttgtaatgaataaggcatcttgctattttgttccattaatcatttcgcttatattttataaatatcgtccaaattttgttctttaaattgctaggacctccatcatgccccgacccaaacaaaccgttcggaatgctagccttggttcttgataccaactctggaatcaaacgtggtgatctctacaccgaacgcacagtgttcaactatacctgccaaacaggatatcatccaaccggggacgtcacaatcacgtgtcagaatggcacatgggaagcggatgcggatgtcccagaatgcaacagtaaggttcaagcagggagttgaaagaaaggaggcgaaactcttgtaatttattcaaacgcattcgtgagttctaaagcgtaacaaaggaatgtgtaacattatacttggctttgaagttccatgctccgaaccgcggttccactgcggggactttcggaagccaggcaccagttttacatttattacaaaatattaatttaccggcaacatttcagtgtaaatcaaaaacgttatatggggattgtattgggaatagtgcatcaaacaaatcttcaaattaggtactccgttcttcctttaatgtgtgtgccagagttggtaaaaagaaaaattaaatcctgccaaaaaactcaatgtttttaatgcgataatttgtgcatgttttaacaaatcgatcgaaatttggtgagggggaggggatgcagaatgcgggagaagatgaacagatgaagggcgtttaaaacttaagggaattcgtacaaaggggcacttctgcatccctgccctttgacaaatgaaatgagattggaatcgtttgaaatgttcctaatttgtcagggacgttaaataaatgaaatggatcttttgtttctgctttcttgtaatgtttttaactcgttaatctttacgacatatggcatttgaagcctcccccttaactttttaaagtcagtgacgatcgtcaaacgcacctccgattaattattttgagagttgtttaaagcaaatcggaaggagagctttttcatttttgttatcttatttttttaatacaaattccaatgtcaaaacgcaattcatcaagcaaaactgtcaaaacatatacaagtgcaatagtgtatattatcaaataagttcacatataatgtatattttcataactgggtgtgggatagcttgcgagaaatacgaacgtcatgggataacttttagacgtttaggttatgaaaatgaccttacagatgatggcccgaattcacaaagcaaggtttgagctcagaccaaggtttgagctcaaacctccttttgtttcgccaaacctccttttgttctttacaaaccaggtttgtaaaaaaacgcgtaaaacgcgtcatatgacgtacgaaaaccaaggtttgtcgacaaacctcctttgtgaattcgagccgatgggtctatccgtgtaggttaatccgtttcgggaaaaatggacaggggggcatgattgagccctaaccactcccacggaccctgtgcgttattgtcattcaatgagccaaacgttggtacatctttattcttatgatgcagtgatcacctgtgccccacccaccctggagcccataaagaatggttcacataacattgagaacaggacctaccatgttggagaagtaagtctttagttgtctctcatttattggggaacaaaaaaaaaatccaagttattaataaaagaacaagatcatggccttatggatagtggatttgttactatcaccattatgtattatctagcatgatgacgaataaagatgataatgataacaataataattataattataacaataataataatgataataatgtaataataatattgatattatgatataataataataataataataaaatcatattgtattttataagaagggataattgttgcttgaaatcgcacattcaatgagaaataacttaagaattcattgattgatttagacagattttttttttatctgctcgccattgatccgtttagatagttttttactaattgatcgtttgattaatttgttaatcagttaagtgactgattaaacttagattatcgaatagctaatcaagttattgggttaataaatccatagattcgttaatcagttacgttatttattaataagttaattgagtcggttgttttatcgcagtttatttattggttaatcagatgtttaaaatcactagatgattttttttttaagaagtttaatttcaatggtattctgaatcttcgtccacagatggtgcaatatcaatgtaacgacgggtatcacgtcgaaggaataagttggcaagtatgtcagagtcaaggtggacccaatgggatatggtccgatagcgttccaagctgcaaaggtttgtggtactatcattgataaagagaattaaatccaagaagtatcaacaagtcatttaaatgtatttataaatagggctgttttaattagggctgtgttaaataggctgtgttctttctctttcttatttatgcttacttaaaagttctacacattcctttttttaaaaaggttttttttttcattaccgagtagtcctttgctttcgtttttcattgcttccgtgtattgaaaattaagtacattttatctaaactgttgtaaatatacgtgagtaggcaccgtgcgagtgaagatgcctctgcgttgaagcatgtgggaaccagctggaggcttgaccacacgaatgactggtagagcagcttatctaaatgcagatgggttggtgaatttgacaacgggtctgtcgctcgtaacgttggaatttttgttttaccctaatttatggaattattttgacaatgatttattcctaataaatctagataatagtatacattctcagatttcaatgaataataatttgccagtgtttgttttggttgactgctaaggcattgtgtttgctattcaactaggggacctacgcccttaagccatacattacagtaatgaggattaatgccccacaaaagggcactaatatagcacatcgacacggttttgatcctggggcctcacagttccgaggccattgatgtgccactgaatcgtgactgttcgcagcgggggcaaaggtagggggcagttcccaccaataaaaaaataaataataataagatgcaccaaaatataaataatgcattgcattttaccccggtcctcaacataaa

SEQ ID NO: 60281 - DNA, 4487 bp, Oryza sativa
atgcaccttaaaccatccacccctccacccattttattacttaccccccccccccccccaagaaaaaagcatttacattcactcgcacctcacagtacatacactatttcacacgcgcacaacactgaaactctagccaatcatcctcactcaaaagatcacaccacggacacaacacttatccactcaacacatagaacactgcacaaatacgccattcacacaacagcacccacccatacatctaaccacatacctaacatcctaactcctaagaaaccaacaaacttaaaccttctttgattagatttacataaaataaaacactaatgcgcattgaccagttgcacataaaaagaaagaacatcaatgacatccctttcggatcctgcacccgacattgtaattcatgtcaatgatacaacaaaaagattgagaggtaccatgagtataatattttcttcagctagttaccctgcactgcattggtatatttgtttaatagagatttcattcagaacaaatcattacaaacaaatcaatgtatgaaattcttacttaattactgaccaattatgcctcctaacacatagggcagcaacaaagtctttcactccgtccgatcctgggccagtctttggatggttccccatgtgtttaatctatccttccacagttcttcgccaagtgtttttaggacgtcccctctttcttttgccttctggtgtccagtggagggcttttcgtgtgatgtcatctatgttctttttcatcatatgttcgatccatctccaccttcttctcatgatgatgttctccatgctgtcccgatggcatttggcatacagtgcttcgtttgaaatgttgtttggcaagaaaatgcgacatattcttctcagactctttgtgtggaagaccgacagcttttgaggtcgttttttgtcattctccaacattcagagccgtacagaagagtggaaaggacacagctctggtacaactttatcttggtcgtgatgctgtactgatgtgatctccatatattattgagcattctgaatgcatttctggctttattaagacagttcctaatgtctttgcctgcgccttcatcgtgcctgacagtgctgtccattgcttgtattggtaagggtcagaaatgttcagggtcatcacctctgttttcttttggctgatcttcaggccaatttctaggcaaaatcactgagtctggatattttttcttgcatatgctggcgggtgtgtgaaagaagagcgagatcatctgcaacgtcgaggtcctcaagtgtagaaaagagggttcatcttatgcctcttttttggtcttcagttgcctgtcttctcacccagtctatggcgatattgaagagcagtgctgatatgacacatccttgcctatctcaatcttcacctggaacttatggttactgtttccaactctgcatgtgaaattgatgtaaaagctcttaattacaagatctagctgctctggtatcccatatttacgtagtattctccaaaggctgtttaggtggatgctatcgaattgctctatgctattacgtagtgcaaatatatggtcagtgcatccttttcctttccgaaaacctgtctgttcccttctgaggctttggtcaacagcatctatggtacgggtaaaaactatctttgccaatattttgcttggtattgacaatagtgtgatgccacgccagttattgcagttttttagtgatcccttctttggtaattttacaataactccctctgaccaatcgtcaggaactgcctttgtttcccatatagttgcgaatagtggcagaaggatttttgctgctaattctgggaccgccttaaaaagttctgcgttgagattgtcagagccggggctttaacattttttaagagatttaattgcagttattacttcttatttagttggtggtatgctgctgacatccaagtcatcctctgcctcttgtatgccagcctctactgtcggtggtggtctattcaaaacctcgctaaattgctcggcccatctagcttcccgttctgcttctgttgtaagaagcctcacctgcttgtcttcactaggtgaatttgtgattcctctttacttgccgctgattattttagtagttgtatatacttttccttgttcgcctttaatggttgcttcctctgcctgatttgcaaggtcttcaacaaaggcacgtttgcttgctcttgtcttcgtctttacgaccatgtttgccactcggtactgaagcttttacctttctttcagtatgtctgattttgcttccatggcttgttttttcgcacccttccgtttatctatggcttgccaagtatcatcagttatccactctttcttttccgtctttgtgactcctagaaatgaatcgctaatatttaagtaggctgtcttaacctgttcttgtaaatacttccgtacaaatacaaatcttcattttgttttcataacacaaataaattattcacaaagcagtgaacaaagaaggaaaataatagaatgaaatcactaaatttgtctaataataataaaacataatgaatttattcattaccatcactcgtgaaaaataacaaaatacaatttgtatacaatgcaccctccgttagtattccctgccacccctcaatcccttcttctaattccccccccccgcaaccattcgcattcacactcacaagctcgcacctcacaaacatacagatattcacacgcgcacgacatttcacacgtcatacctgttcacattcatattcttattcacttttagctcttcccacttttgtaggtgcaaattcaacttgcccacctttactgctaagttttttttcttcctcataaagtccgctatatattcacactggaaggtacatggccttgagccctacaatggaagattctacgaaagaagattacatatttgataaatatgaccaaagaattcacacatttatttatattcaattcaagagttctttattcgctttaaaaagcacatataaaaaaataacaaaaaatatacaatatattctacaaatagtcacattcacaatatatgtaaagacaaaaaaacaacatcaacaacagaatacatgtataacagggtaagatcagagtgtgcataaatacaagataatttcctcgcactcctctcggttaaggaaacccttacataaataatcatccctcgagttgatcaattcctttacttgttcaactattcgtattgtctcatcattcacttggcattgcacagcccactgcttttgaatttcattgttatccatgaagtacttatcattcaagaatcttatgttacctcccaacacagaatgagctccatacctggccattccagctatatgtgccactgtataatttttggaattcatagctttcaaaacaaaagataaacatctttttgcaaaccataactctggatccataacacctgctaaataaggcaaaagatgacagtgtgtctgccatggaattttccaaacccttcttattgcaacccgccattgtctacaaatattatcaaaacatttatcaaacagaggatataactgtgagccatagaaactcgaacaatatttatgaaacaatatatttcttatgtgagagttagcatatttgaaattaaacaaaaacatattacattgtcgattgaaatctccaacacactttgagatatcaaaatcatttatattcttagaaatatcattccctagatgagttacttttgatgcaatatcaatatgtcttccatttatcgtgattcctggatccataactggtttaccattacagctgaaaactattaactgactcttttcagggttaaacaaaatatcaaatttaatggcataatctaaacaagttttaatcatttcttgaagagcagtcacgctaggtgacagcagtgtcaagtcatctgcataaccaaatgctcctgcaaaaacattgcccataaagcaccctatcccattgtcacataactcttctatcagcccatctagatacaaacagaacatgcaaggagagataactccaccctgtttaacaccatttttaactgtaaaataatcagaatatgcattgttccatttcaaccttagcctttgattcttatacatattaagcaatagcctgcatatcattgggcagacccctttgctcagcataatgtcaaacaatttcacataattaactctatcaaatgctttactagcatctagcaataatccatacacattactcccttcatgattaaagtacgatacagtttctttaaccatagcagtacatagtgtagttgataaccctgctttgaaaccaaactgtaggtcattagtctgcaagttcccttcttcccttttcataaatacataatctaaaactttaccaatgatactaccaagtg

SEQ ID NO: 60282 - DNA, 8089 bp, Oryza sativa
  unsure (1)..(8089): unsure at all n locations
ctctgttgaacaaaacagttattaatagtgttagatgtatctacctggaaagctatttcctgctaagcaatattcatgtttatgttaaagtctacaaaatcatatatttgttatttaaccgaaggagtagcattcttcaaactagttggtattgcatgagcaatatcgattatctggagtaattgatttgcattaatcccaagattttggaaataagccaaacgctttatatgtccattatcgaaaatttaatttacagtgcgtatgcctttattaaatagatcataatcaaaaatcattttacgtcttatacatatattatgattatttaatataactggatttacctcctcttcatacaatccatacttcctcatatcctgccaagcctttagcatttcttaataaaatggtggtattttcaatgttaatttggacgtgtcaaggtcacatttaaacagaaatctccctccaactgttctaaaacaaaattgtaaatactattccatccagcacacctatctccatacaataaatatttcagccacatcaaacgttgcgcctttacaaacaatttaaaattcatcatttttaaccctccatgagagtaatccttatacattatctttttctttacgcggtctttacctgcccacaaaaattcaaaattaatgttttccacctaacttaacaaccactgaggaataactttaagtgatgagacatactgtagtttaactttgataatgcatatgtttttaacaattgtattttacccatacgtatgagatctctttgtttccaccatctcaaattttggatgtataatggattttgccttctttttccaataacgtaatcacacacacttacgcacacacgcaaactcgtgcacgcacacgcacgtcccctttaaaacatacaggaccacagtagaatgtgttgtacaagggattggttattttataaaccttacacatatcgtctctgagagagaatcctacgtcatttatatatttacagccctgatagtgggtgcgtgcgtgtaggtgtatgtccagggttgtggagttacatgtaatgtacctgcattatgaaccacaccgttttgcggtattcaacttttatgttcttattttcactatagagtacgactgtcccgcattggggaatcccatacacggctctaaagtcagctctccgcagtacagagtaaacaccaaggtcaattttcgatgcaaccatggttatgagatggttggttccgaagagaggatatgtacgttttctggagagtggacaggagagatgccaagatgcatgggtaagaataacattttacaccccccccctaaaggtaggcgtaccaagtaactctttattacataatttcgaaatgcgcaagtgttcaccgcaccacaaaaaaaatattaactgattaaaaaacacctggtacactaatttacaccccccccccccttaaaaaaatgaaaaagaaatggaaacttccattgtattatactcacgtataaaaaccatctcccggagggcccggaaacgtagttttcaaacttcaaagtgctcggtctgtcatttgacacatcatacgtcaaatttactttgctgctcaggggcgcactggatgggctcttagactgtgtaccattattattacccatgttcggatgatcttgtagcagaaatctcctctgtttaaatttaaggtcgtgatgagttcgacgaactttctcgagtgataaatgggctagggaagaccttcgacgaaatcgtcatcgacggcggctcttgggtgggtcaaaatgacacgagctcgaactcaggtgtgcgaagaaaacgtacaattaatctctcttctggaatggatatctattttgcgtttgatgcgtcgaggagtgttggaattgaaaacttcaagataggcaagaaatttgccaagcttctagtgcgaaaggttagagaagtataaagcaaaaatataagaaagtgaatgtctatgttaaagaggaaaagagttaatagagtttgacaaatctttaaatttctatttttaataacaacttataaacattacctatagaattgtgttaaaatgaattattgaggataaaaaagtcgatcaattgataattttacataattttatgccattgttatataatttattttaaatcaatgggtgaatttgaaatgttccgagtaaacaaaggcatagaaagggcaagattaccatttttcctggcgggaaccctgtatgacacttagtggcttgaaaagggatggactccttttaacctcaaacaggctgaatatccttttttggtttgttcaaaaggaattattatggatttatagcactaaaccttggttaattatggtggctcctaaagggacacgcaaacgcaaaggattggcgtgtatatatatatatatacatgaaacatttttgtcttcttttacgttccaagacgtgacacaaaaatacgtatacctatgcagctttttttggtctttacgttaaagacgtgaaaataacaaaattgacgaatacctatgcaacaatttttgttatttcttacgtccaaaacgtgaatattaaaagagagggacaagcagaattttgtttaagtgagcttaaaggtaatacaaagttttggtaaagggtcatgaattcggttcaaatgaacatattggaagcatatgcgatcctacaatactcagtgatggttgtcgcggttgaaatcgagtctaaagtgattaaattgtaaataaactctttatgttgtatagctccctctcacggtcaagatattaattaagctataaaacaatgtttcttgactaaaattgaccgattagttattctcgtttgaaagttatatatcccaactactgtacatatcctgagattttcatggtcgcagctaccagtgtacggccgtaggcgctatttaaactgtataaacatttaccgggagcaccagtaaatttgtatattcaatttttctcaaaagcagaagtgttttagaggctaaattttctagtgcttatcatacatccgcaggggcatccaaatatatcataattaaaaaaatcactatccaacaaattttcaaaaattcccaaaactttatattacttttaactataccgttcggttcgtctgatgtatgtttagtgaaagtcaggcgcggatccaggggaccgagcgggcccccacccccccccccccatcatctgatggtaattaaattactaaaacccttgagctcattggggctacgccccttaaccccacgccaattagtgtcctgccagtgtcacaaataaggtatcaaaataatgctcatctgaccgtaattaattgcccaaaacccctgaacttccggtggttccgccccctagacccaaccaagggccctaaggcgggcccctggacactcatcagacgataatttaatgcctaaaaccctgagcttctgggggctccatccccggacctcacgccaataagtgtcccgccagtgtcacaaataaggtatcaaaatatgttcatctgaccgtatgtaaatgcctaaaacccctgagctaccgaagggcctaaggcgggcctctgaatgcttatctgaccgttataaaacggcttaaatccctgaacttgtgggggctccgcccctagacccaacgcaaattagtgacctgccagtgtcatgaataaagtatcaaaatatgctcatctgactggaatcaaatgcacataccccctaagatttcgggggggctaagccccttgacccccgacggggcttttccctagacccaacgccaattaacggtacgctctaactaattgtaaatattttagcctccccccacccactttgaaaaacgttcagcagggcctgcatgtaagagtgcggtgatgcggatttttgtctgcccccccccacccaactggtcaccattacgtaccaatagttggctctcataatttcaaatttgggcccccctccccctaagaaatcctggatccgcgcctggtgaaagtaggacatttaaatttcaaaagttgcatcgcaggcaaaaacacacttacaaacatgcatttgtcatcatttattcaaatcattcatatggatgatatttatttaatatgtacattgttttgtgtaccaatagaggccgattgtctctgttttgaagatatgggttgatgaaataatctgattatgaatctaaatatatacatttatttgttgcagcttcaagtgacttcctcgcctggtggaacgcgtgtcggggcagtctcctactcgtctcaagcaagcagattgttcaatgtcaacgattattcgtcttcagaagctgtagttaatgccatcgaaaggcatgtcaattacaaaagtaaatataagcgacgttcagacaagataagaccaactgcctcctatatccgttgctgggcgagaatggcaaaagcatgtgagattgtacaagaataggggtcggggctnaagggnagggcggctggggaggggctggggagggctttgagttcatgcattatgattttgaactcaagggagatgtgagttggtccagcagcacgttcacttggtcagctctgtcttcgcctacaaactggctcatgtaggcaaccccgtttcgagactgagtcaagtcattcggatggtgacgttaaaggtcggcccctatacgtaaaaaaaattatattttattgatatgacacagacacacacacgcgcgcatgcacacgcgcacacacacgcaattttatatgtgcctcgttctatatttttgttgttgttaggggagtgagggggtgatgcttaaagggaaagtccacccccaaaataagtttgtttcgatagaggcagaataataagaaaatcaggtgagtgaaagtttgagcaaattctgaatgaaaataagaaagttatgaattattgaagttgtgatcaatctaatacaaattggcaactctgtgacttatcatacgagctctccttcatttgctttgtgcataatattccataaaatcatgttttcttcgttattgatgacggaatatatatttgttccttgcagggggagtatagaaacatatttgcaattattatatttagggtgcatgtatggttgaaatttttcttgagggaaaatgaaaattttagatttttttagtactgagcaaatggaagttgagctcgcatgatacgtcatagagttgccaatttgtgtttgattgctcacaacttcaaaaatgctaacttccttatttttaatcggaatttgctcaaactttcactgacttgtttctttcatttttctactcctattaaaactaacttaatttcagggtggactttccctttaaagaaatatcttggtgattgctgtgcatgttgtattatcaattgtgtctcgaaacattttaaccaccacccttgcaaagttatgtaatcgaatggaatacttgatacctaaagaagttaagtaaatttttccgtcaaaaaccgatccatcattgacttcaaaaccaaactgattcgatattgatatagaaaatgaatgattaattgaaagaagtataaagaaaggatttcaaaaaatactaaatcttcggctttcttgtgacagataaaggaacgaatttgcccgctgctctcaatgaaatcaaggaaatgattaccggcgaaaccctggaaccatatgggaacagtagcaggaaacgaattatatttatcataacagacggtaagttcatcttaacgagaaggctaaatgttcttgtaaaggtgaaaatgatttattactattcatatattctttctttgtgttaaaacaccatagtgaaaatatcacattaagatattgctcttgaaatacatcttctaaatttgacgagagatagtttgaaactttggataaacatttttgcgccacatgactgtacgtgtgtaccaaaatatgtatgcataggtttgcacggttttgaccttcagcaagattagtcgaattacattcattttgattctgaaacgttacactacacatctattcaactattccttaataataataatagcctaatagtccactccaaattttattaaaccgaaacgaaaattctttttgcccaattgatcgtgagcccggcagccacagatcgacgttgctctatcccttattgttgaacgccaaacaaggtagcaacaactcccatcttttaacgtcttttggtattttgcggccggggttcgaacccacgacctcccggttgtgaggcggacgctctactgactgagccaatactccggtatcattccttatcatctttgtattaatatagccactgccatttgtcctccatttgaagggatagttgagttctgttgcagagggcgatacacgaaataattttgtttgtgagataatgataaactgaatatcaaatttgaaagaacctacaatttaaatgacaaaatcatctttgtttgatcaaaatcggttcagagacggctgaaatatcaataaatataacgatttctactacttgggtaccatcacaaatattagaaaatttgaaaaagccgttgaaaaaacgaaatggcatcttttacgtcgtatttcagccaatgccgatgtcggttttttgttggcattttcgtgatggttatattacgctcaaccagccggcccatgaattgttatttttaattaaataattagttaaaggttatcttatttttgtttaaagtggagctgaattggtataatcgtattgggtaaatttcacacatttggaggtctaaacttaccttcatagcaattgtaggttcttaaaggcgctacaaatgtcttagataagaataagagcaataaccatgcactttgaaggcattagcggtctgaaaacagaacttaactatccctttaatctagagaatcgaattttacaatttcgttgaaatgagggtggttactaacttggatttaaaaaatatatatattccaaagatcagttttcccgaaggattataattcaaataaaaaaaaatgcaatacaaattttccataacaaagggttgatagcctttttattcttgcgcttttcggaggtggattgaaattaaaattaaattagttcgtaattataaagccgaaaaataaaataggttcaatacagtatatttacagataattcataatttgaaaattatgtaatttctatttaatgttcggtgttatgaatcttcgaagaaaaaaaatgccatacgggtcatcacccccccccccctatcatccccaggaaaaaaaatgggagggggtatcctgtgtaaccgttaattataaatcgcaagattcatggctgttgttatctatcaggtttcagtaacgttggtggcgacccatctgaacgcgctcaaccactaaaagaagatttggccgtcaagatacactgcataggaattagccagaacattaataagcaagcacttgccgaaatcgcctctctgcctgtcagcgaacatatatttcctctctcgggttatccggcgctggaacgcgccgtggaagccattacctgtacaaagagatgtgagtaatcccaacaaaagtatttggtccatcaattaccataaagaaaaccaaactgacaacatacaaagaaataaaacaaaatcttggtttataattgaagtagccttgaaataacattttaaaatcatcacgatgatctatcatgttggccgatataggctatattaactgccctcgagtggatttctcgaaattctttgcgatcttgtctgcgtgaagattattgagtaagcctatgtaaaaaaagaagcagaagatagtcttgtgttttcaaagtgccttccatttttatataaattagcattaagacttatattttaagtgtcatattgcctcttaatttacctattctattcacagttctacctctcacttaacctgatgagtaacattaatcaaaccatgggcgtagatctttaattgatacctattgttcggggggggg

SEQ ID NO: 60283 - DNA, 3939 bp, Oryza sativa
cccccccccccgaacaataggtattacgtaaggattgacgcccatgaatcaaactcgtaaaaggttgtccgcttttattatccggcacgctttgcttgtcgttgttgttttactatgtttctgcttttacttttaatttgttctctttaactgactggagattcgaattcgattttgtaaatttctagcactttgcaactccatgagcacgctttcatgggcagaaaaagagaggcccctttttaaaaaatcgggtctattgaccgcctccacttcccaggactaaatctgccctaaactctcaaccaagtacaaatgtaatgttgcatatggcgaattcttggaaatgaaaaacgagtgaaaatactcgtttttcatttccaagaattcgtcacatgccaaaaaaaatagatataaagtatattataccttatatctatttgttgttacttcatttatttgcatagtcatttatgtatattcattcatttcttcattcatttcttcattctatttatatgtttacttatttttttatttttttttcgggggggggggggttatttatttattcataaagtttttcattcactttgcctatttattccagggttttaaaaaaacgtgatcttataaaatctaaatcgcaatttttacacttacacaattttgttgcaaggttgttttttgttgttgtaaaaatcaaggacgtgtgcgattaaaacttgtacgcgtacctgaagtcatgagcactggcgtacagatgggggtgcaaaaaagacctcaaacgaggtttatttcaaaaattcaataccagtgatttacaaatgctgaaatgacatgattttccgggatttttttgtaaattatacttttgtatgcgtttgttggaaaataacaaattcccaaattctaagtcaggccaaaaaatatgcttatttagaagcctacatgtaagggcccgtggaacggcggggctcagggggctcgagccccctcactttttaacttgggaaatggaccaaagacaatagcatgaaactgaaccctagcaaatgtgtcatcatgagcattcagttcattagaaaccaggcaaccgtcccaaaagtaaaattggtgacctggaaataagtgaagtacaactagttataagcttttgggtgtgtttgtacaggaggacttaaaatggacatatcatgtcacagaaatggtcaaggcggcaaagcatgaggctacacaatgatgcgtatcttgaaagattttcggctacctgttgaggatctgaaagttgtgtattgttcgtacgtgcgcccgaaagtcgaatactgcgcacctgtttgccattcaggtttgactcgggcagacaagaaactgatggagagaatttagaaacgagcgtgtctcctcatgcttggccaaagatacacgagttatgatgatgccttcaatgttcttgaccttccctcactggaggggaggagggaaaggttaacaaagaaatttgcgagtaacctcacaaaggaaacgtcccccttctatcactggctcccccctacgcgagcttcccgcacttcccgcgacctgcgcaacgctaaagactattcagaaataaaatgcaaaaatgagcgctacataaagagcgcactccccttcattgtgaggttgcacaattcaaaactggaataatgtaaaaacagatctcttgttcataaatgctgagcatatacgtaaatcaaattgttatctaatagatgtgcttgaatgaaaaattatattgtttactgaaggtttactgattgtttatacggattatattaatttcaatattgcattaccaaccatattctctattagccaataatagaaagtgaaactatattttcactctccattcgtattaggttaattatatgtccattttgttctccatatacatgaaccttgcacccacatgacaataggcctacatttaaaaaaaaatggttgcgtccatgtcatgctaaaaggcatcaaatcatgccaagcatatcttcacttatatatcttttgtatgtttcgtaaggaatattgtacatcaaagggcaggaatacatatcatattattattaagaacgcctacacttatttttttttctgggggggggggggggtgttctttcaactgtaaagtaacctattattggaattaagataccggtagttttcgtacatgtataagaggacttacttgacggtcaaattttaatacgaataacattaggaaagataaaagaaaagtttaaagaaagttaaaaacaaaaaataacataagcgaagcgaaagaaaggatacatgaataaaaataaagaaatgcatggggaattatccaagaaaagatgaacggacggagaaaaagagctgtaaatctgtattgaaacggtcatagaagaacgaaaaggatgaaaactcaataggagatttcagtgtggtgctgttgcatcaatgtatgcattggcctaggttttagctatatcaacaacaaaatcttaaattaaacgatatagtatattagtagcacaaatctgtgcaaaagaaggaaaatatgaacacatatgtgaatggaagtgattgaaatcaccgatttcaaaacaattttttttttttttaaatcacgatttagatctcgtcaaccctgattcattaaattctttaattattcatatgtggtttcaatattccatagcttacgaggaatgtggagagtcaaaacacctgtcggggacgtctcgcattgttggtggtaatagagccggttcaggggattggccgtggcaggcagccctttacgataaagacacagacgaagtaagaataccttttattaacgatattatcttcgtcggcgaggggatatagtaacgctgccgtccgtctgtaacaaatctggtttccgtttgataactttagtaatgattgacggattttaatgaaattttatatgaaggtacatggtataaaaacacatcctaagttcgatttcggagtttgtatgtcaaaagtcaaaggtcatagctcattagatagcctatgcgaaaaaagctaatcgtgtattcgaaaatttgatttccgttcgataactttagtaacgtttgacggattgacgtggaggtacatggtatcaaaatacaggccaagttcgatttagtagtatttaggagtttttggagtatttaggtcaaaggtcaaaggtcatatctcactaaatgtgcgaaaatacgaaattatatttgcgaagatgtggttttcattcaataacgtaagttatgttgttgagtatgtacgtgaaatgtcaaagctcacagctcattaaatatgtaaagaatcgctaattatgtacatgataaatagctacaataattatgtatgcaaaaatgtggtttccgtttgataacttaagtaatgttgggcggattttgatagaatttctaacgtttattggccatttttacccggcgtggggatgctacgctttgcgttgacttgttagttggttgcaaaggtgagtggatctttgttttagacttatgccactatgtgatttgtttgagtttaaaatgaggacagttgcatgagttcttcttccccactttcttattcaaggcaaagacgcaggcagataagaatattgatgaatggcaagttagcatgcaccagcgcacggtggatttgatgacagtgttcaccagattcccttttcggtatttggccctggcttactgtgcggcatggctcccacttagccgagtttgaacctcgagttgtggcgagctggcgcgatcttatggcaagccgttttattattaatttatatcaataaatcaattcttgttatcaagaaataactttatgttgtaaagcaatggtaattcttgataacaagaattcgatttcgtgatatta

SEQ ID NO: 60284 - DNA, 1604 bp, Oryza sativa
cagttctcgactcctcgtctggatttagttgtaccgttctcgactcttaatccttgtcctaattcagtcccccccccccctcccgctcgaagcgcgaaacctttttacgtttcattaaatcattagagaaagaagacgattcgtatttccggtctcgactctaaatcctcgtctgaattcagtttctaccctcccgcacgaagcgcggaagcttttacgattcattacatcattaaaaaagaatacgattcgttgtacagttctcggctccttgtctggatttagtttccccccccccccctcccgagcgaagcgcggaagcttttacgtttcacttaatcattagagaaacaagacgattcgttgtacagttctcgattcttaatccttctctgaattcagtcccctcttccccctcctgcacaaagtgcggaagctttgacgtttcattaaattattatagaaagaagacgctgcgttgtaccgttctctactcataatccttttctgaattttaaagatgttctttgtctgctcctttatcttcctacgtcctcttcatgttctctcctctcttttttttttttttttgccgttgttttttgcgggacagcccccaccgcccccccccctggctacgcgcctgcggtcagataaacacattttgataccttgtccgaccccggaagctcaggggtttaaggcaatcaattgcggtcagataagaattcaggggcccgccttaggacccctggtcgagggtgttgagcccccggaagcttaggggttttaggcgtttaattacggtcagatgaacagtttttgttataccttattattttgtaacactggcaggacactatttggcgttgggtccagggggcggagaccccaaaatcagggttttaggcattcaattaccgtcagatgagaatctaagggcccgccttagggccctaggtggaatccatggggcagagcccccgaaagcttaggcgttttaggcatttaatcacggtcacctgagcatattttgatgcctcattatttgttgacactggcaacactattctttctttcttgctctctttcttttttatttctctttaatatactttttttttaagtgggggtggaggctcccgatccccgccgttcctcgggccctgacatgtaggaatctcaagaatcatatctcttgcgtggctgtaaattcaggaatttgtcattttccaacaaacgcataaaaagtataaagtgaggaaattatgtaatttcagcattatttgtaatccaccgttatggaattagaaataaaacacgtttgaatttgattttccccaagccccctcccccccccctaacagtacgccagtatctcctctttttatttttttctttccctttccttttttctctcttgtttttttgattggggggggggggggacacagcctgggaggcaaggccctttcggccctcgatctccttcttccccttttcttttcttcttcctcttctttctttccctttctctcctctttccctttcccttcttttcctttcttctctctttttttttttgcggggtggggggggggggg

SEQ ID NO: 60285 - DNA, 21315 bp, Oryza sativa
ttctgtgaacacgacttgcccaaaagcgtatctgtttatatcattatatgtcacttcaaaagagagagagagagatagagaataatcaaagtgaattagatcctccaagttagcacccttgtgttgggtcttatgtttttgccagtagttttttaagggtgattgcattgatgcagtctgccattgtttccctggatttcatggtcacgactgtagcagaagtgagttctatgtctctatgctatccatccgtttatctaactatttttcttcgtcatctattaagcttttcagcacaggttcttatgtgaaaagatttttgtatgagccggaatcctttaatgaatacctagatgctagagatacatctttcttaactgattgggagttttgcagcattttattgggagtttatttatatcttgttttatgttctgctttttaggattcaagcacagccaattccaaggggtataaatggtataaatagaagaccttgagggaacagaaagaatcaccttgcttgtgcctaattgctccaaattaaaaggtaagcacatattgaatgaataattcttgttttcaaggaagtttcaccatcttaatcgggaatgtatagctctcatagcattaggtatatttctatggacctgaaacaatacactgttgtattgatgtaatatgcccgcttgtcaacttgtttgaagctgtatttgagacgttttactttagaaaatcttgataagcaatattgcgtgcataacttatgccatatagcaccctaattttatcggtcagaggataaaataataagaggagatgggtgaagtgattccacactaattaacagagtggtgttgtatagaaaccaaataataatcagttacacctactgagtttcacaaataaaaatgacagacctagctacaatgtacatctactgtaaactaaaatgcaatcttaaaaataaaatcatgtttaccttcaaaccagggcagatggattgaaattcaatctttatgcttcataaaaatattgtccctcaaataatacctagggtgacaaatacactaattatacagaaataactggagtcattgcctcatcttttttggagaaggttgaaaaaccttaggagcaatttaagtaacaaatattcattcaaactcatttccttttctaaatctatgaccaaaataaaaatggtttctttttttcacagtccacaataattgtattgtcacatgctatagctaacaaattcagtggagtgtacattttatgggacaaacggtctatgggagcactattcattttaatgtgcattttaatgaaaaagggatttaaacagctgtattatagtcactggtgtaacctgtatgctcataaaatgtgtgcatcttaaattatgttatatggaatcatgtttctctctcagaaaaaaaggtgaaacacaaatttctgagtttggtttctatactaagggctcattcggaatgcaggactgaaaaaacataggaatagaaaaaatataggaataggataggaatgcaagtgtaaaacagaggatttgaaaacataggaatttaatgtgaataggtgtggatggagtaaaggaaaaatataggaatctttagaagaaaataggtgcactattacaaaattatcacatactactagtgaattaaacaacattaatcaacctaataatgtgctttagttgcttgatggcatgatttgcctcgttcccacgcgaaaggagagaaaaaagaggtcagcatggatgtttttcttcctgtgatcttccagtgatatggctagcgcaggaaatttccctatgtatttcctacgaatgttttcctgtgatccgaatgacgccacagtaaagcaatccataggaactcaatccttcatttttcctgtgtttctcctccattccaaataaacccttagggtatgtatgcatattctgcaaacctattctgtgtggtactcatgcgtatgtatgcattgatggctaaacattttcacatgcgcatttgacagctcaggtacgacttgcagcaaacaggaagctttctccattagaaggaatcaaatcgatcaagaaggtagcgggcactcttataactgtcaaagatgcaagtctagataaatagtcatccatgtgaattgcccgttctcaactctggatttatatagatgagaatgagatagctcatttcgagagtagatgccgtgatcggttcactctattttgcttatccatttatagatagccgtcccttgtaaatgcacatttcattgaatccaaccattgaactttgactgtgaatgattgaatcatgatttcttctttttttttttggccagtcacttgaatcaggacctagcatacatattcaggtaggaggtctacgatgggcagcggtgtggtcacgagttccacaacggtgagtgtctatattctgtacaaacgacatagaaccatacttatttcctcaaatgctgttagtcttaagtatatttcctcaaatgcttatctttctaattcttaagtatacttctgaagtgctgatcctgacagatggctacctggtagctgtagcagtacttaagtacaaaatgttaaagagtataatctatttatatatctattaatttttacgatgtgagctcttcaatctggatatttctgagtttcatctatttctgatattcaaataactggagcggggcatcagtagcaaagtatgaaaactaagtctgcccgacacaacaacgtgattctgaaattgacaaggctaaccccatattcttctacactactttttttattcctgcaaactaatgctacattgttatgccgactaatgctgggagcacaggccgcgtcttaactgaacatgagtatgcaaaaactgaaggtgattcttattttctaaatctttatctcaatatttcctctaggggttacattggagcgggccaaatattgtataggtaagcattttgcctcttggctattacaagttttccgtcttatatatgtatctagaagttcatgttgccgtgcgctgcttttacgcatgctgccatgtacacatgtttagttttagtaaaaataagtaaggtttcattgcacggtaagtattgtttacaggtgtgcaaattgataggagctaattcatgcaatggcttctaaacataatgttacttgataactaggatataaattaataattacatggaagaactaatttatatctataagttgctttcaattttaccatgagttagtatgtgctaccataatccttggaattggagggtttgtagcagatctcatcagttgtaaggaaagtggaaaaagtttatttggtcagtgttaagctatcttaccgtgcaatgtacattaggtaatgtatgctgttaacagttatttttgttgttaaatccaatccattttcttaaattcaataaagtattgatgaaacaacttagatgcatccaaacaatgctagcaatgctcttaatggggagcagcaacctgaagggtagagtcacccatatattctggtatattttttataatggaaatgtgttaaggggtaaatcaacatgtaccagacctttagataattctgtatcatttgcctgcacaatgcaaatcatgaaaattttgctgtaatttttatcattaatgcctttcaggaatttaggatgagttcaggaagtcataagattgatcagaattactaccacttatgccattaggctttaagtttatatggaaggggtgtggattggcagcatgcgttgaataattcctcctaaggccacaaaacaattggccttcccagtttgattgattggtggtccaaggatgaaaggcaattacaattttgtatatggagttttttctttgaattttcagtatttaccatttttgtcattgatgagtaaatgatagtacgtatcatatattagtgatagtgagattcagaagccgtacgtgctagcaatctcaacatgtgttcctcgattcgaggagcgacctcgatcgttgtctgtgttttcactgtcttattgacttggcaatggatcaacaatgtaacaaaagtactttgtgtgatagatattttattaatcattttaggttatgaactaccagaccttacagataccatattctagacaaaggtgatatttacacaatgcatgtagataaacagattctgtgcttataatatgctcaattcaatttatattgatcacaacgtgcattgtacgtgcacgattactagtcggatcttgtagttgtagtttttagagtttattgtcttgttggtgttgatgcaaaatacacactgacctgggagattgtcacgtccggaatttctatccaaaattccaaacgtttacatgtgtattaaatcctcgtccaagaattaactgaggcatacaataacaaattgataatagagtactatcaaacaattattaatactcgcaaaataataaattattacagaggtggatagttactctcaaaagaataaaattatacgcagcggaaataaaaacaaaagacagaacagctatggcgactccactccacgagcaacttgacccggacaaagcctaatcctccaaaccatcacctgcactaaagtactcctcctctgacgaatgaatattgtaaaaatgagcatatgacatactcaacaagccacacagcaaatatgcaagtgcacaggataacaaaggatagcataatacagctcaattgcataaacagcatttaattaacatttgagagaatagtaaaacagttaagtaattaagcaatattaaataaacactatacaacacacccgtgttgcataggcccaacctcatctgaacaaccaaccccggttgtacaaatcaaacctccataccaggaatataccattccaaaccaggagtcaatttaattatcacagtattatcattaatagtgagtagtgtgggactaatcacgaaaaacattgttaaacccacccataaccgcaagcacggctattcgaatagttttactctagccagagatgtaccactgtacccacaagacacaactccacaacatgtcaccatgcgcctcagtaccaccacagtaccttggaaaggaactgtgacaatatttctcacacaacacaactcaccacagtgcactgttcctggatcataatctccccctcaaaaccagaggcaatggactccccagcgacccccacggacttctcgccgcttctcagtctggcaccccataatgaatcatgctatacaaaaggtaaagccattgcccacgctggcttgtggttggcatggtaaatgtttcacaacagtagctcgcgaaccggtccttaattgtcatgagcatgaccatcaaaaccatatgctcacaacccacctttaatcaggttttaattatcaattaattatcataacacagttaaccatcgtgagctaccattaaatataaccataattaataatgtagtatgattcatcccattaatgagctaatattcctaagcatggctaagcaattatatatagagcatttagctgaaccaatccaatatataaggtccaagctaatcaatttattacccataggaaaataaagtcatcttcggccattaattaattggaaaaggctcaccacccgatgacattcgaaaataatgcataagttgaaataaaacattagctttaaacgggttcaacatactcaaagggttgtttgggatctatgtgactttccttgagcttcttcaaacgcttctgaaccttcctcaacgtaaacgctctcctccggaatgtcggaaactaaagcaaatgaacaaaatcaacaaaacagtacaaaaacaagcataaacagtacatttggatatttttgacatgtagatctcgattttagatgaatttagcaacttgaaccactcgaatccgagttacgatgatttagttatgaatttccgaagtttaatcgattttcaactaatacagaaaattattacgaattaaataaaggattgatgacgtcacgatgacatcatcgccgaccatggcactggacgacgcgaccaccagcgatagagggctcggccgggctatccgaggacacctacgcgaagaggacgacgacgcgaactcaccggtgcaagaaataacgaagtacggcgtccggtgacgaggaccaatggcagctcggctcggctcgatgtcgacggtggcgctccggcggtctttggcggttgcgaaggggcggacggggtgctcctccaccgtgcgaacccggtggtggcgacggacggcgatggcgacgacgctggcggcggcgcggcgcggctggagcggcgtcggcggcggcggcgctagggctacgcggcggtggcactacgggcgacggcgaggctcgggacttgaggcaaatggaagaggatgactaggggatgctatttataggctcggattaaagagatcgaactccaaacgagaggaatcgaagccgaaaaatcctagggttagtttggagagataaactcaaaacgaattcgattcggtttatccgggcaaaattgatctccgaaactttagggaaaagggagaggataaggaggagatgatttcccctcaagcaatcgaactcggagatggccggttggggcggaatcgaagaggaggcggtggcgctcgggctcggctcagccggccggaggtggaagaaggccccgacatgtgggccccacatgtcggcggctgagaggagagggtggggcggcggctcggcttgggccggcgtgggccgcacagctgcgcgcgaagagaagagttgggccggaaacggcccaacggcctaggggagggttttaaagactttttcaattaaaataattcgtgaaatgatgtttcatttattaaaaataccttccttgttcaaataattcccagaaaaatctagaaaacagataaacaagcaaagtatttaatgaaattttatctagctcaattttatgttgaaattttccctagattattagagttcaacttgtaggcttttaaaaaaataatttctaaaaatgcattaataattgaattattaaattaggcgattttcaaggcatgacagagatctggttagctccagtgcaggtccaagatgttgatgagatgcgggcgtgccagtcagtttgatactgcaactgacaagatatgtaaacagcaaataaaacagccgatcggctgacaagccgatggagtaattccagctgatagctgatattagctgatgtcgataaggttttgagcaatcggctatatgtccaatgcagataattatataaagacaattgaccgatgataataaaatataataataatataatccaatagaaaccaatcgataaataataatatgataggataatgtcacgtccaggaatttagcccaaattttcagactattttgtgtattaaatctctgtccaggaattagccagggtacacaaaacgacaaattaatatacagatccaaacgtaaataaagagtaaaatacttacagaagaggcacttagtcctcacaccgaaacaaaagtagcggcagcggaaaaaggcaatcctagcggggcttcagctccactccataggcaaaactcaactggggtctgagtcttggtcctctaacatcgtcttcggctcagaagcactacacttttgaaaagggggaataatagcaaggctgagtacaaccaccatattcagcaagccacaccaatgatgcagacgtacaaggggatacaagaagggttgtggctatttgcataaaggcggttgtaaagcatttattgagcaaaacagtaaaactgttgattagttaaggtaatattatatctccactaaacaacgctacaccacgttgaataggcccaaccatcccacctaaactaaccagtgcattgagtcgatttattaggggtaagactaatcacggtgaatctgatcgatcgctcataaccgcgggcacgactattcgaatagttttactctggccagaggtgcacaactgtacccataagacacaatccaccggcatgtcaccgcgcccggccggacatatcacaatgtcgagtgattgtgacaagaccattcatataactccctctgaccaagcacaccacacttcaggtttcgccctcactcctcaacaggcagcgggcagccccttctcgtgtctaggcgaatcaacgagccgcaaaggccatcgcagggcccatccgaactccatcacgctcacccttgcctggatgcatcagccggaggaaagctatactacagatcaagcagttacccattcccgcttctggtaacgttgtatgtcttctagggtttcccacgaaccggtccttaaattgccatgggcgcaactagcaaaaccatacacccacagcccaccactcagttgtattttagttggataattacgaccaatgaaacatggccggatgtcccgagcatgcagctcatcatgatactaagaggtctaatattgtaattatcccattgtgtgatgaggacctacctagctcctcacattcttctacaactgccactcccgatccaacaatctccaatgcgtataagggacctatcacacgagcacgtgcacgggaaattcaaaataaggtgaatatgttcctaagtactttgaattatgatattagtgagcataatttactacctaatagttgctcttttcttgtgctcagatttgaaggaatgatatcattggagaccgaaagacaagaggaagagctctctgatccaatattttgtttaatggcacaaacccataccaatattaccgagagggaggtgtggagggatggcaccagcgacaagatagaaaaaatcagcaccaacaacaaaggagagttgctgtaccggaaaactgaagataagaaggagaaggcccaactcggactcgggtagcagtctgaggttgccatactaaaagaggcccaaatcagtcatacggactccgattgggttgtatgagcacttgttggaaagataacttcaagcccgatccagattatgctcatgggctacaagactcgaagcagtcacatcacaatcatcaaaataattcgtgcctgtaatatgtagtttccaaattgactcctagtttgtttcctagtatttgaattgtatgtaaggccttgttgtcacgccctgaagttcccctcccttgctataaattcataaaataaatcgtccgaaaaaattggttcaaattaacctagagttgaatccttaattaataaacgcaaataataatcggaatcggcatgtggaatttttcttggattctacatgtcaaaatatgctaacatgatttttagtggaattttcagagccttggaaataattttataccaattaaaaatgagcatatgctttaaaaaaatccctaaaaatccttttattttcctttttccctttttccttccttttttcccctttttttttctcctttgggccgtcggcccattccttcctcctcctcccgcgccctccctccttgttgggccggcccgcgcccctttcttcctccctagggtcgccgataggtggggcccacctgacggtcgtctcctacctccggccgttggagccggagccccaactgcccacgccgccggcgccccacctcctccactctgccatcccgcgcccactccgccacccgcctttcccgcgcccacgtcgccgtgacgccgcccttgccttcccgcccgcgccgcgcgcccacaaagggcgggattcgatttgaatccctcctaactctctccccactcccccacgtcgccggccaaatcaggggggtttcccggctgtgtccgcccctcccaagcccctataaagcttccccacaaccccctctctcgtttccctcacttgccggcctctcccgagctctccaccgctcccgcaccgtgcacccacccgccgccgactcttccactactccggccgcctctagccgctgctagggccgccactgcaccacaccaccgccgccgtcgggttcgcgcggccgaggtccacctcgtccacctcccctccgtcgagttccaccgccggagcccgcttcttcccgcgctccggtgaggttccaccattgccgccgcctttggccatgttttcctctcgccgtggaccacccttctccctctaatccctcccattgtgttccctaggtggttccggagctcgtccgcccctcgccgccgtctctcggtcgctcatcgtcgctgttcgtcgtcgcctccctccggccggccgaacacctcggtgagaaccccctccccctttccttcctctctctagcgccgccgctcctcgcatccgcgccgccgcgatgcgccgccacccgcgtcgccggccacccgggtcgccggccggtcgccggtcgccggtagccggacgccaccgccgtgcgccatgcccgggccggcttggatgacgcccatccccagccacccgatctgcctttcggcggatcgtggccgtccatcctgtggcccgcatggccgaccacgtggtgccacgtcggttccacgtgtgcgccacatggttcacctctcctcggtcccgtggactcggtccacagtggaccggcgcccttgagtctatgacaagtggggctcatctgtcggcgccaccaccctcccttggatgatgtcagcagggacctttattgcgcaataattaattaaagactttttcttttatagtaataaacacagagaatcttctaaaattcataactaattcatgcgagctccgattaagtccattcaagtctcagtaaattcataaaaatgcatagaatccattaaaaatggttgtgtttcctgttttagtagacttataacatgttttgcttgtgtgctttgtttgtcgcgtagatttcggccgtttcgtcgatccacggttcctcgaagacgttgctgtggtctcatcagtgcgagagcaaggcaagtcatgcattccaattgatcatattgtacccaatttacaaatgtcccgtatttctattaaatgttgcattcttttacaatatcatgtgggatgggtcctactactcagccatatattgtttaccttatgccattgataacttgggttttaaaatgactagatgttggtttaggaaatggttagccatgcttagttcaactagtacacaaagggggatcacattaatgcatagactttgattattggtatagctttggattaatgccaccgtaatggtgttagttaattaaaatacactacatggtgggctgtgggtgcatggttttgctagttgtgcccatggtgattaaggactggtttgcgggaaaccctggaagaacttatcgtacttaccacaagccagcgtgggcaacggctgggcttgtagtgtagctttcctctagccgacgtacccaggcgagggtgggcgtgatggagttgggtcggccggggtgtccggttgatcggcttctggattcaccgcggcacgagaggggggctggccattgcctgctggggacgggggcgaaccctaaggtgtggtgcgatcggttagagggggttatgcgaagggtcctgtcacggcctctttccggtatgtcgtggtggcatgtcggcgcacgaaaacgtgtcgtggggctatatcttgtgggtacagttgtacacctctgatcagagtaaaactattcgaatagccgtgcccgcggttatgggcggtcgaccagattcaccgtgattagtcccacccctagttagctaatgaactggtgtagttcaggtggttggttgggcctgttgcaacgtggtgtagcgttgaacagtgattggttaatattgattaattactgcaactgttttactgctttcaactactgcttttaaatgctagctttatgcaaaagaacctttagcctcccttggatatatcctgcatcataccttctcttccggtatgacttactgagtacagtggtagtactgtcttgctctcttttcccccacaccagagttgaagttcttctcagttggagatgtctcgaagaagttagtttcgtcgctgccgtcaaggatgcctgtggaatggaattgccgctgcaggagtcaagtcttcaggcttagctcgcttttatcttttccgctgcatttgtaatcttttatatttttgtcagacgtggatctgtatgtcaacgattgtcgtttgtgtaccctggctggtcctggacaggggtttaatacacattcagcttagaaattctggttcgtgaatttctgggcgtgacacttgtgctcgactagaaaggttagaccacatttattctaatgaaaattgcagcaaatttgctcttgttcttctcctaggttttgtgccgccgctgccaaactagagagagggattgggagttctgccatagattgttcttgcttttccttgcagggaattgagagggcaatagatccacttttgcgtggtcaagtgtatcaacctatcaaagcatgtggttttgcgaattcatggtgaaaggtgcgttgcacgggcagcgtgttgttcatccagttcgtgaggtttcacggtgtatccggatcctacgtcgagaaggtcaggctttccccatatcatcttggtatcagagcacgattgtctcggtaggatcttttaccctagctacatattttatttctatcctatacacaaaaacgctaaaaaaaatagcccatagtttgcaatctggttctagtgttttttttgttaggttttaatccattagacttgtgtttggttgctgatcttagtgttccttcatgttacacttgagcctatatcaatttatcttgtttgcttgattttgtttcttgtcgcgttctgaattttcagtgcatatttcgttcagtaaaatagtcatcaaagttgcatagagggttggaaatcagtgtttaaatactttttggaaagagcacgtggtgtcctacaaatcattatctctggttgacatcttaattcggccattatctgcgtgtttcggacacaacaaagttagtggctgttctgagttttgtttgagtcttatttcagtttgtgtgctagtccatatatcaataatacaaaaaaaaatagtgagcctattctatcctttgcgaatacttttgaacccattgagactagctgtaggaagttgcttttgggctttgcacggttgtatttttacagtcatacccgtattgttcaatccggtgtgctgatcgtagtggcaaaaaaaaagaagtataagagttcaaaaaaaaaaagagaaagcaaaaaaaataacaagaaggattaaaaaaaaaagagaagtgctgcgtcaccacatctattgtttatttcagaagttagtctttatttgttttgtgcaaatctggtagcccaattcagattttgagcaatcagctagcgtcactccttgtacttttgaaacatgagcttttgatttcatatccattttgtgtagctctcttcttggttgcataggtcccattatcgttgcgtgtgagtgctgtacacttcatttatatcttgtgattagcaactaggcattttgttctagcttggattactacttaacaagaaaatatcttgaatttagaattgctaggaccaacacttagccctccaagctccacatatttactacttgtgcaattgctcctgaactgtgaattcgcctaaccatcacctttgagttgtctactaccatcagggtgtaatcagcccctcatctcaagaaaggaagggtaagaacatcaattggtgggtgtagttgagagattccacaattttttttctttctattcgctgctgcatataggaattttttcataactaaccatggcaagaataggagaaactgaagatgttgaagaggatggtaataacaatgaaccaatcacccgtctccaatacaatgcattaagagatgtgttgcgaagggagatgaattccaggatggacactctagaggggagaacagatgaactatcacagaagttcgaaaagactattcaagattttgaggtgcaagtgaacaacaatatggagcaattgaggcaaaatattgttcaagatcttgaacatcttctaaggcctgatgttgaggatgatagtgtccatggatccttacttgatgagacggatggtgatgctgctacttgtgagaaacgtcaagcacaacaaagacgcaatattgctgctgcacacgccatgcgtccacatgggcgtggacatggtaatggtggcaatgggaggggccgcggccgtgctggtcgtggccatgctatcggtgcacatgaagatgatgttgatgcagacttcgcgttggatcaagattgtcacgcccggaatttctatccaaaattccaaacgcttacatgtgtgtgaaccctcgtccaggaatcagccgaggcacacaataacaaattgataatagagtacaattattactctaattaataagcgaataaaatgtcattacagaggtagatagttcctctcaatcaataaagatctaagcagcggaaaaaataagataaacggcgcagacgactccactccacaggcagcttgaccagggctacacctaatcctccacaccatcagcatcactgtagaactcttcctctgatgaatgattgcaaggtgagtatatgacatactcagcaagccacgcagcaaatatgcaagtgcacaggataacaaaggatggcatagtagggtttcatttgcataaacagcaattaataaacatttcagagtttaataaaatagttaagtagtaattaaacaatattaatccaacgctatacaacataccctgttgcataggcccaaccattctgaacaaccatcccggctgcacagttctatctccaaaccaggaatataccattccaaaccaggagctaatcaaattattaccagttatagcatcttttattatggtgagaagtgtgaaactaatcacgaaagacattgttagacccgcccataaccgcgggcacggctattcgaatagttttactctggccagaggtgtaccactgtacccacaagacacagctccacaacatgttaccatgtgcctcaataccaccatggtacctcggaaaggagctgtgacagtacccctcgcacaacacaatccaccacagtgcaccgttcctggatcataatcacccccttataaacaaggcatggactccccagcgaccctcgtgggcttatctccgccacttctcagtctggtgctccgcaatgaaccatgatatacaaaaggtaaagccgttgcccacgctggcttgtggttggcacggttaatgtttcacaaccgaaactcgtgaaccggtccttaattgtcatgagcacgaccatcaaaaccatgtgctcacaacccaccattatcaagttttagttggcaatttaattaattaaccaatcacgattgaccatcgtgagctatcattaagccatcattaaataatagtgagtcataagttatcccaatagtgtgctaatgtttctaagcacggctaagcaactataaataatatctagctgaaccaatccaatatataaggtccatgctagtcaaattataacccataggaaaataaagtcatcttcggccatagttaaatgggaaaggctcaccacccaatgacattcgaaaacaatgcataagttaaaataaatcaatagctttaaacaggttcaacatgctcaaagggttgtttgggatctgtgtgacttgccttgctggccttggaactcttcaaattcttctcctgcgaaaacggactctccggaaacgtcggaatctaaagagaaaagagcaaaacaccaaaacagcacataaacaagcatgaacagtatatgtggatatttttaacatgtagatctcaattttagaaaaatttggagacttgaaccaactaaatccgagctaagatgaattagttatgaattttcaaagattaaatcggattaaatcatttatttagattttaattgaattatgacgcaataatgaattatttttgaaaaggaaaaaggggtttattgcgtcagcggctagggttcgcggtgaaccgggtgcatggcggcggctcacggaaacgaacggccgagattgatccatccaaaacggacggccaagatcgatcggtccacggccagaccacgagagacgacgacgatgacgtcagcggtgacgtcaccaccggcggcggctcgggcgcgcaaactcgccggcgaacgacggtgcgacgacgcgaacggaggacaccaacacgtagagggcgacgcggcgaactcaccggtgaccaaaacaacggcggaagatcaacggacggcgacggcatcgaggaagaagcggcggcaaccttcggcttgacgacggcgacagtcctccgcctacggcgacgacggaggggcggacgaggatggcgacgagacggcgaccacgacggtgacctccccgagcgacgacgacgacgggagcggcggcggcgcatggctggacgaacggcgacgacggcggcgctaggctacatggtgctagggctctaccggcgacgagaggcgaaggcgagggtggcggcaggtagcggcgggcttgggggtccttttataggggcaaggaggtggcggcgaaggcccacggcgaccggcgacatgaaggaaagtctagggttcggaggagagagatcgatccgaatcgaactcgaatccagggatttccaaacgattctagccgacgattccaaaagagaaaaggtagaggagatcccgaagatcatttcccctctattgatttcaccggagaaggaaaggcgcgagcaaatttggaaggagaaggcggcgcggctcggctagggttccggccgggagacggcgcgaggaggacgacgagtccgacaggtgggacccacctgtcagcggccgagcgcgcgcgcgggcggctgcgggctgactgggccgaagaggagagagagggaatgttttgggccgactttcggcccaaagccaaaagaggattttaaaaacctttttcaatttaaattattcattaaatgcaattccatttattaaaaatacttccttagctcaaataaatcccagaaaaatctaggaattatagagttaagcaaagtatttaatgaaattttatctggccccattttatattggaatttattaattaaaattagatcttctcgtctaggcttttaaaataaattctaataattccaattaaacaacattttatatatttaggatttttagggtgttacaaagatgatgggcaccaacggcattgtgctcgcaatggcgagcgtgaggacagatttggaaaactcaaggttaccataccaaaattttgtggtaccaatgatcctgaggagtatctcacttgggaatttaaggttgataagatatttcgtatgcgcaactacacagaagaaacaaagctacacatggcatcacttgaatttgatgagtatgctctgatttggtgggagcaaatgctgaaccaaagggaggaacacgatgaacttgctgttgctacatgggtagagatgaagcatgagatgcgtgcacgatttgttcctagtcactacaagcgtgatctttttgaaagattgcagaatatgaggcaaggaacacgctctgtagaagagtactacaaggagatggagaaagccatgattcgagccaaagtgaaggaagatgaagagcaaacaatggcacgtttccttgttggtctaaatcatcccgtcaaacgcatagtcaatttttagatatacaacactattgtgcaattggtgcaccaagctacaaaggcagagcatcaagtgcaagaagatgcaaaggtggcacacaacacctcatttactactcgctctttgtccagtgggggtagaccgaccccaaagtttaacttgagcaagaacttcatctccagcaactctccttctctcaatttagcaagtaagaaagaggagagtacacaaagtgcaagcaagaaatttgttgttcctacaggtagcagcacctcttcggtgggttctacaccaaagagtagcaatattcagtgcttcaaatgccttggacgtggtcacatgcagaaggactgcccaaataataagacaatgctgattttggaggatggtgaatatgaatcaacaagtgaagataaggatgatctagctgctgatttgacgcattttgatgatgctcaagaggaggatgaggaaaatggtgttgtgtattatgactttgaagagggaccttcacttgttgttactccaaaagttttgacggttcagcccaagattgatcatgaacaacgatgcaatttatttcagaccaaggcaaaagttgatggcaaggtatgcaaagtaatcattgatggtggtagttgtcatagcctagctagtaaggagatatgcaacaagcttggtttgaatctggtgcgtcatcctcatccgtatcatgtacaatggtttagtgattgtggggaagtgaagatacaattcatggtgcaagtaacatttcagattggggactattgtgacactgtggagtgtgatgtggtgccaatgacggtgtgtcacttgctgcttggtaggccgtggcaatatgatcgtgcggcgcaacatgatggccgtacaaatcagtacaagttgaggtggaaagaaaaggacatagtgctgcgacctatgactccttcacaaattataaatgagaattgccaaaagctagaagttgttgttcagagtgataaaaaaagagagcaaaagattgttatccacaaatcggtgagtgagagccacaagccaaaacaaaatggtaaaaagaaaagtgaaggagagaagcttgtgatgttagccacaaaatcagaaatgagagaaatgagagatgatcccactatgttgcactttgtcttgctatacaaagatgcactgatttctactaatgagttaacatctcttcctagtgtggtctcatgttttgcaggagtatgatgatgtgtttccataagaaatgccagctggtttgccaccaattcgtggtattgaacatcaaattgacttgattcctggggcatctcttcccaaccgtccaccttatcgtaccaatccagaggaaacaaaagaaatttagcgacaagtgcaagaacttctaaacaaagggtatgtacgtgaaagccttagtccttgtgttgtccctgttattcttgttccaaagaaagatggtacatggcgcatgtgtgttgattgtagagcaattaatagcatttctgttagatatcgccatcctattcctaggcttgatgatatgctagatgaacttagtggtgctgtcatattctctaaaattgatttgcgtagtggttaccatcaaattcgaatgaaagaaggggatgaatggaaaattgcctttaaaacaaagtttggattgtatgagtggttagtaatgccttttggtttgactaatgcaccaagtacattcatgcgtctgatgaatcatgttctaagggctttcattgggaaatttgtggtagtgtactttgatgacattttgatatatagtaaaacaatggaggaacatcttgctcacattcggcaagtgctagagatgcttaggtctgaacgcttgtttgctaactttgaaaagtgcactttttgcagagaaaaggtggtgtttcttggatatgttgtttatggacagggtgtataagttgatgaatctaaggttgaatcaattaaaaattggcctacacctgtgaatgttagtcaagtgcgtagttttcatggccttgctggtttttataggcgctttgtgaaagattttagcactattgcagccccgttaaatgagttaacaaaaaaaggtgtatcttttgaatggggaaaagcacaagaggatactttttgtgagctgaaaagaggctaactgaagcaccattgcttattttacctgatttcactaaaacttttgagattgaatgtgatgcaagtggaatcggtattggtggtgttttgatgcaggaaggtaagcccattgcatattttagtgagaagcttggtagtgcacaattgaattaccctgtttatgataaagaactctatgctcttgtacgtgctttggaaacttggcaacattatctttggccgaaggagtttgttattcattctaatcatgaagctttgaaatatttaagaggccaagctaatctgaaccgtaggcatgctaagtgggttgagtttattgagtcctttccatacattgtgcgatataagaaaggaaaagagaatgtggttgctgatgctttatctcgcaagagtgtgcttttgactcaattagacgtgaaagtttcaagtttagagagtttgaaagaattgtactctaaggatagtgaattttcagatccatattctaagtgtttggatgggaaaggctgggagaagtatcatgtgcatgatgggtttttatttcgtgctgacaagctatgtgttccagaatcgtctgtgcgtttgcttttgttgtaggagtcacatgcagtaggtttgatgggacattttggaagagaaaagacctaaatgctgctatctgagaatttctattggcctaagttgaggcatgacgttgagaggtatgtgcaaaggtgtgtcactagtcataaagcaaaatcgaaattgaatccccatggtttgtacactccattacctgttcctaatgcaccttgggaggatattagtatggactttgttctaggattgcctaggacaaggagggggagggattcaatatttgtagctgttgatagattttcaaaaatggcacactttattccctgtaacaaaagcgacgacgcgtcgcatgtagctgacttgtttttcagggaggttgtacgcttgcatggagtacctcgcactattgtatcagatcgtgatgtcaagttcatgagttatttttggaagactttgtgggctaagcttgggactaagttgttgttttcaacgacttgtcactcccaaattgacggacaaatggaggtggtgaatcgaacactttctatgttgctgagaatgatgattaagaagaacttgaaagaatgggaagattgtttgccacatgtggagtttgc

SEQ ID NO: 60286 - DNA, 3588 bp, Oryza sativa
  unsure (1)..(3588): unsure at all n locations
aagacgaaatttccactgccaaacacatggtttgtttatggcaaaaccgtgtctttaatctccgcgactcaaatttattagggattggagtcaaacatttttttaaggctcaccgtattaactactccctccgtactggtaaaggaagtcgttttggacagcgatatggtctccaaaacataactttgacttcttgtttctataaataaatatttaaaaatgatatatgtatacttatgaaagtatttttcaagagaaatctattcatataatttttacattttcaaactcaacaacttgaaagttattcatgatttatattctcaaggattgacttaaatattatcctaaacgactttttttacgagtacggagggagtatattaccgtacattctttttttctacggtgccatacattcttttttagaaaaaagatacaaatgttcataaagacgcgcacactcacttctacgaatccacacatgtacaccttacccatatgaacacctctggaagattagatcagtatatcttgtgatcagggtttttaattttgaaatttgttttttttgccgcaggagggggggcggaccaaaatttcgaaaactttgaaattttgaatgaatttgaataaaatttgatcaaattgacaaaaaactgtaaaaacccaaaaatttcggacgagatatgagcttgccgaaggggacgaaattaccaaaaattcgaaaatttcgaaacaaaatttcaaaccctgcttgtgattgacaaagtcaccacgagtatctccctatcgatggatatatcacctatcaccgaaagcgtaattagtcgtaaatacaaacatcaattctatgacttaaatctgattggactggttttaacccaaggaacctaagtaacaaattaagctaccctcacttcgcattgtcatacggatttaatcctacgcgccatcttatttgtgaccatagacacgtactgcaatgctctaaaacttgggctacatgggccattttttgggccactctcacacacgaaaggaaattattgcacagaaaagtccacttgaaatccctcaacaattggtcgagtttaattgcgtccgtcaaacagaaattaaaaccggatataaaaggtccccaacttttaattactagtatatgggtacgttgactaggtccatcgatctgtattgacgtagagcgctcacatgtcacatggcagctcccctgaacctgaagagatatgtgggacccaggtgtcagcatcctcaccaccttttcctaatttcttcacaccggcgtgcgacgagctcgatctagagctcacccggccggcggtggcggtggcgatggtggacggacgtcgagccccagcagcaagttgtcggtgagagcagctggaagctaggcgagttgaagccagtgacggacgcagcagcgcggagaggagcacgccggccgctcgatccgtgcgtacgtacgtgcgatgccgtcgagtcgtctaagaccatggcgacgccgctgtgcaggtttggcaggggcgatcttctgttctatcgggattagggaagacgtacgcgcgcccgtccgtcgccatgccatgccatcaatttcagtccgaaatttctcccagagggaaagctgtcgtgaccgacgtcctgcatgctcatcctggggggtgcgccgccgccgacggtctgcatgcctctccgtgaccgacacaacaactgccttcttcttcgtccccgttgtcatacgcacgttggtgaaggtcgttgggaacgaccagctcctccaatgccatcaccacgcatcttccgatgtcgttcctgcttttgcactctgggattacatcggttaaggatcaggagagagatacggggagaaaacagggtagacatgtttttttttatagtgatatgttgtcacgtactccctccgtccaaaaaaaacaaaccctgggtttccgtatctaacgtttgaccgttcgtcttatttaaaaaaaattaaaaagacaagtcacgcataaagcattaatcatgttttatcatctaacaacaatgaaaatactaattatacaaaaatttcatataagatggacaatcaaacgttggacacggaaacctagctagggtttgtctttttttttttggacggaggaagtaggtgcatagagcctaagtcaacatatcatattggacgaaaccactgagagatccgatttactctggtttaatagatgggggatactctctatccggttttgtggttgggaggctctgcactcagataaaagccgatcgatagtttttgaagacaaaataattgaacttcgtccaaaactcatgttcctcatctgcatgcatggatcacgttgacacgtaaatctgagcttttttggaattttttttcatttttaaatttttattttttaatatttacagaaatattataccggcgaaaagttgtacagaagtagatcctgccgccctacctgagggcggtagggtgacgcgaggaacggacaagatgaaaataaaaactagaaaaatacattttttggcagggtaaaaattgcatttgcccacttgcaacctttgcagagggcagcaaaggacctcaatgcaaaatacgcataccttgtcaccctccacttgggtggcaggggccatttctgtaaatattttggatgatataatatttctgtaaatattaaaaaatacaaattttaaaatgaaaaaaaatcagcattttcatcgatcgcgctgggccaaaaaggatttaagcccatccggcgaggtgaattattgagaaacgggtaattaacctgttggactgggctgatatattctcgaatgcgcctttattttgtgaaataagtccattttacctccctcatctcttgcgcttgtgtgaataacatctctcaaccggaaaaccgggtataacgcctcctccatctccgaaaaccagaacaaatcacctccctcggttgttttgctggtggtttcgtctgacgtggcgttgttgacccggctgacaagctgactcagcgtggtgggacccacatgtcagtgtgtagctatctctctctcccctggcctttctcttcaccccggtgcggctcgtcgacgtgagtcgggcgcaaggcggccgggcggtgtgttgcgacgcagagaggtagccgtgtggcggcggtgatgcgggagagcgcacggcggcgagcggcgcgtacggtgtgctggtcggctacgggcggcggggcacgcggcgacctggcacgggtaaggcagatggcagcagatggcgaggccgggcacggcacgtggcgacctggcacggcctgatgacggcggcacgacgcggttggccggcggggctcagcaacgggcggcgggggaggggtgcagccggcgacgggcgaagatgttaaatgacatgataagggttcggttgattcagctgaagataggccttgcgccacatgtgatattgatccggtagttagaatagatagggtttgttttgattgttatcacatgcaggntggtttctagatttgaaggatctgttttcttgtagcg

SEQ ID NO: 60287 - DNA, 5905 bp, Oryza sativa
  unsure (1)..(5905): unsure at all n locations
cctgggtttganttncgagtggattcccgtccttctgcaagnagntcatcacatggatgtttcctagctttgagggatctgtttccttgaagcgatatatgtaaaagccacgatgggggctattcccatctgatcaacacgcatccagcgcacaggactcgtgctgctgtttctcccagaaactttccacaggatagaaccagaggtgggcaacccccggcggtggccctcgttggcggcagcggcgctcgctagcgacaaacggggaagtagactggcggagaggagctgggcattggcggcggggagacgggaagggggtggcggccggcggggagaggcgccagcgacgaatgccgcgtcagcggcagcgaccgctttcacgccgatatcgtatatcctcgctgcgctcgacgcggacatccacgatggcgtacgcgtcctctccatcttctccggccacgacgccggaaaccacctcgccagaatccaagcattaaaccgtcgccacgcaattctaccaagccacctacatgctgctcgtgatgacagccaccacattggaagccatcattgcggcggaaccatgcgcactcgccggtgacgaatacacgcagcttctccaagccgccttcgcctgggccctgccgatggacggccggagccacggccggccgcccgcccgccgctgccacatgacctcatgataccatcttcgtccgccaccacacgacatcctcggcgcgtcgacctcatgatacgttgccaaagaaggggcctgtgtgacaagcagcgccggcgacaaactgcagcagcacacatgcatctacatatacaagactcagcatgcaacaggagcaacaagaaacaaagaagagaagaagtgaaaaaaagaaaagggggatgatccggccagccgtcacacctccctagccacatcgccgtccacgccgcgcccgcatcgccggccgttggccttgccggcggccgccgcgcaccacgccgcaaaggcctccgtgacctgcgtcgcgtccgcgaaatggctgtgccaggccaccatcgaccacgcctcgccgccgcacggccgagccccgccggccaaccgcgtcgtgccaccgccgtgcgctctcccgcatcactgccgccgcacggctacctctctccgtcgcaacgcgccgcccggccaccttgcgcctgacccacgtcgacgagccgcactgtgtgaagagaaaggccggggaagagagagataagggagagagagcgcgctacacactgacatgtgagtcccaccacgctgagtcagcttgtcagccaggtcaacaatgccacgtcggacgaaaccgccagcaaaaccaccgagggaggtgatttgctctggttttcagagatgaaggaggcgttatacacggttttccggttgagggatgttattcacacaagcgcaagagatgagggaggcaaaatggacttattccttaattcgctcttcttttaaattgggccttccagttccaggcatgggcttatacaatctatgtataaatcagcctccctgaatttggttgcttcactgcacgagtgagttttatgaacaaagccacttttcattttctttatattgtactgtagacacatacacacatcgctacacacgtagcactacactttacatacattcgccaatgcgcctctaacacatattttaagaaacagatcactagcgacatattatatccccaatctcactaaaatcctgttaaaacctagctcacttgcatgtgcgtacgtaatggtggatagagtcatacacccaaaactccaccaccacacctgtttttccaacacctttttatttctgaccatcttacccacatatatgtgccataattattcatattttcgatctattttatactcacgtccacacatcgtttcaatacatgttttattttaggatggagcgagcatatcttaacaacgcgtgttatgccatcaagccacgtgcatattggatgcgtaggtagtactaggtacatatgtacagttgcttttgttgaattattaggtagaattaatcaatcaatcaagtattgcagtgtggccacacgaacgagtttttgacaaatcaccaatggatttccttttcctcacgagagtgcatatgtaggtcttgtctcatgtgtatatataacgacacgctagcttggagtctccattgatttctccatatatggatatatgcgtcagtcaaattatacatgcggccgtacgtgcagatgtcgtcgttttccataggtttcttatactttgactttaattaatttctctcgtttgaaacgtggaaaattgtatcaatgtctatatgcaattatattaaacgtggaggctacactcatatacgggattgtaatgtgtacactaattcacagtttgcatactcatttaaataaagaaaattaattagcttttatatatgattcttttaagatggaaagacgaagggtatatagcacatacatgcaagctaggataatgggtgctaattaaatttagttaagccaattacgaacggagaataaggttgacatggttcccgatgtttttttttagagctgggccatccctagttacataacatttgtgaattttgatgtgtgattacgtcgataatattttgataaataattttatacccattttaaatgaaataatttaatttttttaaacgctatgtaatttaacatacagattttaaatttaccgtggatctaacttctagatgcgttgtgtgctaacaaacgaatttgcctccctttttgactggtcgtaagtgggatatatatacaacagcgtgtgtaacaaaaatagaccacttaatttggctaatcttggtagtaagtaccaaatgatttgatccaacacgcatgtgcattcatgtgtagtttcttaattggtgcatctctgagtcagacatagaaactaactaactaataatgcattataatcagaaacttcccagctactcgcatgatgatcggactttaattagctggtccacacatgatgcaaataacaaatgggttagtgaaataatggtggaaatgatagccttgtcacaatcaaggctaagcatagagagatagaggggggaatgtggttacagtaacgtagaaaattgcagaatgtgccatgaagcatattgataagcaatatatattatcaatttgtttctactccctctatctctaaatgtttgacgccgttgatttttttaaatatgtttgaccgtttgtcttattaaaaaaaagttattattattttttttcctatcatttgatttattatatatatacttttatgtatacatatagttttacatatttcacaaaagtttttgaataagacgaacggtcaaacatatttagaaaagtcaacggcatcaaacatttagggaaggagagagtataattgattgcccgtgtgttcacttgtgatgtaaaaaacagcaaacgatgaatccatcagacctttctatgaggaatctgatgccgaataattaagagatagtagcatgttgaaggttgaacacacgaaatcttggggtccatggtttattaatttatttttaatgaaaacgaggttccaggaattaaaactttgtagtagtacaattcttttggttaatgtggaattattaatatatattgtcgagtataagaaagtttcactataagagtgatgcaatgttccaaagtatgcaagtgcataagataaaaagacaagctaatagagtagctcatactcttgttaaagtggctatgaattcgagatcttgtgaggagtggatgttgtgtgctccagcaagtatatatcctagatttgctaaatcaggaatgtaatctctattttccttggttaataaagctctctctttaacttaaaaaaataattaatgatgaccgatcattattttggcaaaagagcgtgtatttgaacagataattaatataccaagctaggctgggtcctagcttaagctagcagctatatctatggtttgtacgaacagatgaacacacggctaatggtgttcagccttactgatggaaaggctcatccactatatagatagcactatctgaactataatggcagcagcaatgagttctttcacgctatccatctcgatgatggagaggaggccggccggcctgccggcgccggtgcatgtcagccgctgcagcagacatgaaattgagtgcgggaaactattctaaactcttgaggggatatttcctcgttgtttgcatgtcacttaaatggttataatttttttaaaaaaaatcaagaagatgtattaatatgtgctatatcactctacaaattaacatacaagttaaaattcaatttctacatatcgcaatgaaaaaaaaacaaatttaactacagttagttattcaaagtcaaatttatttttttttcgttgtgacatgtagaagctaaattttaactgacatgtttaaaaaaaaatttttaaaaaaattatttataactatttgagtgacatgcaaataacgagcagatatccactctcattgagtgctcatcctcgttccttccagccttctgttgggtgggcatttttttttatggtggactgtgagacatgcactgatcaagctagaggcgcacgttcttgcactgataggtacgtacacccattaatttgatttctctttcacttgtctcatgtgtatgagtagcttgtacaatcacatgtagcttgtacaatgtactatagttattgttgaatgttgacgattatatttatacggaattttaggaactgcgtaccatatcaagaatagtgcgggtgtgcagtggcagaatggcaggagcattagctggcacgtgtctttaaaatatagatgggacggagctgctcgtatgataagataaaatataactgaatacaatacataccgcatttatattataatagtataaaagcatagtacaactaatatattaaagtataaaagaacttcaataattgtacgaccttttattttaaaatgaagcaattaataagctttgcatcatatagttcacagcaaaatgataaaatgcatggcagaagaaggcgaccgatcgacattgaggctagatgggcgtcatcatactgtgtgaacttttgaaaacgaactgtccaactccatcaatggcacgcatcgaaatttggaagatgagatgtcgatcggatattcattgtgactagcattgacaataggtttgttgctgttttctctcatactttccttcttaattattcccaatgtctcaaattataaaggcatgcacacattttaaaattcaaacttcattaatctcgaataacaataattagtcaaaacatatttataggtttagtgatataaataggtattgttagatttatatttggatttcatataatgttgatttcaattcagataatgctcatatataatatatactctgaccaagctccttatggtcgtctatgggtgggaatatatagctccctccattgaaaagcctcctaaatatttcttttaattataaccgagaccatggaatcttaactctgatataaccgagacagctagctctagccgatcgtatatacatttcgctatccttaattagcttatactagtaagttgtaacagtactttctccattctagaattaatgtattaaaaaaagtaggtgaaaagattaaagaagttataagaaacgaggtgaataaattaaatgaaaaataattatgtttgatttagaataagggaacgtggagaaatagctttattttaaaataagttaccgttagaaatgactacattttgaaatgatgtaatat

SEQ ID NO: 60288 - DNA, 15060 bp, Oryza sativa
cagcgtggcaacggcagccaatgtcactgccaactccggtggtttcctcatctggctggcactctaccttgtaccctctccccgctccattcccaaaggcggccggtggggagaaaggagcagcgtggctacattcactatgaaaggctttgagcaataaacaggattaaccgaattcggtcttgccttttcctaataacaattcattccttgagttttgactaaccaaattttgattgaatgcgcacccgtagacaggaatcaattatatagccaatttatttactatggcactgtaactaaacactttctctgaaagtttcctgcatgcttggaaccaagaatatatatatatatatatatatatatatatatatatagctgttagagaaacattgatcccaattgttgtaagtagaagtacatcactgaaacacatgttcaacagaacaatttccaagacaagctcatccctgaatcaaaacttacaatgacactcatggtaaaacgagcctgatacaatcacataaaacaaaatcaattgcgcaggataaacattgaaacaggtatgaacatgaactacgagaatcaatcaaaacattgaagataaaatattttcttccttcataacataatttgtgcaattgtcaagaatcaagcaatcgtatcacaagataattcagatattcctcaaatatgattcttaatgagcttacaaagttacaacttacaaatcaacaataatgaatggagtaaccatcacctcggttttgtcgataggcaatataattggccaggtgtagaagtcatgctgccttctcttgatcaaatcctgaaaaaagttgttcccttgcatcagaaagcaacttttctgcaaacccccgtgatttctccagcccaagtaatttcgggtatgtcgtcttgtcactcgccaagtcctcccctgctgtcttgccaacctcctcagaagacttggtcacatcaattatatcatcaacaatcctatcaacctcgcatacatgcgcaaccgttcaatctgctcataagagcaacctcccaagattgccccaatatccattgatgcctcaagaatttgatgcctattcttttttctaattaaaatgttactaatccaaccaagacaatgtaatctcttcagtaaaattgtgcttaagcagctgtgagatttgagcctaaatgatatctcgagttaaatcttgttacttattttcaagtattataccacaagagggagaagcaaaagcctcacctcatggagagaggagcggcgtggctacattcactatgaaaggctttgagcaatagacaggattaaccgaattcggtcttgccttttcctaataacaattcattccttgagttttgactagccaaattttgactgaatgcgcacccgtagacaggaatcaattatattaccaatttatttactatggcaatgtaactaaacactttctctgaaagtttcctgcatgcttggaaccaagaatatatatatatatatatatatatagctgttagagaaacattgatcccaattgctgtaagtagaagtacatcactgaaacacatgttcaacagaacaatttccaagacaagctcatccctgaatcaaaacttacactgacactcatggtaaaacgagcctgatatagtcacataaaacaaattaattgcacgggataaacactgaaacaggtatgaacatgaactacgagaatcaatcaaaacattgaagataaaatatgttcttccttcataacataatgtgtgcaattgtcaagaatcaagcaatcgtatcacaagataatttagattttcttcaaatctgaatcttaatgaacctacaaagttacaacttacaaatcaacaataatcaatggagtaaccatcacctcagttctgtcgatataggtaatataattggccaggtgtagaagtggtgctgccttctcttgatcaaatcctgaaaaaagttgttcccttgcatcagaaagcaacttttctgcaaacccccgtgatttctctagcccaagtaattttgggtatatcgtcttgtcactcgccaagtccttccccgctgtcttgccaagctcgtcagaagacatggtcacatcaagtatatcatcaacaatcctatcgacatcgcatacatgcgcaaacgttcaatctgctcataagagcgacctcccaagattgccccaataaccattgatgcctcaagaatttgatgcctattcttttttctaattaaaatgtttctaatccaaccaacacactgtcatttcttcagtaaaattgtgcttaagcagctgtgagctttgagtctaaatgatatctcgagttaaatcttgttacttattttcaagtattataccacaagagggagaggcaaaagcctcacctcatggtcgcaatcgaccatctactgcctgttgccaggacgcgagctgcacgatccctgcaaaaaaaaaacttggaatagagcggtcgatgagtcaaagggggagttctttggtttgggggaaattttggaatagacctggttgttgatggagctgacggcatcgtggtccctccaagcgaagtcgtcggtggggaggacgacccgccgagctcctacaggaaggcgcggcacaacgtggactgcggaagggccaagcagacagtcagtacgcgtgctcgtcggcgtccctgtaggacttgcacgaagctggcgaggtggtgctccatgttcagctcaagctcgttgtcgccgctgccgaccacccgccggatcagcggctcctcctcctggttggacactccacgcactgccggagacaccggaactcaccctccaccgcagaaggcttgatccggtggggggagggcgaacgaagcggaggcaggatccgcgacgaggagggcagccaccggtggtgtgacgatacggtggccgggcgggaggaggtggggaatgggaagcgattgggggtaggtgtggttgtttttcaataaaaccccttgtgtttattatgtttacaaaacggaattttctcttcttcttcgcatagtatttctctaaaggataaggggtttttggggaaaaccataacaggctgtcaggcaattcgagggttatatatggacaagcagttttttttttgcaaaataaccagatcccacgtggcatacatgcacagtgaaaacgggcaccagcggtggaagaaacagtcacgcggtatagtcaaaggcaagattaacagtgagattaccagcaaaccgcattttcccggtcgcagacacgctcgtgaggagccgtaatcacaagacgacgacgtgtaaaaaaatgaggtagccagaaaaaaattcaaaaaaaggagaaaaacagtacggttaggggagttattgattgattgatgatccatccacctacccctccgaagcacatcttaattcttgacaaggaattttgttggcacatctttaattcttgacaagaatatttttttgtcatcttggtgcacgggtggcatgagtgtcacaacctcatttttttctcatacttatacttatacttataagccaaaatttaaaatttaaaaagttattttagagtttattttataacatttgtttttaaattactaagaacacatatataaaagtcttagttacaaattattttttgttgctaataaatcagacggataaacatacgtataaacaaaatgatgggctctatctcctgaaagtttgtagaaaggtccttttcaacaaaacggcggggaattgaggaatgatttatacatgaaaaattcatgtagtgtattttaaaacggatggttgattaattcattaccattctcacgcaacatacctcatgtttgaaatataataccaaaaaatgtgacaacatgatgatttggagaatttgaaatcttatgggcgaagtgacacgccatgtggataataacataacaaaagtcatgtttataagtagaaaggctattataatttttaaatatattttttcaatataaatttgtgcattttaagcgtatatattttccgcggcaaagcgcggaggtgtcgtctacactagcacgggttcggtgatctgtaacgggctgcaagcctcatctctattgggtagggccccgtcgcagagcaaaggtcgctgatgtggtaaaatatctcaatcgggcatccggccatcacggatgacacacatcttaatcgtgccaacacaaaaacccgtcacggatgactctcatctctaacgggcctaaacgatagcccgtcacagatgactcacatctctaacgggtctaaactatagcttgtcaaggatgagtataatccaaaaaaaataaattttgtttttttctagcctcatgtgcctctcataggccgggctagtcttttctacacactttatcctcactctgtgcacccgggacagtcatccgtggcgggcgccaacttaagacccgattgagatatgaaatgttatctcaatcaggtctaaactacggcccgacactgatatgtgtcatctgtgatgggcctgagttttatgcccatctaacatgtctatacgaccatatctcaatcgggcattttttcgacccgattgagatgactttcttgtgatggcccgctaattctagaaatgttacaggcctcagatatggaaggttctgtagctataactagttagttcgactacgcgagcagccaacactaatgtgtgtggatccgccaggaccaagctgcctctgagacgaaattctacaattgctccgtcttgcagcaactgcctcttgagtcattaacatgacggcggcctcacaggttgttttgctcctccgctcgagagcgttgtggttaatcagttgatactagggatgcctgcttcggttcagtattgtggagcaacatataacttcctggtctaggtattactcccttctttcctaaatgtttgacgccgttgacttttttaaacatgtttgaccattcgtattatttcaaaaacttttatgaaatatgtaaaactatatgtatacataaaagtatatttagcaataaatcaaataatagaaacaaattaataattacttaaattttttgaataagacgaacggtcaaacatgtttaaaaaagtcaatggcgtcaaacatttagggaatgagggagtatcatttttctaggacaacattcaattcacatggtagatataaattgagtgcaaactgtagagggtggaaacaaagccttcaatatccctgtccctagttaacactttggttctcctccatgtaaatattttaggcatagtagagagttcctcagacaacacatatggtgcctccctgagctatgtattcagaaatgtcgctcacaaattttcatttaggctggttttcatggctttgctttttagggatacttccatccaccatagaatcaaaagtgataattattgactgcgtgttaagtagtgagttaattagcatgagaatggaaggcattgggatgccatactatccagaaatataacatgaagctagttcaacccaattctttctgcacagccttatgcggtgtgagatacgcaatcaaagacatggattgctattgcgacaccaaagtatgttcgtcaacaacatgcaaccctatagcatccaactaagggtgtatttacttcacgctaaaattgaaagtttaattaaaattggaacgatgtgatggaaaagttggaagttttgtgtgtgtaggaaagttttgatgtgatggaaaaattggaagtttaaagaaaaagttgggaactaaacctctaaaattgctataaagcctggtttagttccaattttaaagaaaaattggaaaattgcaggtcaactaaaagcagggccatcttagaggcctaggctggttgttctctaaaatatagagccagccttgaccgaatgtaatacgtcatagaattgtcgtaaatagcaatccattctaggcacaaagagaggaaaatgatatgtaagggcctaagaattcatgctatttttcctataaaactcatgggtaattagtccttgacaactttgtagaaaaataacaactcctttgtttttccttataactgtccataatgcagccctaccttcgatagatgaatattcacaccaaggtcaagaaaaaccaaagaataattacatttttgaattttcttttcttatgaaacattgcaatattgattgtcgacctagtcaggtagtattttcgacccagtcaagtagtattttctttaggtggataatgaggttgtaaattttgattaaaggtagaaacttcaatatctccagagggggaatatcatgtttttccctaagaaagaaacaaggcttgtgatgtaatttttatttgaaatttatttgttttgaggaaatgttaatgtaatttcaaaaccgacaatgggtagaaggctagaacgaacaaggcacggtagcccatttgcataagaccgcttagagcatctccaacagcctccttagtctactctccaagttaaattttagcaattttgacaaaaattcgtgctccaacggactggccaaccgtatggccaagccatccggctggccaaagtgctcctcgcactggccaaatttggccagcaaaaaaggcctagccatttgtaggccccacgcttttccccctctcactctctctccctcccgtgtactagtactactcccaccgctcgccagatccagcgcgccggcgacgccactccgccagcaccgcccctctgcgcctctcttccgcggtgccgcccctgtctcgtctcctcgtctgcttgtccactcctctctcgcctcgtccagtcctctcttgcattggccggccacgaccgccgccctccgcgccgtcgccgaccgccgccctccttgccgttcccggccgtgaccgctgccgccgtccgcgacccaggtcgtcgttgaggtcgtgttgccgaggtagtcatcgtcgcgagcctccgccgccgccgctggccgtgaccgccaacctatgcgcattcgccgtcaccgcatctctctctacttcgcctgcgacgccagccaccggccgccgaccgctgcccctagccgtcgtcgacctccatgcccgcatcggagagaatgtgaaggaggaggaggaatgagagactgacatgtgggacccgatgttaaattggagaatgtgaatagagaggctattggagtaaaaggcaaatttagctctccaattattttatggctggccaaatgagtatttggagagatcaaaatagccaatctgttggagatgctcttattggacccaagcccaaccgaagaaccacaagtctcaggactgagctgataccatttctctgtgaaaacaattaattctatgtgataggcgtaaattgattgcagaccgtagatggtagaaacaaatccttatccctagtaacactttggttctcccattggtgaatatattagcacagacaggcagctagctcctcataagttgtaaccaacacatatggtgtctcactgagatagggaataaaatggtgctccaaattgcattttaggtttgttctcaacttatcatatcttttgcttcctagggatgtatatattacttccatccaccatagaataactgtgtgttagctatgagttagcatgcatgagaatggtaggcattgggacgttatagaatccatggaaagaatatgcatctagttcaattccattatcactgcaaacccttacgcactgggatactcaatcaagctaaggcagggattgctgttcgtgcgcaacagcttctttgtcaatagcatgcaggctctaatgcccatgatgcaaacttactgaacagttccatcccaatgcaaaatatttgagatgcaaagaagaagtacaagatgtaagaccccaagctcatttttcttataaaaattgtaggaataagttgtccttgacaactttgagaattctcactcttttaggtttcatattgcttttccttatgtacagccatatttcgatcaatgagcctttctctccgagatcaagagaactaaagaattcgagagaagattaaattggttaaaatctcggaatcctttttgttccgggacattgtaatttcgaatggccgatcttagtgaggttgtagatttcgaccaaggtatatgtaaaatttcaatatttcgagggtaaaatgcatgtacattcccttagaaagagtagagaaacgtccaggggttttctggttagctccacaagatggtgagctagatgacttgagttcgaaggctcaccccttctaattaattaatattatgtcattttctaatatttacgtcttttctttcttagaaagagcacaagaactgtagtgtaattttatttgcaatacttttgttatatactatttattttccccaagggtgtgtttggagctgttagcatgtggtgatggtgtgtttttattttcctttttgttttcttgattatagcatcccagagtttatgttttttctctactatattcaatgaaattgacacaatcatgtgccggttcgttaaaaaaaaaactttgtttagaggaaacggtaatgctatttgaaaaaccacatagaaggctagaacaacggcagcccatttattattgcagaatgcggcctgttggaccacagcccatctggagaacaacaaaagcatcacggcccaatccaatagcatcacgtgcacacacgctggtggactggtggtctcatctcgtcaactcttgggcccccacatgccagcgacagccaactgcctccggttcaccggacgcggtccacggaacaccaccacctcatttttggcgggaagaattggcgccaagccgcctcctccttcccgccaagaacaccacccccacccaccttgttcttcttctacttgttcccccaaccaaaaccctcgcgcccccgccgcaccacccgcgcagccgcacagcgcaaatcccccccaccccgcgcaaggtttcgagaggtctcgtcggagatggaggcgttcggcgggttcttcgtggacgagaaggcggcgcgggtggagaacatcttcctcgagttcctcaggcggtaaggccggagccgtctccttccattccatttctagggtttaagcggggttccggttcgtctgacgcgtgaggtgggggattattttattttatttttgttgaaacttggatctgtaggttcaaggaggcggatgcggcggaggcgttctacgagacggagctggaggcgatgcggtcgcgggagtccaccaccatgtacgtcgacttcgcccacgtcatgcgattcaacgacgtcctccagaaggccatctccgaggagtatctcaggtgagatttgatttgatttgaaattttttttttggtggggagttcagattgggaaattttgggatctgtccctggatttgctcggatttgttcagagaactcggttgatgtgtacttagcacaaatagaatttttttcctagaaaaaatacaaattaatttgctcatctgtgacgacaatttggaactgactgcttatgtggatttcattgcatcaggttcgagccgtacctccggaatgcgtgcaagaggtttgtgatggagcagaggactggcgagaaccgtgcaccaatcatctctgatgatagccctaacaaggacattaacattgccttctacaacataccaatgctgaagaggtccgcacttgctcctccaggtgtaacagtttttttttccctgtaaaattaactctggaaataacagttatctgacggcaaatgaacgaattctgcaaatgtcctgaaattcactacaaaagtgtgatatatacatatattcaagggtggggctcattgcccctggaatttcatgttagtacgtttcccacatttggtagaaaattatgtctcactttttatcttgcatttctaatttgtcataggttttatgctaaattgtatgatggttgccataacaattgacttaaattgttgttgtaataggttgagggagcttggaacagcagagattggtaagctcacggctgtaatgggggtggttacacggacaagtgaggtccggcctgagttactgcaaggcaccttcaagtgccttgactgtggaaatgttgtaaagaatgttgagcagcagttcaagtatactgaggttgtaactgtgaaccttatgttctacttttttctctcatgcaatgtgtctaatgaaaggtttctgctccttaacttcagccaataatatgtgtcaatgcaacatgccaaaatcgatcaaaatgggcccttctccgacaagagagcaagttcacagattggcagcgggtcaggatgcaggagacatcaaaagaaatacctgctggttcactaccacgctccctggatgtcattctgaggcatgagattgttgagaaggctagagctggagacacgtgaggaactcttgctggaactgctttgtacccactggattggcttcacattaaagtattctgtttcggtcattttcagggtcatatttactggaactgttgttgctgttcctgatgttatggctctaacttcacctggtgagagagcagagtgtcgccgggaggctcctcagcgaaagaatgggtctggtgtccaagaaggtgtcaagggcttgaaatcactaggagtacgagatctgtcatatcgccttgcttttgtagcaaactcagtgcaggtatgacctctttccagcaataaatatcgatctggttagcttggttataatatttttattacaaggttaacctttctctttaatgttattaggtggcggatggaaggagagaagtcgacatccgggacagggacatagatggagatgacagcgaaagacagaagttcactgtaagttcaattcagactcgagactagttactctgtttcgaagaaggaaaagggactagccttgtaaaaagaactatgagaaattctgtttacatggtattcgaacattctgttgcatgctagcaggctggcatggataggtgtaaccataccagcatcctttttctatttttttgacaatgagtatcattcaagctccctaaacttttgcatgatcctggtgcactgttgatttagtgtgttacatattcatgtaaggatgttagatcatgaaatggttatcattccacttttttgtttttgtgtattatattctttatttttgatcatatagttttttgtcatcaaagtgtttatattattaattatctccctcccccctctctcttacaggaagaagaggaagatgaagttgttaggatgaggaacgttcctgattttttcaataagatagttgatagcatatgtcccactgtctttgggcatcaagaaattaagagagcaatccttctcatgcttttgggtggtgttcacaagataacacatgaagggataaaccttagaggtgacatcaatgtctgtattgttggtgatccaagttgtgcgaagtctcagttcttaaagtaagcttctcattgtattctcattgtcatgattcttattttctttttctgtgatgaataaaatttaagttccatcattcaatgttgtcattctgggatatataaaatctattctgctgcttcaccagatcatatgttagtgtgcataaacgaccattgctttctgataagggtccctcagcatgatgcaatacatcttgattagtctactagttgaatttaagttactataagctttttaacaatgtttttctgaatgatatttatgggttgacaacttgacataaaatccagaagttgctcatgtaattttgttcttggattggacttcctatcttgttataagttccattcatcttaatgaaatttattcatgaatcatcacaaatgtgctattaatccaatcctcagatataccgctggtattgttccacgatctgtttacacatcagggaagtcctcatctgctgctggtttgacagcaactgttgctaaagaaccagagactggcgaattttgcattgaggtattatcaaaattttgcgattccatccatttgtattgctaatacatatttagaagtgcacctttgctttgaattgcatgcttcaactaaattgaactccaatgagcttggatgcactttgtgtgcaatcttcctagttcttctgttctattgccttacctcctctgctgctactggttatttttgcaggcaggagcactcatgttagctgataatggcatctgctgcattgatgaatttgataaaatggacatcaaagatcaggtaggcttgccgacttttacctattgttgcctcttttcttattgaacgtgagtgtcccaatttcatttctccattgtaggttgctatacatgaagcaatggaacagcaaaccattagcataacaaaagcaggaatacaagcaactttgaatgcaaggacttcaattttggcagcagcaaatcccacaggagggcgttatgacaagtcaaaaccactcaaggtaagcctaacaaattataaaaaattgtacttccaagtacttctgaaaaacttttgcatccctgtattttgttgacatgttgtggtaaaatttcagtgctgagatctaatatttcaatcgttgcaatccttatcagtataacgtggcattgcctccagctattctttcaagatttgatctggtatacataatgatcgatgagcctgatgaaaacactgactaccacattgctcatcacattgtgagggtccatcagaaacgtgaagaagcacttgcccctgcatttagcacggcagaattgaaacgttacattgcttttgcgaagtccttgaaacctcaggtttatatctttatgcacttcatatataactttcaacttgtcatcaacttatagatgctttatgtcaatgcagctgagttctgaagcaaagaaagttctggttgaatcatatgttacccttcgtagaggagatagtacccctggtactagggttgcttataggatgacagttaggcaactagaggcattaatcaggctttcagaagctattgcccgaagtcatttggaaagagttgtaagtaaaatcctcattcatatattgcatgttttttagattatgcagtatggtgtctaaataaattaacttaagttcaacaatcaggaatagtattattagttggttgtggtgttaaatttaaaaggctgacatttgttccctccctttgcattggggtttttcaccttacggcataatatttctgctgacttcatttgggattaatttcacaggttctcccagcccatgttcgcatggcagttaaattgctcaagacatccatcatcaggcaagtttcttgaaattgctcaagacatccatccatcatttgcatgatgatttgctaacaaaatcttattaattgtgcagcgtggaatcaagtgaagttgatctctctgatttccaagatgctgatgatggcacaaatgtaccagccgataatgatgctggtcagccaacagaaatggatgctgctcctcaacaagacggtccaggtaggtttccccttattattaaaatggcttttttgtgtgttcttgctattattctgatcattccggtaccttgtttttaatgtaaaatgtagaaaatgagcaagcggcagatactggtaagaagaagttggttataaccgaagaacatttccagagagtcacgcaagctttagttatgagactacggcagcatgaagagtctgtcacgaaagatggtattgatactggattttacactacctttccatttgttttgttttgacttattcgctattttgtatccttaccctagcaatttccaactgtagaagaagcatagtaatatctgcttaggttcaaataagtgaattaatttttactgcttatgtcccatataaggagtaacaagatccttagttgtgatttacttacataattatgagcagcatttctgagacatgctttctctcgagaacaaatgaaattacgatctcgtctagattacagcttccagaggtctaggttggcgagcaattctttttaattgcgtaaattaataaatcctttgtttatattctagaaaaacataatttgcaataattgtctagtactattgtattgctttagcttttgttcttctcttacatcttactagaaagatatatgcatcttcttaaaattgatgtggagcctcatgcaggcttgtagatgcatcaatgtgattaacttgtacgccaaccatttatacagtgtagtaagcataaattgtagttatgtctattcaggtttcaccatgttgatgtctcgttatattgttaggacttaatgctatctaattccgctcctgtataagtcattgcttttagttcatcttgtgccgccctaagtgtttccttttatgaacaaggatgatccttgtcagacctccagctgatatagatgtcaaactgacatgttccaacattgaattgcaggagatggtctggctggcatgaagcaaggggatctgataatttggtatgttgagcagcagaatgcccaaggagcctatagttctacagcagaggtgaaggaagaagtgaagtgcatcaaggccatcatagaggtaaaagccttcattgatcttatcatctatgtatcaatttgcctgcattgatcctatcagttcaacagtatggtatggaaattaacctaacaagactacatttaaggcatttagctgcatcaatttgcctgcactgcaagctcaacattgaccatttatattgagcattacctcagctttccatgttgctaaaagttatcaatcgatttgcaaatgcagaggttaatacagagggatggccatctcatagtgatagacgaaggagcagccccagcggctgacgacggtgctgcacgaag

SEQ ID NO: 60289 - DNA, 2728 bp, Oryza sativa
  unsure (1)..(2728): unsure at all n locations
agaaaagtgacccattcttcagctattacctgccaacagaattcttgttcacaaacaaccaaattatagaactaatatatgcctatttggtaaacagataatcaactaaattttcacttccgtaaagaacatgtcaaatataatttaaacggtgaactcaaggtaggcaacgaacaacgatcagccaaactggttgccagtggtgccatttctcctcgtggaggatggcaccaatgcaggcatcctttgttctgatctactatgttgtgtgcacctggagtcttggcgtgttaaggcaggcatcagcctatcatagcctagttttactactgaaaccattgcaccagctaaagcctacaagaataagagaagtggacagctatgccagtcctttgatcttgcaccaatccatcatgttttctttggttcttctaatattattcgcaaagcaataatgtaatccattgtaatgcagcagctgattggcgttgggaagattagatagcttagaatagaattgaagctatagatggattgtgcaacaaattgagataaattgattttctattgttaggcgccggccctaagtggcatagcgcgtagctgtgctcgacgggagggcgaggacgcacgcctcacctccccggagccgtggtggaaactaacaggaactgggattaacttctttcttgattaatcacttaaaccgaatggcctatataggcttacaatggaaaaccaaacagctactaaccaggaactaacaacttaatcttcctaacaaacttaatcactgaaactaatcctaacaacttgatccaacatcacggcgcctgctctggctgttggcgtcggttccggcgctgatactgaatgccccacataacatctatagtgcaaaaagagcagacacatagcgagctttagtaatcacatccaaaaataatacagagaaaattacagttcattaatttatttttggtgcaacagtaatatacagttctgatccagacctatataacctttatcaaatgcacttgtatatttttggtacaacagtaatatatagcagcagtagtagtgattagtgtgattagtgtatacgtttagtctcagattctgcatgtaaaagatcatctaatgtcaagttacaaacatgctcgttataaattaattttatagaagtcactaccttcaaggggcataattagtaatgaacaaactaaaaatgcaaagccacaatctattttgatgaagatgcatgactacatttggatggagcattatcaaattattatccacaaaaaatattgtacattgctatattttgctggaacaaatcagcatactcatacttcaacaaaagatatatcaatttcttatacttggaaacaaagaatcttatgcattaactcatttgtaatttaaagtcatcagcatgctacaatggatcgtagatgaaccccttaaagaaatgcacagccaaattgacagcaacactaccaaagcaaagctcgccgccatcaaagtggggtcatattcggtggagatgcaacctggttgtggtggcagatgaccttagatgctgtgccagaggaccagtagggcagcacggccgtgacgcaaggggatggaggtggcagcatcctctaggaaccccgcgccgatgcccttctctgctttgcgtaagctcaacaaagcttcactacaagctgcattcacacgctcacattcatagtgttacactgatttaaacttgcaaagaaaaattcaatacacatatcttcatcggtccaaattaatcacagtatcacactaagaccaccaacttgacaaagatataacatgcagtatgaaattccagaggaaacttttctctcctcacctccttccaaaaaggcagaagaagaggtaggatggagctgacgaggagccctccatgcggcagatccagcagcacccgccgtactggagaccgccgctgtccgaaacgggacaccaatgccacagatcatgcagctccctctccaaatcggttcaccgacctcctggatccagtgattccccgtctcctcgacgtcccacacgcacgtccgtggccgcctaatcgcaggcatccgctgatccggaaatgaacaggatggagagggagagggagagggagagaggggcagtgccgggcatagaggtagaagagtagaaggcggctcctagcttcccctcgctttagggctgccggatctgccggcgaggaggccggagtcaccggatccgacagtcccggcctcctcgttggcggatgcggcgcgggagcgagaggatggtgatggcaggacgacggcgcggcgacagcaacagctcgcagtagggagtgcgcgggggaggtcgccaactgcgggaagaagaggatgaggggacggcacgcggcggcggccgtcgcttgggcaggagagagagcggagcgagaggagaggaggcagaggaatggtggcggctagggtttggggaaaggggtgagggttgcaaaaacaacccctaaacttctagttttcagagcgcggttcaattttccgttttttcgcttcttcatatagaatattgttttcttaagaggtcctctaagtaagagcgcacaacgttagaactaaggaccagggatctataacaaattatcaagtaaatgtnntgggcgnctgtgtcnaagtcccttcaggtantcaagggccca

SEQ ID NO: 60290 - DNA, 1772 bp, Oryza sativa
attcctgcagcccatctagagcattactcatcatagcagacattaaatcaaaataatcaactgaagagttcggtggacggtacataacacaaattaaaaatgatttcacgttccgtaccttggtttttatccaaatagtttctaagtttaacccaagatctttcacatgttgaaagtggagggtgttcttcaaataaatcatcacgcccccaccatgcctacttctatctttccttagtaaatcataaccatcaatatgcagttcgttgtcactaaccgtgttatcacaatgagtctcagtaaggccaatgatgtcgaagggagaatttcttaacaaataccttaggtcttcaagtttatttggtaaggaattaacattcaaatgacacatacgtaatcctcgttttgaaataactggtatacttccatcatcagaaagttcaagataggcttcttgattgctattactgtctgcattgtcactatttcgaactgaatcacttgatcgattgaagtcatcaatgtcttcatgactattgtctaatctatgtgactcttgaggagtctccgggctgtttgtagacaatctagccagtctcgtgggaaaacacggtcggacgctttcttgcggaatttcgctttgctcatcatctgaaaagacggagcatcaggatattgagattggagccgaggatattcgttatccaaactagccggaccagaaacataaacagtagttgatggaaactggtcacgatgaaacgcagggcgggatcctcgaagatatgcgatgatattctgtgccaatacacgtactccgtagccgtttaagtgtacgccatcagcggcgagatgtgtgtcaggagtgatgttttcattgtccacgactccccagctgcggcgattggctagaagtttcaacatttcattgacactgcgcactttctcgaaatcgcttgctgattctccgcgacgatggattattgtcgagacacttattttcttggctggtgtcagtttgacaatttgttctgccagggactcaataatgtagtccaaccaaccataatttgtatacgaattatttcgttaacttagtcagcatcatagctgtatattttaatgcaggcgcagagctaggatcttattttagggaggggcggtagtgagcaagcgaatcatctaaacagcgcgcaaagcacgctcattaaagtgacttggtaacattgtcgaaggttgatgaaaaaaattgcttaatttttgtatataatgttattccttttactgtactaaccctctgacaggcaaaaaatcctgaaaaaaaaattctcaaaccacgaagatatctatggttttctttgaaaaggtcgatgtatgacaccctctaacagtgattaacagtaaattctcccaaccatttttgaattttcccaaccgtttttccatgaaaaaaagacataaaacaggctataaaaaatctgtcaacacttaaatgtctggaatggaatgtaaagttattttattgctttgtgacgatttccattcacctaaaatgtaattaaattctaataatatagttgggagaattaagggatcaatcagatcatttttttcgctatttgtaccataaatattggtccgttttcaatcaaattttcagattatctttgattgcagatctggcattgaagaagtgacaaccttagcaccactatctctcaacttaacaatgttaccaagtccctttatagggtgtgtgggtaataggcctc

SEQ ID NO: 60291 - DNA, 612 bp, Oryza sativa
tacctcgatggatgccttattttacaaggaagtggtcatgattcctggtatttaaattaccttggttaagggagaaatattctcataggtgcgagttcgttgcttattttttgtaataagtgccctattataggactcttgatgaaaaaaggaaattcctgcgccaggcttgaatagtaatcaatgacttaggcatagtgttgaggttaggggttaccttcgtttgttatgggctacacggaaagtgatattcatagcaggtggtgatagccctgtctgccctttacatccctccatgtttggatacatcatagagctacaggcctgtaagttatgtctagttaattattccattgctgtcctttctagccaaagcgtaccattagttattgtccttggataaaatctctttccttgatatacacaccccttagctatgattcgatacactcagaatactctaaagctgaagtgctacatcggtatctgtgcgcttgcgggttgatctgtgaccgtaacaaatataaatacctacccatcaacgaaggtgtttagtggtacgtggtttgagcacggaagttgaacttgccccaggggattaaaaaaccagcg

SEQ ID NO: 60292 - DNA, 27255 bp, Oryza sativa
atttgtgaattgtcatctgcataattgtcaataggtctttgcccacatgttacctcaaggataaaaatgccaaaagcatacacatctgttagaggtgttgccttaccggtacgtgcgagctctggagctaggtatcccatagtaccgactacatgcgttgtttgcgggtctgctccatggtcatataactttgcaaggccaaaatcacctaggcgaccgttcatttcaccatcaaggagcacattacttgctttaacatcacggtggatgacaattttttcccacctatcatgaaggtaaaacaagccagatgcaacacctttgatgatttgaaacctctgagcccaatcaagcgtaggtttgctatcttcgcagtacaagtacttatcaagactaccattcggcatatattcatataccaataatagttcaccttttctcctgcaataaccaagtaactgcacgagattgcgatgtcgaaggcggccgatactaacaatctcagcgataaactccttcattccttgctttgaatcatgggacacccttttcacagcaacatgcaacttagaagttggaagcacacctttatacaccttcccaaatcctcctagaccaagtagattcctattcttaaatccgtctgtagcatgaaacagatccttatatgagaagcggtgtggcccaaactcagcctcccaatcttcatgtagctcagcgtacctcattcgcctccgtaccaaaagaacaatggtggttcccactatgagaatgaatgttgctgtggcaattggtagaatgatctctagtagtttagtccgtggttttgggctaacacgaggtagttttggtaatttggataagtcaatggctggggcaggacggtttatacccaagctcaatccgagcacacaatataatgtgttgattggaccagttgaagctgagaagccgatataggatggttcttctagcacaagtgagaggttatgaatttctgacaacagtggcctcaatggtttgcctacctcaatgggagccatggtcaccttgatctgtgtggtgtcttcgttgtagtcaacccatacttgcattggcttgtagctacagagggacaaattgttgaagatactcttgttatcactatagaaaccagctggccgagattgaactgaggtgagattgttgatgtcgatgccaacgtggttgtcgtcgatgtcgtggaactcggtattttggctactatcaagctcgactgcaaaaatgtggttgcttgcttttccatctgatgttttgttgagtagacccaagtattgggagtcctgagcacttgacatatcactggttggagagatcacgaaagtcatgccatcggtacatttttcattagagtagacaggaatcatgccaaacacaaagttaattgagaaggattgcaccgtcccgttgggcgtcttcctgaattgccatggagttgggtagaacgcatggcctttgatgtggacggtgcgattggtcagctcaagaaccccatcatctgtaactgttgctgcaccatcaagggtgaggtttctgccggagaagcccgaatagacgaactggtcctcgctcatggtgatggcaaggtttagggctagggcgatgaagggtaaaaggagggacagatgctccatatgaggtatgtttgctacttgtaaaacctcaacaagagcagaattggaaatggggtgttctcctagaccttgaggcttgagaggtgctttgtgttgttactctactttcaagtacatgatttatttgtattatgagcaattcttgaccggtcatgcctccgacgcacaagtcaattgtctatgtagttttttcaagtttgtcattgtcttcaaacgatctaggctgcgagcctttcatgaaagccaagtcatttgtctacactgagaaattatttgttcaatcatctatgtgaaattaatttaggaaatatttttacagagtactatcaagtttctgaatttcccatgttgtatgtctgaacaacttaaagtgttaactctttagcattcaaatatatcagtttattgctacaaaattccagatgaaaataattatgcctcctttttgtataacatgactggctttggcatatcttatttctaaatgatatatcaaataccaaaagaacatttactagtagaagtgaaggaaaagatcataactagctatttgaatatactatgtagcagagcattctagaaagaaataagatgcatacaacactattcacttaagaatcggacaacattctacatgtcaacaatatttttttttcaatcgctccactttcattttgaactgatcaagtcagttttgctcctatgttttggcattccctttgttgaatggagctattcctagctatagtcaaggtaggaaaaacttcagtagaattatgtggtttagttaagctcagctccattcagaagattccttctgtcactgccggccaaattcagtttgttatatttggtcaattttgtgtacacacctggcgttcaatttagttttcactatggtacagaagattccttcgtcactgccggccaaattcagtttgttatatatttcgtcaattttgtgtacacctggcgttcaatttagttttcactatggtacatttgtcaattgaaggacaataattcctgtccacatggaacagtggatgtggaatatattgtatggatgggatcttttttttgtttgctttttttttttggttggtagatttttttttaattgttatagatagcttgtggtcagggatatgcgcaatatttactggtgttgtagaattctaacagtcaaaatcaaaatctgtagaattgctatccttctaatatattcggcaattcttttgccgcttccactttaaaaaaacctgtagaattaccattcaactactctgtaaatttttaatgctcaaagtcaaaatcaaactcttattctcatctaatggttgtagaaacttgcagtcctgagatgaggcatcaataaaaattcacctgaataggacaggcatggacaatttatggaaaattgaaggaaattctcttctcatgatgcaactggtgacactgatgcttggtaaccatcattattgaacagtcaccatggcaggccaagcttgctcgatcaacatccaagtcatactggtgctgggttgtaactacttaccacccataaccattttttaaagaaattaaattcaaatagttttgttttaccatttgatgtatttttataaaatttaaacttctgggcgttgcctgtcggtattctctaagaaaataaatttgaatatccgtctgataaaaccagtaaaccacctggcggttgcgggactggcagtgtttgccaagatttatagcaaaatccatatagtaatgatgaaaacttataaattttcattaattaagggaaatggagaaggatatgctacttattttggtgggaatagattatgatatatgctgtaaaatataagaggaaaatgctcttatattactccctgaattcactttacaaaagataataagagttcaatctaatagcaccgaacaactagattgagtaccaatggtctagatctaatgtcctcagcctatttccgttacaccatcctctctctcatgctcccaatatttgatcacatccttccttcatcccccttgtgattcctgagataagctcaatgggcactatgtatatttatagcatttatcactggcttacaagttacaactctggtacttaaatagcagtggtatcagccactatttgcaaccaaatcacagtagcagctgctatcgagggcacatgggcaggatacacagaggattactttagtggcagtgtgttgtgaagtgtataatgtacatgcttgcatccaaggactcgcaaaaccaacattagaaaaaatttcaagaaacaagggatatgattgatgaaactgaacggtaaagggaacccttaaaatgtatcacaattttatccgctttactgataagagcaacccattacatttacatcagaatacaggctacaagtgcacagctagtgaaagccattaagcaagaacattgaatcaagccatgggcatcatcttccttctagtgagaagctagatgttgagccaaagcttgtcatcattggagatggatacaaagacatagcagatgggtcgtaaccttcattttgcttttgtatcaatgctaacatgtcaaagctgaagtgctccggtttaagctctggtagtggcacatccccatcgagatattgcataacttgtcgcacattgggcctaacattaggaaatgggtgcgaacacatcaatcccagctttagtacaagacatgcttctcctatatcatagttaccttggatcttgatatccattgtatcaagaagtgatcctttgtgccagttctgaagcacccaatcaaccaagataagttgtctgccttggagtcttccttgataggcttttgcccacaagtaacctcaagaataaatatgccaaatgagaagacatcagtaagagtggttgcctttcctctgtgtactagctctggagctaggtatcctatcgtgccaacaacatgtgtggtttgtgggtcagttccatggtcatataatcttgcaagaccgaaatctcccagtcgtccattcagttgtttgtcgagaagcacattgcttgccttgacatcacgatgaatgacaactttatcccattcttcatggaggtagagcaaaccagatgcaatgtctttgataatttgaaacctttgtccccaatttaaagttggtttgccctcttgtcgatgcaagtatttgtctagacttccatttgccatgtagtcatacacaagaagaagttcaccttttctcctacaatatccaagcaatttcacaacattgcggtgttgaagatggcctatacttacaacttcagcgacaaattcttttataccttgcttcgattcatacgaaacccgctttatagcaacctctagtctagagttaggaagcacccctttgtacacccttccaaacccacctgtgcctaccaagtttttgttcttaaatcctttagtggcatcaaataaatctttgtaagcgaaacggtgcgggccatactcaacctcccaatcttcacgtacctccttataccttaaatgtctcctcacgagtaaaacaatagcaacaccaatagctagtacgaatattgctgatctattggtagaacaatctctaagagtttggattgaggtcttggactaagattaggcagtttaggtagctttgtggggtcaatgattggagcaggaatattcagcccaaaactccaaccaagaacatagtgatgtcctgtgcttaagcctgttgaggatgagaagccaaggtatgcttgatctgttagcactgttgagaggttatggactacagagagtagtggtctcttaggtcttccaataccaagaggagctaatgtcacatcaatttgtgtggcattcccatcatactctacccaaacttgcattggtttatctccaatgaggctcacgtttgtgagcgcgccattgttgtcattatagaagccgacataagaggatcttactgagttgagactgttgatatcaatcccgacatgattattgtcgatgtccccgaactcatcattcctaatggtatcaagctcaattgcaaagaggtgattggtcgaactgccattgtttatatcattaagaagacccaaaaattggattggaaaggcagtggagaaatcattgcttggggcaatgaagaaagcaaatccatggcctcttatatcaccaaatgaagagagaataccaaatacaaaggagacagagaaagattgcaccgtgccattgggggacttgcggaagcatagcggagctgggtgagatgcatggcctttgatccggaatgtatcatttgtcagcccaagaaggccggtggctgtgatttttgctgcaccatctagagttagattgctaccggtgaagccggtgtagatgaattggtcatgatctccactagcactgatggctaaaaggctaatgcttatggtaaggaagaggatgataggcaaagtatactgcttcatgctagctagacatatacagttgtgacaaattggttaatgtaaatatgtcttgcattgcatccatttatagggttcacatctcgcaagctaggttgtggcctagtcagttggagcatgtccatctcagcatggaaaattctaggattcaggctaaagacatggtagaagcagccggtaatttacatgtcttggctaccatgaagtccaacaacatcgacatcaggtgtttgctattttctcggaggaaaaagtcgcatcactcccatcttgaaaaatgaagatttcactttcagactatatgatgccagcatagactatattattgcaggtgaagaaatagaccgtagtttacaagtcgtgagatccttttctttactctcacaatgttagttttgtataatctttgtaagtacattcaacatccctattattaggactttctgttattataataggatttatacatgatattatatggagtatacattagtttgactttgaattgttcttagaactcagaagaaaactttgaatgcagccttttgaaaatgctaacgatttgcattaaggctacattcagaaggctcttataatgcaaataatgcaaatagttagcattttcagctgtgttcggctcttacactttctcaacatctattttgtgaaatcattatcatgattaatatttatgatgaataattggctatgcaaatgatttaatcaaagaattggtttgagaatttgtgtgaatgttggtgtgagtgcgtgtgactaatgtgggtcaggttgtgatatctgtgcccagaaacggttgttttgtctgattatgtgcaggtgacttgaggtcagccttggtcaatggtgaggaccgggactatgttcagggaggaacagaggtctagtgcggtcgggataccatgtgagaaggtgactagagtcaggattcttggaggtcaacttcggtcaacggtggggatcgtgactaaactcaaggaggagttgaggtccagacggtcaaggataccgggtgacgaagttggatacgatatggcacacggtggatggacatcgtgtgggagagatttttgcaacgggcttcacgaggtgtgcgtgcaagcgtcggtgtttgcgaaggagattggtgtgagaaattgaggaagagtatatggtgctacagtacatgtggtgctgtagcatgcatatatgtgtgtgcagtacgtgtatgtgtatgcgtattgtgtgggctagcaggcatgtatgtacgtgtggttgtacatgtgcagctagttggttagcatgcatgtgatgcatgcgtgtgttgatgagattggttgagcaggccgaagcagccgcggcgtggacgtgtgttggctcggtggtgacaagccgactcggctcaggcagcaagcagcagcagcgtagcaggaggaggagtccggctcggttggcggctgaagtttgggctgtgcgagttttggtaaattgtaaaaggtttggaaattgtggattgagtcctactgtgaataggagttctacacctactttgagtaggggtttttgtggtataaatagagagggagcgtgaggcttcccggtatcgcttttcagagcgtggagttgatagtttagttagggtttcgagtttagtcgagatttttgtaaggagtgctgttgttgcacttcgtaaacacagagagaagcaataaagttgtcatctactttgagagtttttcgatttgtgtttcaccgggtttcggcggtataaccaggcaattcaccggcggtcagactggcagcaaggcggcggtcagaccggcgggagcaaggcggttcgaccggcggcgtgcaaacggttcgactggcggcggcgacaggactacgttgagattttcatcgatttgagggtaacttttatttccgctaaaagttttgggtttttggttttccctaccattcacccccttctggtaggcttggtttcttgtgttcgattcttcactattcccacgttttccacacatgttttccaaagtgctaaatatgtggttttgttttaaaaaaaatctatagaaatattgttttaaaaaaaaatcatattaatctatttttataaaaaaaagctaatacttaattaaaatatgttaatgagtcactctattttacgcacacgagggattagtttccaactgtaaagccgaacacagcaaaagctatcaacctgagaggtttatcagtgtgctctgtaaatttttgcgccaaggtacaaaattattgtaaaaagaaaacctctaaatagtgcaaaggagatgggacagggggtagtggcgcagggcagggggacttatattacggaatgcacatttcttcccggtgcaaaacagaactttggaaattttgtaaacttctaaccaaaataagttaaaattttgattcgatttgaatgaaatttgctaaattcattttttatcatgtaaaaggaatatttcggtcaaagcaatatcgtaccatgggacgatatacctagatatagatggccatggcccgaggcccgatggcccgcccaaggtctggtgattttggcccagcccaggcacggcacgggtcgggcctgtgcctgtccagcccaacagtcgtgacgtgcctagactgctacctcggcatgttgggccagttcagggatacaaaactaacttattctcaaccatatgtaaggcacgtcacaaagaatagagagcaaaaatagacttattatatggcacaatccaagagtagaggcgtaaaatagacttatttttaactatatatatgtcacaacacaaagaggagggagaagaaatatacttattttaaagaaggcacgataggccacccgtaccttcaggccggcatggcacggcccaaatattggtgggtcgtgcttgggtctgaggtgcagcccgtggatcgacacggcaggcctggtgtgttggtcgggccgtgccggcccgatagattctggcccgagcacggccgtgcctgggccgtggcgcccagatggccatctatgtatccactatccagagtttccaaaattccgggaataccattcccaaatattgaacctcaaaatcgagaatttaaaattagggattagtgttcgaaaatacttataggagtaagtaagatgtgtgcttgtaagaacgagagtgcgcgcgtttatgagcagctaggttgtaccgtttttcgaaaaagaaaagaagaaacactacttatctccgtcccagaatataagattctagtattagatgggacacatcacagtactacaaatctagatttataatactaagatatatcctatcatatactagattcttatattatgggatgaaggtagtaccaagagcatacagtgatgactgaggagttgttaatgccggatagcgatggcttacccacacaatcattcacatgtgaacaagacaaccaaagcaacaactttgcaaaaacccaaaaaagaatacgaagaaaagaaaatattaataataattaaaaaaaaaagaggataagcaagaaccgtacaaggcgagcagactacactacccttccatgttgccggccgccggccggtgagatcgagctcagccatggcatccgccgccgctcccgagatccaggagctcatccaccacccctacgacggccgcgtcacctccttcgtcgtcctctcctgcgtcaccgcctgcctcggcggcatcctcttcggctacgacatcggcgtctccggtaaccacccacccacccaccactctccctccctccctcccactcatcatcgacgacgagctcgccatgaacgacgcgatacaattggtggtgcaggcggcgtcacgtcgatggacgccttcttggagcgcttcttcccggaggtgtaccgccggatgcacggcggcggcgagcgcgtcagcaactactgccgcttcgacagccagctgctcaccgccttcacgtcgtcgctctacgtctccggcctcgccaccacgttcctcgcctcgcacgtcaccgccaggcgcggccggcgcgcgtccatgctcgtggcgggggcggccatcgccgccggcgccacggtgggcgcctccgcggcgggcctcgccacggtgatcctcgggcgcgtcctgctcggcgtcggcgtcgggttcgggaaccaggccgtgccgctctacctgtcggagatggcgccgccgtcgcggcgcggcgcgttcagcaacgggttccagctctgcgtcagcgtcggggcgttcgtggcgcagctgatcaacttcggcgcggagaagatcgccggcgggtgggggtggcgggtgtcgctcgccgtcgcggccgtcccggccgcgttcctcgccgtcggcgcggtcttcctccccgagacgccaaacagcctcgtccagcaaggcgaggaccacggcaaggtgagagctctcctgagcaagatacgaggcagcgacggcgccggagtcgacgacgagcttgacgatatcgtcgccgccgacaggtgcaaggtgacaacgaggcgcgggctgacgctgatgctcacccaccgccgctaccggccgcagctggtcatggcggtgatgatccccttcttccagcagatgaccgggatcaacgccatcgcgttctacgcgccggtgctcctccgcaccgtcgggatgggcgagagcgtggcgctgctcgcggtggtcatcaagcaggtggtcggcatcggcgccacgctggcatccatgctcgccgtcgaccggttcggccgccgcacgctgttcctcgccggcggcgcccagatggtgatctcccagctactcatcggcgccatcatggcggcgcagctcggcgacgacggcgagctgagccaggcgagcgcgctgctgctgatcgtcctcgtcgccgtctacgtcgccggcttcgcgtggtcgtgggggccactgggatggctggtgccgagcgagatcttcccgctggaggtgaggtcggcggggcagagcatcgccgtggcggtgaacttcctgctcacgacggcggtggcgcagtcgttcttggccatgctttgccacatgaaggccggcatcttcttcttcttcgcggcgtggctggtcgccatgaccgccttcgtctacctcctcttgccggagaccaaggggttgcccatcgagcaggtcgggaagctgtgggcgcgccactggttctggaggaggttcgtcgtccccgactccggcgacggcgaggaggaaggcggagccattgatgccgataagctctgaacaattaatcagctgtgcacatcactgactgactatctcattgtctgactgatccggcattccggacacggttgtttcagaacagaactggctatacccagcaacatgtacagactagcaacacattttttagctggatttaagtatgtaacaatacatatttgattacacataccaaggcttaaacaagcatttagtagtaactttttttttattttagagccctgacaagcatactagattatgtaggatcgaatcacaagaactaagccaaccagagggggggtgaatggttggtatacctaaaaaccgaaaacttttagcggaaataaaagttaccctcgaaatcgatggatcacggtctgaccgaagttgccttgccggtctgactgctcggatgccgccggtctgaccggtaattttaccggtctgaccgccgaagtcgtctgccgcgcctgctgtcgccgccggtccaaccgccttgctcccgccggtctgaccgccgccttaccgccggtcggaccgccgatgagtcgccggttaaaccgccgaaacccggtgaaacacaaatcgaagaactcttaaagtagatgacgactttattacttctctctgtgtttacaaagtgcaccaacagcactccttacaaaaatttcgactaaactcgaaaccctaactcaaaactcaactcaattgctctctaaagcgataccgggaagcctcacgctccccctctatttatacatgaggtaggcagcttaaagccacgaaccaaactcatactaggagtcctaaacaccttaggaaacccactagtacaagaaagaaactttacataaccaaacgtaccaaatttagtctccttctaaattcgactccgcatctcatacacacacaattcctccatcgtatgccatatagaatctccatcaaccacgtgcatcaactcttgcctaagtatcccgcatgatctctgaccaccacggacgtcgtcttatccccaagccgactcccggtccatcaccgcaaatactctcccgagacatcgagtcacctacacatggaaaaaacaaagaaaccatattccgagaccaagctatctccaacttaactcattagcagcaaacaatagtattacatacgtatagtatccatctagaagtcataatcatggaataaactcggatatccaaataaacaaaccgaaaccgaaaccgacacagtgtcggccggtcagaccgcgggctgcgccggtctgacagcgcattacacgccggtctgaccggctactagagcccggtttgaccggtccacataaaatcacagcagtccctgtaaattcacctgtgaaaaccaatcatctccaaaaccatttcgtgaataaattccaaataacaaaaccaataatctccaatgcccaattgttcatcacagaataataatcaaaaacacctttgattttacagattatacatgtataacattttactaggaggaaatatacctcaaaattaaataaactgaaacttaagtgtatatatggcagcaggtggatgctacctcccttcggagaggccagtgatggtgccatcgctcaccactgattggcaatatgcaacgggtgagcccacctgacgattctgcaccatgtccattggcgccaactcaggaaatggcaagtcatggttaagatactgcatgacatgccacatgcttggccttgcagcaggtgattggtgtgagcaaagcaatcctagtttcaaagctaggaatgcttcatcagcatcatactcattttggagctttggatccattgcctcaagaagtgatctctcgttccaacaatcaatcacccagtctactaatttgagctgatcactattcatcttgtgttcaatgggtcttcgtccacaagtaacctcaagaacaaatatgccaaaggcgaacacgtcagttaggggtgaagccttaccattttgtaacaactcaggggcaagatatcctatagttccaaccaggcgtgttgtttgcatgtcagtgccatggtcatataatcttgcaaggccaaaatcacctaagcatgcattcatctcttcatcaagaagcacattactggctttgatgtctctgtggatgacaacttgctcccactctccatgaaggtaccataaaccagatgcaacaccctttgattattcgaaaccgttgaatccagtctagaataggacggttactatgaccatacaaataattatcaaggctaccatttggcatatagtcgtaaaccaaaagaagttcacctttacgccggcaatagccaagtagctgcacaatattccggtgtcgaaggcggccgatgctaacaacctcagcaacaaattcccttatgccttgtctcgactcatgggacaccctcttcactgcaatttgtgacttagacttggaaagaagacccttgtacacccttccaaatcctccagtgcccaagagatgactattcttaaacccttcggtggctaaatataggtccttaaatgagaacctatgcggtccaaactcaatttcccaatcttctcgcaactcagcatacctcagccttcttctcacaaagaagaagatggccaagatcaccaaaaagacaaatgtgggagttgctagaggagaaattagtggcagcaagatgagctgagtagcttttccatctacacgagctttaggtagatttggtagatgagctgtgaagaaaggtggggctagtccattcatactaaagctccagcctaggatatagtgcctcgattctatttgacctgttgcagctgataaaccaacgtatgcaacgtttgtgagcacggctgagaggttataggacattgacaggagtgtcttggtgggtctggccattttgaatggagctaaagccacatcaatccatgttgcctctccatcgtagttgatccaaatttgcatggcctcgccactaatcagactcaagtttcggaaggaaccagtgatgtcatcgtagtagcctgcagaagaagatgttgccgagtgaagatcgcagatgtcgatgccgacatggttgccatctatgtccataaactcgttgttttgtgcagtgtcgatctcaacagcaaaaacatggttgctcaagttgccgttgttactgtaattgaacaatcctaggtactgtgccggtaacgcatcagaaaaattagagcttggggcaagaaagaaggccatgccctctgtgctggcatgcaacaagggagagacgacgatgccaaacactaaggaggcggagaaggactgcaccgcggagttgggcggcttacggagccggaaaggagtcgggtggaaggcatggcctttctgattgaccgtaccattggtcagctcgagcaagccctctggcgacaccattgattagtgtagatgaattcttgattgatgtttgcaggtgttgttcgtgatatttgacctgacggagaagcgatgcctttttatgttatggatctattccttttgaccaagttcagctcgttgtgccagggcatcactttgagcttgcttttgaagattttgattaatgcgatgatggttattctgaattcacgttgctttgccatgataatgttccgtttttcatgaaacaactgtttggcagttggttgttaggcaagataaagcctaggagattactgttagcgaagccgtagtacacaaattggccgtctcctagggttgtagccaaggatggcagaataagtttttgttcttaaatcctttagtggcatcaaataagtctttgtaagcgaaacggtgcgggccatactcaacctcccaatcttcacgtacctccttataccttaaatgtctcctcacgagtaaaacaatagcaacaccaatagctagtacgaatattgctgatgctattggtagaacaatctctaagagtttggattgaggttttggactaagattaggcagtttaggtagctttgtggggtcaatgattggagcaggaatattcagcccaaaactccaaccaagaacatagtgatgtcctgtgcttaagcccgttgaggatgagaagccaaggtatgcttgatctgttagcactgttgagaggttatagactacaaagagtagtggcctcttaggtcttccaataccaagaggagctaatgtcacgtcaatttgtgcggcattcccgtcatactctacccaaacttgcattggtttatctccaatgaggctcacatttgtgagcgcgccattgttgtcattatagaagccggcataagaggatcttactgagttgagactgttgatatcaatcccgacatgattattgtcgatgtctccgaactcatcattcctaatggtatcaagctcaattgcaaagaggtgattggtcgaactgccattgtttatatcattaagaagacccaaaaattggattggaaaggcagtggagaaatcattgcttggggcaatgaagaaagcaaatccatggcctcttatatcaccaaatgaagagagaataccaaatacaaaggagacagagaaagattgcaccgtgccattgggggacttgcggaagcgtagcggagctgggtgagatgcatggcctttgatccggaatgaatcgtttgtcagcccaagaaggccggtggctgtgatttttgctgcaccatctagagtcagattgctaccggtgaagccggtgtagatgaattggtcatgatctccactagcactgatggctgaaaggctaatgcttatggtaaggaagaggatgactggcgaagtgtgcttcatgctactagtcatagcagtggcaaattggttgattaaaagatggcttgcattgcaaccatttatatatagggcacactcacatcctgcaaagctaggttatgacctagtcagttggagcatgtccagctcaccatggaaaattctaggatttaggccaagacatggtagaagcagtcggtaatttacatctcttggctgccatgaagtccaacaacatcgacattaggtgttcgccattttctcggaaaagttgcatcactcccatcttgaaaattgaagatgtcacttgcaaactatggtaccagcatagactatattattgcaggtgaagaagaaatagaccgtagttacaagtcaagaggtccttttctttcactctcaaaatgttagttttgtataatctttgtaagaagatgaaacatccttattattaggacttcctatgattataataggatttatatgatattatttggaggatgcgctactacagaaacacaaaaaaaggacggcactataggtgccagttcatctaaaactagaacatataaggcttttccctccctcacgtggctctaaaatccaacactagcacctataacatcttgtaggtgccgattttttaaataaacgtgcacctttatatgggataaaaatgccagttttattaaaaactagcacatcaggatggagctaaccgagccaaacacccagcctacgggtttttcctcctcggcctcagccttactcccttcgtcccaaaaaaaaatctaggtagagatgtgaacccttgtccagattcgttgtcctaggtggagtcacatccctacctaggttgtttttttttgggacaaagggagtatgtcctcatcctcctccctccctccctccctctctctctctctctctctctctctctctctattcttcgctctttccccgaagagccaagcaccccccgcccatccgacaacgatagagctacctccgattcgggggctgcgggatctgtgcccccctcctccaacggcgagggcggtgcatcgatggcgccacctctggctcaaggggggagagggtgccggacttgtgcttcccccctccaaaagcggcagctgcctcctcccctcggcccgtccaatggcagcggcagtccgacttggggactgccgatctacgcaccccccctattctcggcgtagaccatgacgagtggcggccctgcctacccttgagcaatgatggcagcggactaacaggtaggtaccccttctccccttccccatccaccccttcaaaaaatcccttcactcttctgggatgtgacagtggtggtgagcggcaacgcctcggcctccgatgaacagtggcagctgtggatttgtgatgaatattatgttgtaattttatgggatgattcttgttgctggatatatgtgagaattttcttatctagtttcctttacatgttcttggctcgaagcattggttcgatttgagccgatgcgagccgcgtcacttttgattctccacatcggtgctgtttgagaggtgccggttggaaaaatccgacacctatgtgtggttcctaactggcacccattgggtattctgcagtagtgatatattaatttgactttgagttgtcatagaacgaactaaatgaatatatgcagcattctaaatatgctaactatttgcatgaaggcctagatatagcattcatgaaagctctatttgtgacgagatacaaaattattataaagagaaaaaaaataactctaaacagttggaaggagaggagaccagagggtggaggtgcaaggagagcaacacaccaagaggctgagacagtgatgcctcacccacacaatcattcacataacaacaaaacaaccaaagcatgcacaactcagcaaaaaaagaaaagaaaagaaaagaaagtggataaacaagcaccgaacaaggcaaaacagactacagtatatccttccatgatgacggccggccggacctgctcaagtactatagcacctggcatctctcccgaaatccaaaacctcatgagcacgatatatatggagcaacccctacgataccatgcccctggattgatcacctctttgctccttcatcagttcatggtgttctcctgtgtggtcagcgtcctcgcttgcagtgcgtgttcgactctccaagacatatgctcaccctccttaataatattgatatcaggctaggatttgaattaggaattcaaattttaactttgaattccaggaactaagggtaaattccagaaagaatgtcttaaagtttttgacgatattcagattttagaaaattcaggaattttgatttttggagaaaaacaattttggtaggaaaagaaatttcaaaggcaattttgaatttgatttgaaaatttaaaaactgagtttagggaaaaattttgggattttaaactagattttgaattagaatttcaaaggaattctgtgagcaacttaggagggatacaccgattttataattcgaaactagtgattttcatttcgatggtaatttttggatcgagattgggatggtcatagggagagatttaattgagatctttggcacaagcactaagacacactaaataactgaatttgttgaattaggtttttattaatcatactatcaaatcatatacagatttattttccattataaaccaaattaattccctccattttgataaattcgaggtactattttatcaaaagtaccatgagttacctccaactgtttatatgtgaaatagtgctacctagcatgcaagaaacatgactgtgagacaagaaactaaggtaaaaattgttatagaaatttaagaaagcaaagttaattgtggttgttttactctgcatttggagaatcctatctatcaaattatgtgcaagatttcttatgtgtgcttgacagaggttgccagttgccaatgcaatcaatacctgccttgtatttgcctcgacgaggactctaatatgtggttcttataatatggctaatggctggtagtaatctaaccaatatcccatattattttcctcggaaaagtataatcttttaattttcaccaaaggttgtgctttattgagtggttgcctgcagttacaacaatcaagtatcaactctgatagttgtgagaaataaataaggaacacaatctgaaaatgcttgaattctaaagctcacacgctctctgcacattgtcggaccgacaaaggctaactctgacgaagctgaagtaaaaacagagaatcaaagacagtttgttcggcgatctcgctgcagcttttccgggattctcttctccttctattcatacccaaaactaggggaaattacatgcaaacgtggccatcccacgttcgactaaaatcagttcagccacagtaacagatttaacataattttggttgaactggccaagtaatatgcatgaaaggaaacttcaagacaactaaaacagcacaagaacagaaatatggagtgaacaaggatgttgatttcgttttttggttagctaatatttacttttccttccccgtttcatagaataataaataatttacagtgagcatccacaaatttgaaaaaaaccttctgggtcctgattttgttaagaaagcaacattactacaaggctgggaacaccagcttacaataaagctacaatatgttcatacaagtagacaatcactactgggaatcccatccatttgtatcatcttccactcgtgaggctcgatgtcaggttgttgctgcaaactgtagatggcacagatttgtactggtcgaaaccgtcgttttgcaaatatcccaacatgctataactcaagtttgtgggcatcaaccgaggaagtggcatctcattgtcgaggtattgcatgacttgacgcataccgggccttctggtacaaattggatttgcacacaacagccctagctttaaaacaagattgacctcatctgcattgtggtctccttgtaatctgacgtccagtgtgcttgtcagtgatcctttttgccaatgctcaacaacccaatcaactaatattgtcgggctatcatgcgtgtaattgttaataggtcttcgcccacatgttacctcaagaacaaaaatggcaaatgcatatacgtctgttagaggggatgccttaccggtgcgcgccatctctggtgctatatatccaaaggtaccagccacatgtgttgtttgtgggtcattgccatgctcatatagtcttgcaaggccaaagtctcctagatgaccgttcatttcagcatcaagaagcacattgcttgctttgatatctcggtggatgacaactttctcccacttctcatggagatagaataatccagatgcaacacctctaatgatttgaaatcttttggcccaatctagcgtgtacttgccctctttacagtgtaaatacttgtctaggcttccatttggcatatagtcatagaccaataagagttcatcttttcttctgcaatagccaagtaattgaacaagattgcggtgtcggatgcggccgatactaacaatttcagcgataaactcctttattccttgcttcgattcatgagacaccctcttgatagcaacctccaatttagagtctggaagcacacctttatacaccttcccaaatcctccaacacctagaattttctcattgttaaatccttcagttgcatcaaataaatatttgtacgagaagcgatatggcccaaattcaacctcccaatcttcatatagttcagcatacctctttcgcctccacactaatgctgtgactgctgctcccacaagtaggatgactgtggtgatgactatcggtaggactatcttcaaagttttagaccggacttttgggccaaatcgaggtaactttggtaacttgatgatatctattgtcggagcaggactgttcattccaaagctccagccaagaacataattcaatgcaccgacattattagcaccggaagagaagccaatatatgatacaccttcatctaaaattgttgagatgttgaggattgctgacagcgttggtctcaaaggtttggttagcttgagaggagctatggtcacattcatctgtgtggcctctccatcatagtccacccatatttgcactgccttgccgccaacaaggggcaagtcattgaaaatgccgttcttgtcatcatagaagccagcaggatgggtctctagcggtctgctgaaactactgttgatagaaatgctgatgtcgttctcgttgttctccagaaaccttttgtcttggcaacttaaaaaattaactgcaagattgctctccctctgatcattcttgaggcccttgctcggaaatatcatgaaagccatgctgtcgggacatctaatagaaggagccatgaagagcacaaagttgactgagaaggactgtaatggtaccttcagaaattgccatggagtcgggtagagggcgtagcttgtttcgtaggtacttgcgccattggtaagctcaaggattccgtttggtgttaccatggctgtgccatcaaggataaggttgctgccggagaagccgttgtagatgaactggtcctgtccaatactgaccgtggtgaaggatgttaggaagaggaggaagcaggctaaatgctccatggcaggacgctgcaaccggtgatggaccatgaaaggtgggcaaccgggatactgcaaattaaccggcggtacaagtcgacccaatttatttgcagcgatgaggaaatagttatgcaggcatgacttctgtggcgcaatgcatagtcagtcttccatctagtcttttccatgttagggtgtgtttagttttctgggtgtaaagtttttaaagtataccagtacacatttgaagtattaaacctagactaataataaaaataaattacatattccgcttgtaaactgtgacacgaatttattaagcctaattaatccatcattagcaaatgtttactgtagcattacattgtcaaatcatggcgtaattaggctcaaaagattcgtctcgcaatttacacgcaaacattgtaattattttttcatccatatttaatgcttcatacatatgtccaaacatttgatgtgacgtttttaactaaaattttttggaacctaaacaaagcattagtcattgtggaaaagtagctagcgtgcttccaatattaatctcatgaggtcagagaatcacagctagcttccgtctcttaatttaaacctatgtcatacgtggatgtagtggcgaattgaagccaccatctggtgaccccgatcgagcagtcgcctggtggctcgtcagaaataacattaaaaacaaattcgatgttattatagggactgaatgtacaattgcctagctagcaaataatgtacaaccagttatatataaccaggaggtagcccgcgcgcccacctatgcgggcatccgtatccttttatatgattattaactagcacggtggcccgcgtagattgcgcggctagcaccattatatttgttttcttatataatagcttaaaatttttaatactttattactaaaatatattaaaaatagcaacacaatatttattttttattatattgatagttattaattattttctactttcaaattttacttatttttaattatatttctatatggactctaggctcttctcttattcttgcttatttttaattttagttatttataaaattttctttctatatgaactataaatcctacttttaatttttaaaattattttaattctgacttccagtcagttctgttcttcttccaatattcttaattttaattccaaatttccgttactataaattgtattcctacaagaactctatttccaatattccttattttttaaattccaaaataaattatattcttatgtcacatcctgattttcgtttcaggatttataaattatttaataaattattaatagaatttatattaaatgttctttaatttacaagtgaagttaaatgtgggaataaaatttcctaaatttaaagcatggatggatttaatttttattaaattctccatgcttaattatactctctgaaattttctcggatttttcagagctcaattcctaaatgatacaaagaacagttcagtaattatttgatcaataattatctaattataattgttaagagcttttcttgtttaaaaatccttaaattataaattgttgtttaaaaggaattattagaaatgattttaaaagcctaaaagagaagatctaattttaatttgttaaatctcaatataaaattgggctagataaaatttcattaaatactttgcttaattctataattcctagatttttctgggatttatttgagctaaggaagtatttttaataaatggaattgcatttaagaaataatttaaattgaaaaaggtttttaaaagtcttcttttggctttgggccgaaagtcggcccaaaacctctcttctctctctcctcggcccagtcggcccagtcagcccgcgctcctctctctcggtgtcgctgacaggcgggacccacctgtcagggtcgtcgtcctcctcgcgccgccgccgccgcccgaaccctagcgcaagccgccgccgtctccttccaagttcggccgcgtctttccttctccggccgaatcttttgaggggaaatgatcttctcgacctcctcttccttttctcttttggaatctccggtcaattcggtttggaaactcgaggattcgaagtcgaatcggatccatctctctcctccgaaccccgttctttccttctcgccgccggtcgccgtgggcctccgtcgccgctcgatagcccctataaaaggacccccgagctctcctctacccgccgcctctctcgccttcgcccgccgtcgtgtttagcgccgcctccgcatagccctagtcgctgccgtcgttgccgtcggttctgccgcgtcgcgccgccgttgcagccgccgtcgtcggtcgccgtcgccaccatcgggttcgcgaggtcatcgccatcctcgtccgccccttcgccgccgctgaagaccgccggagcaccatcgccgtcgtcgacccgatctccgccgccgcttcttcctcgtcgccggcgctgtccgttgttcctccgccgcttctttggtcaccggtgagttcgcctcgtcgcccgcatcatcttggtgccctctgtttgtgccgtagagccgccgttcgccggcgagcgtgcgccgcccgagccttccaagccgccgccgccggtggtgacgtcaccgctgacgtcatcgtcgtcctctcccgtgagccggtcgtggaccgttcgatctcggccgtccgttttggatagggttgatctcggccgttcgttcccgtgaaccgctgccgtgcgcccggtccaccgcgaaaccctagccgctgacgcaataatcctccttttccttttcaaaaataattcattattgcatcataattcaattaaaatccatataagtgttttaatctgatttaatctttaaaaattcataactaattcatttgaactcagtttaatgtggttcaagttgcaaaaattatataaaataaagatctacatattaaaattgtccataaattgaattaaatttatttaattctttttaaatgggctttaaatagatttaatcttgtaaaattcataataaattcatttgaagtcagattgaggccgttcaagtctcataattcatctaaaattaagatctacatgtttgtttactttttatgcattgtttatttggtttttattagtctttttcttcgttttgcgtgttagcttgtcatttccgtcgttgtgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgtttgcattgactactttattccttgataccttgggtgattataacttgactagttgagctatatatattggttcagctagatattagatatgattgcttagccatgcttagaaacattagcacactattgggataacttatgactcattatttaaggatggtttaatggtagctcacgatggtcaatcgtgattggttaattaattacttgccaactaaaacttgataatggtgggttgtgagcacatggttttgagagtcgtgctcatgacaattaaggaccggttcgcgagctactgttgtgaaacattaaccgtgccaaccacaagctatcgtgggcaacggctttaccttttgtatagcatggttcattgcggagcaccagactgagaagtggcggagataagcccacgggggtcgctggggagtccatgcctctggtttttgagggggtgattatgatccaggaaaggtgcgctgcggtgggttgtgttatgcaaggggtaatgtcacagctcctttccgaggtaccgtggtggtactgaggcacatggtgacatgatgtgggactgtgtcttgtgggtacagtggtacacctctggccagagtaaaactattcgaatagtcgtgcccgcggttatgggcgagttgagcaatgtttttcgtgattagtctcacacctctcacaataattatagatgttatacccgtgcccgcggttatgggcgagttgagcaatgtttttcgtgattagtttcacacctctcacaataattatagatgttatacctggtaataatttgcttagctcctggtttggagttagatctgttcagccgggtatggttgttcagaatggttgggcctgtgcagcatgggtgtgctgttcagtgttgattaaaatttctgattaattactccactgttttacttctcttaaatgttttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaaggatccagaaggagaagacgtttggcttataccccagttgagctgcctgtgggagtggagccggagcttcgctagattttattttccgctgcagttttcttcttggtgaggactaagtgcctcataagtaagtatttatcgttttagttaatttgatgaatctgtatattaaattgtcagtttgtgtacctcggctgattcctggacgaggattttatgcacaaataagttcggaaattactagtgaatttccgggcgtgacatcttatatgcactttagactcttctcccaatattgcttattttttatttttaaattttaattttagttttctctaaattgtatttctatgtggactctaaactctatttttattttattttcttgattttgactttcaatttactctaaattcctatatggactctagactcttttttcaatattcttattttttaattctgaatttctgttgtttctaattgtatttctatatagactctaaactcatcttttaatattctttattttttagcccacgcaaattgcacggctaatatcattatattttctctcatataatagcatatatgttttctcaatgtattattcaaatatattaaaatgacaacatacttttagattttgtactaactttatcaaactactaatgtgtaatattcatattgtatttcagttatttataaattgtatttctatatggactctcttccaatg

SEQ ID NO: 60293 - DNA, 12332 bp, Oryza sativa
ccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccgatcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatctttatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcattcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaacttcctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaagctcagcagaccaccaacttcaagaagcagaagaagaacaaaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaatagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagcttttttccaatgaaggatacacatagtggttcgaaccaaccctctgaaataattcccaattcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggataaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttatcttaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctatgagcaagttgagccgatttacttctaatccgggagatgatcactggcgtgcgcttgagcgagtaatgcgctatctgaaaggtactgtggaattgggacttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagaactaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctatccaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgccctcctagccacttgaagcatgtgtggtggagagaagaggggaaacacacgcgcgcgctcgctcgcctcgccgggccgggccgggccggcggcgcgcgtcacgacgtacgcgtcgaatggtccgaaaaattggctcctcacccttgcgcagatgcagcctccttttgcagttttgttttgctgcaaattcggattcgttttgttttggatccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcacgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatccttatatgcccataatctcaacataatttgggcatagagccatagtataatagagacataagtaaaaacaaagcttcccaaacttagttttggcctagtagtgtaacagggacttagttttgcgtccttgcagtcagaattgcctcatccatgcacataattgcaatgacagctgaattaagtccgattaaaagttagataatctcattttttttcttctctcagaattcataccatcttatttttctcctttaattcaaagacattttgaagattactagtatacatataaaagaatataaattgtccacataatcgtgtggttatatttgcagttaggttaacgtccttttcatgaaattaaagcgtgatataccaagccaagtttcccaagtttcagggtcttaattaatttccggcagacgaaaattactcagggcgtgtcacattagctattatataagatgtcgtatgggatgttcgggcactaataaaaaactaattacagaatccgtcaataaactgcgagatgaatttattaagcctaattaatccgtcattagcaaatgtttactatagcaccacattgttaaatcatggagcaatcaggcttaaaagattcgtctcgtaaattagtctcaatttatgcaattagttatttttagcctatatttaatactttatttaggtattcaaacgttcgatgtgatagggtgtaaaatttttgcatggtaactaaacatgtcctcacttgtaagttctacgagtggttgattgacatgaaccttttccttgtttgaaccttccggccataagacaaccagtcagaataggggaccatgtgatatgacattttccggtagattgagtcttaggccctctttagttcccacaacaaaaaatttcacgatgttacatcgaatattaggacacatgcatatagtattaaatatagttaaaaaaaattaattacacagattgtgtgtaatttgtgagacaaatcttttaagcctaattgcaccatgctttaacaatatggtgctacagtacacgtgcatttgctaatgacggattaattagacttaataaattcgtctcgcagtttcctggcagaatctgtaatttgttttgttattagactacgtttcaaactttaaatatgtgtccgtatatctgatgtgacaatcaaacaaaaaatttctccaactaaacaaggccttagcgaaaaaaagagatgatttttactgtccagcagaggtactagtagttcagcaggaggtaccagtagttcagtgtaccatctaaggggtaaaacgggcactcttattttttccattattgttctctctcctggtgacttctcgaaattgtcgcactacgccggatccggtcatctctgacaggccctaactctcatcttgacggatttggccccagtcagggattagtggtcactgatgactacacctgatctctaatgggtgaaagtatgccaatggtaattaaaacctttgacaggccaaatcgtttcaaatcgttgagtctaacaatgctcatcctgcccagctagatccaacgatcggaaacgatttggtaccgtaaggtaccgatacctcgaggtactttttgttggaccagagcaaatctctatttggcaatcagggaggtcatcaaggccttttccggttaaagttacttaaaattttaactttttaaccgaataacatgccccggtaaaagaaagcagctttaataccaattaacaatcccctttattaccggttgtagcaaccgagaccagtaaatcgaccagtaaatcaagactaaagatctcgatgtttagtaccggttgaaagaacctttaataaagatgcatactaaatcataaattatatgtagaatgtgggattgaaactcaaaatctacctcaaccctcacgtgcattaccatatcccacctactacacatatctaacttgaatacaaatgcttttttttactaatcctggagacatctttagtaccggaatatttttagtccaaattagtgttatcaaccggtactaaaaatacatctttagtaccagttgataataccaacccggactaaagatcctctagctttaattagtctcggttggtgttaccaaccgatattaaaaatacatttttagtagcgactggtaacaccaaccgagacttaagatgtttatagggacttggatttttagaaccggtttagtaccggtttttaatctagccgagatatttgtgttttggggactcggataaaagatcgttactttaatctctacaagtgatggaattttctacgcactctttcttaaaaatatgacagattttgcagcaataaacttggacatacagggcgcctcttattacgttcgataaatacagtatacattagtcctcaataaaatatcaatatatagaaaatagcaaacaagcaatattttgtatcatttgggccgtccaaattctctgcgccagattagcagcacacattgaattaatatagccaaatcatcttccacgtgtagtcagaggcagcaagtatagttgaaccaaaatgctcatctctcatcacacttgaaacggaaacgatggcattgcggacaagttgactgcttctttaatttctacatcacggacacatttagttctggcaactgcgcatcgccatcgaggtattgcagaacttgccgcatattgggccttgcgtttgaaaatgggtgtgagcataataatcctagcttcagtgcaaggtaggcttcatcgatattgtagttaccttggagccttctatccattgtatcaagaagtgatcccttatgccaattctcaaccacccaatcaaccaagatgagatgtttaccttccgagttttgcctgataggcttttgcccgcaagaaacctcaagaaggaagatgccaaaaccaaagacatcactaagtgtagttgctttgcctgtgtgaactagctctggagctaagtatcctattgtgccgataacatttgttgtatgtaggttactgccgtggtcacatagtcgtgagagaccgaaatctcctaatcttgcattcatctccttatcaataagcacgttgcttgccttgacatctcgatgaattacaactttgtcccactcctcatgtaagtagagcaggcccgaggcaatgtctttgataattttgaacctttgtgaccaattcaaagttggttggccatgaaaattgtataagtgcttgtcgagactttcattttccatatagtcatataccaaaaggagttcattcttgcgccggcaatatccaaataattgtacaatgttgcggtgttggagattccctatactaactacttcagctataaattctttaataccctgctttgagccatatgataccctcttaacagcaacctgtaatttcgatattggaagaacccctctgtacacctttccaaacccacctattcctaccaagttattgttctaaatcctctagttgcgcgaaatagatcctggtaagcaaaccggcgtggaccatattcaacttcccaatcttcgcgtacctccttgtacacaagttgtctcctcacaagtagaaccacaatgccaataattaataccaatagaattgaccctattagtggaaggattaatagaatggattgagttcttggaccactataattaggtggttcgggtagcttgggtagcttggtagagtcaatggttggagcgggactgttcataccaaagctccaaccaagaacgtagtgatgagctgtgcttaagcctgttgaggatgagaaaccaagatatgattgatttgtaaacactgtagaaaggtcacgggtaactgagagtagtggccttataggtctagccatgccaagaggagctatggtcacattagttaatgtggtgtacccgtcgtactctatccaaacttgaattggccctcctccgatgaggctcaagtttgtgaatgtgccacccttgtcatcgtagaagccagcatgataggattgcatagaattcagactatttatgtcaatgccaacatggttgttgtcgatgtccccaaactcattgtttcggatggtatcaaattcgatggcaaagagatggttgctcaaactaccgttgtttttatcattgagaaggcccaggaactggattgggaaggcggaggagaaattattggtgggagctatgaagaaggcgaaaccatggccccttatgtcaccaaatgaagagagaataccaaacacaaatgaaacagagaaagatgtcaccattccattagactgaccgaagcggagtggagccgggtgcaacgcgtggccttgagccctgaacgtgtcctttgtcagtgcaagcaggccggttggtatgatttttgctgagccgtccatggtgagattggcaccagtgaagccggcgtacatgaatctttcatggtcaccaccggtgctggaagctgaaagattgagggttaggaacagaagtaggaagcacaagatgagctttgtgctactcatcgatcgcttcttggttgacttgtattttgtagatctagtacttgtcgttgcgcaggtgcactgtcagtatggtaacttagtaagcagttaaggtgattttataggttgtaagctggagcgccgtgcccttcacgattggaattaacttggaaataaatggttatttgacctggaaaatttgctactcttataaacgacgactcttcaaatgtcactcctattatcgtacttaatttttatgtcattgaacagacaagttttcctcttcttttttaccactttcacctacgttgggtgacacggtggattgccaacgtggattagtgttaagaactgatttttttcccctttccattcgcaaattcacgaacttaattagcattataaaaggagtaaatttagaatatgccatatcctgaactctcaaaatacattttatttttgtctttgaagttatcatgaatgtcatatagatccaaacagactccaacctactaagtgcgttgctagatgccacgttgacacctaggtgtcagtgaaacccacatatcagtcatatagaaaaaataaaattaaaattaaaagaggagagtaagatgtttgtaaatcttttaaaagtaaaattttaaaagaatggagaaaatacgttttaattttttccccaaaatatatgtgactgatacgtgggtcccattgacacatatgaaccaccgtagcgtaccacatcaatgtatggaatagcatacatgacatcaactaaaaatacattttaaaagttcatgaaactatatcatacactcatacaaagatcgtccatacacattattcttataaaagtattgttcaaagcaaattcccaaaccatttttttagctaagtagttgagatctttttaaaacgtttataattgtaattaaatatttttcttaaacattgaatatttacgatggcagcgagcactaatgatgaacactgttaagtacttcctccataaaaaaaaatttaaattctaaagtttaaattttgtttaaaaaatcaatttctatcatcctacctaccttcatcatgaaaaacgataagttttatctcttcaatactctttacctgcctatcactcttactattttttcaatgattaaagatattttagtcattctcactcttcactaattctatcttaagatgttaggaatatttttttttgggcgggaggaagtaagtgtaaaggaatacagtactctcgatcgcctttccaggcttgtaaaaatctcttctttcaatggcatgtacatcagaacccgtgggccaattctgcaatcatccacacaatcagccatcaactactctgaaaacagaagaaaatgacaaaaagtggataagcaagcaccgaacaaggcgagcagactacactacccttccgtgctgccggccgccggccggcgtgctcgacctcagccatggcgccctccgccgccgctcccgagatccaggagctcatccaccacccctacgacggccgcgtcacctccttcgtcgtcctctcctgcgtcaccgcctgcctcggcggcatcctcttcggctacgacatcggcgtctccggtaaaaccacccacccaccactctccctccctccctcccactcatcatcgacgacgagctcgccatgaacgacgcgctacaattggtggtgcaggcggcgtcacgtcgatggacgccttcttggagcgcttcttcccggaggtgtaccgccggatgcacggcggcggcgagcgcgtcagcaactactgccgcttcgacagccagctgctcaccgccttcacgtcgtcgctctacgtctccggcctcgccaccacgttcctcgcctcgcacgtcaccgccaggcgcggccggcgcgcgtccatgctcgtggcgggggcggccatcgccgccggcgccacggtgggcgcctccgcggcgggcctcgccacggtgatcctcgggcgcgtcctg

SEQ ID NO: 60294 - DNA, 1501 bp, Oryza sativa
attcctgcagccttgatctgtacatctacaattacaaatttatgttgtttactgtatagtgtttcactttacctcacaaagctggaccgcaatgatgtcctggttgccttgctggtaccagatctcaaattcaagatagttggggaaattgctgctctcagtaatcttgaaaacgatattcttgtttgggtaggtacaagaaaccctgtagtgtagaggaaaccagaaccatgacatgtcagtaacagcacatgcgtccataattccttatgcagatattgtttctatagtagttttcattttatttttcatctaagaaaacaaatagttatgccgttcaatcaagaattttggcagattaattatatgcgcagacctcctgtactcaatcccaaccacgccaagggttagcagcgctgtaccagcatctgtactctgcgccatcctggtgaaagcatgctggctgaggatgaaatcagtgccatcactcgccccagagtcggtgatcacaattgtgacgccatttggagagcaatagtaaggattcgtgcacctcacctattggtaattggcattgttggtaaaaatgaaaggatttttttttaatgattcacacagcctagtcatacagatggattacctggtagcatgcaccacagcctaccccatccctgtagaggcttgctgaagctgaaacatcaccattgttgagtgttgccccaaatgcgccatactcacatgcaccgtctagaagtacaattagaaacaagtacaatttctatgagctagcttagaaactttatgcatttccgagtttaagtataatttaacttcctttttttgggttcatgtgaggtatgctaacccaattgaagtaattttatctgaaaggtacttactttcggtcccttttatatcagagttggggtaatatgctgctctcgacacagtgaagtttgcatctgcagtagccttagagaggaacaagatgagagaaagtatgactgggagatgccgacgaagcagctgagccattggtggtttggaccgtggagacgcgtacaaagccttaagagatgcggtgcatgcaataggagaggtgaaacaagccaagtagttctatttgatgttgatcttgcctcagaggttgttatgtatttatagtgttgatattgcctggctgtttgctatccttaggttgctgatgagtttacgagctggaatttttttttattttttatttttatttttattttttggttttgaatgccaatgccgttgttgacaatgcttctctctgatgaatatgttcccccaagttgtgtgtttacacttttttcgctttctcaattgcaagaacatttttacattgttgttgtgtacttgtgtgtatgaaacttgctgtttgtgttctagttagttatatcccttttccctcccatttcagttttcagcgtcttgttctggtaacagtgccgtactgatttgaaggtaggagtag

SEQ ID NO: 60295 - DNA, 1130 bp, Oryza sativa
cataagaattatataaaggtcatgaacgaattatattgtctaacacatatatatcatcaaaaaaaaatttgcatgttgttttactcaattcctaaggtgctgtagacagctatattctccatgaaatgaagtgcttgcgagccacttgatactaaattatagtcacatacacaagtcaacagttcaatttatagcgcgagcgagttctataaaagtactaaacatggcattgaaagttgacattgtgcaactagaatgctagatttatacatatgaaaagaaaatattaatgtatatatagctcacattttaatctgtcattttggtaatggggaaactaaggtgcgtgatgatagcggccctgaagaaattccaagagttgacctgggctccatacaatactaatccccttagcgttagaagcgctctctcccatcatgcacatgaccaagcccccacttgacttcggtatcccttgtcatttggatcacaccaccgtgcacttcacaattcacactactccttcagattaatccatctcgttgatatttcatctcgagtcgtaaaaaccctcatattgtattcatcactgacatgtgtgcccccaaaaaatatcaataggtgtagaaggtcgtgtatatatacgcattcatgtgtgtcaaggcaatatattttgttgaatagagatgacatgggataataggattaaggaggagtcttccctcctcattgcccttttaatacgtcttagacacccagacattgacttagatgcctcgggagaagtagcattaggatttaagaccgttccccattttagctgtaccaagagagacaaaggtacacaagattaccagaaagaggccaggagcatgtcatccaagaagaagagagctgccatagatctctccctggaggcagagagaagacggccagaagaacgcggcggcggcagcgatcgcgaagccagcgatggcgccgctgctgcagctgaggaagatggtgatgtcaagcaacgagagggccctaaagaggaaaccggcggcgaggaggagaaggtagttgaagtggttgtggaccaaggagacgacggctccaatgaggagatcaaatataggactcaacaagca

SEQ ID NO: 60296 - DNA, 837 bp, Oryza sativa
accaaactcatactaagagtcctaaacaccttaggaaaccctctagtacaagacacaaactttacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacatcgtcttaccatcaagccgactctcagtccatcaccgcaatactcttccgaggcatcgagtcacctacacacgaaataaacaaagaaaccatattccgataccaagctatccccaacttgactcattgttagcaaacaacagtattacatacgtatattatctatctagaagtcataaccatgaaacaatcatggatatccaaagaaacaacccgaaaccgaaaccgacatagcgtcggccggtcagaccgcgggctggccggtctgaccgctcgatcaccaccggtctgaccggcatacaccacctagtcggaccggtcacataaaataatagtgaatccgatcatcacctgaaaattgattatctccaaaaccacttcgacgataatctccaaatatcaaaaccaataatcacagatgtcaattgttcatcacagaataagaatcaaaacacactttaatcttacattacgttattatacgttcaccgtgaataacatttagacccatcactctcgagttcatatatcagccaccacatcggaggaaagttatgtgagagaatttcaatcggtgataatataggcacgtacgtgtcgcctctcgcgacatgtaaga

SEQ ID NO: 60297 - DNA, 1988 bp, Oryza sativa
ctggtgggggtgcgcaggcgccgccgctaacacactggcgcaggcaagccaggtggtgacaacacatggtattttggttatttggacaaaaaaaaatatacagtactaaagaaggctaaccggatgatgatggtaattatagaagttaagtaaaagttgatggtttattatagaatgtgataaagtcagtggcaaatcgtagacatgtgaaaaactcagtggcatataatagattctttctggaaataactatgagcaacactaacactacagtgtataagaatcacccttgtaatttccatcatttaaagccttgaactagatataagagaggcaaaaaggaagctacattaagtcttaagctcttgattctcttagattattcaactttgaagaagtatttagtagcaaatagaaggaaatacaatggatgtaacaaagatttagtggattttgaatagagcatcgcaaattgaagtcaagatgattagagatcaataaaatcagtctcttcatctctgcatgcaacaaaagggaggcatatacgatgttgtcaaagctcgtcttaagagaagagagaatgagtaaggaatagaaggcaaattagcaatagcgaaggaagccaattcgtcactatgagaagtactacgagtgtgatggaaaggatgaaacaacactccactccttaatcccgactccttcatgattgcaccagacgatgacatcatgttcgatgggctaacatggccacttgtctttttctttagttactaccaatttctatcaaattaaactaggtgaatattattgttatgcatataggctaaaggtccatcccttacaaggcttaaaaaattgcctacccagaccggccatggtacaatccataagcctttaccattgaacatctacgactacctccgtcccataataattgtatttttaggattcaaatgtgtcccaaaataattatcgtaatagagtacgccctctgtcatagaatataagaatttttagggtttgacacaggtattaagaaagtaggtagaactaaatgggagaatgttgtgattggttgagaaatgtgggtatgtgagaaaataaaatgccggagagttgttattggttgagaaaaagagaatgttggtgaagaagaagttatattttgggacgagagtactaattaccccattaatcactttttgttgaaatttctctctattctaccctctaccactctctcacttttacctatacactatttaataaaggatatcatagtctttgttatcaaatcttaataactaaacaatttagaatacctcagaatttttagatatttaaccatttgccacatttagatgtggcaattaactttttgccacacatgttatagacacgtgtggacccacatgttattgagataggggtggcaaatagttatttgccaaatttaaaagtagcaaatagttaaaagccccaagaattttaccctcaactatccattcccctctccccaatttaccatacacacatggatgtagataggctacaaccaaagcaacacccatccatcacatcaccacatcaccaacaatggcatcactgctcaactcatcaccatcctccccttgcgaacccacacacgcgcgcccacagccgcggcgcccgcacccgatccccatccccgcaaaccctccccccacttctcccttcctccaaaccctagctcacgctctcatgtccaccgccgcggacccctcctccctctccggcgactcctccccgacctcctccggcgacgccgaatcctcctcctccccgtcctcctccgccgccgccgctgggggctccgacgaccccgcccccgtcgaccaagtcgtcgcctcgggctccggtgcaggcggcgatggcgacgccgccgcagccgtcccaacctcgccgcgcattggcatgtacttcgagacggaggaggacgcgtacgagtt

SEQ ID NO: 60298 - DNA, 43266 bp, Oryza sativa
ctagcgcctcccgccatctggcttcacgtggacggctcggatttcccctatggcggttgtagggtgcccgaaagtttggcgctctctccgacttttttctcgacgagtgtagcttcctaggaggaattctggaggagtaccggagctgtcggtacactctgctccgggtccggagaacttcttctgtaaagtaagcattcgtgtttctttcttatgttatttaattactttgtctatgtaagatatatttccatctttgtgggttcattgtttagtattcgtaccaagtgctctagtactaggattctggatagagaaggaagttcctgcgcaagtattagagtagtaattaataacttagaagtggtgtgtaggttggagattatctttgttctttgtgtatcccacggatttgtcagaggtaggtggcaagtggtgacaaccctgaatcccgtcctagtaatcctccacgttcaaatacatcatagagctatagccggaaccacgctggcagaccagcaggggtcggtgcccgaagcaatagataggaaattacctttaacttagcttagataattaaaacacatagaaagtcctctctagcctgcctagcatatctatagttgttgtccttggattgtcttagccttaggtagattacagaaaaacacacacgctagcctgggagatctgcttaactcctgtgcaggtcctaaatcttcctcttaggttcaaagtgtgccagttgatttgatcttgcaatcaacgagaaagaagcacaaagaaatcatggttaaatccaaagacgatagccgatcggctagtgccgatgacgtatcgttcaaactctgagccaatggtattggtaatagattggcaatgagtaataaaaataatataacgttaaatctactcgatcgtttgtagatattaacgatatataatcatcttcttaaaatatatttgaaccatgtgattgggacagatcgaacagcaagtcgagacagtataaatcacttatactcaaaagtactttaagatgaagattatatatacatttatagcatagccgatcaaatagatctaatatgtatcggctaatactccgataccactctatactaagatattgaaacaaacaagatatattagataataaacctaattctctttaatgcaataagatcttaacataaagggcagatttatcatgtcaatcaagcatacaaaggacaaaatagctaaatcaggtaagatcggctgaaacaccgatactatctctattgatgatcataaaagagctagatattagtagttataaatattacttaatagatcgaactcaaccaatgcagcattaagcataagaataaatacaagatctaagcaagatgatgaaaatctctaaaagatggtagatatgctatataatctagattaataacgaaatctaactctatcgaatgctcttcggtaacagatatcaatcgatcagaggttaaatcgtgaaactaatgaagattatgaagcatatatgataactcgacgatttatataaacaatattagagtatcataaagatggaagcactaatcccgagaacgcaagccgccatgacaagtttacctctttttgaagatcgaaatcgatgcagctcaacccaaaagcaagaactcgtcgaaaacaatgaaagtagaaaagggtgacaatgcgccgaaagtgttactgaattgttgttgttaattacatggttttggatcatatttatacccgagatacatgataagtccttgccggacatgactcttatctctaacaaactctaagatacaaacgaatctttacggcagactcttgccgaaacatatctctaaagaaactattcaaaatatcctaattagtagatacaattgtctatctgcgagcttatctctatcgtggcaatcctgatgtagcacgtcggtcgattccggaaacagtgtcatcactatctcaacgaaatcggctatattggctgtatcggctatctcctgtccgatccatctcagctgatgccatcttcagccgatgcccttgcagccgatacgcactctgtttcctaaatacgatccttcactgaatccactttgtttccgatgttgaacctggttcatggtttaccaaatttggtcgttaacacacccattccctgagttcgatatccgtttggggtcacccgaaggtgaagtgctgcagcggtattccgtgcgcttgtggatttatctatggtcgtaagaaataccaacactgggctgggtcggcttggctagattgggccgggaagggaaggaaaaaggagttgggcaccaaggaggtaaagtagactttttgtaaaaagtagggcacccttttacagactgtttgaaaattggttaaggaccttaaaaagactttgggttataccttttaccaaaacaaattttctttttctaaaaaataaaaaataatcataagtagataatttttatttatcaaacccttagggtttaattttaccttatttttggcaccggcaaataacagaacaaaatttggaagagccagcatgatgcaaatttttgtaagaattttttgagcaataaatttggattatgaaatttttatttactagaaaaatatctgtgtgttgcaacggatgaaggctattttaattttattattgttatatggtttagttaaggtgaaattcactgtgcgaattcacttggatatatattttttagaaaatcatgagctgcagttaggagactagtcgtctcaagttagcatgcgagttttttaaaaaagaaatttcttatacgactcctgtacttttaaaattgaacgaacctaaaaacatatttaattttttataatatttttatttatgaaattttcaaggtgttactttaggattgacatcgtatcctatgttactgtaaatttaatgtccactaacttctaaagcttaacatacaagtatgccacatcattacatactagcaattattatatagaacattttaaatatcatgcaaatatgacatattattcataatttttattgcatttttaaaacttaatatgcaagtaatgccaaatcattatctccacatcatttttacattatttaggcatatatgtttatcatttctataaggaaaaagtacaaattaccccccaaactattgcggtcaaccaaattacccctctaaacccaaaaactatacatcgttcaccctgaactttcaataccggacaaattacccccctcgacccaatccagaacggttttatcctatatggctacacgtggaagtcaagtcagcattccatttataaaaaaaaatgtgggagccacctatcatgctttctcttctctctcactcttcctctctcttctctcggcgcggggtttggcaggccggcctctaggtcgatggagaaggggcgccattgtccagcgggatcgagccccgttccccccgagaaggcggagtccagacggcggcggtctcatacggaggagaggtccctgtagccggcggcgggcgcccatcgtcggtgcgggatttgggtgggcgagaggcagcagctgcggaggagctggccagcggtggagttaggggcaccgtcggagcggcacggtggagggggcccgacaacgccagccgtgcaccttgtcgcagtgaagaggtggctgtttcccttggcggtggcaaaggattcccccgagtggcagaggagcggcgtggcagagagggcctgacgacggagatccatgcgtcgacggtcgccatcggaggtgcgggcggcggatggccacagggccggatgtcggaggactgtggggctgggcgccaggcggtcggtggcctccatccggaagaacaaggccgcgaccgaccctcgcttgccgttgtcccactgccatctgccgttgtcctcgacgccccgagcgacctccgccgccatgccaccgccccaagctgtgtccgcccctgccgccgtcccgccgcccttgtcctccaacgccctcctcggtgccgcccactgccgccgcgtcctccttgcactccgccaccgcccgcacaccgccgagagggaggggggaagcgcgccgagcggccgcctcctcatcccctgccgccgctgctctgtgtccccccctccccccgccggccgctgacctgtgagagagagagaggaagagtgagacagagagtgagagagagagaagagagagaggaagagtgagagattgaggaagagtggaaggagtataataggtgggtcccatattttttttataaatagaatgctgactggactaccacgcatacgccatgtagaccaaaaccaccgcggattgagtcgagggggggtaattcgtccggtttatatagttcggggtgaagaatgttcggttctgttgttcggggggtaatttgatcgaccgcgatagttcgggggtgggggtaattcgtactttttcctttctatgatgtactccctccgtattttaatgtatgacgccgttgacttttcgaccaacgtttgaccattcgttttatttaatatttgtgtgcaaatatgaaaatatttatgtcatacttaaagaacatttgatgacgaatcaagtcataataaaataaatgataattacataaatatttttgaataagacgaatggtcaaacgttagacaaaaaatcaacagcgtcatacattaaaatatggagatagtatataatatgcattcagtcacatgtcccgtagcaaagcaaggcgcggagtatcgactggttctaaatatattcattacctcgtctagggagcttccaaaagcttgagcatccctttcctttatctcccgcttcagtaagcaccgatatgccttagtaattaatgtccccacctcaagaatcaaattcttttcgtgttcattttttgatatggccccacccatcctgccttatggggcgcactatttctctcaactccttttaaaagatcattaagaaattagaggggctcttcttcttctatcactaacaagacaaggtttctaccaccagctataggcacatttccataaccaatcgaagttgtatgcatctgtgtaactagctctgccatttggttggaactgcccaaagaaatctacggtatgcgttactatatataaaccgatttatagtcttgtttgtggcttgctgcttaatttcctgtaaccgtacatattttattatatgaatcaatatggtctgtcaaatttgtgtatactatatcattagctagctaggtggcattgtctgagatcttacttaagcaattaactagctagtgtacgaggtctcaaattaaacaattgcatgcatagccaatgaatgcaaaatgctgaacttcaatcaagccatgatctgcagttgctgtctctttctgttttttctaactattttaagctaatgatgctgatgccaactaaaaataacattgctacataaatcgtaatcaacggacgcatattttgattgggactggaaatacaggggatcatgtagttggtaagcatattgatattgatagaccggtagcgctacatgacttgtagcgtgctaggaaaccgctagcacgcctcacaggaggctctttggtattttctcttttttctcctcctgcttcctgagttatctgttgctcctcacatccctcatgcatgcacctgtcagagcattaaaaaagttacttttctctgaatccgtatgcatccatcgcctagtaagaaaaaaaaatacttgtttgcttcagtaaaaaaattactttcttgcttcatttaaaaaagatattttcccattaaagcaaatagtttttattggttacaacatttgtgatgtttttagtggttcctttgtaattatcattttgtaaatacttttcttttaatgaaattaaatggcagaatagctactttagtccctaaagtttctccgtaggatcagtttagtccctaaccttttaaatggttcaaagaaatccttaaactttatcataaggcctagaatagtcattgggtccaccaaaatcatcatatagatatgccatgtcatcattcatgcaaaatctatgatgaattgtccaatttactcttacttatatcatagaaaaataaatataagggtgaattagacataaccataggaaaaaaatactcatccttttttttcaccgttttgaggtatacttttgctcttacattttaccttttgtctttttattttgctatgatatatataagggtaaattggacaaattatatagattttgcataggaatatgacatggcatgtccatgtggcgattttggtgggaccaaggactatatcagcccacgtgacaaaattaaaggacttgtttgaacaatatgaaagattaaggactaaaatgatccagaagcgaaactttagggaccatattggctattctcccaaattaaatcacactacaagataaagccctggcagtgattaaattaaaaaaaatattttcttgcttcctgcattgcatgcatcaatcgcccaaaagttaaaaaaaaaagggtcaatgccagattaggtcccgttaacatttccatgtcttgtcgctcttaattagtttcatccatagcaaatttatttactgaggtttattgtaagtagtaatataattacttggatgtttctcaacaccatacatacgagtataataatttatttactgtagagagtacacaaaaacaagaaaaatagatatgtgtctcctgcacgcgagcatagatagcagcagtcgaaacgcatccgatgtaaggatggcgacaggtaccgctgcgcatggtctgcttgcttctctcgccagcaccgtgcgtcgtccaccgtcgctcacgatagaccgcctcctatccgataaagagtcccaccggcggtggcgaggatcctgcatcaatgtggatctgccgtccatggccgacttctccgactcggataccacctcccaggcgacggggacggtccccagctctgccctcaccacccctctccctcagcccttcctgttcatggtggttatcgacggccaccgcaattgagcgcgaggggagcgacaccaatgtcttttttatttttttttttaaaaaagaagggcagaagctttgtcgcttatgtactgatagagaaggatgcggcttataaggagtacaagtgtacaacaaaactacataatatttaccgagtccaggcacaagaaaccaagcgggcccgcaaaagaaaccgatgggacctactctgctggggtaatctctgtgagttttatcgcacccgcaacgatccaggttcacgcctctttgttctcgacgatgatggtggccggcatagaagccacttgcctgaaaattctaccatttctttcgcaccaaagctcccacgctattaggatgatcaacgatttaagtgcctttcttgaactgttcactgtgcgcgagattttgtaccaccaatcttctaccgttgcgcagtctttcccactcttgtagtcaaaggtccacccttgtccatctttgtatttccgcccagatcattttggacagtgtagggctgatacaggcacggtgcgacagagggtgcaaaaatgttgattagcttccaccctctcttctgtataatctgtcagccgtcatactctaatttcgattttcagccaagagaagaacttgcatttggacggagccaagcaattccaaatagtctggttgtaaattgttctgaccgctccaatgaattggagtctaagcgagcgaagatgtagtgcaacgttaaagtcgggaggcagtgatggcagtcgcggtgagggggttgggcgcggatttgcggcgccaaagaagaacagaggcagagggtatgacgacgaacatgggtgtgaaattgcggcaccggggcaggaccattacgttgtccatggagttctgcaccgaagggggggggggagggggtaggaggaatgccaatttgctgaattgcgacgatagaagtcttcgtcgcagcgtctcaaacacgatagcaagcagcgtggcatcgtcttgatgtcaacaaaagcaagtgatcgtaagcaagcaggccgctgtggtgccagtgcacagttcacgtgggcaggactacacattagccttggcgaacacctccaggagcccgtcggcgtccgatgggcctacatatgcagtggaggcatcggccttggatgacctcaggcggcaaaggagtgttgaacattgccttgtactccgcaagggcttgatcagtgagtttccctttcagttggaatgaagccaagctgctggcacaaattaagttgcgccttgatcgccaccggcactttcatttagccagtggcttcttggctagtcgcctgctcctacgcaccccgttgccttctatggcatcgtccccaatggcatgttttggatagggcacccgtggcataggcaggattgctagggccactggcttgaacaaggcgcatagggtctctccattgtcgtcatcatcctcagcattcctcagggccggttgctctggtgccatctgttctggtcccggcgtccatcggttgcattggagttcacgccggcgatggcgaggtgagctgctgtagcagcaactgctgggtgtcgtccccagcggtcggtggcgcttctcctgctccaggcaatgtgaaagctatcagctccggtccctccgggtcgtccacaaggaggccccgctcctgcctttcctaaagggcatcatcaacctcccacaacgatggaggcccttctagatcggtcttgatgcgcttaaagaccttgcgaaccgggatggttgctccggaccaggcttcactgcctagcatgtgtagtgagagctttcccatgatcgtagcaaggcggtcaacgaccatggaggggctgagggttcacaccgtgatagctgtagaatgttgcaaggctgagagcttaaggtggaaaaaacttgttaaattcgcgtgcatgtagatcttcatcggttggcaggctcttgtgcacgggagggaggaccagcagctcattggccaccgtcaccgctgtcatcatgacgtatgccgtggcggctgctttctccagcattcaacaccgcagcgagtacgtgtgctggagcgcaccgttgagcccctcgcatctatttgattcactgccacgccccacgtccttgcctctatcgtctttgtcgtcgtcgcggtatgaccggcgtcagggatggtcccatagcttgtcggggtggtcatcgttgtagcagcttcggcagctactgctctccttgcggcccttatccttgtttccacttcgcagcccattgtgctccttggggagacgcggcggctatgggtgatgggggaactcctcaaacacgcaggccagcgactgctcgccatcgatcaccccaaggtgccaggccaggaggcttctcttcattggctcgcacttgaccgggttgaggaggtcgacggtcaccgtggtgttgtcatggatttcgtcgtagtggaggagcaccggatacttgtcgccgtgttgccattgttctagcgatgtctctatcaccaagacggacttcgtcgagccatcccacacttttttggtgaagatgagccaaacgtgtttagggatcatgctcgggttcgccatccatgtccagagcttgatgaagcgcgtgtcgaccggctgcacgaggttcatatcaactgattccaaggcgcatcggcgggcaatgacttgtttgatgatgtctaggatccaagcatggcggggaactctatcgagcactaggcacacacaaaacatgagggctgtgtcgagcgcatccttgaggctcctccacttgatgaagtgtatctcgataccccaacgattgtcgtaccccttccagagtgcgtcggcggagtgtcgactatggaggaactttatgaggaaagcctttgggtggtgtttcgtcaccgccaccacatcaccgcgtaggtcgaactcatcctttagcacttactccacctacttggccgtcgtggtcgacagggccttctttgcccaggagaccatagcaatttcctcctactcacgacgctcctgctcaagggcgaaggaggaagggttgatgcattcatcatgcatgggccttgtagtggcatttcctagaagcgccatattcccggtcagggcacacggcgacggaggtggcaggcgctctgggtgggctggctaggccagctaagagcttttccagtgtggcggccaaagctgatgagggacggggtggaggtgtgggcggcggggcatggaggatttgtgtggcaaggagcaacggcgagggcacgcagtagtgcggcaatcgcaatcgcgaacccagtggactgagtgcctgcaggagaagcatcggaccgggtctctgcaggtggacgcacgatggtttttatctaggcagatgaagcacctaccctaggtcttctcttgaaaaggcacgaagcgaggacgtggggtgggcgttgagcttgaatggggatgtgaaggccgtgccgtcctccactgaccatgggcctttacctgagtccatctgtcgtttgtagcattaagaccaccgcgattggtctacgtgcggaggtgacgccttgtgctaggctgcgcgttcgtagcctcataggagggtgggtggatggcacccgtattctccctgaggatggcaaagtaattgctccggacgggcacagtaatgactgatttcaaacttggccatgctagagttttggtagggagcgggattggagacttagcacattgcgggttgacggccgctggatccagagtctctggcacctccacgacctatatgtgtgtactggaaaaaccattttaatcgtattattattagattttttttaaaaaaaagtatatgggatttttatttgaagatagtactgatatctaatttggaatccttctagcttagcatttatattttctaagatcttatcattggcagctagcttcttgcttaaagcatcattagttttagcttgtgcaaagatgagatccttcgagaaaggctggttattgaagttaccactgttgttgttgttgcctccttggtaaaacggcgggcctggttccacccctgacctccttgtggatgatatccattgttcatgaacaccgcctcttcacgggtctcaagacagtctgtctcggaatgacccgagttgccgtagacctcgcacgtgatgtgtgcatccaaggccttaacggtgccttggggcatgttcttctcttggtcttcaaggcgattcatgaggaggtcaagcttagcagccagcatttctatctccttgacagtatgcatgccacactggcgggtctggagtcgttcttcgctctagcccatgtttgaaaccatcttctctatcagatcgacgacacctctgaccgttttggagaagaacgcccctccagctgcagcgtccaggtgatcccgggacaagggagtgagtccgttataaaaattctgcaggatcagccagtcgtccatcccatgatgaggataggcggccacgtactcctgtagcatttcccatgcttcaggaatcgactcgtcccttctttgctagaagcttaagattcttatgtgaagggcattagttttgcccttcgggaagaatttggagagaaatgccgtagagcatttgttccaggtatccaccgttgcatggttgtcgtagaaccactgcttcgccttccctagaagggaaatgccatagagcatttgttccaggtatccaacgatgcacggttagcgtagaaccactgcttcgccttccctagaagggaaaacggaaacagtctgatcctgacggcgtctgggctgacgcctttcattgcgtacgtgctgcagatctccaggaactgttgaagataagcacttggcattctcgttaggcttgccacagaatgggcttgcctgtgccatcgtaatgaggctggtgtttagatcgaaatcgccatcccccaagttgatttgcggcccaaccggcacgttgtcagtagagggtgcagtgaaatagcggagggtcttctcagccatattcttgaagctcggtgacactgggatggttgctttctttgtcgaaagagctttctgcagagggacaactcgcggcttcacactcctgaagaaagcatctgaattgtcttggaagtttttcgtcaaatcaaaaccagccatacacagcaaaagtgaaaaaaaaacaaggttagcctgcaaaggacagtgactatacagaggtaaatataaagttagtagcatatagtaatctctttattaatcttcccagcaagggcgccaaaaatgtttgttagtgtttcttaacgacattatagaaatataaatcccagcaatggcgcataaatattcctggtatattacggttagtgcgcagaaagatccgcaagcgcacggatataccattgtagcatttcaccccgaagtattccaaggtatcgtatttatttaatctcaatggaagattgataagagaagactatactaataattaataatttatatgttacctatataagtcacagtctaagcttgtgttaattaattcaagggtagagtgacacgaagaagaagaagtaagttactctcattaaataaatcctaggctaagtggagaaagaataagaaaagaattcatcctaatacttccagtatacaggtatctttaatttacactatctagtatacaatcatgtagccaataccccctaactaagccctcctggtatttcaagtgaccacccctgattgtcgagtcccttacgacaacccgtcatggccgtccaaccgaaaataaatatggaggagtacccataccatgaaattaacttaggattatatactaacatggaggaatactcgtactgagctgtcaccatcagcggccaacctttgttgtcccgcagcatataacccaaaataatgatatttaataatctaagcaccatgcttaaattatcaaatactactctatatccgctaccatgacatagagcaatcatttgcatggtcattatacccacaccattgcatatctctggtaagctagctacacaattatatcgagataaatgtaaagtgaagtcggtacccaaataataagagtgaagtaaaataccaaaactgaataaagaagcatattccattaattgtgtaagtcttacaaaagagagagaagatactagagccatacccgaattctcctgaagactcgaggactaagaaaactattctatttcctactccactagcactagaatactaactaaacttgagagagagctttgatcttcttgttgagtctgtggagaagtgagtgaggtgagctccttttatagactgagtatgatggttattgcagatggaaaggtcggaaatgccctacagccgttgttggaagtgaatcctgaatgtccatgccaaacactagccttaacggctgtgatgggggtttggccgaaccgtgacctggcccaatctgcccaatttttggcaggcctcctccccgttgattcctcagtccagtgacgtggtgttttgggccttttgagattatttctctggatttgtaggcccatctatccacaaatctacctctcgacggctttcgattggttgttcgtttgttttccgtcgattctccttctctttatatagcaatctctgaaatcaaatagaatccaagtacaagtaaattattctaaaacaaatatacattgtaagcatatctagttctcctttattttgagtatattgacggttgaaattggtctataacgaccatcaacaggcgtcaagcggctgttgatttgtttagcgcttaaacattcttcgtaggcgacaacataacttagttggtcacccgcctttgaaaatagcctttgatcgtagacggagcagctggccgcatgcaaagaagatctactttggccacatgcgaaaatagttttcgtagcagtgattactgcatataaagtaagagtggttaaagcattttcctatgaaggatatttagttgataatatcacaataaaagatatacattgccaatatggcccatcacgatttgcacaagtacgttgggattttgtattattaatattgattttattgaagagatagattaggtttccaacatatgacgctaaatttgcaaagagaagcattgaatcaaatattttgattttacgccattattttttaataaacaactaggtgattcctcgcactttgctgtgggaattactaagtaattttaaatatatatgtttttttcaataatcgagcaaggagtaagcttgatgttaattattagtaacaaataaaactgatttgtctggccatgtttggagagaaataaatttaataggctttgtaaaagattatacatgaaatttaggttgttggccaagatttatatcacaagaaacaaaagatagggaaaaaagaaataaaaagcaaggatttattagtagtaaacatgtaacaaactaaataatatctctgctttgatacgggatatatggatgaatgtatgttaactattataaaaatgatggatatatttgttgaaatattgcggaaatgatgagagaggtgatgattggatctatttgcattttgatttgtagaattaaataaattatggatgatattgcatgtttgcatgagcttttttgataagtagttattgctcgtggatgacgaggtggcatatttgcatattgagctttagacttagtgagctttaactttatagaaaatatagatatgaaaacacaaaacaaaccacatatgcgcttttccacactttccatggatttgatgtatgctacatttgttttaatcattttaatactttcttcaatgattttggtacgtgaaatacatagtttattgttgagaaaattatttagttcatactaattaaaaaagttataaatgacctatgtgattgcattacttgtaatatatggctttttaatattttcagtacatgattttgtcactaacatttgaacatatgcaacaaacagtagcccaagggacagataccatcatcgatcattgattacagtatgaagcgaacatgagccaatctggtgcaactatggagtggatgggaaatccaattgatgattcttttgagtctattccttcagctctttctcttcttcactggaggcctccgacgccgtagaaccaacaaattgatactgatattcatttggctggcctatgtgggagcagacctagttgctgtttatgcccttggtctcctctctcgatatgaatacaaatccaaaattggaagtgactccttgacagtcatctgggttccatttctccttgttcatcttggtgggcaagataccatcactgccttctctatcgaagacaacaatctatggctaagacacctattgaatctcgttgttcaggtcagtctagccttgtatgccttctgcaattcatttggtcagatcagtttgcagctagtagttcctgcaattttcatatttgttgctggtataatcaagtatggggagaggacatgggcactcaagtgcgggagcatagatggccttcaaagctcagctggtggttacaaagacaaagaacaggaagagcaaaaggataataaatatggaagctatcttagcaaggtattctatgctcatcaaatggtgctatatgctcgaggattatttgcgggggtcacggtctcacaacttggccaaaaagtaagaaaggaactaacacatggtataagaaggtgtgaaaaatatgtgaaagcaaagataatagagctggagcttagcatgatgtatgacatcctctacaccaaggcaatgatactccagacatggatcggttgcatactacggtgtatttcccacatcgctatggttgttgcatttgtgctattcctagtaaccccaaagcatggccatagaatggctgatgttgcaatcacctacacactatttgctggtgcccttcttatggaagcatgtgccattggtgtggtagtggcatctccactaacatgggcacgttggagaaggcacaattatgttaatttgcttgctattgggaagatcattggagcaaaggaggagaggtcagttgtgccaatttctttggggcaatttagcctagcaacatgtgctttacatgatgggtccacacccaggataatgtccaatgcgttgtatgcatttggcttggagaagatctatagagatgtacgtcatgtgaaacacgttgaggccactgagattgttggttgttttgtggattgtttcaataatagaccatccaataatgatcaggatgaggtaattatgggggtctctaaagaagggaatgtggatgtcaggttgaacttgttgagcatatctcagcgttttgaggtcggcatcattcaactgcatttgttcacagatatttatacaacttcagtactattacttgaaccaggcatctgggaagaaaagacaggcattgtatgggaatgtgtgatgctatcaaactatatgatgtacctcctgttagcacacccctccatgttgcctgttagcagtgattacgctgtgatggaacatttgaactatatggctaaattagtggacatgtacaaatatgctggtggcaagctggatcctcacgcaaggatggacttactgctcaaagctcttgagcaaatgacaagcaacacaaactctgacctcattgttgttgctagggaactcatttatattactagggtcagtggcacattattgaagttggtgaaggagacgtggatactcctcctcatctatgctgccagcaagagccgcggtgagctccacgcgcgtcggttggacaacggatcggagctcctcaccttcatctggctgctcttggttcatcatggcctcggcaatgtggcagagtttgggttaacactaggccgctatgtcacaagtgaagccccgccaagcttatctgaaattatcgacatcccgtgagtattgaacgttatgacttttgaggtgttttcagccgtctgatcatagcaaacggacaagatcgattgctacagtaaagtgtatccctgtcacgccctaaaaatcgactaaattaataatccatattttaaatcatttctagaaattattttaaaaagccttcaagttaaactctaataatctaggagaaattgtaacataaaactgagttagataaaatctcgataatactttgcttgtttatttattttctagatttttctgggaattatttgagcaaggaaagtatttttaaaagtttttaaaatcctctcctaagctgttggcaacatctctccccctcgtgtgcgtgctgtgcagcccaagccggcccaagccgagctgctcttccccttctcagcccagccgaaaatctaatttgcctccctcagcactgttcatcttctacctctagcagccgaactgagaccgaattggctcggtttttctcctccaaatccaaccttttctcttgtgttttcctaaaatttgttgaggggaaatatttcccttatctacctctttcgtttcccccaagaatcggtttatctctccaaactaacccgaagattttccggtttcgattcctctcgtttggagtcgatctctctcacccatgcctatataaagcatcccctagtcgtcctctttcgtttgccccaagtcccgagccccgccgtcgcttgtagcgcagccgccgcgacgccctagccgccgccgttgccatcgtcgttccagccgccccgcgccgtcgctgtggtggtcgtcgccggtcgccgtcgctatctccgggttcgcgaggagaagccgcgcaccgtccgccccttcgctgccgttgcaagcagccggagcgccgccgtcggcgaggtcgccatccgagccggccgccattgatgacgtcatgctgacgtcatcatctcctatttttcagttttttttaatagattaaaacttcggaaaatcataactaattaaccgtagctccgattcaagtggttcaagttgctaaattcatctaaaatctagatctacatgttaaaaatatccacatgtattgttcatgcttgtttttgtactgttttgttgattttgtttatttgctttagtttccgacgtttcgttggagggcgtttcagttgaggaaggtttagaggtttttgtggaagctcaagacaagtcacacagatcccaaacaaacctttgagcatgttgaacccgtttaaaactaatgttttatttcaacttatgcattattttcgaatgccatcgggtggtgagccttttcccatttaattatggccgaagatgactgtattttcctatgggttataatttgattagctagaaccttatatattggtttggttcagctaaatgctatatatgtataattgcttagccatgcttagaaacataagctcattaatgggatgaatcatactacattattacttatggttatacttaatggtagctcacgatggttaatcgtgttatgttaattaattaataattaaaacctgattaaaggtgggttgtgagcgcatggttttgatggtcgtgctcatgacaattaaggaccggttcacgagctactgttgtgaaacatttaccgtgccaaccacaagccagcgtgggcaacggctttaccttttgtatagcatggttcattatggggtgccagactgagaagcggcgagaagtccgtggggggtcgctggggagtccatgcctctggttgtagagggggtgattatgatccaggtatggtgcactgtggtgagttgtgttgtgcgaggggtattgtcacagttcctttccgaggtaccgtggtggtattgaggcgcatggtaacatgttgtggaactgtgtcttgtgggtacagtggtacatctctggccagagtaaaactattcgaatagccgtgcccgcggttatgggcgggtctaacaatgtttttcgtaattagtctcacattattcattgatggtaattgtgataattaatttgactcctggtttggaatggtatattcctggtatggaggtttgatttgtacaaccggggttggttgttcagatgaggttgggcatatgcaacacgggtgtgttgtatggtgtttacttaatactgattaattattcaactgttttactattctcttaaatatttattaaatgctgtttatgcaaatgagctatattatgccatcctttgttatcctatgcacttgcatatttgctgtgtggcttgttgagtatgtcatatgctcattcttgcaatattcattcattagaggaggtgtacttgagtgaaggtgatgatctggaggactaggcttggtccgggttaagttgcctgtggagtggagtcgccatagctgttccgtagtttgttttattttctgctgcgtagaattttattttttgagaggaactatccacctctgtaataatttgctattttgcgaatattaattagttgtttaagagtactctattatcaatttgttattgtgtgcctcggctgattcctggacgaggatttaacacacatgtaagcgtttggaattttggatagaagttccgggcgtgacaatccctgaccttattgattagattggatgttacttgtatatatgtattagcaattcttatcgattcttacttattttgtagttctattctacatacttatgtgttggcggatggcatgaggcccttcgactaaatctgccgaaacccgtggcgaaggctatgaagcaagaacggcacgaggcgaagagtcgtacgagtgccttgccaggtcagaggcgtcttaggcgaagggtgtaagccgaagactacctgccgaaggaagacgacttcgccatggcaagttcgcccccgcgagggccgaggaagcctttccggcccatcaagcctaagggctatagggccggcgatcgccagacggcccatcaggggcccatgagcccctataacattatgtacccctataaatgtcccttttgtaagggtaatcatgtaaatttccctgtacaacctaaaccctagtagtaagaacctgtaatggagctataaatagtcccctagggccatgtaatggggggatcccaagtgaaattcaaaatttaatacatttcatttttccaaccactgttgagtaatcacgtctttcgacgtatgcagttgtcctttcgacaacagctggcgccgaccgtggggaactccgagcgaaaccactgagagcgaatgccaccgaagagggtcatgaaggagaaggttgccaggcggaaggagaacgacgctggaccggacatggctgccgaggaaggagcagagcctgcggcgcccgtggccgaagatggaggagcacaagcgccatcacaaccgccttcggcccctgcaacctctgtgcaagtgccgaacgcggccgacgtggcgaaggcggctgcggcggcaagggcactccagaccaaggcggagatcctttcgacaagccaaccggtggtgccccaagccaccccatcgcagccggcagcggccccaactgcgctcgccgttgtacaggcccaagtcagccttgaccccgaagcacaagccgaaggcgacatggaagccatgcggcagaacatgagacggctccaagacatgcttcgccaaatgcaagaacaacaacaagcatacgaggcggcaaggcggaccaaggccacgtcggctccaatccttcagtattcggcaggctatgtcccacctcaagtccgtccgcaagtgacgacccagccctctccgccacaagccgcacaggcgccggtgtacttcgccgggcagcatcaaccacctggccaagcgccacaatcagtggcggaaggggcttcggctctgtaggcgcaactcctagctttccttcagcaactcaaccaaccccactgcatttcaagtacaaccccatcggcccgcccggaggggaatacaagtcaaggtacgcttaattggttgccaccgattcagctgggcctgggagtttcgccgtggaatcaaggaccgcagttcgacttcgtcaacgctgctcaggcgccaaccgttcggcagcaagctccgactccaggcttcggaacaaaccaagcaccaattcaagctgccatgatgtggtcacagccaatttttgacccgtccatggcggctcagcaagtaccactagttggagccgggcagccgaacgccatggcccaacctcacgcacaagctgcgatttcgccacaccgtacccgcagcaaggtgcggtaaacagggtgggaggcgaaaaggggctaccgctgagtgggggaatcaagactcgtccaatcccaccctagttcaagttcccacccgtcccgcgctattcgggcgaaactgactcgaaggagttcctctccatctacgagtcagcgatcgaagcggctcatggtgacgaaaataccaaggcgaaggtaatacatctcgctctagacggcatcgcccgttcttggtatttcaatttaccagccaatagcatttactcatgggagcaattgcgcgatgtttttgtccttaactttcgaggcacctacgaggagccgaagacgcagcaacacttactcggcattcgccaaaggccgggggagtcgataagggagtacatgcgtcgcttctcgcaagcccggtgccaagttcaagacataaccgaggcgtcggttataaatgccgcatcggccggtttgctcgagggcgaactcacgagaaaaatcgccaacaaggaaccacagacgcttgagcacctacttcggatcattgacgggttcgcaaggggcgaggaggattccaagcgactgtcacgtcctgataaattcatcccgaaattaaaaatcattcgctaaaaggaataatagaattaattaaaattcggaaaaaaattggcaaacactaaaatacgtacaagaaaaattcaaatgtggcctggagaatttttgttaaattctctttggtctaaaaggagccctcaaattttacttgaattttcagagcaccaaaaatatttattaaacaacaacaacaattatcaaagtttactaaaaagaaaaactaaaaataaatccccctcctccctttgggccaagtttggcccaaagacccctctctctttctctctctcggcccgcggccaaagtcctctcttcctccctctattcctctccctctcctcctctccctccttctcttgggcctcctctccttcccctcggcccactccctcctcctccctctctcccccaggccgcctccccctcctctcctcctgggccggccgcccggcccaagacgagcggcaccctcccgcccgtgccgcgcacgtgcgcgcgctgatgacgcgtgcctgaccggtgggtcccacctgctcggtcgtctccttcctcccgcccggcatcctctctctctcttctctcccgtgaaacctagcgtcgattcctcccctaaatccacgcgattcaaaccgggaattccaaaattgattagggggaattaatcccctctccctcctctctctttcccccttaatttccccttgaatggctcccccaatcgctgggaacggacgcgccaactccggccaccttccatggccgccggccatgtttcccgtcgccgttccgccctctcccgtgcccggctccctcccccatcctataaaacggaaacccctcgctccgttctatcgttttagccccctcccgcgatctcccgtggtccctagccacctccccgccgtcgtcccctctctcccgtgccgccggccatcttcagccgcccctgccgccgcgttagcacgccggccggccgtgccgtcgcctcctccagcatcgcagccgcctcctcttcgccggcctgccctctgttttccgcggagacctccggaagtgcctccccgccggcgacagtggcgttgccgccactgttccgcctccggccgcctctgccgcgtcccctgtgcgccggccgacgtcgccatcacctctcccggcaccggagcgccgtcctctttcccggccaggccacgacgtcgcccgaatttcgccggaacgccgtcgctcgcgctggcctctccttcctcctcgtcggcatctcctctggcagaccctttcgccatgcccgtgcgtcagccggcgctgccgtcccctccctcggcacggtgacgtagccctccacctcgtccacccctcggtttcgcccggaagccgttcttgtccgtcgccgcgaacctctccatccgcctcaccggagttgttcggccgcccgtccctcctcgcccgtgcaccggtcggccgcacctccaccaccttcggcatcgcagccgcgacgtcgtcctcggcatcgcttccccttcggccgaacaccgccggtgtccgtcgtcgtcttcaccgttcatccttgccggctcgtcgtctcgcggcgccgcctccgtcgtcggcatcgcagcggcgtgttccacgccatcctcgcctccgtgcagccgctgccggctgccctcgtcgcctcctcgccggccccggtcgtcgtcgtcgtcgtcctctcgtcgctcccggtcgtcgtggcgttcgtccctccgtcgagccgttctcgtccgtcctcggtgtttcgtcaaggtcgctgtagccgtcgtcgtcttcgtcctcggctccgcgtcgtcaagcctcgtgccggccgcgtctcgccttcgtccaaggatcgccgccgaagtcgtcccctcgccgttcgtcttcgtagttcccggccgtctccgccgcgcccgttcgtcgttgtcgttcccacgcctcgtcgcgtggtggtaaggatctctcctctcgctgccccgtcctcgtcctttcggtgtcgccccgtacccgttgtgcggttgtcgaccccggtatccgtgtaccggtgtcggtagtcgttcacgtgtgcgggtggtgaccgtgtagtgtccgtgttagtgtgcccgctcggtagccgcgtggtttccacgtgtgcagcccgtgtggtgtctagtagagtccgtttgtcggccactcgcctcggttgacacacgggatctgcttccgtcgacccgtggaccgtctctgtgtactcggtctaccgcggtcctttaggttgacatgtggggtccgcatgtcaacggcgcagccttcctgtcttttccaggctagcgtttacacatgttttatagttgcaaagcttaattataataatccgcaaatctccatataacagcattaaacttcggatgatcatatcttggtcatacgagctccgaatcgacccgttcaagtctcttaatgtttgttataacctaaagaactgtgtgctttctttttatgtgttgttattgcttctttataggcttgtagctttgcttgtgtgcttcgcgtagcttctgtcgttccggaggttccagaagcgtggttcgcggtcgtcgccgaaggttcggaaggccgttctctcggagcaaggcaagtcacatcatccttgagcatattgaatcccagtttataaaattattttgatttaaattaatgcattatcgctttatttaaattcccgcgttatcactgttttatctagccatgcctatttacctttgttatgaccttatcattgttgttattgttactattaccttgttcaccctaggataaacaaaaccccaactagtgggtactctattcatggtcccactagtatgaatttaggtagatgcttcgctgattaattaggcaacattaggtggtttttataactttagactttgggaattctcatatcatttggacactatggaatggttggcttatggtggaattggacatacccctctcttcctctttcaaagcccctaaaacctgtttttcggtggggtttgggtgcatgccagttgtggaaagtagcaccccggccactataaggatgaagctcgggcctctgttgcaaagcactaccgtacttccacatgtctagtgggtaaggcttagtttgtggctcagtctggttataaacaaaagtacacggatggagatggacgaagtcgggggtcgatggacatatctaggacaaatgaaggctacacgagctgcggcccggtagtcgagatgtcatggcacagggccggtgtcctgctgctgggggctcagtcctgcctacctgtcccgggggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggtgcacggccttgattaataatactgtgtagctctaggatcgtctttttaaaattggctttgggcaactaagtgacttttaagtgcaaaacctaacccttatattattaccccttgtacccccttgcattagtcatgcatctgccggtgtggcttgctgagtactgtggttgtactcatttttgctcaatctttccccccccccccttcagtaagagaagctttggagatgaagtcctaggtggagtcctggcttataccccagttgagcgcctgtgaagatggagccgtaggcccgctagtccgctgctgtttattttttgattgtcaggccttaagtgcctttgtaataatgtaaatattatcgatataataaagatgtgtcttttatatcatgtttgtgtggtgtaccccggcttttcctgggacggggattaatacactagcgttcgggaaaatgtatttttctcagtcgtgacagcgacggcatgctatacaagctgagtacgacaaagcctccgtcgccgctgctcaagctcaagcacaagtgcaagttgccgaaccacctcccctctctgtccgccagtctcagccggcgatccaaggacagccaccaaggcaaagccaaacccccataacttggagaaagttcagaatagaccgtgcaggcaaggcggtgatggctgtcgaagaagtgcaagccctccgcaaggaggtcgacacccagcaagcgagcaactatcagcagccagcccgcaagaaggtccgaaaggacctctactgcgcctttcacggacgctcttcgcacagcacggagcaatgccgaaacattaggcaacgtggcaacgcgcaagacgcaaggccgcagcaaggaacaactgtcgaagcaccccgcgaagcaattcaggaacaaacacccctagccgatcaacgccattatgcacagcgaagggtaatccaagtgattacaagagctgacccgccaagccagttgtcgaaacggcagaagaagatgcagacccgtatggtccacagcatcacttcggagggtgaaggagcgccgcaatatctgaaccagctaatttcttttgggccagaagacgcagaaggagttatgttcccacatcaagatcccctggtaatctgagctgaaatagctggtttcgaagtccgacgaatcctggtagacggagggagttcggccgatgttatcttcgccgaagcatatgccaagatggggttgcctacccaagcccttaccccagcaccagcatcgctccgcggtttcggcggggaaccagttcaagttctcggccaagcactcttgctgatagcctttggctcgggggagaacagacgtgaagagcaaatactgttcgacgtcattgacatcccgtacaactacaacgccatcttcggccgcgcaaccctgaacaagttcgaagccatttcccaccataattatctcaagctcaagatgcccggcccgacaggggtgattatagtcaaggaggttcagttttcggctgcttcaaaaggcgatctagccataattaacagagcagtgcacagtgttgagaccgaactgcatgaacggccgaagcacacgccaaagcctacccctcacggcaagataacaaaaatgcagattgatgatgccgaccccacaaagctcgtatcactgggggcgacatggaagaagaagttgagaatatcctagaggtgctcaaaaagaacatcgatatcttcgcctggagccctgacgaggtggggggcgtcccggcggatctcatcatgcatcacctagcagtcaagccggacattaagccaagaaaacaaaagttgcgcaagatgtctgccgatcgccaagaagcggcgaaggccgaagtacaaaaattactccgggcaggggttatccaagagattgaccatccagagtggttggcgaatccagtgctggtgcagaagtcaaatggcaaatggcgcatgtgtgtcgatttcacagacctgaacaaagcgtgtccgaaagacgatttccccttgccgcgaatcgaccagctcgtggattcaacagctggatgcgagctcatgagtttcctggatgcatattccggttaccaccagatccacatgaacccgctcgacatccccaaaacatccttcatcactccattcggcacattttgtcacctcaggatgcctttcggcttaaggaatgcaggagcaactttcgccagactggtgtacaaggtccttagcaagcagttggggcggaatgtggaagcttacgtcgatgacatcgtcgtaaaaagccgcaaggctttcgaccatgcgatcaacctgcaggagacgttcgacagcttgcacgcggcaggcataaagctgaatccggagaagtgcgttttcggcatccggcgcaggcaagttgttgggtttccttgtttccgtaagaggcatcgaggcaaatccagagaaaatcgatgccatccagcaaatgaagcctccgtcaagtgtacatgaagtacaaaagctcgcaggccgaattgcggcactcagtcgattcctctcaaaggcggccgaaagaggtttgcccttcttcaagaccctccggggcgcgggaaagtttaattggacaccagagtgccaagcagcattctacgagctaaagcaatacttgcaaagcccgccagctctgataagcccacccccaggaagcgaactgctattatacttagcagcttcgccggtggcagtcattgctgcactcgtccaagaaacagagtccggacagaaaccggtctacttcgtctccgaagcactgcaaggagcgaagacaaggtacattgaaatggaaaagctcgcttacgctctagtgatggcttcgcgcaagcttaagcactacttccaggcccacaaagtcatagtgccatcacagtaccccttgggcgaaatactccgaggcaaggaagtcactggccggctcagcaagtgggcggcagagctatccccgttcgacttgcattttgttgcacgctctgctatcaagtctcaagtgctagctgactcgtagctgaatggacactagtacttgcccccgaccccgagcccgccgaacaattctgggtgatgtgctctgacggttcgtggtcgcacaggggggcaggcgttgcggcagtcctcttctcgccgaatggtgtgccgattcggtacgcagcaagactgcagttcgacacaaccaacaatgcagcagaatacgaagctgttctcctgggcctaagaaaggcgaaagcactgggagtccagcgcctgctaattcgaactgactccaagttggtagcaggccatgttgacaaatcctttgaggcaaaagaagagggaatgaagaggtatctggaggctgttcggtccatggaaaaatgcttcaccggcataacggtcgaacacttacctagagactagaacggggaagcagacgccttggcgaaatccgctgcttgtggtggcccacattcgccgggcatctttttcgaagttctgcatgctccgagtgtgcccatggactgctccgaagtcatggcaatcgaccaggagaaactgggcgaagacccatatgactggcgaaccccatttgtgaaacaccttgaaactggctggcttccggtagacgaagcagaagcgaagcgtttgcaactcagagccacgaaatataagatggtctcgggtcagctttaccgctccggggtgcttcaacccttatttcattgcatctcttttgccgaaggcaaagaaatggcaaaggacatacactaggggctatgtggcgcgcactaggctgcaagaacagtggcctccaaagtatttaggcaaggagtttattggcccactgtgttgaaagtctgtgttgagcaaataatgaagtgcgaaagttgccagcgtcatggccgaagccaatctgcgccccagtatgatcggcagcccattgcgccaatatggcccttcgccagatgggggctggacatcatggggccgttcccggtggcgcgaaacgggtataaattcgcaattgtagctgtggaatatttctctcgatggattgaagccgaaccccttggggcaatcacttcggcagcagtacagaagtttgtatggaaaaacattgtttgtcgtttcagagtgccaaaagagttcattactgactatggcaagcagtttgactctgataagttcagaaaaatgtgcgaagggcttaacctggaaattaggttcgcgtcggtcgcacttgtcacgcccggaaattcactagtaatttccgaacttatttgtgcataaaatcctcgtccaggaatcagccgaggtacacaaactgacaatttaatatacaaatccatcataataataacgttacacacttacaaaagaaaagaaaacagcagcggaataacggtctagcgatggcttcagctccactcccacaggcagctcaactggggtataagccaaacgtcttctccttctggatcctttttcttcaactgaggttgattgattattgcaagaatgagcatatgacatactcaacaagccacacagcaaatatgcaagtgcacaaggatgccaaaggatggcataatataggctcatttgcaaaagcagcatttagcaaagagttaagagtaataaaacggtagagttattgattagaaattttaatcaacactgaacagcacacccatgctgcacaggcccaaccatccaaaacaaccatacctggctgtacagatctaactccaaaccaggagctaaacaaattattaccagttatagcatcaataattattgtgagaggtgtgagactaatcatgaaaaacattgctcaacccgcccataaccgcgggcacagctattcgaatagttttactctggccagaggtgtaccactgtacccacaagacacagcctcaacatcatgtctaccatgcgtcgcgatattggaaagtacccgaatagaggctgtgacaataccctctgcacaacataactcaccacagtgcaccattcctggatcataatcacccccttataaaacaaggcatggactccccagtgacccccgtgggcttatctccgccacttctcagtctggtgctccgcaatgaatcatgctatacaaaagataaagccgttgcccacgctggcttgtggttggcacggttaatgtttcacaacagtagctcgcgaaccggtccttaattgccatgagcacgactctcaaaaccatgtgctcacaacccaccattatcaagttttagttggcaagtaattaattaaccaatcacgattgaccatcgtgaactatcattaagccatcattaaataatagtgagtcataagttatcccaatagtgtgctaatgtttctaagcatggctaagcaatcatatctaatatcaagctgaaccaatatataaagctcaactagtcaagttataataacccaaggtatcaaggaataaagtaatcaatgcaaacaggccataacaaaggaatagattcacaccacccaatggcattcgaaaataaatgcacagttgaaataaatagagaatttaaatataggaacaacatgttcaaaggattgtgtttaggatctgtgtgacttgccttgcaataatcggtcttcaattaatcttcttgaatacttccggcgcactcgcgaaccttcgcaacgacggaaacgacaagctaacacgcaaaacgaagaaaaagactaataaaaaccaaataaacaatacataaaaagtaaacaaacatgtagatcatgattttagatgaattatgagacttgaacggcctcattctgacttcatatgaatttattatgaattttacaagattaaatctaattaaagcccatttaaaaggaattaaataaatttaattcaatttatggataattttaatatgtagatctttattttatataacttttgcaacttgaaccacattaaactgagttacaatgaattagttatgaatttttaaagattaaatcggattaaaacacttatatggattttaattgaattatgacgcaataatgaattatttttgaaaaggaaaagggaattattgcgtcagcggctagggtttgcggtggaccgggtgcacggcggcggctcacgggaacgaacggccgagatcgatcctatccaaaacggacggccgagatcgatcagtccacgaccgggccacggcagacggtcccgatgacgtcagcgatgacatcaacaccggcggcggctcggcaacgcatgctcgccggcgaacgacggctcgacgacgcaaacggaggacaccaacgggtagagggcgacacggcgaactcaccggtgaccaaaacaacggcggaaaagcaacggacggcgccgacgacgaggaagaagcggcggcggtcttcgggtcgacggtgacggcggtgctccggcgatcgacagcgacggcggaggggcggacgaggacggcgacgcgacggcgaccacgacggtgacctccccgagcgacggcggcgactggagcgatggcgaagcacggctggagcggcggcgacgacaacggcacaaggttacacggggctagggtgctaccgacggcgagagacgaaggcgagggtggcggcgggtagagggaagctcgggggtccttttataggggcaaggaggtggaggcgaaagcccacggcgaccggcggcgagatggaaagctagggttcggaggagagagatcgatccgaatcgaactcgaatccacggatttccaaacgaaattagccgacgattccataagagaaaagatagagtggatcgcggggatcttttcccctctatcgattcggccggagatggaaaggagcgatggaatttggaagggcggcggcggcttgcgcgcggctagggcacggctgcggcggcgcgaggaggacgacgaccccgacaggtgggtcccgcctgtcagcggctgagagagaggaggaaggggcgcggcggactgggccgactggaccggggagggagagagaaagagagaggttttgggccggctttcggcccaaagccaaaagagacttttaaaaacctttttcaatttaaattattcatgaaatacaattccatttattaaaaatacttccttagctcaaataaatcccagaaaaatctaggaattatagaattaagcaaagtatttaacaaaattttatctagcccaattttatattgagatttagcaaattaaaattagatcttatcttttaggcttttaagatcatttctaattattccttttaaacaacagtttataatttaaggatttttaaacaagaaaagctcttaacaattataattagatcattattgatcaaataattactgaactgttctttgtatcatttaggaattgagctctgaaaaatccgagaaaatttcagagagttgacttaatcatggagaatttaataaaaattaaatccacccatgctttatatttaggaaattttatttcccacatttaacttcacttgtaaattaatgaagatttaatataaattctaataataatttattaaataatttataaatcctgaaacgaaaatcaggatgtgacaacacccgcagtcaaatggggcggccgaacgtacaaatggcaagatcctaaaagcactaaagaaaagactcgagggggcagcgaaaggcaaatggccagaggaattgctatcggttctctgggcccttcggacgacccccacaagaccaaccaagtttagtccgtttatgcttctttattgcgatgaggcaatgaccccagcagagctaggggctaactcaccaagggtgatgttctctgggggcgaagaaggacgcgaagtatcgctcgaactcttgaaaggagtaagagtcgaggcgcttgagcacatgcacaagtatgccacaagcacttcggcaacttacaacaaaaaagttcgacccacggagctgatgcctggtcatttcgtcctaaagaacaaggcgaacccagtagcggttggcaaacttgaatcaaagtgggaagggccataccttatcaaacacaagtccaggatgggatctttttgcctagcgacactcgaaggcgtggagttcgaccattcctagaacgctgcctctctcaagcgcttctatgtctagaatgggtggcacccaaatcgccaaattgtaaaaatgtacatactgtcatgtaagcccttcagcactatataagcccttcggcactatgtaagcctttcggcaagaaaaaaaagaagaaagagagaaaaagaaaaaaaaaactagatgtagggctattatccaccatggaggccctaaccagtataaaatctctgtgtcctccgccttcttcttatttttcgtgtgattgataatttgtggaaaaaccccaaggaaaacgcctgatcagcgaaaaaggccaggggggcgaaacgaatcggccgaagcatcgctcgccgaacgttgaaaccgcaacagcttgtctcggaaaataaatagccgaacgacattacgtccgatcagcataaaagcaaaagcgcttctctcgacacagaacgctacagatcaaagatgaacgacgaaaagctgaaaagtcagtacacctatttcgctaatatatgcaaaggggccggcatgttccgacctaacggaagcacaaaatgtgacgatgcaaacaatagcgaaaaggaaataaaacacgtctttattaacttcgaaaaaaataatcgaagaatagaagtttcacaacacgacataattcaccttacaagtaaattacatcttcgtccccataatcactatccctctctaaggaatgataaggcgaactaggttcgtcatcactactaatatcgtacacaaccttaagaggagtggggggtgcaacacaaactaaactgtaacgacgctgaaagttcgttccctgacgattagtcttctgatggtttcgccaaaagcgagccatatcctccaaacgttttgaatgaacaagatcgtaatcttctaaggttcgcccggggtgcgcccgcagccagttggcaaccttgaaaaccttataactgcgaccgtttatctccatttcgcgataaacaggccgaaatggacatcgcaccttcggcagacccttcactgccacaaatttctcattttgacttcgccagctcccgaaagggggccggatgaacgactttcggcgaaccccctgatggacagtgcagaaaaagcaaaacgcagcttacatagtaagaataggcggaagaagggggaggtatggcataatgcgagacgagcgaaataataatacgccaaagacttcgatcatcaaaaagtaattaagattgtcacacattccaaatatacaaaaaaaaaagccttttttttttaaggtttggcgacagcctgccgaatgtacaccattcgcctctccaggcaaactcaaaaaaggaagcaaaactacaaaaacctaaggaaagggcggagggcctcacacctctaggtgatcctaggcatcgcctccaacctcttcgcccaccgcgtcctctccttcgccctgatctgccgcctccgccttcgccagttgctccagaaggcgcgccttggcagcggaccggccgtctttctgccagaattgttttcgccacgcgcgaagagcgggcgaaatattctgcgcactaatctcccagtcccacttcgcgtaggtagggaactcggcgacgtgctcgcagccgaactgctgcaagaggcctaaggtgaaagccgccgatacacgtgcacagcaatcgcgccgtacgcggtggcgcagtccgaaaccaatccgccagcctgctgggtccactcggagaagtcgaaggctgaggcatcctcgatagggaccccccgcaccttcgcgcccatgtcggtaagggcgaggcggagtgtttggcaagctgttctcgcagattcggtggtcttcgccatctcctgcgaaaaccgctgcgactcctccgcggcactcgcttcggccctgctagccttctggcgaagagactccatcttcggcttagtaaggttgtaatagcgatgagcaccgccgaatgggccttctccttctccagttcggccgtgaggcgatcaacctcggcccaggcctctttccccttgtccaattcggactgaaggcgtttgacctcagttttcgccttcttgagggtgcggaccagggactccacctccaggttcttgcggcttatttcatcatccttggcccgaagacggctcttaaaaccgtcaaaacgggcccgcacggttcgctctttcgaacagtgagccgcaagaatctagatgaaagataggagcgggcgaaaagaaaaaaaggttaactgcgagacgtaaaaaaaagagggaagaggaaaacgaagaaggaagaaaaggcatacccgaaccgccagacttttgatggtggaacacccctcgtcgaactcgttaagttcggtgaacaggctcggggtgccggcgggcaagaaagattgcttactccctccacaaagggaataaggtccggccgggtctcgaagtcaccaggggcgaagtggggcgccgcaagggaatactccgaggcaaatgcttcggcggccgcacacttccccttcgccttggccagcggcgaaatggctggctcgcgcacagggctcccgaaaaccctcgccgcagccgacaagatccgttcggcggaggcggaagccccggcggcggcgctaccgcctgccccagcaacgccgagcggagcaaggggagcagccgaaaggtccaaactgcggccagcaggtgaggtcggagtctcgtcagaagactcgtcgtcgctgaaaacgcgagcgatgtcgaggaatcccttcttttttaagatcttcttgaccagacctcctttcgccgccttgcccgacgagaacgcaactaaggccttcgccccttccaaatcctttcggcgaagaggggagctgttcgactccaccccagtctcgttgtgatctggacttggggtaggagtgtagccgggggtgtcgacgcggtcttcggtcgcctcgttcgcggccttatcagccacagcctccacctcctcctcttcctctccttcctccttgccgtcacgttcttcggcatcatcctcgtcatcggcgtcggagtcagacgaagcaggaacccttcgcttcctgggggcaagcttcacttgtccacgcatccgctttcgcgaagggcccgcatcgtcatcggctttttggggattcgcccagggaggcagttcgccgttgtaaacccggttcgcccgcccagccgcttgtcacgttagcagctggctatactcgactaccgaaacatcgccgatcatcctgcgggcttcggcttcggcctagttgagggtcgacactgtaaaagtaaagggtgtagctgcgttaaaggtcagacaagacaaaataacaaaacacaggagtgtatagcaaaagaacggtcttactgttcgtcccctcaggaagaaccaagttcggcaaaccgtcagcttcttcccattgctcgatcgtgacttgccacgactaggagaggggaaagatgcgaagcatacagaactcctccaccaagtcacggcagctaaggcaggagcaaaccttgcacaacaggacgaaccgcgcctccatagcgccgtccacggcgatcttgggttttcggttcggcgcaatcgccctacgccggcaccggagggcttttgccgagtcagaaccagccgcgaaagggatggtgtgatagaaccacctcgacatggcagcgttcaccggccagagatcggaccgctcggggcgaacaccgtcttcttcgttccagccggggtaatcaccgtcttcgagttcacggtggcgatgaatatggcgccgaagagctcggcgctaggctcaaacccggaagtccggcatgcccagtcaaagatggagattcaaactagcgccgccgggctcaactgcggaagctccacctggaaaaggcgaaggatctccggcaacaacacgttgcacggaaaccgtagccccacctcaaaaaaggcggcgaacaccaccgtccggttgtcgataggctttggcaccacggccttccctggggcgaaagcttgccccgcgaccaacgccccagagctgaccagcttcgccagctcaacgtcgtccacaagagagacccccaaaaaggcggtgctgtcatcatcgactcggccgggatccagccctttcgctgaagcagggtttggcttgcgaggggccatggagaacggtgcgtttacggtgacgaaaaaagagattgggcgaaacgcctgaggggtcgaaagatgctgtggaaggaagagacggaggaagagagcgcgcacggtaaaatggcaagtgtggtggtgaaaaggaaagagcagtgggaatatatagcccacccaggcgaccgttcgcctacccaccagtaataaagcgccacgtgtcgcaaaggtaggcgaaacggtaaattcccaccgatcgagcagcacagtaaaaagcccacgatgggaaggcccaatactgttctgttcggcccaggaaaagagaatatatataaccaccaatcgcaggaggcgaagcgcggcaaaataataccagccgcacaagtaacaaacttcattcgcaggaataatgtaggtttcggcaggagcatcggtcgaaagggggcgctgcataccataccacatggtttgcacggtctcggccgaagctccaatctcacccttacccgtgaggggcttgttggcggatggcatgaggcccttcgactaaatctgccgaaacccgtggcgaaggctatgaagcaagaacggcgcgaggcgaagagtcgtacgagtgccttgccaggccagaggcgtctcaggcgaatggtgtaaggcgaagactacctgccgaaggaagacgacttcgccatgacaagttcgcccccgcgagggccgaggaagcctttccggcccatcaagcctaagggctatagggccggcgatcgccagacggcccatcaggggcccatgagcccctataacattatgtacccctataaatgtcccttttataagggtaatcatgtaaattcccctgtacaacctaaaccctggtagtaagaacctgtaatggggctataaatagtcccctagggccatgtaatggggggatcccaagtgaaattcaaaatttaatacatttcatttttccaaccactgttgagtaaccacgtctttcgacgtatgcagttgtcgtttcgacaacattatgtatctgctagcatactgtttggtagcattaaaacaaacaaacaaattaaacaatagtaataatgcttgttcttttttgtaattattattactgtttgctctagggccattcacagtgcaaaatactactacgagaagcctcgtagtgccacataggacagagacacatgtctcaaatgactttctccccacagtgcaaagtagctttttagagatgtttcagtcttgcatgccagaccccttttttttaattatagtccccatattttgtaatttacaggaaaccacaatattttgccccaaacaccacataaattagaaaaagaaatataaattttgcacctccccttcgctcgcaaggaggccaccctctatctcctccgtgcaccgcgcaccctctcccgaactgcaccgtcggctctccttcttccccgccccatgccgtagtcctggatctggtcagtgagcttcaacctcggacatccaagggaaaaagtgggggtgatctagtactactatggtgtttagtccacatctctatggtagttgcttttgcaccatttgtagcagcctcaaagtatatatggccaatcttgcaatcacctactcattgtttgttggtgcctttcttatggaagtatgtgctatcggcattgtgatattgtcatcaatgacataggcacattcgagaacccatatgtcttagtttatctatcaggaagaccattgaggagcagagaagttagtggtgtcaatttctatggggcaacttagcctaacaacatatgtaaattttacatcataggtccacacccaggatgatgttgaaggcacgtttcctctaatttcagaggataaacttttggattaaaatgacacgcttttcaaactgctaaacggtgcatttcgtgcgaaaactttctatatgaaagttgatataaaatatcagattaatccattttttaagtttgtaataattaaaacttaattaatcacacgctattaccacctcgttttacgtgaaacacttaatctttatcttcatcttcatcttcaggagattcaaacaccactggcttggatacgatccatatagatgaatcatgaatggcacgtacaaacacgtccagtggtggtggcaattaatgaattttcatacaactttatagtaatccttattatatgctgatgttggagttcagatgctttcctgctgcttattattgaatgtaagtcattgatattgtttgatttgtcttcagttttgatgtgttctttgttcttggttttcttcggctatatgatatctctcggctatatgctagcttcaaaattttcactaaggtggccactaatagaataaacaggtggctgaccgtatagtgagtccaactcaaacagctttcatgagaggtcgcaacatcctagatagggttgttgtcatacatgaaactgttcgtgagttgcatcgcaggaaattgagtggggtcatccttaagattgactttgagaaggcttatgacaaagtaaaatggcctttcctactacaaactcttcgcatgaaaggtttctcgccaagatggatttcttggattgagtccttcatttcgggaggaagtgtagcaatcaaagttaatgatgacattggacggttctttcaaacaaagaaaggccttcgacaaggtgatccgctatctcccattttattcaatattatagcggacatgctagcggttatgatccagagagcaaataatgcaggacagcttgttggactggtgcatcatctcattgatggtggattgtccatcctccaatatgctgatgatattatactctttatggaacatgatctagagaaagcttgtaatctaaaaatgttgttgaacgttttcgaagaattatctggcttgaagattaatttccataagagcgagctttactgctttggtgaagcccaaacagctcagatcaatatactaatctttttcaatgtgaggttggttcttttccattccattaccttggcattcctatacatcataggagacttcgtaattcggagtggaaggaagtgattgaatggcttgaaaaacggttggcaagttggaaaggcaaacttttatcacttggagggtgactaacactaatcaattcagtgcttaccagcctaccaatgtatatgatgtcctttttggaaatacctaaaggagtgatcaagaagattgattatttccgatcaaggttcttttggcaaggggatggacacaaaaggaaatatagactagcaaggtgggacatcatatgttgtcctaaagaccaaggggggttgggaattcaagatcttgaaattaagaacaaggctctccttagcaagtggttgtataaactactcactacagatggtgtgtggcaacaaatgctaaggaataaatatttggggtcacagcctttgtctcaagctcagtggaaagcaggagactgacacttttgggctagtctaatgaaggccaagcctgattttctcaggtttggctccttcaacatcaaagatggctctcaagttcggttttgggaagataaatggttggagaatgcctgtttaagagaacaatatcattgtctctataacgttgttaggcataaacatgcaactatttcagaaattttccaaaccagtcctataagcttttcttggcgcagggaccttactggctctaagttagtggcgtggaatcaccttctctcacgcatcgctaatattatattatctcacgaccaagatgagtttaaatggaatctaaccactgatgggagattctcggttaaatctctttatcttgcgttggtgcagaccgatgttcccaatataaacaaaagaatcaggaagatcaaagcccctctaaagattaagatcttcttatggtacttacgtcatggagtagtcttaacaaaaaataatcttattaaaaggaattggagaggaaacaagtcttgttctttctgccacaaagatgaaactattaatcatttgttgtttgattgtcgttttgcccgcgcagtttggtctttaatccagtttgcttcgaatattagtttacctaatagtacaactcatatgtttgggcattggataagaagacaaccacgcaatttgagatctttggtcttattaggggcaacaaccactatttggtctatttggctttgtagaaataatgtggtttttgaaagaaaaaacatatcttctcctttgcaggttatcttggctccgctcataggctatccttcagaaggtcaatttgcggggtactatcattgcggcttgtcaacaattggagctagtggccatggagttttctaccccggcgcatgggtggcgttctaggctacggttagagggctcctgaagttctttttgtccctgctatttggatgatgagtttatcttttgtttctttcttgttggctgtgtgcactctttgggtgcagaagccggaggtgctctcagaataattgtttcacttgatagaattttactgagattaataaagcttccattatcttaaaaaaaaatatgatatctcttaactgagctttctagctcttccgatttcggttcttagtctttatttttgcggattgtcaggccaacgaatcaacctcaatgtaacttactgagttcaagaaagcttttactattaaaaaaacaaatcaacctatttggttgtttgatttctgggttagaaataagatttttgccgtagaaatgcagcctgcagggctgaataaacaacggacggctgctgctgtttttgcgtcccagtcactctcatttgatagagagagccagtgtctttaacatctgaagctgctgttcaacacctgcaaacccagtgccacgttctgaacctgcaagcttctgcttgtgacgttgtcaagctccaacaattcatatcagctaactagtagcattatagcaaaggttaatatctgcagtgtcataattgcaaatcccccaaaataaacaatgctcttttcctactctctgttagctaaaaacagtgtagccaaaggtacgtttctcgaatcatctgaatctgaatgata

SEQ ID NO: 60299 - DNA, 1827 bp, Oryza sativa
  unsure (1)..(1827): unsure at all n locations
cgcagatgattctgtggcacacacctcatcagngtacagtgcttactggatttgtgagcatctttgctttatcccagcatgcatgcatgatgaaaatgaactgtacacatcacatatgtttaattttgccggccccaggaatatgtaagcagtgcagttttggaaataggaattttttccatctttctatgtatgatgcaccacaaaatttggttgcaagggataataagatgccagttgataatatattgaagtgacttggtaaaatcatgctaaatcttcattcatgcatgtatatatgcatatatgccatattcttcatctccttaattattgtaacgatcctagctactccctccgtcccataaaaactcaatctagaattatgatgatacataatctagtataacgaatctagacagactgcttacatctatatttgatgggctagattatgttacatctcaattctatgttggtttcttttttagacggaggggagtatatatactttaacaaggatccttctattcatgcagtgtaacagaacttcttttaaaaaacaaccaaatttttagatggcagcaaattaaaggcgcttaagctaacttgtctagatttctctaatttttattaaataaataagaaaatattagtttggattcgtttttcttgaaaaagagaatagacaaatagctgttcatattcaattaagaagaattagtagcatatatataaatggcttagccaattagcttaacaaaaagtgaaagcctccgtaacaattgaattttggcatattttcatatgagccaattaacttgattcctgcagacaaagcggctactcaaagacagaaagaccaaagatcactactatgaaacaagtttttgtaggatgccaaaacaagtttctgtaggatgccaaaacaagtttctgtaagtgactagacgactcacctatgaccaaaagcatgtgaaaatcgatgatcttcacatggcaggcttcacccgcctgagaaaacaggtaggttaagttgaccatccacagtgatttattttagctagaaaaaataaaaatacaattgaaaaaaaaacatatgcagttccataacaaacagagagaatacatcacaatttcatcatggatttctaaatcatcgatcatatcacaaattcacaatgtcttgacagcagagagaatacatcatagagaagtggaggttgtacatgcgtgggcctgctagaaccaatgctgtaggtaggggcgagagacgatgaccagcccatcaagccccatatattggtggtggcatgcaccgacccggccttcccgccggtggatttaggtcacaccactaacaacagccatcgtgttagcattgagctatatgaccttcggcagatctggtgcccgccaccaagctatagccctcgccaccctcttagacgccccgaagcggttgccatctccttcccgagctccagctggatgagattgcctctcccctttgactcgaccgccgctcctcccctttgcactcgccgcagttgttgagccctctccaccgaatctagtggccttgatcgggccagcgcggtcgtcagggtcctcgtcatggctgccccattctccccttacccagtttccaacaccgccaccttggacctgatcgtcgagagagggattgagccacacccctttgccgctattgttgccccttcatgccctttggagtcaccggatttgacactcacgaatgtcgtgttaccgccacactagatccggcttcttaaacaaaaaccctttccttccttttaccacccc

SEQ ID NO: 60300 - DNA, 3696 bp, Oryza sativa
tcattactaccacttgtgacagctgtaccattaacagatctacagtccaacaagctcaaatcaacattcataaacaatcaacagaaaaacagaaagtcccatttgatggaacttaatcaaggagagaattttgttcaaggcaaaagctacctgtctaatggtgatgaatcatcatcttgtttagtttcctttgctccttccaacaaaacataaccattttcatcactgctgtttcctgactttgcatcctatagtgcagtagaagagcaaatacaaacaacttttcagatatgagcttattgataactcttgcactgcactcaatgtcaacaaatagaagttactatagatgcttcataacctggcgttcaaggagcaatctagcatcactgacatgctgttcccagccctctactataatgcgaaaagcttcatcgcgtgacaagaaagatccaaagaagtgctgcaagcaatgcaccttgagtgagatagatctggcataaccacataaggaatcaagacagtgataggttcctcaccctttttgtaccggcaataatttcgatggcattatgaaaaatagcagctgtttttgctttacgtacatcagtcacttcctgcaacggaatagttttctgaaaaaaaaaggaaagatgaaagtagaagagagttgtagtcaataatcttttatagcagtacgagcaacgcatcagtataacatttttgtacatatgccgctataaaatatttaatgagaaatagcagcataaaactattgcagacaaattaatgaaattaatcagatgataatcatattgtagcagcaaaattaactttattggtcagccaattaggacaaaagcaataattaaaacaattttgttggagagcaatccttcatttccagttcaatttagctcaccaagtcagctaataaacaatgttccacttgcaggaagccaacatttaggcattaattacaatcagcacagagaaaatggaaattactagtgggaacaaccactagctcatgcttcaaacagagtaacagggttttgatggacatgtggccttccatatgctaagtgtttaacctactacagaaactatatgaagacaaagcataacagagtagaatgccatttatgatggtccatcagcaacgcaaaatatcaaggcaagaaaacttcaatttagataacacagttccaaaaaaaggagcaactattttaaggacaacatttcttcagctcaatttattgcaacagaatgtgtcaaacaatacaacacaacacagaagatatgacatcaaccagaatccactatgcctcgataataatgtgtatccgaaaaaaaaatgttcggtaatacacttcttaaagtgcaagtgcgactgaacaagctaaaggagcatatatgatgattgccttctgatcattcattaccttggtctcatatccaaaaatgttagagtagaagcatatatggtgtagaaataaatacatatgaccctgcagaataatgtatatttgttagaatctgaaaatcgtagatagtgttgaaggcctgaaactaaagcctatttttttatttaccctgcaaaataatataaccaagctctatcatttgcacaggtcaaacaatggattttttaggtgcaaagcactggctaaggacagtagtgaaaccagattgtctaataatgcagtagtttgaactctgaaactaagtaatgaaagaaggagtgtcatttgcaagacagcaaggatgatggacagtagcacccttaattgcaacaagttagatacattcatctaaacttgttcggtgcctagattagaaatcaatctacactattattgtattatgaaaaatatggattagatcttagtgttaagcctttccatatgtctttgcacatgcttctctacatcaaaggcataaacttgaattagaattggtggtgcacatgtcttaaatcaatacaaagcaaatccaaacagtgaatctaccctcgaaactgcagggccaacacttgccatgtgtattatatcgaaatcaactttggtataggtgatttatgtgtgcttgacctcaaattgactctgttcgtgagtgattgacagctgtgaacacagtatgaacaaccaggttatcattttatttctaaaaatgtgacaagttgcctttggtaaccctgtcctttagttctgcaggcaagcaatgcacaaaagaattttctagatgctgctgtgctcaatggggtggaataataaaatgcaggcaaaaagggaagtatgtattgttgtatttgtaacaagtatgagttaataggtattttggccaaaagtgtcaacataaatgccagcagcttgtcaatattcacagggtcacgatacaagtaaaatagatgtttaaattttgcatattttggaaagattctttttaagccataggtgattctctacttttattgtctagaaaacctgtgttacgaatcaagacttaagttacaagaagtagcactgaatgatgtcatataagaactacctgaagaagaatattttcttggagcgcacaattaaaatcttgcacaagaacctgcaatgcacaaatactaccatcagggataatcataagtgatataatagttcatcaaattactgttcaataaaaaaatgaacttggcatattatcttgatatggcatgctaggtcgacccacaattagagtcactcaaattcatttatcatcaaccaaatgaagtcataaaaagaagttcatgaaactacaagctggctacaaaatcccacaatttcggcaagcttccacaaaatttagtcacagttcaaccatcaactccgccacacattcaatagacagaaccgaatcgccacaacctgatgccactattcaatagaaaatggctcgatttgtcatgatgcgccatgttccaaagcaagtacaagcaatgaacaagtcatgatgcgatttgtcaaggaaaaatgaccacggcacaaaaagtcaaagttcaccgaatcgaacacccagctcaaccactggagcactcaaaattccccgcaacaaaagtatgtcaatccagggtcgtcgaggatcagatcgatcgaatagatgaagcgagaagcagcgatcaaatcaaaattttacctcgtcgggtggcaggcgaaacaaaagcctgtactcctcgctcctgctcgcgagcaacgggctctgcatcaacgaaccaaacaaacccacaccgcgtcagaaacccccaccaaccagtagtagaagcgtagaaccaaacccaaacccaaaatcgaggcgatattccggcagcaatccccgacacgggaagcaaccgacccacccaccgaggggtctggcgtggcggcgagctccccggaccgcgcggactccggcgatgacgcgtccaccgcgggcggcgccgaagcgagccgccgcggcggggaagccggggagggcgcggtggtgtcggcggcggcggcgggggggcccctgctgggggtccggctcggggacgcgacggccggcgacgccatgcccgcaccccgagggggggagggagagggggatacgagggaggggaggcaatcgtacgccggcggcggcgaggtggtggtcgccggggaggaggggggaagagaagagtaggtggagtgaagggggaggagg

SEQ ID NO: 60301 - DNA, 2010 bp, Oryza sativa
  unsure (1)..(2010): unsure at all n locations
tttctgtgcagtcggaatcggtttttacatgcggatcttccacccgtctggaatgaggtgtctacgaaaatcgcgattttcgcatgtgggtgacgcacccgcgcgcaaaaatcgcgattttcacgtgcaggcactttagtcgtctgcatgggaaaataaaaaatcaaaacaaaaaaaaaaatcaaaaacgccgtcaccgccatcgtcgccgtcaccactatcgttgccatcaccaccgtcgtcatcgccgccttgcccgaggcccgccgtcgtcgtcccggtggttgccagtgacggatccggcctccctgcggtggccagcgacggatctagcctccccgcggtcgccggcgacggatccgctccgccgcccccaccatggctgatgccgcactcgcctccgccgctgcctccgctgctccaacccgatgccgccacctccgccgccctagccgaggccgccaccgctgccgttgccgggagatgggaggaggagggtgaaagggagagggaggaggtgggtgtggcacgtagaaggatatgggaggagtgggtgtgggacgaagagggcgatgggatctgagaggaagatggaaggagtgggtgtgggccggcgacgccgggattaaaaggtgggtggctatttttgtgtgcaagtcacttgatatgtccacacgcgaaaataagcctatttttgcgtgtagacctgttaagtggcccgcctgcgaaaattgatttttccgtgcggtcattttaaacagccgcaagcgaaaatagaacacgatttttacagacgcgaccacttacggttcatctgcaatctaaaatgactcctgtacgaaaaatcattcctgtagtagtgagcgcctataaaaatatagttatttttgcagacaactctcctagcctaaccacctataaagatcgacttctacatgtgtgtatttttttatgccgtctgcaaaaataaaaaggggtgttgtgaaaattggttttttttaagtggtggatacatttttgcaaatgctacacaataaatgaaattaatataaataaagtaacaagttgccaacaagaagaagtaatgccaattttcaattttcacaattgctgttgccagaccttcactcatgagagctgaacacatccaaaatggtgttccccgatctacagcttgctgcaataaaccactttgcataaataagaaaaaggaatccatgcaagatccaaataaaccagaagtgtagaaacaaaattaattaattaagtttctctttctagcctttctgtttagaggtaactacatctttcaccattacgactatcttgtgcgctgctttaaattaattaacttgcatttaattatccacgtcaccaagcgcacgagctcgaccccactgtgaaaacatatttctatggtgccttcgtcgtggtagttatattaattaagtgcaatactgtaggtaaagtgcgagcagtcaatctcagatgaacagttaattaattagatatagcatgtcatcagcctatgacaatgtgtgtggtcaagccatcaaggacacaaaaagattaacaaatgggcgagagagaggtgaaagtgatatgtcgtcaaactctgcaactaatattatgtgcagctggtggttatatacatgataacctatatcttcctagctactatatcatatatgcccaaattatagctttgacatctccaatgggacaaaggcttggtggtaaaattaataattactactccacttaattcctggttatttgattaaactaatcacccattggttgtggtcaagcacacaggagattcaagggcataatctctggaaaatactaaagagaaaaagagcatgactttgcctttaattgagcttttgtcccccatatatatattgaatattatttgttgtgtatgtgataacaaaatcgattttgatccccaccatggaatcttgatganctncttgcagtaggacgcgaatcaccaagtaccgg

SEQ ID NO: 60302 - DNA, 950 bp, Oryza sativa
atatatatatatatatatatatatatatatatatgtggataatgctaaaaagtcttacattctgaaatgaagggagtattaattaagacagatcatacgaattcagcaagtattgttttgtgctgtactgctacagtgcaagagttgttccgcgaataactcatttttccttttgatttttcggtttgagaacgtcgtctagcaccattcaaattaaggaagcctgcagtgcactgtgcactctgcatggtctcctgactaattagcaatctggcgccgtcagctcagctttctcttgtaaaacatactccctccgtaaaaaaaaaaagacaaaccctgggttttcgtattcaatgtttaaccgtctatcttatttgaaaaaattatgaaaaaaattaaaaagacaagtcacgcataaagtattaatcatgttttatcatctaacaacaatgaaaataataattataaaaaaatttcatataagacggacggtcaaacgtttgacataaaaatctagtgtttgtctttttttttttaaggcaagggagtacgtagagattggcgcggccggggatgcaatatgcaagtcaaggccgttgcagcgaaccagcttgttggtagcggccatcaggatgcaggccggatcgatgcctgcaaactattgttgcgcatgaagcgactgttgtagcacattagaagccagtatggtggacaggatcttccggcaggcctctgtaaggccccagaggaatttcacagagagaacgctaagccgctaactcttcagttcagtaagatatcttatatatggggtatatagggcaaagttgtctcggtacccaaaaagaaaggggaaatgttatcactaaacaaggaagaacagagatcgcatattacattcgtatagaggaaaacaatcactgtacgctccggacaagcttctccagact

SEQ ID NO: 60303 - DNA, 3626 bp, Oryza sativa
  unsure (1)..(3626): unsure at all n locations
ggggtnnnaattcggtcgactggcacagnagnncatcatattgatttggtatatcctaattttcacaatggagagaaagagagagtgagaggaagagggtcctccaccatgggaattaatctactctttttactaaagttttgcatgattttagctttttctttcacaccttttctctgcttgtgatatgatgccgaaacgtcaggcccggtcccagcacgattgaaatatataaatgtacaccgtcactagttgtgcatatattttatatgcttgtgtaaacaagtaactataaatttaaacgactccgtttggagtgtacggattttttttctctgattaatagaagaactatttcagtaaaagcaagccccttatctatcaatcttttttgcaaccattatgtaggtcatcgatatctaactaaatccaaggcatgctatatgtcacttgttttctttcgggagtgaaacaaatgatgtgttcacaactttgacattttaaaaattgtatttaattttgtgttgatccttgtcaatatataaaatatagtaattcgatttttttcgtcaacatctacataactacataagggtgcacaacaaagttgaagtaaatctgtactcgtctactggatcgagttaattttactcattgtgtagctttaatatagagaaacacacaggttttccagctagctccataattaaggtgatgggctaaccggcctgacttcgaagcctcaccccttctatttatttgatattaggtcattcactattattcgtgttttttagctttaatttaataaaaattaatttaaaaaaagcaaaaatcgccttaactattaatcaacatatacgctaacagtccaaggattattatactaactccgtttttaactatatgacattatcgacttttgtacatgagtttttactattcatcttcttgaaaaataaatagttaactattgtttagtttgttataacttgctatatcattaaacatagggcctgtttggtacagctccaactcctaaatataactccaggagttgagtctggagtggagttatggagctgccaaaacccagttccacaactctaatatattttgtgagagagctccacccaacttcactcctagttttgatgagctgaaactgtttggctgagctccagctccaagaggggtggagctagagctggagctgtgccaaacaggctcataatgtttgaaagtaaataacgtcacacgtatttataaacgggggctgtatataactttaatttatacatatgcattttccgcgcaacaatcagacggtgagaatgaacatggagatcgatagtccactaggctggaaacgtgcacgcatcctgaccgtctatggatgctttgatcggttcttcccaccgagaattgtccggcaactaggtggggcagggcttcgccggccggccttccacgtgcaaagctacggccacagaaaagttggcaccaaggatcggaggccaggtgcagcgacgcaagctagtatgccgctgaaaagcagcagaaaaaaaaaggcagatttttttttttgctggattgttgctggttggctacctgcatcgatcatgcgtgcagcatgttatggagcacctgatctatgatcgatccggtgttggcttccaacatctagcattctagctagctagcagatgcaagatatttccttcttttttttccaaaagaagagaaaatgtggcctgataattatgtttcgatcggttgattattattcggtgcttgatttatgtttagataatattatttcaataatataataattatactgaagtagtactcaatactgccaatataagggagttgtcggcaatttgattctgacatgcctatatggggcagctagtgcacgggcaacgcaaccgacctatccgtatttcatttgtgacgggtttcttgtggcaaatggtttgcaaacatgtgtcttctctcattggcgaaatcggacacaatctttgcaattttttttattaaattagtactatttgaaaaaaaaatctcagttaattctatattactgagaatttggagtatgaccgtttgctttttgtcaactttgcaattttgagcacaaaccttattagtgaaaagtacatacactttaacttatgagaaatatgtagacatctgacctccaatattttggcagccaacctgttgtccatccaaattaagatcgatcatcactgactacaatatcttgcagctatgctagcatgtgcatagtgcagaaattaagacagatagagatgaaagggaggagagggaaaaaaaagctgctttttggaggatggctacatgtcattcaccttcaaaagaaagacaaactcaacaaacttgagagtgatcaacgcatgcatatatgtgcatgtaacgtgtaagctagctagccaggtagcatctacacattagaaacacatataaatatttgcattgcatcgaccaatgattaagaccaacgaacgcttggtagagagagcacttagcgtctaagcgtgacaagctctcgatcgattcctgatatgaagagtatatatataattcttgacacatactatatgctgtgctcagatatgatatatatgtgattgattgatcagtactacaacacctgcagagagagagaccctagctaggcatatactctgattaatttgtttcttaattatcatatgcactgatcgatgcattgcatgatatatgtgagataatattctctctcttcctgtttagttttcgtcagcatgagataagagttagcacagtactgtatgcggtttgttttattcttgttctactggtggcgatcgatcgatcgatcatgtcctgaattatattctctggattgagtccaattccatctcaacatctgtgtcatgcatgctaggtgccatctagctattggataacgtttgcagaatgatgctgtcgatgcatgactgatctcttgtgcattatatattactatgtgagtataattgcaactggaggttgtcattaattgttaccgtgtgggagcaacatataagcagatatgctacatacatatacaatgggaacaaatatgttgtgtagtattaatttttcatgtttcccttattttgtttatcatttcatatatagtattgtacaacatctaagttggcttttcatgagcgttcattgtcataagttcttataagtgaaattaatttatttttacaaaggtccgagatcgatgcgaaatataattaatactttctagtagttaaatccataagtaaaaagactgaagtaaatttactactttgtgaaattctaattaacgtacgtatggttgaatgtctgtgttagatacattacttctacatctaattaaagtacaaaatattttcttctccatgcaagaaaagtgggagtgagaagaatatttcttatagtatagttctgtcttttttgtttttctggaaaagccaaatatacggcatgcaataatgcacattttggaaagatccctttacagctagagcagctggactggatttttcacaatttgggccttttaaaaaacttat

SEQ ID NO: 60304 - DNA, 5018 bp, Oryza sativa
  unsure (1)..(5018): unsure at all n locations
acatctctatcctatgcactagttcggagagaggagaggaaacgaaaaattctacatgtcacatattacgtccatttgagttcaatttttctatggttggttcttgtgtgtccctaagcgtgaaaaaaatatcaaacaaataaaacaaaaataaaaaatttccgagggggggcgccaaccactctggcgcactccccctagccacctcagcatcgccccgccacgtcggcagggggacggcgccaaagaggctggcgccgtactgttgaacgacggcgccaggcactctggcgccccaaaaaggaccatttttgggataagtttttctaggggtctacttacaaaataagtttttcaaaaggaccaaaatgtgaaaaatccaggcagctggatgggaattttatttccctcttcgactgcaaaagataaatatcccctaccaacacatcgacctttattctacattatctatgaaatactgagtacagaattatccgggccttttcttgtgccattgaaattgtggcacttgtaatttagctagcaactattttggacggtccaaatgtgcaaatgcctttggcctaaccttactctaatgattccatgatctagcctgaattgaagaggaagactacaacacttttgacacaactactcattgtggatcaagtgattggctcgtgcaagtcttgacaagtagatgcataatgcatgcatttagctagcttaagaatgtcgtagagtatcttaagtgtgttgaatgatctggtgaagaccatcgattgtgaccaatcatattgtggtccctgttccgcaattattgaatgatcttggttaaatttaattaattactagcatgtaaaggactatgtttgttctagaatctcaagatgatacctaattagaatgcagcttcactatcaaatggtctacgtaactgagataattcacataactttacagctagctaccgcattgaccttagctagcatttttccaaattaattaattattctctccttttcataaataattattgtctagaacaagatttatttaaccttttcaaatatagcaatcaatgtatagtagaatatataagtttatgaaatctaataaatttatgatatcctgacaatatttttaaaggcaaatctaaataccattttctttaaagtaactgataagtatttgagaatattgattgtcatgactttaaaattttgactatacatatcttgtgctaaacattaaatatttttaaccaaaggaagtatatacgtactgctgaatataaaactgcgatttgaataatgttgactaattaataaattcccgatgcgtagtagtgttggtgcttcttttgattcaacaattaaataaatcttccttgacactaactggactagctagctagctatagttaagttatgcgtacctttcattaattttagtggcttgcatctgagattgacacatgtgtaccattccctagctcatatcatgctgtagaaaacatatataaataaataaatacataagagcactgacaagtgtctcttagatccacttagaaattaaacgccaatagcaatgtgtatgctagctatagctagttgtatttaaccacgctaagatttacgcgtatctaaatcaaatttatgtcgtgttgcattgcatgcatttaattaatatccgttccaaaatgtaaacacttttgaacttcgatacatacggtcctcgagatgctattttaacaatgatatctataaaagtatgatgttttcaataaaagagttgcatattgtgatagtttgtttaatgataaatccagtaacattaaatttataagattaatcctttttatttttttattaatagtcaaagttacaaatatttaacttgacactatattaaaaatatttatatcttgagacggagggagtatcaacttttgcagtaatcatcagctgataacagcggctcccattttatttttctccgttcttttcaactattttttgctactcgcactacgtgcaacgtgaaaagataagttgcaggctccttgtttgggccagcagactacctagaaacggttgatacggtcaataacatgtttacatttgcatgtgctttgcatagtgtccggtttggccaaccgtgtgtacccggtttcaacttacacacatgccacgcgcagcctggttattttgaaaaaaaaaaactcctcatgcatatatagaattttaaacagacccttccactacctgacagcctgtggtgttttatctggaatggccctcgtttttttttacaaaatataatgcaaggaagacaaaattctgtttctagggatgacgttgtaaacatgataagtataagggtgcttatgcaaaatagccttatctaaccctcatctctctagccagtttctggtagaaataaggggcattcggttgactaggattgatatggggaacaagctaattaaaattgaggtttggctcggtttgttgacatgcttgatcgagccagctcgcgacccttggacggtagcgacgcagatggcatagggagggaagcctagagttttaatctgtgtcaccgaagagtggccgggaggaggactagagccaaggaggagagcaatgaaccggtgacttgagttgagactgatgaggtgccaaattaaccgccgggcactgcccacacgacgcgtagtggctctttagagtccgagtaagaaatagggtggctcggggagtttatggaggtgggatgagccacgaatcggtgtcgtcggcgaccggtgtccccgtcccacgtcaagtgcgtgaaagcagctgggaattgaagggatgagggggaccaagtgggagggatcagggagggagggaaggacgatatggtttagggagttaaatagggttttctttaaactggttgactactcggtgaagtactgtttattgtactacctcatattatgtatatatatatatatggacctttatttaacactgattagtaaaatccttagcttataccaaccaagtttcacctcatattctactaggcatatattcatatatatatgccagcagaaaattaaagattcggccagagatacgatcctttgagctgtcgccacagctttggtacgtctttagctttacctaaagaaagaaacagcgatgcaaaaagaaatggatgggacttgtgctagctatctagctgctgctccctgctttagcgaaaaaccaaaaaaaaaaaattcaaagtcaattatatatactgcaaaatggtggtacaatctatgcgaaatgtttggatgtattcaaagtcaattatatatgctgcaaaatgggtacaatctatgcaatccataggccctgtttagataccctgacaaaaatttttacccggtgactttcaaatatttggatacatgtatggagtattaaatataaacgaaaaaataactaattacacagattgtgtgtaaattgcaaaacagatctttaattttaagcctaattgctccatgatctgataatgtggtgttatagtaaatatttactaatgacggattaattaggcttaataaattcgtctcgcggtttacagacggattctgtaatttattttgttattagtctacgtttaatattttaaatatgtgtccgtatatccgaagtgacacatcaaaactttacacccctaactctaaacacagtcatatactgttatgtttgacttgtgtctttggaacttgtttcataggatatctagcatctacagtagagtacactacagttctgcagagagctggctagctagatcttgctgattgcaataatgttccaattagcctttggaactcgggatagtgtaaaccgtaagataagggctagctgtgctgtattaattaattaattaaggaaatatcaagatcatgttcatggtgttcactgtgtcctttttcaccttaagacgatcttgtaaaactaaacatttacttattagctgattgcataatccgtgacattttgattccgccccaatgtttggaaagaaaaacatggataagcatcgctcatactaaataatatttttgctgagggaattcttcttgattcctaaaataattaaactaatcccacaaaattcctgcaataatggaacactggcttagagctccttaattctttctgagggtaaacctgaatttggagcataaaaaatgtaaatatataattttcccaagaaataaatacacaaacatctaaaagatctagcaggaaaccttcgagtgcaagttagttatgaacaaaagttagaccatatgcatatcttagttctagaaaatgttgggacatgttggtctacttacacggtagtactacctgtttgaaggaaatgaataacaagattttagttgcttgaaatattcttatctgggaccaacttaatttggcacgtgtaccttaacatgtgggctccattatcagcctctatcatcgttccgattggttcatatctcgaatatgcaagttttcttttttgtcgataatagaattcaatcaaaatatatacgcgagcgtctggatgtgtgcttgtcttacttaggcttaatagcaacgatctttctctgtataagctaagtcatcgtttttgtgtttctttgtaattcgcatgcattgtcatgttttgtccattttatcgggcatttggatctttggctgatgtgtaaaagtgtccaattaccaatctttcacgcagaaaattctacaataggctaaactaccccttcgtttatcgtaatcacgtttcccaaactaaacagtatgatttttatataaaagtgttcttaaaaatcaaacaaacttattttttaaatttgaaatgattaatactcaattaataatgtgctaatgactggtctccttttacgtgtcattgtaatgatgaactncttgcagtaaanngagangacactcaatgggcgcgcg

SEQ ID NO: 60305 - DNA, 8567 bp, Oryza sativa
cggtgacgtgttcgcgggcagccacccgggcacccggcgtgtcggggtgcgtgtgcgctccgtcgtcgggtcgggttgggtgggttcggccgctggcgacttggagggggaggggaggggggaagacggaacggaaggggaagtgaaatactaccggcagcttctatatgcttctttttttttcgttctttctactatatgtatgttgccatttgtttgtttgtttgtggtatatagcagaaaatctattattacggcaagataataatactctctctgtacttaaatatttaatatttaatgttgttgacttttttaaacatatttaaccgttcgtcttatttaaaaacttttttgaaatatgtaaaactatacgtatacataaaagtatatttaacaatcaatcaactgataggaaaagaattaataattacttaaattttttaaataagacgaacagtcaaacatattttttaaaagattaatggcgttaaatatttagagacggagggagtactattacagaagagctttgttatttatgcaatgtagtacgccaccctataatatccaacgtcttacttgctataaaacctgattatgtaagattaaaacatgattatgtaccatataatgtcgatacaatcccagtatcccaccgatgatacaaattatttttttatggatttccctacagcactaaacaaagagtcaagtttattatacgagaaaataagtgtttgcccttcgaacttgatcgattctctcattttgctatcatcacactctaatgctccaacaattgaatatattatttaaatatatcgtaatgcaacattctttgattttttatatggcatgaaacattaaaatgaatactaagtttgtactccctgtagtcacataccacacgaaaatattaaatggcatatgcatatgctactacctctgtttttttttttgaaagatgacgccgttgactttttatcaatcatcttatttaaaaaatttacgtaattataatttattttattgtgagatgttttatcacttaaagtattgtaagcatgatttatatcttatatatttatataaaatgtataaaatgtttaaacaagataaatggtcaaagatgagttctaaaagtcaacagcgtcatctattaagaaacggagagagtatgttttaatattccatccaatcatagataagtgatatttttggatgcgtaaaatgaacacatttaaactaattaaccctataaactttgaccattgattttatttaaatattttaattcaacttttaaaaagtgatatggtatattcgtttataacttcttttacaataatgtatattaacctttagtgtgaaaataatttgtaatttatttataattatcaacaagtttcttggaacatacaaaagtaatacactatggtaaaatcatctttccacccatctcctaatgatgacagagaactaacagaaagagccaataaataaaagacaaaagctgagaatgaaggatataaatgaagtgctatttaggagggcaaataagagaatccgccaactttaaaaggcaaataaatattcttttttattaatttatcttcactcagaatacatatgcagcccatgcaagttcactgccttttttggttcctccactgattcattatcaacatcacatagccattataactaccatgtcaccattgttttcaggtgtcaccattgttttcaggtatagggattgaaatatcatatatgcagacaagcatggacctcgttcactatccctacgtgaaagattttttttttcctttaggcagggatcgaattatccgattataatataatttgttatagatgcacaatggagtgtatggttttctcttttctttttttatttttacctaggctacagctgcacaatttcagttgtaccttgcaggatttatgttgagttttttttaaaaaaatcacttcctccagttccgtagttcttaacattttagacaaggttaagatcaaagattttattattaataatagaaaattatagttaagatctgttttggtgattgtgccattgttctaaacgtaagaatttttttttcttatacactctaaacgtcaaaagtatgtaaccaaagggagtacatacatttctaacaaactggatattttatcaaccagctaataaatgccttatcggctatcgcaatgtgttctcaaccactgcatcgccgtgcaaagaaaattgggacagggacatgtccttagcatacagtacagataaggcaggcttcattcatggtcagattagtatcaaagcacggacaggcaaatcctcaaaccagcatagaatatcactagcaaccacgccactgacaaatgaaaaaggacaattaaacttccatcttgcccggtcaccctaatactctatatccgcatgcgttgcgttcatgcacggtcgtaatatatattatcagaattaattaaatgctcccctaatcacacatcacgtcgcactagaaaacagttaacgaatgatgatactgatgactatagtgatgtggtagcagtaaacaatcaacaggttgcaaaaaaataaacataaaccagatataaatatgacatattctagtacaataaatttaaacaaacttctatctaaatttattatatttgaatatgtagtattatatctgtatcttaagctgcccgcacgctacggcgatcggaaagacaaccaaagacgaaacgtgtcggtttgggcgtttttttggttttttggaggagaggagagacacgccaaggaacgcatggagcggcggggccagggcagggcggcagtggccgcgagcgcgacggccggccgaccggtcggtcggtccggcttaaaagcgaccggatcgagaatgagaggctgtcccgtgggccctcgctactcgcccaaagagaacagaaggcgtatgaccgacctttacgtcgtctttgtcctcctacaaaacacatgcacattgtacatttgtacctcttccgtttcatttacttttgggattatcaaaaagtcattggatgtaaaacggagtcaaactcaaagcctgtttagatcaatttgctacggtaatttttttttttaaagtttggtggcaaaagatttggtattataattttacaagttggtgtttaaatgcatggtaaaattttgctattaattgctgctgcctctctcatacgcgggtccaatgctttttggccaaatttgctactattaactctcaaatgacaaatgtcaacttgtctgctttttgctattagtgtttagatccattttactaaaaagtgatttaaagcggtaaaacttttgttattttggatgatctaaacaggccctcagtcgtatttttctcaatcgccaatccataccatctttttaggttttaaaataattgataccacacatttatcaatatggatttagatcgagattatacatcccactcgatcaggaatttttttgtcatcattaccctgaacaagttgatttgtattggtatattatacaccccactcgactaggggtttttttagtcattttaccttgaacaagttgatttgttttggttgattacttgattatactcccgaaaaaaaaagaagattacttgattatacatcctatactatactaggcgctttttgaccattttacctttgaacaagttgatttgtaacggagattcttcgtaaggcttctcgtgggacaaattaacaaatatctgaggaatttcattattttcatacgaattccctttaattaatattgtcacgtaaaattccaaaggaccctcgacatttatttttctaacacagattatagacaacttttgattgcatatgttaacattagctaatcggttagatgtttcttcgcgataaaaaaaacatcagttagctgttcacattgaaatgatggagtcatggggatgagtcttatgcaccaggacttaagtcctgatgtctttaaattttagtgcttccaaccaagaacatataggcattctatttgtggtgcaatgtattcaaagaactgtacttagtgatgtttcatatggaattctccatggtatctttcattttattgtcccagagatatcagaaatgtattccaactcagcaacactttactcagttcaatctttgattgtatgcaaccaaaggttcacatatgatgctctgtgcaagctcaattatattcaatataatccttacacgtgttgcataacttagaaaatagggcatcatgtaggcaattgtcagaatgacacatgattaagccaatccaaaagaaaaacacaaacactgctgaaagtatatatagcgaatcaaattattagaacatacattattattaagtaacaaaagtaatggatggcaagtttcacctagtttcttcaccatctcctctcagttttgctttctttttcctgttctcccagaggccccaaatgaccagagcgggagaggcccctcctctcccagggattatggcggccaacatttcacccatggcaggagagcaaaaaaactgtggtgggagaacaaaaaagagttcatcttttcttctccccagtactagaaataggacgatactttgacgtgacatcagattactgagtgatgtcattgtcaaactcaaagagtcaccaagggggatgatcctgtggcccttatgtgaagagtcaccttttcccagactaaaaatcctctgatggcacttgatacaagggtgcaaaaagagtcgctaaatgatcttagaaacaacctttgataagtgtgtttcaccctgaaaggaatggttaatcctaactatgcaccttcatgatataatagaagagaaatacaagagattggagcaactttagttcctcatatgaagttatgaacaaaactgaaaagcaattgtttgctctgacatgctaatattattattgatgtgttttcacgctctattgtgcttaatctccagcaaatacatgaactgtattctttcgtgtctcaagcattactcaaaggtcatacctcatataagttgcagaatatccagggactgagttattctatacttaggtgtcatctatcgtgctttgacttcccatattctgggatccttatgactaactttcttggagtgagttattttcttttccttagatgacatctatgctttgacttctcatgttctgggatactcatggactaactttctttttctctggttgcaggtggaacattgctctaagtaaacaagggtaatagcatttcgtttagttgttcaaaattagcatgtttcaatcttcttgaaccctgaaatctgcgagactttcaaaaatatttgtagcaggagattctttctcctgcacatcaatgcaatagataggggttgtcgatggcatctctactcaaaccttgtttcagatgtgaggacttttcccaatttctgtggggggaaaagcatgtaaaaattcatcagtaactctgaatgtcttctcactttcaagaacaatcatctgcaactcactgaaacagggtctgaaacttcactcttcttttgatgctgccagatctttcatatccaatgcctatcttactgtgcactagtttgacagccagatcagtatttcctgcttttcgaagtgcattgatcatcatcgtacgaactctcccaggtatttcacgtcctttctgtacaatgccatctgctaatttgcaggcctgcttgaatctgccagccttacacagcacattgatcatatcctcatgggccgtctctggaatcacccccattggagcaagttcatccaatatcctgcatgcccggctgaatttaccagaaagacagagcccactggcaagggtcctgaaagctgcagctgtgggagtaattcccttgtcgatcatcgcgtcccaaaacttcagtgcctcttcattcttgtgttccttgaacaaaccatcaatgagaatggtataagtatacactgtttgatcacagccatcatcttccatccgtttatacaaggcacatgcatcatccattcttcctgatttggctaatccatcaatcagcacattgtagcagtatgaatcaggcacaaaacctttagcaatcatctcctcaaatagctcctttgattggtcgaccattccagcttttccaaaaccatctatcaaacttgtatagaagatggcattcactgcaatccccttctcttgacaacttctgaagcatgcaactgcctcatctagtttaccaaagcggcacaagcagttaacgatcactccatatgtgactgagtcgagcttaagcccactatctttcatcctctcaaagagtgccattgcctccttctctcttccaaatttacccatcgagtcaatgagtgcagtgtatatagctgcattggctgcgcaacctcgcttcagcatcctttcaaacacagccattccctcgaatggcttcccatccttgcagagtgctccaatcaccaaaacataagcatgttgtggtatgtcgttccccattcccctctcctccatttcttggaacaaaccaatgcacaccggaaacgtgccttcactgtaatggcactgcatcagtgtaaggtacgtcaccttgtccggtgtgagcttcgcctgttcctgcatctcgctgagccgcgccatcgcatcatgcgccctcccggcgcggcagtaccccttgatgagaatgttgtaggagaccacgtcaggacgcacttgatcctccgtggacattgcgtcgaacacgttgacggcggtatcaagaaggccagcgttaacgaggccgtcgagaaggcagttgtagatcagcctggaaggctcgacgcctgcgaggcgcatggccttccacgcccacaggagctcctcggcgaggccgagagccgcgaggctgcggatcagagacgccgaagacgacggcgtgaggtgccgcaaggcggtgtccccgtgcgcgcgcagctcggcgacgagctgccgcgcgtgcgccgccgcggcggcggcgtcgggggtggcctccctggaggaggaggaggaggagtgggcgaaggagcggagcagcgagacgtagcagctcacgagatggtgcgggtgggagaggaggtcggcggcgacggcgctggggagggagcggtagaagtggagcgaggggagcgggttggggaggaggtgcggcgagcggagcgcggcggcgacgaaggccggggagaggcggaggaggaaggtcgcgcagaaggcacggaggtcggcggcgagcgtggcgggaggggagcggaggatgagggagacgacgcgggcgagccacggcgacggggtgggggacgaggaggcggaggaggcggcgtacgggcgggggtccgagaggtcggtgtacggctcgatccactccggcggcgggagcggcggctggtgggggtggccgccgtgggaagcggcggccactcgccggcagagcggaacgtgacagaatcgccgcattggggcgtgcgtgataggcaattaggaaccggaggaatatgttagagcatctccaacagttctccgtcaaactctacaagttaaattttaacaacttcagcacaaaatagcagtccaacagactctctactcaaatggccaagttaaatgcctgcccaaactcctccccccaaatttagccatccaatcagaatagccaaatgtgggccccaccatctctctcctctctcacccggagaaaattgacattgtgccatcctcaaaaagtgggtttcgcccaaatgccatgctggaagtgggcttcgttaaaatgccactttcaacacatggttacacgctaaaatactatctcggaccaaattaccctcctctcatcttcttcctccctccatcaccatcagctctcgccggcggccaccatctgccttcgcgcgagctctcctccatggagaaccacaggccacaggccctgcggggacccctcccatggctcccctccccgtgccccctcccatccgccaccatcccagccccgccctccgcgagcccccgcacccgtcccggccaccgccgccgtcgcctgcacctccgatgaccaccgcgccgccccttcgccatggccatgcccaccaacgactccgccgtgcgggtgcgcctccgccgcctggaagaacgggagtggctaggacggcgggttggcatgaaagacagagaccgccgacgtcggcgtcggtggcgcggatggcgtggagcgtgaccacggggtcgtcggttggggacggtcgaggcggggaggaagtggtgcggagatggaggcggacgaggcgggggttgtcggggaagaaggggagcggaggtagaggcggatgaggtgggcgtggcagaggcgagccggctcggcatcccttgtcagaggtggaagaaggtagtacaggggtatttttgtccgttcgggcattatagcgtgtagtcttcgattgaaaatggcattttaataaagc

SEQ ID NO: 60306 - DNA, 1335 bp, Oryza sativa
cagtcgtaatccatgagtaataagagatagtttgtcagcatttttgccatgatttaatgaaaatatcacaaattatttatatgtccagattcatagagtgcaaagatcattttccatcacttcagtgttccctgtataatattgctggctgcatcacatctcttattacttaattttcctcttcatctttacagaagtttgtggttaaggtagtttcccttgctatagcccgtgatggtgctagtggaggggttgttcgtaccgtcactgtaagtgctcccttttttcgtccttattgtcattgtctgttcccttgttgtagatattttgaaacatcagataccggaactgattgctttagttgacttcatacaaacatgtaaatttctatgctatatttgtcatgctgtttgctgtgatggccatagaatatagtatcagatgaaacttaaaatgaaaaagttggccttttttaacttccatggactggttttcttgccaaaaatggataatatttcagtgtgatatatcccttatacttcattcagacctgttttactcttttactaaaatgtgttagggtattgtagacaagacattggatgattggaagcattagtaacaaattttcttatgtcttgttgggcatctatttgctttgattgcattttcttgtagctcttcctttttctgaaaatgtgtagcatgtggcaaagtaaattttaagttgaggcatgtcttgttatctttgcttaaaatgctattacttttctgaaagaccaatgattcttgaacttatggatatgataatcttgcagataaacgcagatggtgtttcgaggaaattcaccctggagacaaactacaactgtggcatgaagagctggagccccagaactcgttgctggacatacttgcagctgggaaccctgatccgatggtccaatgaatctgccctcagccatacacctcccttaagcaactttcttctgtatctgactttcactagatttactgaagaactggactgcagaattatgttcagctgtgcgcaattatctagtgcaagatgcttcttgtgctgtatgtaatttcttttcgttaaggaagttcaaaaatatcatttagactttgatttgcctccttttgtggttttgatgcatatggcttgccccctcgtattggcagtatgttgcttctcttttctgcatattttcattttgaggctccatatgcacgtcgtaccttatagtcttcaactgaaaaccagactgttgtgtttattcaggcatagttagaagataaagggtgtaaagaagatttaagtttttttac

SEQ ID NO: 60307 - DNA, 995 bp, Oryza sativa
tattttaagttacctgccaccatgcatgtgcttgctgaattaagttttcctcttcattttaccaactaaacattgttgtgactatctagatatatatatgcacatatatagaattgtattaatatagctactagtactgtatatagtgcgtcgttgcaataaaactagatagttagtttaaacacacgaaaatacttttatatgacggaacatacagaaccacaatatggaaaataaccgtgagtggatgtatactggctggaaacgtggtcgtgcaccgactgatgagtgggtacagcaaactaaggattttttggattatgctttttccatgccaaatgttgttgttagtggaaaaattaagtgcccatgctccttgtgccgaaactatgtttcacacagaaggcaaatggttgagatgcatttgtgtcgtgagggtttcaaagagaattacatgaactggtcagaacatggtgagtgttctattggtcaagaagatcaagctacaacttcagcagaaaatgagaaatttgatgaattggatcggatggatgacatgttggttgacatagccggtgactatgagctttctgaggaagagccaacagcctctgcccaagctttctacagaatggttgctagtgctgatgagaaagtgcatagtcagacaacacactcctgtttatctaccacatctcgtcttcttgccatcaagtcacagtacaacatgccagcagcatgctatgatgatgtgatgcaattgatccatgagcttctcccttctaggtcaaaattggatgataatttctaccgttcaaagaaaactcttgctggccttgggatgccatatgaaaaattgatgtgtgctacaacaattgcatgctttactacaaagacaatgctgagaaagttatatgtgatttttgcaaacttctcgatatgagaatgagcatagcaaagttccacataaggtgctaaggtatctccctatcaca

SEQ ID NO: 60308 - DNA, 12363 bp, Oryza sativa
  unsure (1)..(12363): unsure at all n locations
tcctcatgtccctgtagttaatagatttcacgtagttgcggctacgcattgcaatgcccaaccttcttcattaaagtaatttgatagaaaggtgtgaagatgtgtagactagcggcctatttaggagagaccagtggcggagcgaggataaaattatagtggtggcttctcaatcttttgggccttataacaatctcaaacaaagtctattttagcccccttacaatagatatatggatttaaattttagggggggtcttaatggggctctaatggtttattaggggtagggggtctaaagatccccagcccccacgctgccttcgtcactgggagatacgagaattctaagaagttttgggcaagaatctagataagcctgattttttagtttttggctacgaatttttttctagattctgtagctacatttgagaatctgaactatatatttgatgagaaaagtcgaagatactaataccctagctagaatctcatatcaatatattgtgggctcttagacattgtcccttcacgatgtagacaaaggagcgaaggaggaactgggaaccggtggtcatccttccccacacgagctggccacatcatctttcatgtgtatatgtcgattctccatatggtcggcaagcaaatcgcttgcacttacatcatataggttgttgcctcgtacagtcacactccctccgtcccataaaaattcaacctaagacgagatattcgttgtactggaaaacgtcgttactcgttttagattgaatttttataggagggacggagagaatatatttctattaatgcttgttcattgtcattaagtacggatcgatctaacgtagtgtggtaattaaaatttgtacgcgtgactaaaagggcattcgcgcaggcgtatttgcaactgcctgtaaccgaaatgactgaaaatgttctattttcaatggtggaaaacaaaacttgtatgcaaattaaaataaacttctagaggcgacttcttaaggtaatcacaaagcagcagttgtttttcgtcttgacttcttgcgtgctaaagtattttgacatggatatctatcgtgttctgtcgattcgttccagttcattgtttcagctaaggtgtcagcgtagttgcagtgacattgttatgctttcttccctgcatggagtacatgtacatcacttcctttttcatttctgaactttgtccctctctttctctgtgcttgggttggaaggtgatcagattcagtctccttaatctttgcattttcatggcaccattaaaaaaaaggaggaacactaaatcaagctagatcgatctgtcggcatgtagctatgtagctcattcatgcatgaacttgggtactactaattgggaatttgttgttgcgtgcatatcatcagtgcatgcattttcgatcgatcgagatctagataaagatcatcgaacacaaaagctagctgcgcatcttttaatttttgcgtgcatttagctagctagtactagtatcgataaagatcatcgagacataaaagataattggtgtaacttttttttaagataatgggaaagggtttctagcatttacttcatcagaaattatagccaaattatttcaaagttagcaaaactttcgtctacatcactaaaaaaattaagtccagcataattcgaataattcgaatgacaagacattattaaaataaataatattgccaaatcttcattcgtaaaatgtttcgtgaccattgtttcaaagaccacttttattttcttaataatgaaaatggattatatcgtctccaacttctataatacacagccataaaggacaacgacttgcatgcgtgttgtatctgtactcttcacacttctacaacagggcttagaatcaaatctaatatgttcccctgtagagagtaatatatatgatttattaatagaagatcgagttaccataaacatttcattctgacttaaccaaataattaactggtgtaataatgaactaattaaagctatttagctgatggatatgcatgacagcttgttcagatgatccatcgagatcaggcgagatcaaaattaaagctactactgtagtaagcagcagtacgttgagcatgggctatgtgtcccagcttctcccctctttagcaagattggacgcgtccatggccggcagccatacatctgtacatttgttctagcccagcagcttcctgatgatcagatcatagatgatcgatcacttgttgacagttgacacgtgtacaatacaatattgaacaaaaaaagaacctacacgttgcacagtagtccgatcaaatcgatcaggcgtgtgcatgcatatgattgatgccgattgagatgaaatgaatttgacatttggaatgttgatttgctgatgatgatcagtctgcttttgatttggattctggtatatcctgatcatccatctagaaaagaaattaaagatgtttgtacatatgggcgggcctaaagacacttgtaaaaaaaacatcaataatccaaaccggtctatcactgtcggttcatataaatcgccatcaggttaaattgttggctttagattgaattaaccagctgaatgaatatatggtgatcgattttgaagcatcagtactgctggttcaagccagttatgagctgaagaattctacaacccaatgccatgggcaaacaatatctatcatttgtacgaagtgagcgtagctcaactagtttgcatggttttccttgtggtgcaactagcaccaagactcaagttctatatttaacacgggtgctcgtatttaaggttaactatatttcagtggtagacaacatactcgtcaacagcgagacgcctatgatgatttcgtcaatctcaagatataccggcatagtcttctcgagatgctcacagagataggatgtgcgtgtgtgatgacttcgtcaattttaaaatatgccggcacagttttgtggaggtgctcataggggcaaggtgtgcgtgtgtatttatagggacgagcgtacgcatattatgaatgtctgcgtttgtattgtgtttttaaaataacctatcattgttactataatcagaattaataaatatttgccctaatatataggacagagctaatggtttggaactggtatgattaaatcctggatgcattaattaacgttatctgcaatgatagaacagaatgaattggaacaatttctggtggtattaaagacattttacagtttttaagaggtaagacatctgatacctgaggtactgatgatagatatcatttttttaaaaaaaaagtacctccttctaaagaagtatacaatcacgtgctggtggatacttcctccattccaaaatatccaaaatataaagcataaccacttctaacccaaagactaagaaaataattaatatcatcttgtagtttggatcatcctaacagatacaatgcatgcatccaatagaattagagaacatgagaatggaggatttaaaaagtaataatttaatggataagaggtaatagttaatggcctacatgcatgcataccttatattatgaaacatgtaaaaaagtggttgtgtcttatattacagaatggagagagtaatttcttactatggatgaagttctcgtcatcgtgtgtgtgtgtgtaaaatgaagcatcgcccaccgtttcaccgataatcatatatgtatatatatggtcactgagagcacaaatgaacataacttaatttaatttgctactttccttgtgatatctttttttggcgatatagtgcttctgaaatacagcacctggatggatggaaaatgttgatgcatataaattaaaatttttcttttacaacgagagtacacacaaatattttgttcctgtgccgggcccatatatatacatatatatacatatacatatatatatatatatacatatatatatacatatacatatatatacatatacatatatatatatatacatatatatatatatatatatatatatatatacatgtatatttcatatatatcacaagtctagcttcatttgggcatagacataattcagcagtgggcgtctacgcataagaatattagatcattggtcccatccaaagaggatgcactatcaaggagaggccagcagcaaccaagttttttttgtggacaaaagttgcaaacgtatatttgggatggatggccatgcatgcatatatgacagcaaagtgtcctaataggcagatcatcttcgatctgtccttccaactcgttatggaatcatgttcttgcttgaccattaatccaaacatatatatgcctaggttgtagctagctaatgctctgtgtaattatatatttcttggtgatcatcattttcaaaatgatcatgagcatcatataggcacaaaatatatagtaccaatgcatgcatgtttcctttgtttatatatgcccatggctttgtcctgtgctagcttcagttactttttctaatggcatgctttaattaaggccctatttagatcttccctcaaaatttttcaccatgttacatcgaacgtttgaacacctacataaattattaaatatatactaaaaaataactaattacacagattgcgactaatttgcaagatgaatcttttaagcctaattgctctatgatttgacaatgtggtgctacagtaaacatttactagtgacagattaattaggcttaataaattcgtctcgcggtttactgacggattctataattagttttttattagtgcccgaacacccatgcgacaccctatataataccttatgtgacacgccaaaactttacgcccctggagctaaacaccccctaatatgtgttgcatgtgtgttaatttctagttgtctttagtacatcatcattgatggtggtgtgtttaattagtttctagtaagaagcttccatctttggggaataaagtggcatatatatgaaagctaagaaggcattgatcttcaaaaaaagaggctaagatagagaaagacaccgtccgattgttctactccatgcatatataggagatcatataagttctattcctctagggttctgaagaatcaactaggttagcttaattatacgtacatatgccctggtccctctgtttgctaagcatatacattaaaaaggcacatctgactttggtctcctccattgaacatttgtactggccattaatataatttgaaggtatctaggtgtagttgggttttttttcttattggtattggatacacaatttgatccattagatccaaaatccaaataatctgaccaatcatcccctcaacacatataaagctccctggaaattaccttaatttcaattactaaatatatcttactaataagaaatcaatactatgtatttcagtgtctactaagcaaatggttcttcaaactgattactgaacaggttgtttggcaagagaagaaaatatttgaaaaaacactcaattactcaagtagggtcaaaacaaggagattctcattttttttgtcgggtcttgtgaaagctaaagataaatccttacttctggaaattgggtagtaaataggggcgaataagtaagatcttgggggatgtttgggttgggaatttccaactctatatatcatttttcgtaagagaaatgtctcgatcgcaactgttatgaattttgttccgcttaatgtttcttttaggagaacgttggttggtcagaactgaattaactggtataatttaattgtcttgattttgtatactagtttgaatggatctaatgattctttcaaatggaatcttcatcagaatagaattttctgttagatcaatatatttatctttgattaataatggttttattgagaggaacaagtttatatggaaattaaaggttccaattaagattaataacttttgtggtttttgttcaaaaagttgtgatctaaccaaggataatttagcgagaagaaattggaatgggagtcaaagatatttttgtttgtataatgagactattcaacattttttttaatgtcatattgcaaaaatttctttggagaatagtttatatttcctttggactgaaaccccctgatagtatatctaatatggttggaaattggcttagtggtgttgagtcaaaaactaagaatctcatatttgttggagcttctgctttatgttgggctctatggttaagtagaaattaatgatgtttttgataaatctccaactaaatcttatatgcaagtgttctgcagggcaactttctggctccggttctaggcacaacttcaaaagtgtgaagagaacaaggagctcctattttctacatgtcgaaacttagaagttacagtcatgcatattttcgccgactacggatggagattcacaaatagatttcaataattgtttactccttatgtttggctttattatctaagttattttgttgcctgaatgtttgctctttttgagagaatataattggttgtagtttctttgaagcaatggccagatttaatcctattattttaaagaaaagtattcaagaatactagaaagatatgagttaattaaatcttttacctttaacggcaatataatactaaaagaaatagcagaaatgtataggaagaccggccattatctttagtcccgagtgaaataactgggattaaaaattcatctttactcccggttggactgaagatggacaggggccacgtcttttttcttttatttattggttttttgctgcatgtatctattcccccatccaaatcaacacaaatcatccacaacaaaattatccacaaatcatgcacaacaaaatcatccacaatacatacacatccacaatataccaatcaatcacaaatcatccccaaatcaaaaaaaaatctcctgcaaaatatacaaatcattccctacaaataattcacaaaaaaaaatccatagtcgccctttgcgcccgccgccgccggggcggccctccgcacgcgatggccaccgctgcacggctgcatcccctcccagatccggcggaggggaggccgctgcccttcacgcctgccgccatggggggtagcccaccacaccggccgccgcttggcgcggccccgcacgccacagccgccgtcaggcgcagccccatcggctcttcgtgacttagaggcagagaggggaggagcaggaggaggaggagggagaggggtagaggaggagtggaggagggaggaggaggagatgagataaggaggggagagaggggcgctgcgcgtgaggagataagggagagagagaacgcgcgtcgtgtgggccgagagagatatttagtcccggtttgtattatcaaccaggattaaagttctatatttagtcccggctggtagcaccaactaggattaaagttcattgggggccttccaactattaattcgggactagaaatgatcgatttttagtcctggttggttaagatcaaaaagtagcgctcggctttttaaccaggactaaaaaatatttttttagtcccggttttttaagcaaccaggataattatggaatttggtcgaccgacaaaatatggtttctctagtagtgtagtgataagatcagcttgagatagcttatggtgtatcaaagacaagacaataaattaaaaagctcacatggtggttggatgcattattgttttttttatattggaaatggtaactggatgcgttattgttaatagacattcatgcttttctgatagaacatgcctactcacagtatcccaacaactaatcaaggcacttaatcccaagccatacaagctaacgtctactcctccgtcccaaaataatctaatctagtacttgctaggtcaattttttttagaacggagaaagtatatatcgtctcacaaatttcaatctctgaaagcatttaaagcatccattagaaccatttggcatctctgagctagcgttcatagaacttggcttggttagactaagtacatatcgtatcatgtgagatatgcatgcatcgatcggtgggcttatttatatacatgtcattaatatttatgagagttcttgcaactaacattttgggtgaatttactatcatattaattactctctcagtttctaaatacatgagagtttgtcctaaacgtcacatataaaaacgaagagactaatttgatgttagggtttgtaatttacaaaacataaagttccacgcatggcaatcatagaagaattcgatgtgtcaacgatttcgcgctctataaaatagggagaaaatcaggaagaaaataaaggtggcatggtgactcccgaacgatcatgattgtgcacgtcatatttaatttcctcctccaatttgttggatgtagagtttttaattactgtattttcatgcaaccagattaatttgcactctctcctgtcctgaatatttgactttaagaaaaacattttatcaacattttaaaacattaaaatcaatagcttctgaaatgcttcgttaaaataaaaggaaaaatcgtatacatggatttgccttgaaaagtagtactatgtattaaacttattagatttattctaatgtagaattgatggtcagagttcgaatggtttgatggaatcatgtttgcaactgtcaaatagtattaattatcagagggactataacacccccactatatattttatatatccatccaaacatatgcttttgttggtgtgtacttaagttattacaccctaaaaggtagagattccaaagaaatcaaatgcttgcatgtcattggcaccggccacttggtcaatgttttcatgttctcttatggttcactcaaaaaatcagcactaatagttccggacaaccttctctacttgtcattaaaagctgccagaaagttctgggcctcttgccaagaagttccgggctctatatttaactgctaaaattttaagtaattttcagaaacatatattcaacccttaggtgatatctccgggtttcagaaacaaggggacatcatatccccttgagagaaaaaaaaacatctacccacactggggtggatctatccgggtctagggtagttagagttcaagccataggcctagaacccaaactctatgcaaattccatttaaatatcagaaaatcttaggaatttgtagagagtttggataagatcaatagaactgagcctatgtacccacatgcctgcatgtatgtaagcaaggacttatttttttttctttttgtcttcagtcgttggctacctaattaaacttattggaggatcacatcgcaaaacctaatcgatcagctgtttataacgaatttgttcgtcaatattccacacttccacaggatagctagctaggacgaaaaaccaggagctattaggcatcaaaccagaatttgttgtacatgctttcttccctcctggacgtattcttgagatcctaattaaagacatatattctaagctacattattgtggatgaatcggcaacgtgcagtttatatttttgaccagatggtattcatgtccattgtacatctccaactttagaaagatcacgctgactgaagtagctgaaccaatatgcaaatattgtaggaaagcgatagagagtgtaaaaaaatcgtataataaatctggtcgtcggctacattattcaaacatgcatacaaattaatgtatgcatgtcaactccagccaatagtttgtcagccatatatatatataccgttaaagaaaacggcttgctcatcatcatcatcaatcgtagactttgtcatatactctctccatccctaaatatttgacaccattaactttttttaaatatgattgaccgttcgtcttattgaaaaaatttaagtaattattaattattttcctatcatttgattcattttaaatatacttttatgtatacatatagttttacatatttcataaaagtttttaaataagacgaacggtcaaacatgtttaaaaaaatcaatggcgtcaaatattttacatatagttttacatatttcataaaagtttttaaataagacgaacggtcaaacatgtttaaaaaaatcaatggcgtcaaatatttagggacggagggagtatatgttgcaagtagtattcgtttaatatatataataatccccctttaggtcacacaaaaaacattatagatttaagatcagagaatgctggccaccgttaattaattgatatatatctgcatatgccgttctacatttcatatttaatttgaatatagttatatatgctctcaagttgatctggacccatgcggcatatatacaatgttccaacacactctcagtcatcaacatgtactaaaagaatattcaagacttaccctaatcacatgcatgcatgtctctctctaatttgatactaatctgatcaccttttgcgctatctaacacgctacacattcttaacatatagctaaacaggtgcatgcacacatgaaattcaactatataagtatatatctttggccacttgaattggaagaattggaagcattgtcaccttgtggctgtacgtttatatatacacgtgttcgatcatatattccatacacggatacactgtacatgtgtgctgcacccacattcatatatataggtagatattacatatgcattgatcacacaacacacatgtatctcttgtagctttcattttcgtactaggtgcaaatcctcatctgtaaagaaaggtagcatttttaaaaagggatcgaattaaattaaaaaggttggagatcgatggagatggaatttcgtcccatgaggggatgtcgtccctcgcttcttcaagtcatggcatgttctccaaatagtaccaaatagagttcaatgtgttgtttgtgttacaactcatataaatcggatttgaacttgtattcatataaatcggatttgaacttgtatcgttcttgagtgatatattacatataaaccgatttacatacctgattaactttttaaaattaaattataaccgtttagattatatgcaagaaactatatatatgacatctcttaaggagcaaaattattttcccatcgatggatatgaaagcactcagtttgtcggtataaatagctatcagcgtcaaactatccgttaggaaagacatttgccgacacgcagtctaccaccagcatctacgagggatctacagcagtcgggaaaagtttttaccggcagaatgatccaaatatatatcactgatctgcatcatatcgtacctgatactgttcgaaaaggccggcatctatctatctatctaactgcagctgaatgatccgatgcagctgcagctggtatatatcgagcacctaaacccacttcgatctgcaacttgcagggaggcaccatattcgattataaatttcgttttattcgatcgatcgatcaagagagagcattagcacatgcaggcacgcgtaaacgtttcagatggcgacgatcgaagacgacgacgacgacgatgatgatcgatcagttgctctgctgctaatgctgatcagttgatcgatcgatctttcctatcactttcgcatgcagagaattaataaagtttagttgagatcgatcgaatcgttttatgttgttgttgttttcttcggtttggaattgattaaagtagtatcagtactaatcgatcgcctgatgtattgctggagatttttgttgttttggcgttcatcctctgtgggagaaatttataaaggactgatcgatcacaaaagtgaaagtcggtcgtcaattaattaattaattaatccttgttgatctcacatgcagtttgagattaagcttgcatgtgtgtgctagctattaaaaataaaacaaaagacttacttgcatcagggtttcccttactaccggttatcgtgatacgggcttaccgtcagaataagatcacggaaaatgcccgataattaacccagctaattaagttcaaagagaaattgcccccggttttcctcttttagtggnntttgtctgnttttntgaatgttttctcccttcccttgttnctgntctgtnntgnngtgcntagncagtnnatncatncaatcccaggggggtgcggcgtgnaatgaatacacagagaaataatatttatccatctccaacgctatatcataactaataacagaatagataacacgtacattcacgaaaaaacaacattaacgcctactanattataaca

SEQ ID NO: 60309 - DNA, 3300 bp, Oryza sativa
ctcgcgcacgatggttgtcttttgctgaggttgggctattttggatctggtagtcaaagagctcgactgtgcttcctcgccgagctccaccgtccccgacatccgcagccagcccgcttggcggagccgacgacctctggaaaaaatttcagttgctacagtttggttaccggccacactttatcatagtttgtcatagacaagtttgatcaacttaacaattgtttggttgaagccacactttgtggcagggttccaaaaaaaaaactaagtctcataaatcaatgattttagaaaagtatggcaaaatcccccttagctaaggtgtagcggtgaaatttgatcaattttttgttatacattgtggctaagtgtggcaggcaacacacaccacctcaagtgccaaaaacgccaaactaaattgtgtgtccatgctaaagaagtggaagactttcgtgctagtttctcatattttcattcggttacattgtacatctaagagacaatgctcccattatttttagatcatttataggattattgccactaattatttactccacctatttaaaaatatgtttcttaaaatactcttttctattagattactagaccacctgttctaagccaatttttaagttactttaaaaaaataatttgtagctgtaattaagtagataatccgtagcaataatttgttaaataatatgtttaaatgggccaattctaaataccctcatcatagtgcacttgaaaggtatccaaaactgacgctggaatggctctttgacaaagtttttttaattgttggctcaagaggtgagttatctagaggaataaataagatattgtttcatacgccactaatgttcttatctcaatactgggcaatgatggaaataacttggaatacttctatgtgaatataaatgatgatgatcgaggcccataaccagcaccaaggaggatgctttatggaaaaattattatcggtaacttggaacttctagaagcagagaaatgagttgatttttatcaaaagataccttattctccttcttgaatcattgtactgttattgttttaagtttctaataaaatactccctccatcccaaaaataaccaattagccaggaattggttctttttgggacggagggagtatatcctaacagtcaatggcggagacaagcctgagatagttagagcttgagccctaggtttgtatcctagactcctgtttaaatctttaaagcattggtgagaattttgaaaatataaggtgtatatataagtcgaaccctactcctacagagtttctggctccgcccatgctgacaacggggcttcctttgctcggttctcaaagaaaatattcttagctcaataaaatgttataaacatataattaaatgccaacgcagatctccttaaaagcttattgtgaagctattgcccaaatgttaaaaaagatagtttgcttttgaaagatcaattagatgccatgtcaattgaaagtgcacttataaccttgacatcttgatcattataaccttgacatcttgatcactccaagcagctatgcctatgcagaggttatcctctgattttgtggccatatgccccctttacctttttgtttttcgctgttgcagttttgtttcacactgccagcctgggcccaccccgatccctctcgtctacctcgagctgaccctgttggtactcgtatcgtcgggtttctgaattctgatggttgaggtcaatttccctgaaaccaaatttgttggcacaacaaaaccgacgacagcatttggtcatgagataacatcatagtcattcaaaacgcaccacacgtgtcatcttccatttcataatcaatgacaactacagttcatatagattacatgttcttcctttcacacgaaattcgaatcctatttagtactaacagagatcacatatcattccctgaaaccaaaaaacagaggaagacattgacatatggtctacgaatatgattcctacaagcttctgcacttattagtagtagaatatgattcctagttcctacaagcttctgcactaattagtagtagaacgcagtccttgtaccatgactgataaagatacgtttttcatgtgtaatttctgaaaaataatacttcctccgtttcacaatgtaagtcattctagcattttccacattatctagattcattaacatcaatatgaatgtagaaaatgctaggatgacttacattgtgaaacggagggagtagtagaattgagatgcagcagcacacagatagaataagagttttgttgagttcatcagttcctagtgtaccccagccttgcagcaactgaaactttcttgaaagaaacagaattgtaactgaaactttcttgaaacagaattgtttagttcaccaagattcagaactttggatttcctttagcaacagaacagagaattgtgaatttctgattgtgatctgaacacttggctcaacagaaccaatggaggcatttggtcatgagattacagagacaaaaagattgctcaagtacaaaaaagatgttatcttttattcataatcaatgatttatacaattcatagattacatgttcttctttccagttaaagaattcatcatcctatctaatctaagagatcacggtgccttccatgagaccaaaaaagaagaggaagacaagagacctagtctgataatcttgattcctacactagcttcttgcaatagttagtaaattactaaattagtgcactatatactaataatcacaatgccaagaaatcttcagcagcggcggcggcggcgttccggccaccggccgccgcagaactcgcagtgctattcggcggccttcctcttgcggccgccggagcaggacggggaggcggaggccgacgagctggaggacggcgaccccgactccgagcgacgggaaggctcgggggagcggaagatcttgcagagcacgagctcggcgacgccctcgccgccgtgttcctgggcgacgccctcgccgtcgtgttcctgggcgacgccgtactccaccatcatccatcggggcgccacgacgcccgccgccgtcctctccttgtacctgaacctctggcagtacccgcctccctccaccgccttcttggcgcccatcgagcaccaccgcttgccgccgccgccgccgaccgcgcgcgacgccgccctcttggatccggcgcgggcgcgggcgcgggcgcgggggcgcacgctgaaaaagtaccacgcct

SEQ ID NO: 60310 - DNA, 694 bp, Oryza sativa
tctatcaaccttgttgaactcctcaggactcaaggcggagagaattgcattggaagcttgagcattgcgatggatgagttgctcttgctccaaagtgagctccatgtcttcatgagttacgtcaatacctgtacaaacaactttcaaatacttggatgcaaagagattagatacaactttatcttgtgcttccaagcggcgtaatgtgtcccatcaaattgaggagcacgcccggaaggcacggagacgaagttgtgagagggaatggtaagtttgctgtaatcaaaaggtgtagtggctcccttgggtgatggtgttcccttgctgctcgctccatcttcattaccaatttccccgtcctttccacctaagtccgacatcgtggatcactcaaagcggtgaagcttgaatcaagagcaccaggctctgataccaattgaacgtgcagagatgtagcctagagggggggtgaataggctttcctgaaattttctcaacaaacgcaacggttaaattgacagggcccggaacctcctggtgatgaacaccggaacttcctggcagtgatgagtagcccggaacttccggagtttttgagccaggaacttccgggcaacagagataaacgaaatatgagaagaaaaacaggtcctagctagggaaaatcaggcacagggttgcacaaggtaaaaat

SEQ ID NO: 60311 - DNA, 11563 bp, Oryza sativa
tgtcattatatgatatagcaagcaaatgtataaatatcatagtagaagagtaatataatgagaaacctgcaacttttcaaaaacaaaatacctgaacgtcatcattaaacatccgataagtcttcctgtaacgctgcaacaacctgaaggcccacttgctctggaaatcttcaaactatgaaaaaaaagagagagaaaagcatcagaaaaaaatattctagctaaagccacatgtaacaacaaaggcaagtccaaagtaacactaaaatcagaagagaacctgtacaataacattcggccagcgagcgaaaaccgcttccataaattcatcgataatcgctacatattcttccccctccagacgatgttcttgtaacccaagatctgtatggtttataaaagattaacataaaaaactgtctagaataattcttaggggcgaaaaagctatccattctcacgggctgttaaatattacaagtaaacacatgtttacaaattacaagtgtcttcatttgctttagagaatagaggctaactgtgtgtttgatatgaaaaatatgtgataattagaagcttaattacaaattaaactacttcaaattatacaacacagaaatattttaagaacaacttacacagaggatccttgaggagcttctcattgtttgttcccacatcaatcatgaccggaagaacctagaaaaaaagtgaagacagttttaaatcaatggtaaatataaattctgctagccacatgagcagtaggcaaacaacaagaaatgaatagcagtagagtacttatagaatccataacatttaagcactaggcattggtaccacttttgctaaggtacagtaatttaagtcaatgtatcttaatttgaagctttgttatttttccgaccctatgaattcacactttagtaacatatttcattttagctgtgtccagaaatgagtcgagatagtaaaactctagcaggtattttatctccccaatctataataaaatgggcctaactgacacattatcacataagtagcaggaccatcattactgatcaaacgaaatccctatagatgatacatatgaaactgtatttttagcatccactaatagtttttttaacctcttcagcaaacaagcttcactatactttcttagtttagctgattaactcctgcaacaaaagtcattacaaaaaagcacgggagatgtaaaattagaagagggagaaagggaagagtctaacaatcttctaaggtaccataaaccaaaagtttttaccctctggggatttattccagcagcagcaacatatagatccaactttccaatggcaataccaataccatgcaccccgagatcacccaggcccaatatcctgcttccatcagtcactactatcatgtcaacctgcaaaggaacggacatattttatttactttgagattatatgacattttttttcttgagagatgttcaaaaatcaaaagcaaaaggtagactgtcttatgctctgagatagcgttactgaattataccactaaagattaaaccaatgaaagagctcagctgctaaatgtaaaatcagtaactggatgaacacaaatgagtacctggtcagctggccagttgtacaccatggacatcatttccccacgatcttctgcactaaaatacattccccgaggccgtctaaataaaccactatagttttgacaaacaagtccaacagtcggcgtgtaaacaataggtgcatgttcctcaatattatctattaagacctattaaaaagatgaaaaaaatatggaaatcaggtaaccactttgaaaaggcacacctcagcctgctaaagttaacaacaattgagattatagtagaaacgaagttagcaacgaacatgtgtaatcatacagtgtcccgtaaacagtccaaattgtgcgtattaaatggtgagagcatacatgatcaatagaaataaggttgcacacaaatgtatgagttgtaaagttacaaaccttgtaatacattgtttcatttctgtcatgcagcctgttaaggatacgccattttgctaacgggtaagtatccgatgggccatctctcgcatatttctgcagccgttgcatgtcaagcactgttataaaagtgaaacaaaaaaagaagtaaatgaaccgctcacatcagcattcacgcagtattgtgatgattcacagatagctggtgaaatgttcaggtaatttagtgctaaaccctttgcatctatatgctgtatctctgagtggaacttgtactgatacttcagagttggtgctgtgcaagtgtgtggatgtttgggcagtctttttccgattgaagtttgtgagcataattctaaatgtgcagttgtctactcaagttggttggcccagaaaggacgatccaccttttgtgaagggactttttttagtccagatcaaacgtgactaaataaatgacgattgaaactttctcctagaagctggattataccatgtccaatcgcacagatcaaacagaaattctatctgacggttctacaattgatgcatgcgcacatacagacagtcagacacacagtcattcactcactcacttactccagtgcctgctgtcaattataggtaggtaagctaactcattctaaagctcaattaggcacctagtcaatttacagtttggacgtggccaatcaggcacaattcctagctgaaaaaagaaaaaaaaaaacaatcccaattcgattcgacccatgacgattcaagcagcaacgaaaaatccaaaacaaatttaaggatggaagagagagagagagggggggggggcgcgggtgccgcgtactgaatcggtcgatctgctgctgggaggagacgacgttgggcgggagcaggccgcggaggccgaggcggtccctctccgtcatcgagaaccccgtgccctgcaggaaagccacacagccaaaaccacccacacgcatcagaacgctctcgcgccgccgcgagggaagaacacgagggcggaacgcgagcgagacgagagcgtgcgtacccggttgaaccatgggtcgtggaggatgtcggagccgcgcttgtggagcacgacggggcggtggcactccgccgtgacgaagccgcgcgccagcaggaggaggtggtgctccccgccgccgcagcgggatcggcggaggaggctccgcgagatggacgccgccgccatcgatctcactctcacactcaccagcgcgatgccgcgttcgaattattctctctctctctctctctctctctctctcttccggctttttgggggaggagatgagagcgagacgacgcggcgcggcggggggatctgctctagctgcgcggttgcggtctgcgcgacgaggcgccgacaccgcgacgcgagaggccgggccgtgcgtgcgactctccccgcggggacggacgactattccggtgccggttcggttgatctgagcttttgcgttggtacggcgcgtgggtggcaggtccaggtcagtcagtcgcggccgggaccaggcgtggcctgagatggggcggagatctgccgggattactcgttcaaatgtggacttcttttttctcacttcagatggcgcattcattagccggcaattcgctagcccataagacgggggtggtgcatacgcaggagaggaggaggcagcacatacgtgagggcgacacgaaccgtacgatgcattgccattatatgcgacacggtctgagactagtcattcctcgtaaacaagcgatttattaatatttatatttttcgatgtccatatagccaatcttatgtggaagaatagagaatcacacattaaattcgagaaagtcagtaagaggataagttgttggattgaaatatgcctatcaaaaataaaaattttagatttggaaatatgactatcaaaagtagatggagggagtatatttttttaaaaaaaattctataaaaaattgtttaaaaaacatattaatctatttttcaaaaagaactagttaatactaaattaatcatacaataatacgtgtttcgttttgctctcgtctcttgtgaggtcggctgctgcgagctcaagctcgtcgacaaggaagggggtagagagagaggaggtggtaggggaaggggataaggagaccaccaccggctacaaggaaaggcggcggagctcgaggggcctaatgccacgcctcgttgctcgcatcccctagcgaggccggctgctgtgagcttgagctcatcggcgagggaggagaatggagcaacgaggaagacagcggttgagggatagggatgaggacgggaacggagacggtgatgcgacggagatgacatagatcgtgacggagtggcatggttctaatttatttaaattctagtggcatgtactccaatatgatgaatagtagttgtatttttttaatttgccacatttgcagtggcatggatccaattaacccataaaattatcactggtgagagataatttcttataactatttaccactgtgtcttaccagcatagaaagcagcgtgggtcccatgagtcagcctcttcatttttattcttctccaccatccaatgatggagcacgagttgcttctccctccatcgtcgttgtgtccccatggcgactctactgatggcacacctagcaaggataaaggattctgacaagctattcttatgtaaaaacaacccgtctcattcgattatgaggttcagctctaagtcaaccttgtctgcatcgtcgatggacagattgatcgtagatggcggtgcgggatcggaggacgaatgatggctcaggcagtcaggctccttcaccggccggggagaagaaggagaaggaagggggtgactcgtgggatccatgctggcaagtcatagtggcacaccacgtaggtaaaagtggtaaataattaagaaaccatctttctccagtggaaattttgcaagtgcaaacctaataaggatatttgccaaacctcatagtcgcaaatagttaaattccccctaaacaacattgttttttttcttttcctttttttttggaaaacaacaattaagaacctaattacatatttgctaaatttggctatcatcaagatattccatcgaaggtgagtttacttttacaacaaaatatatcacgaaaacaagctacttttgttacaatattttatggacaagataaaagtcgatctttagaaaagacactttcaaaatatgaatatttgttccacacaacatgtattaaaatattcattttcaatataatagcatagagaaaaaaaggcaaaagacagaaatgcacagggcccaaactcatgcccttagcattttggttgcctcctcctcggtacaaacatactacggagattttcatccacttcaaaatgcagtgaatggtgatgcgcagataaagtaaagcatcgaggcaagtggctgcaactcttcttcatggagtaaaatcaacaaacacatagctatagctagcggcaacaaagaaagcaaaaggtgacaacagcgaggaatcctctgcatgtcttggcttgttcggtcattgtgttcctgctccacaccacacgtatcggtactacctcgccgccttctctggtcgtgcgctatcgtaccatgccagtattgaggccgacacgacacacaccatggggcgcacgcgttccagcactccttgacgtcgtcgtacttctcctcgacgacacaaacgcccctttgctttattgttgtcatcgtcatggccatacattcctaagaggctcacgtatgctgcaaatgaacagcaagctgcaagcggttgaggaggttagtgtagaccgtgcgtccatgccgagcgcgacaccacgtatgccgaggccaagcttgttgactaggacgaagttgatgggcatgaggaggtgctcgtagcttggtgtagcaggtggaaatcgagccctcgcccatcccaagtcaagtattgttcacactaggagaaaaggaaaaatagagagcaagaggaagaatatgcgtgggtctacggtggttttgacttttcgtgttatttctctctcttagtcaaccaaaattaaatatttgcaaatatcggtagcaaattatcatattttgaaagtgtcttccctcaaagatctaactattattacgtctaggagtgtctttacccttatgtctgtagagtatctttcttcctttacttaacatttacgaaagatggatctagttggataggggctgtcaacataggccggagttgtcttggtcttttcaaagggttatcatggtgagaggcacgtttgagtcacacctaaagggaaaaggtatataaattattagggcaaccatgctcgagaatacaataagtaaagcttatgtatgaatatatcaataaaataagggtaatgcattttttacgactaacatggttgttggtggcgagaaatgagttcaccacaatctggctaatggtgccgtggtggaaggactcgtgatcgtgtgtgactggtgttgtcgagctgcaaagcatggccaatagacaacacttacgtgcataacaaaaccaagtgtcaggttatcagcaaaggaagaaagaagaaataagagatcaacacgttcatgggtatagccaaacaaagaaagacaacacacaagaggtgggtggcatatatccttgagaagccattcagcgagcaagaatagaaatagctgatgatgcattcaaatctatcactttgttaggcaccataagagaaccatgttagcgacaataggttttaacgaatctatcggcagctgcatgcaatgaaaaagcattagaatcaaaaggaaaataattacataacttaagcagtcaacaatcgagcgaagtggtgaaagatgcattaaggtgcaacacaagaaaaagaaaaaaggaacacgtgccacacaacgacaatgaccaaaactagtaggaagcaggaatcctaccaagaccaatatctatctattctaccattcaacttggaaacctatacatattcctaattattatcattatattatgtgaaacccatataattaagttgtgtgtattatctcatactatttacttcacatgctcatggcaacagttacagaaaaagtatacattgcactataaaacattgtagtttggataatggcggtgtgatgtttatgcttctaagtgtgccattaaaaaaccaaaatataccaacatgccattgtcttctcagcattctcccttctttcctggggatcctctgttgatttttatgatagccatcgtcttcctaacatcccttcaacaacgctccatctctcacttccaacaacgctccatctctcacttgcctcaaatgcaactaaagaaagacgtgcagtgacaatgatgtcatcatataggatgtttgattggagcaatgtctcaatgggtgagaagatgaggcatactcgatgctgtcaatgcaactctaatacccataagtggtataccaagttgccttcactgttacaaatccaaatcagttttgattgaagacacacctattgtcgcgaatactgctaaccctcactcccgagatatgctttttctacctctagttgtatctaaaagagtgcctagagagctgcattgctagctttggtggtaggaagtgctaagtccgaaaaaatgatttatgatgaaatgtttaactacatcttcgtaggaagcgatccaatatagttactgtggctacgactgttatggctggcataacaaacacaaccgtggctgcgagcctatgactttatttataaaggttatgtaagatgaaatatatttttattttttctgaaaatgaaagcgaaacagctggaacattttgcgctccctccagcccacccacgtccaaactccaaacgccaaacgaagcaggcttcgctccgattaaaaaaaaaaggggcctccttctctgcttggcggggcgggcggtggtaataaccggcaggcagtcaggcaccaatctcggagccaaacaacgcccatacgacgagacgagaagaggagaagcggagcgcatcgctcggtcttccttccttccgtccgtccgcggggcacaaacgcacccaccacccccccataacgcgcgagatcccctctccgccccccctctcccgatccgccccgccggatcccgccccgccccgatccgatccgacctagcccgcctcgccgccgccgccgtcgccggccggagaagggaggaaggagaaggagaaggagaagaagaggaggcacgagatggcccccgtgtcggcgctcgccaagtacaagctggtgttcctcggcgaccagtccgtcggcaagaccagcatcatcacccgcttcatgtacgacaagttcgacaacacctaccaggtgcgttcttcttctctatcggtttcgccgtctgctcgcctctcttcggggggttggggttggatctgatcgggggccagatccggcggtggcgccctggccggccggccggccgatctggaggagaggcggttgggattggatctgtgtcgtgggttggccgctgactcggtcccgtggcggtggtggttttggtcttgttgattatttggacgtgatcctctctgctagtgaagttgaatcagcagtatctcgtgtgcgcgggtgatgtgatggtgtcaagcaaggcgtgatctcggcggccttgaggagagcgagcaattaagcctcgatcgatggcatggcgggatccaagtgcagccccatgatacaaatttacagatttacagggagcttaacagtaggcaatttcaacgagaatgggctgctgcattcagaatgtggtctttggatattgaacttgggattggaaagcagggaacatgagccttgtgaatgtggtttttcttcagctacagggcattgtggaattcgtttgggatctgggattgcaatttttctctgctagattgcacatgccttgtgaccggcgcacttatgccatgctgtagacaagattggggatcatctgttttcacattattgtaccacattgagacatccgtattcggaatggtgtctggacgccttttgatacatcgaaaagatgtccttcctcacgagggctatttctattctgtatgatggtgggaatgatgatgctgtcattatactattgcacgcttattttgagcattatatgtcactgcaatgtttcagttttaatacttatcttaaaatgtttcagttttaatacttatcttatctggtcgttatgttctcatgatttattctattttgcgaacaggctacaatcggtattgacttcctgtcaaagacaatgtaccttgaagataggactgtcagactgcaactttggtatgatggcatcttttgctgcatttccagttagttgttctactccttgggaatcggcaggcattatcttatgcattttgtatttttttttctgcagggatacagctggtcaggaacgattcaggagtttgattccaagctatatcagagactcttccgttgcggtcatcgtatttgatgttgcaagtatgttctctcatctccatgtgcgcacatgggtggcatgtgtgttctcactaactgcttttatactagcaacaatgcagcagaccaacagagaattgccaagcaaatttgatggcacatgtcaacaaattatgatttttaatagcaatgtcatttttaattcgttttgcattataaaagctctttcctatcctgcctcctttttccttaaatttgttttacatgctgtaggcagacagtctttcctaaacacttcaaaatggatagaggaagttagaactgagaggggcagtgatgttatcattgtgctggttgggaacaaaactgatcttgttgacaagaggtgagtggagttcaaaaaaattcttgttttctttagccctttcctgttatcttgcttatctgatgattttgctgttaataatgatcctctttaccttctggattttacttggtgaattttattttgcagcagtttcatttgaatgcccttgtttctgtatgatgtcagattttgttcaccatatgctttatgtgttactgttagtggtgtactggtgtttaccaaacatttcatttatttgtctcatgtaagacattactgaattatgatttctagaaatgcattctaccagggttagtagagtaaaattaagtgcaatacctgctgccttaatttttttagttgggttcccaaccaatatttctatatgatgtcaaatttatttctctagatgtctttgattttatggtgtttaccaaacaatgcaatcttattatgtaagatagaactgtatatttacttttgatatgcagttattacgcgatgattgaacagtacgataatttagcacaaaactcactaccttataattttagttggatcaagctcaaggtttgtgattcaaaacaatgccatgtaatgtgagtgtatgataaaatgttgacctatgcccacttgttattggcattgttatgaactacaaactgtaggctcacatgtgtctaaaagtctgtttaattctagatatttccttgtttcatttatcgctaaacagataaccacaacatgtgtgattcaggaaaatttctgtcaggtccctaaaaaagtcagaccttgctataattccaaattatcgtggcaatttccattttttaggcaccacttgttgtggcattggcgattaagatacatcaatttgtggcatcagtgccagttcttaaagccaatcttgttttggtgtgaatttttggaataaaatgtgtatggccagagcttcatatttcatgactgcagcttctgtgctctttaatattattttccatgatagtttaagctgacattcattttgaatctctcagtttaattttaaatattatgtgataacttatttcttgctgttgcttttgtgctggtggactcatttcctgctttagcttcattagattaaatatcatcgatctccataaatttttatgtaaaatgtatatattgttgagtgttgctgtcaattttaagtcatgtactttctcatgcaacaggcaagtctccatagaggaaggagagggcaaagcgaaagatctcggtgtgatgttcattgaaaccagtgctaaagctggttttaacattaaggtgtgcttaggaaaatataaatttcttgcatatcctttgtattacatcaggagattagcacgcgtgtagatctggcacattttcagaaagttcaaaatcgtgttcttttatttgggagatgctgaaatctgaattatttatgggttacatggggataatttgttctgacattttttctcatgctgatcaggcgttgttccgtaagattgcggctgcacttcctggaatggagaccctctcatcagcaaagcaggaagacatggttgatgtgaacttgaagtccagcaacgccaactcatc

SEQ ID NO: 60312 - DNA, 4591 bp, Oryza sativa
  unsure (1)..(4591): unsure at all n locations
tttgaatatttagggatgaagggagtgctttaaatgtttctaccagaagagagtaattaatactcctgccattctataatataaggcacaaccacttttctaaaggttcccataatataaggcatacatgcaagcatgtatttaactatgacatctttntcctttaaacttatactttttttaaatcattcactctcatgctatctaatcttattggatgcatgcattatatttattagaatgatccaaactccaagatgataataattttttcttggtttttgggttaatggtggttgtgccttatattttggaatggaggaagtatatttaataaaatagtttggcgtaatcaaatgacatatcaaatgtcatgactaacgttgagaaaaagaatgggacatatatcatcaatatcaaaccatctaggaattaatattttatccatgaataagtttaggtaaattgatcaaagaccacgccatactcggccggactcacatgtaaaccccataacttagtggaacattatcctccctatcatgcacgaggttttccttatggttttggtgagggttattggcttatcgctattcagtggtaaccgcatggttatcgtgaaaaccatgaggttattgttagaagccatgagaggttttaaataccttggtaatcgtgataatcgtgagattctgcagtcatagtaatgtatatttattgcatgtattgacctttcatacaagagttttgttggtacaatgttatatcctatattattcactatggttaatcgctatgctacactcagagtataatataaagtaaatgtaaggatttagtcaatgatacggtggatgttctccaatactttatcattttatttgcacttaagaaatgtttagattcgtcactgagcatgtcaacgacacacaaagagatgttatagataaaaagttaaaaaaaaccgtgagccatatataacccatattaggatcaccagatccaacaattaattattagataaaaatattccacattaaaatctcaagtaccatccaacccttcggcaagtaaaaagctaatccactttatctaccatcttaaacttattagtcgacgagctacaatatatttcaccgaccgacaaacttataaagaaaaaacggtggatggcgcgcgcgcacgagtcgagcacgagcaccactatgcacccttcgtcacagaagatccggtgcccccaatggtagtagtagcagctgctgctgctgctgctgctgctgcttgctgatgccaccacgctaaacacacccccaaaaaataaaaagaaaaaagaaaataaaaaggaaaaaaaaaggaaacgaagcagagcattcacggtgtgcactgcagagtgcagagcatcgcaccgctctcccgccaaaaaaaaaaaagctggtgggcccacccctccactcgccctcctcttcccgccacgtgccccctctccaccctttccacccagtgacgtggccctcataaccttcgcccataaatacccctcccccttgccttgctcctcctcggcctccactccaccaccacctgctccgccattctcgccgatcagttcatccgatccactgctttgcttgcttgcttctgctaggtttgattgcttcgtgtttgattgcgcggtgagatgcctccgaatggccaggacttgcatggcggcggccgccgcggtgtagtcgtgctacctcctcctccttcgtctccggcgacgccgcactcgccctcgccgtcgccgccgccgtccaagatggactgcttcttgtcctccgtctgcacgccgctcaatctccaggtacatatcgatcgatggtacggatagatgctgctctgtgtggttgaggtgattgattgatctttggttggatggatgcttgatgatgtgctcagttcatcgacgtggcgtaccgggtcaaggtgtcgaccacggcggcggcggcgaagggggcgccgccggggaggatatcgcacgccgggggaacaggtggtggcggtggcgcgcaggaggagaggacgatactgaaggggatcaccggcgaggcgaggccgggggaggtgctggcggtgctgggcccatcggggagcggcaagtggacgctgctctccatcctcggcgaccgcctcgccggtcgccacgccgggacggtgctggcgggcgggcgctcgccgtgccgcgccgtgcagcggcgcacggggttcgtggcgcaggacgacgtgcttcatccccacctcatcgtacgcgagacgctcctcttatgcgccatgcttcgtcttccggacttcttactcgtagtcgtcaaggccgccgccgccgaggccgtgatcgccgagctggggctcgcgccgtgcgccgacaccatcgtcggcaacgcgttcgtccgcggcgtgtcggggggcgagcggaagcgcgtcagcatcgggcacgagctgcttgtgaacccgagcctcctcgtcctcgacgagcccacctccggcctcgacttcaccgccgccgcgcgcctngtcgncacgctctcgtcgctggcgcgcaggggccccaccgtcgtcatgtccgtccaccagccgtccacccgcgtctaccgcatgttcgactccgtcctcctccttgccgaggggacctgcctctacttgggcgccggccgcgacgccatggactacttcgccgccgtcggcttctcgccggccttccacgtcaacccccccgacttcatgctcgaccttgccaacggtaattaacccaaaacactaattatactctattattattactttcttactttattcaacaaaagcagggaaaaaatcaggaaacataaatttcactaaatttgctcaatttgaatgaggatcaaattaggcaagttataaatcaagggattatcttttaattgggtgtagtagatatgaatggtgaggattagaccaatgatcacaaaggagacaagtaaacacacctggagagtaagtgtggagtgcacccaagaaaaagttcatgcaagagaggagataaaagttttttgaagggagaaaaaaaaagaaagagtggatggaggtgagtgccctagccttctcaccttcataccttttgtgcaaagcactttatggttgaaagatcacacacccaactcaactggacacctgtcatggatggaggagagtggaattagggcactatctaccttaccttaccagcatcagtggggctggaccgctgctggacatcactcatatcgggcccgaacccgctaccggtaaacccgctagcccggtcaccgaacggcggccgggctagcgggtaatgtcatattggatatccattctgtttccaccaatcttgttggttgtggtggctgcagaagatgatgagatccgacactagtggcagctttcagttggatctggttcctttgctagcttaattagtagttagcttgggcagcttttttttaagtatgagaattagcagcttctcttttaccttgggatcaagcaaaatcaatggagcatatgggcatgatatgcagtgtggatatggttccaagtgcctgtctcactagactaagaaaattatgctcccccctggctcatggtgatggcactttagacagaaggaatcatttttttggtaccaatacttctccttttggaagggtagagagctaagctatccccctttttggcccctcctttggcacctggccacttaagtaagtgccttgtagccagtctagcatatcaaagcaatggggcagagagagagagagagagagagagggtgtctccatgatccgattatatcgaggtcaaccgcgtcgtggcacgattgggtctaccgatccctaggtggagggggagcggcgttcatggcccgatcaaggtcccgtttggcagaactcctactcgtttggaagccatatcgtgcactatcagcttgggagttgggaatacacataaactgcaaaatgcgcagaaaaacaatttaaagaaaataaaaaacaaaaaacaaaaaggaaaataatgaatggatggaattttcaggagtgattattttccattgtgcctacctttatttgatctttttctgattgttactacattgttaagaaattatgatcaatcatcctacttatgatctttgacactgaacatttctgctctgttttttttctatgcaggattcgctcaaacagagtatgataattgcaacgcagccgatggcggcaacgtgaagcagtcgctgatctcgtcgtacaaccgagtgctcgcgccgcgggtgaaggcgtccatcaacgccggcgacgtccacggcggcgagcagcagccaccgccgccggcggcggagagctgcagcgggtgcacgagctggtcgaaccagttcgcgatcctgctgcggcggagcctcaaggagcggcggcacgaggcgttcacgtcgctgcggctgttccagatcatcgcgccggcgctggtggcgggggccatgtggtggcggtcgtcgccggcggcggtgggcgaccggatggggcctcctttctttcgtctccat

SEQ ID NO: 60313 - DNA, 21345 bp, Oryza sativa
cgtgctaacggtgattcgtgattactccatgtcgttcatcagttttaatttttttttctttcttttttctgtttttctcctgatccattgatggatcgaggtgtcaagtgtattattactgccaaattaattaaattaaactaaaaaaatgatccggtgtaagtaaccatcttcagttggagtgaaaaaatttgagcgccattgtcttctccgacaccgatctccctcttcttcgcctccattcttcccaaatttaactaaaaaatcaccgagttcaactttgcgattgagcgtatgaaaatttccaccttatttcgacaaatcttggttgaatttactgtttcgaatttaaattctcaaaaaccattgaaaatttcactcagtatatgctttcatcccttgtcaaaacctcgaaatttcacgattttctaccggtttttgtcgaaagcgttagccttgaatcacccctttcaacttgaagtaagtagttcatcgtaaatttttgtgaggtttcagctaggatttcccttagaattttgtttggaatgtctagaatcacacgattgaagaaggctgattctacagtgaagtcacactcggcccatcatttcctgggtaaaattatgtgggctcacatagaagacaaaatttggcccaaaactaaaattcatcttagtgcactctgcactctccacatgggcctcaacttcatctcgcttaattctctctacttactgggccacctaaaaatagcccattaattgttcatatcgattcattccacaagaagaatcaaaattaaacaatttatctgccggcaaattaattattggcacgacaggaaaaattcaaatcactagtccttagtttaatctaatttatagtgtagatgcgtggttgatccaaaaataaaggttaggtttccgtacttacatgggacggaacgtatagtatatctgtatatgtatgtatatgcgtacgtgtacagggtacacgtgtatagtatggaacaatctatacagtgtgtggtacaatagtgtaccaaaagtcggttggtttggcctcccccaggagtagagtgcaatgtaagcatatttatttatatttcttttcgtaaattaattatgcgcataaacaaatttggtgcataatttagattattaacaagacggtgttgtgtaatgatgggatggtccatgcaatgcgtacgtactagcatgctaatcattgaagttatgttaagttgggagaaagggtgcataactattacgaaaagttaattaatatttctttgatggatcagatcagatgctattttttatataaaaaaaggaaatttcaaaagcgatggcgccgatctaactcagatatgaatagacgacgatgcaaagaacgtacactatcatatcgatccaaaggcactatacggatcaaaacacaaatcataatggcattgattatatatgtgcagtacgtattttactctacttgtagtgtgtagtatcaaatttcaatgttcagatcgatctaccagactactactatatatgggttgagaactacgaaaataagttgctaccaacttgcatcgattacattattgatatcctctagaaattctacatagtgtaccaacaaaataattatgcctggtgggtcagaaaatattattcagggagtatttgctaaataggttggaccgttatatatacaaggacttattctttcatgtacagatgtactcccatttctcagattgatcagcatcgctcatatcctcttgaagaactgagaactaattaatgcctcctttgaaacaaagaaattaatttcacgagaatttaacaggattatttaggaattaaactaatttgtataaaattcctgcattgcggagaagcatacagaagagaattcgggctgttaaattaacgcaggaactctaagagttagccaactgctcgccattaattattggttcactgcccagcagtcaaattgccagcttggacaattaaacaacaatttgattgacctttatatttttgtcctagaacatcctttataggttttgacaaccttagtgaatactagtagttagtacaggttagttacaatgactcatgcaaactatattgaccgtacgtagaaagttctttttcttagtgaaccagtgacatttcgtccagttttgatacctatatctctgcttgtggttttcatgttaagcaaatggtttctcattttcattgaacaaaatggtttttattgttaagcaaatgactcatccccattcaatgttaagcaaatggttttcattttgttcatttattatagctatctgcttggggttttcattaattgaacggggatgagtcatgattgaatccgggcaggggcggatccagcgtggatgctggggggactagagtcccccctaccccgctgaatcattattgttagaaggggatatgaaaggggaagaataggtagaaaatgaaaagtaaagggtctgcaaaaggaagaaggatatgagtcccccctaaaatcttgttctagatccacccctgaatcccggcctaatatcatttgaaaattaaactgaatttgctactacagtctgaacttctcattttactatcacatatatgttgatttggccctttatttggatttgatcatgtttaatttgaacaaaatctgtgtttttatgcagaactcgatcaggtcgagtcaagactcaagagctggcctttatgttggtggtcccatggtaaaactgtgtctaagcacgtgattaatcatcagtaaacgcatagtactgacgacaataacagtactgcaggttaattaaggatgggatctcttcgaatctacagtatctgctaccgtggaacggcatacactcataaattaacttgtacgagcaattttcagagtaataactagtagcagagaaaatagagtgaatcttagtctaggcctttatcaaagtttcatcatgaaatcacctttaatccatatatattttcattttgattcatttttcttatcttttatttcgagcaatctacgattgaattttggtaagaagagatccaggatctaaaactgatgacatttagtcctaaataatgtaccaaactctagcttctcagatctgaagtactgatggtgattctcttttctgcagctgcctggatgttagatcaaattaagtactgtgtgctttgttgtaagaattacttcttaattactgagttccttaagataaatacatcacgatttcccgacaattaaactaatttcgatctgtacgcaagtgacaattacagtatgagaacaagaattgaccggcatgcaagtgacaattacagtatgcatgggcagcagagataaactaaagcatcgatccatcaaaatgaattatgtaattgcaaaagtcaattatgcccggtaattagtgcagtaaactagtgcaagtaatcagccatgtgctcagctcgatcgaactagcaacctgacatatgtcacatatatatccatccatgcatctactttttctgaatggcagcttccagctggatatcatgatcatatcttgatcttaattcgcctacactatactgtgcttgcaatcgcttggctgcgttgagatctcgatgaggtttattgctaaattattagggttgtctgcccactctcaccagcattggcataaaaatatgcacacacaactacttcacaagcatgtactatacatttgtccccacaatattaaaaagaaaacattcggatcgatcggctgaagttgaatgcagtggagaaaggttttttttagttaattgtaggacaagtttggtataaataaattagggtaatatttgcttgaaccaaaaagtattcgagaaacctgtattccatgcttattttttggacttaggatgcggtttttatagaccgtggatgatgacgaagaaaagctgattttatggccattatttaagggcacaaacgaataaattaaacatcagaaatatgataattaagttgattaaaaggtattttctaaaatattgatggggaattattttacaaaaacatactatttaggaacttacttaaatataagaatttttacatgtttcttaaatgcttatattttgaagcagatgaagtactttatatgtaggaacttgagaagcatactgtgataatccataaggtagtgagaacatagcacacgggttagagttattatttgtgtgactatattttatatgttgtatatgggccctatggtgaagtttggagctgtttttcctccactgcgaggacgaattatggaaaatattattgagaatggtcgcattcgagaatatcttttttaatggagtgctaccttaaattttttgtatcatgaacttcatcgatctgagctgtatgtatgcatgattaacccatattttctagcctttttttttcttttataacattattgaaggccatttctcatatgtatggctaattttgaaaaaaaaaaaggttgtctatgtgttatttatgtgcataatcaatttctccactatatatactaaaccgtgtgaatccaaaccttattatcaaaatgtaaaactaacaatggggaggttttttttttaaaaaaaagatgttttatacatatatacaacaacaagaaccactatgaacatgcttaattttttatatatagatcgccataccacaaggtgagatgtactatctccatttcaaatcaccatcagaacacaggcgaaattcgaagaaaatttaaaaaaagaagaataaaaaagagagaaaggtaggaaatctcttttcctttagatcccaaataggagtaataacactttgagagtttttgagttcacacacggattatttatgtacctaaccgagagcccatcgatctcgcccgatgcgtgcacgttaccgcccggcccgggcccggccctggcccgcagctcgtttgggcccagacggacgcgccgccgccaccggtcgtcgcacgacgaacgcgccctccgccacggccatggcgctcttgcagccgtacaggtcgaggagagagccgaagacgccgccgccgcccccggcggcggcggagagtgaccagcggcgctaggaggatggcggcggcggtggcgccggcggcgcgggaaaaaggtcgtcgatggcggtggtggagcgctccctggtgcactcggcgagcgcggcggcgaaggggtcggagtgtggcgcgtctatggcgccgccgcgctggtggtggtggcgccgtcggtggtggtggcgggacgacgggtgtgccggcgcgcggcggagcggcgccggggggagagggagcggcggcgtgggcggggagttggacgggtggagggaggtcttggggatgccggggtggtgctcccacgagaacgggacgacggaggtggccgtcggcgtggcggctgtcgcggcggcggcgctggtgttggtggtccggccgcgaggggacggggagggagaggaggcggtggaggagaaggaggcggtggagagggagcaggaggaagaggaggaagcacggtggcggcggtgagacaacggcagaggtgccggcgccggcggcaatggtggttgcggcgccggtggcgcgtgagtggtggccatggccggcgaggagacgagggaaggcggggacagacaagagtgacagaagcgggataaatacggtggccacatttgcacttcagcccttcaatttctccaaaacttttatgcttctttagctcttttctataccattaatgagttaacatcctctaccataataatactaccattatgtatatgttactataataatagtgcatttacataataatagtgtcattatgatataagatcatcacccaataatagtatatatatagtacggagtagtatttaagtgaaaaggaattttacggccactgataaaagtatctcgaggtatataaattttacgctaaaattttcttatcttacttagtatctaaatgtatcaaattttataccagagaatatagtacctccatgtcccttttcaagaatggaaatattattcttaagatgaagctactaagtgaattaaaagtaataaaaaagaaaactgattttacacaactgaaattgcactcattttgctttgtgcctttaagttaggtaaattaaatgtttttcccccaccatgacccagtagtattttttttacatactataaggacatgttaacttgacttacaaacatgtttagctgaagaacgtgtctcggtccaaggatgaaaaagaaaccgtggcatgtcataattgtggcaacaaaagaaacaaccatattttattttctagagttttatttagggacgaatggtcaaatgttagttaaaaagtcaatgacgtcatatattaaaatatggagagagtataaaatgtgctctttattatgcttttctcatgtttcagtttctttgggcggaaataattagtttgcactggtacagaatgctctatctgtccaaacaaattttatatacagttaactgtttatagaccaaaggtaatgtcataaactcatgtggagatgtactaatttcaactgtagacaatttagttttatcgaaaactgtagaccatttagaagacatgacacaattaaacaagaatataagatcctctcatacgcaacactgaaaatagtacaaatcacatgttttcattatattggggcagaggccacagagagctgacgctgtagcagttagccagcgcatttttcaattagctgtttggtttgattcaaactgtttgaaattgatgctggttttacttcgaacagttgttttataccaaaaaggacataaaacgtactcgagtactgctcaacattaggacttaattagtagtagtagttcataatgtgccatatatggagattgtggtgtaatttaaaccagagcttaggtcagagtgagcacaatttcttcctaagaaaagatatccatacaaatttcaggtatattttatggttgttgcacttactaactacaaccaaacaaagatactacactcttattttgatattttatctcttagttcatactgaatttgtacacctctttgctggtagcaaggcgttttcagttatgtgatagatcaagagaagccctgacttgatttttgctcttgtttaattctcatgtacaacctgacagttacacttgtaggtagagctcctacttatatagtagatggctcaactctggtttttatttcagatataaagtgcaggtgatatatgccacgtgtgctcctgtaaggatttatctttaattgcactgcactgaaccgtttgcattactgtacactaataaatatgtacgatggaaagtacatatacgtacataaatacgcaaaaaatgaggacatttgagctgtattcttatccgtagaagggaggacgagtgagaccaaagggagggtttgcttctgctgcctctgtttcagtttcatcagactttcagtattggataatatgggaagtgtgcagtgcaatgcaggtagttcagcttatttttcatgcttatttttcaagagcagagtttcttgcttatttttcatgccagtagttcagctgaatttaccatcttgtaggtcatgttggttcttgatttcttgtgcatttgtaagtagaattcgtgctaacaatcccatcatttcacatataactgattataagctctagtgcttattagcgatcaaaatataatttggaaataaaacttttatatatatgttcatggtgacttaaaagccaatataaaaaattaactacgatgacaaaaataccaaaaccaactctgaacttaagttttaaaatcaaagttttggctgcggatgatatgctattatgatttaagtagtagattgaagtatagggagtgagatgatgagcagcagtactagctagtacagtactactatagttttcagacaatggaagtgtattaatttcgttatctgaactaaattaaacaagacgttactctcctttgaccacattttgagtaggagcagagtgcaatgaatgggagctagctggctctgcagaatctttagtgaagtgcctgaataagctaagaccaccacagagatcactgcagtaacgcctcatcctccacatgatcacttgcgtgcctctggaagacgtgttcttgaggctcggcgacgatgctggaacaggatgggcgcagctgacctctgaaatttttgagccgttcttcaggaagtagctaagcccttacggtgcaagaaacacagcactgtagtgttgcatttctgaacttgcgttggatgggcaaatggcacacccttctctttatgcaaatggcataccttcaacgatccccatactttacgaatatcgtctgcgaatatagcccgtcgacaagatttactagattttcaaagaaacttttagatagaaaattattgtaaaaaaatacaccttttagtagtccggaaaaccaacttaatggaaacgagagggctaatttcagctcatagcagtgtaattctaagggtaaaatggtttttttttgggtaaaaatggtattttgagacactaaagggaggtctttggatacaaaccaaacagtatggcaaaaaagagaaataaacgattgcatgagtttttcaatgcaaaaatgtaccagttctcttatcagtgataaatttacgctattacattatttagctatgcacctaatatctggaaaataacttgccagcaagttggatgatcatgcatctagtgcagtgtggtggtgagccgtctgaagcacatgatttgggacctctcacctctggtcctctctctgatttgctaaatttctactaattaatgaccatcctgttaaaatgcacatgtgtatacaaaggacaggggcactttatgtatggcctctgcatgctttctttccatcttttcctaggttgatatgatcatatgatgttgttaatgtaagtttttacattagtgcctatcacggtatcaatcaatcaatcactcatacacctacatgcctttctgtttctcttcttcatttcttgcttttaatttgtcgtgtttcctgacctactcgtgcgtcggcgttggtgcgtgtcctgcttttttgcgccaatcatcaggctctccaactctttgctctgtcgatttgtgtgaacactatttataattatgtagcggtcgaaataattattccttcatctattaagataggagtttgatgatgaacaatccctacatctgtactagcagctagcggatcagagatatctgaccatttgcatctgcactacatttgtttgatttgatcctttaacctaatcaagtcaacactaatcagaagcagtagggtagggtgttaatacaacacattgatagacaattttctgaaccaaacaagggcctgattggcatagttgtccggccaaacagttttaactccagctaaaatgaaagtagagcgaggtgaagcgctcttacaaaattaactaaagatgtggagttgagtttaaactgctccataactctagaccaaacccaactctttaagctaaatttaggagttggagctctatcaaacatgccctaattattaagcaaattactataggagattatctacttgattgcagggacaaaataaatatcttaaaaaatgaacttaacaaaataacttaaaataagccgtctgaataatgcagtggaataaagtttttttttttacaaaacgtatttttcacattgtagtgcaaataatccatttcaataatgtggtcagtaatgtcagatacagcaatatctccagtgtatctccctttctttccccaaatcttcagtgaaattctgtgcccttcacattcatctgatttgtacatttcaaccttcggagcactgatattcccagtggtcagtcaactagtagttttgcagcctaccacgcactgcacattacaattaagtagtgaaacctacaaattaacaatgctaatctttgcttagtgttgcacttagcatatcataatcaaattcaacaaaacgtttggttgcctcctacttgcagcctctccccatctgtttcttgacgcagcggtcattttttgcgtgtaattttcagtcacaggcatgaacaactggacaagtcatcatcatcatctcgtcagctacaagttcggtagcagattcgttgctgcgtttttttcacaaagatcagccaaagcagtgatgacaaaattcagtactatgaattgttcttagctctgaactatctggtactgttaggtgaacaaccctgccgtttgattgcaatttttcaggagtcaggacacatttgatgctactaatcgatcggcagctagctgaatatagcaactcctacctgcaattacatggattaatgctctactccaacctgtgattacatgaattaatgctgattggattaacttgattcagaagtatcaggcatggtgaccctgactgacatcactctctggcttctttactataatggctgcgtgagattggcatgatcttgatctgttaataattttcatttgcattatttttttctgatattgacttccattatgagcctgaatgttttactcgagtgaatgaaactgcaattttggtgtgctttcgttttctgatccacagtctcatgtttgactgcgacattaaattatgtcagaactgaattcactaatccgtcgtttgcaccctttttatggacgaatgcatgattcaggcagatggtgagctgacagacaaagcacatcttcactgaattttgttgaaacagctactgattttgacatacaaactgaaatgaccaagtttcagtcatagtttacatcattcgttctgaaaaatatttttgcacgtacgaaaactgaacactgttccagataaaaacaactcaggttcatttcaaacagaagcaggtaggtcgttcgattcgacgaattcaatacaaccaaccctgtaaaatggcgagtatcaggaagcagaatcactcgtacattcaagtactaattaagaaattaaggatgatgacgttcgataacactgtcgcactcacatcagtttgaacaaatcttctctcccctagcatcgttagtactgcaggttcatcattactgctgctgttgctagtagtagtattcgcgtggcagtgaagaaaaaacccatttttatcttgaaaattgggggtgttagcttctctgccaccttcagagaaattcagagatgcagttattagtgattggagctgctagctgattgatcatgaagaagcagaagcaaagttgattagctgatgaatgaatcactgaaaagtcatagcggtgaggttattggattagtacggtgagatgagatgacaccaagatggagttggagagctgagaagtgactttcagggtatattgtaggatcgaatcacaagaactaagctaaccagagggagtgaatggttggtataccaaaaaaaccgaaaaacttttagtggaaataaaagttaccctcgaattcgacggatcgcggtctgaccgaagtgtatgcgccggtctgaccgcctgatgaatgtcggtctgaccgatgtagatcgatcggtcgaaccgccgagaatcctgctgcgcctgtcgccgccgccggtcggaccgcccgaatgctaccagtctgaccgccgcttgccgccggtctgaccgccggtagatcgccggttagaccgccgaaacccggtaaacacaaatcgaagaattcttaaagtggatgacgactttattgattctctttgtgtttacaaagtgcaccaacagcactccttacaaaaatttcgactaaactcgaaaccctaactcaaaactcaactcaattgctctcaaaagcgataatgggaagcctcacgctccccctctatttatacccgaggtaggcagcctaaagccacgaaccaaactcatactaagagtcctaaacaccttaggaaaccctctagtataagaaagaaactttacataaccaatcgtaccaaatttggactccttccaaattcgactccgcatcccatacgcacacaatacctccatcatatgccatatggaatctccatcaaccacatgcatcaactctagcttaagtatcccgcatgatctctgaccaccacggatgttgtcttatccccaagccgactcctggtccatcaccgcaaatactctcccgagacatcaagtcacctacatatgaaataaacaaagaaaccatattccgagaccaagctatctccaacttgactcattagtagcaaacaacagtattacatacgtatagtatccatctagaagccataatcaacagtattacatacgtatagtatccatctagaagccataatcatgaaataatcacggatatccaaacaaacaacccgaaaccgaaaccgacacagcgtcggccggtcagaccgtgggctggccggtccgaccgctcgatcaccgccggtcttaccggcatacaccgcctggtctgaccggtcacataaaatgatagaatcctgcgatcacctgtgaaatccaatcatctccaaaatcacttcgtgaataaattccaaataacaaaaccaataatctccaatacccaattgctcatcacagaataataatcaaaaacacctttgattttacatatacaatacagtgtcgtcagagggtttgatcagttgatgatctagtactccctccgtcctaaaatataagcatttttagtatagtgacaagtcaaacattttcaactttgactataaataacaaaaaaataaaaaagatcaatcatgcaaaattgatgttactagatataccattaaacaaactatcataatatgtaactctttttatttaaatatttttcttttatagatattattggtcaaagtagcatttcagagaccgtgtcagagtccaaaaatacttatattttggaacatggagtacgtaaatacttatattttggaacatggagtacgtttataggattatgaatttcttgacttttgtcgtcttaactaggattggatggcatgacatggtagaatgactatatcaactgttataaaggtactacttccgtgttggtgcaggtgccgtagtatagtgatctgtgtttgacatgtaagtgaattgtctaccttttctaatcagctttaagcatagaactagttgatttatgtaactcaatatagtagtataggagagagtgtcttgacttcgaatatttgtttgctcgcaattaaataaaaaaatgtaacatgcttttgttcgatacatgaggatttgggttaagttgattggtgcatgtaactcaataaactgattgagtcctcgggtttaaccattgacctttcacaaaaaaaggtatttttatgtaaaaaaatatattcaattttcattaccaaaagattaatgatcagaagtaactaataaccttttgcaataaaccgtaaagaaaatattccacatgaaaatatatagaatttcacatgcatatattctcataaagttagtaggcactcgtctagaacttgggggatgtattaccgacacatcaatccattttcttgtccataggtcaggtcagcttctttccatgatcagtcacaataacagagaaaatcctataggagcaagtaatattctgtaccaaactaggacttgtgcaggcaagatgtgatttccaaatacatttgtctacagtttgtagccatagtagggctggaattggatgttctaatagctaggtggccaaggtaatgaaattcttgcggtaggatgcaatagagtggcgtgataggctgattatggccaaagactatgggacaaaattatgcagggtttcattaatggttttccaatgtcgacttctctcctcggtcatgataaaatggcatacacaatgtaggtgcttattaatatttaatgttcaagataagatcctatcaaacttttaaaacttttgccatataatgacttttaggttttttaaaaaaaatgctatgggtatatttgcccaggttttggtttgaaatttccaaaaattttggaccccagcgtgaaactatttcgctcggaaaaaaaatagaaaaaacaattttgatcaaagtttactcaaatgcggtcaaaatattttgaactttcctaaaatccggaaatttccggcactcccggtagatttatgcctaaggaaattgtgtgccctatatttgtcttgaaaaaataattaaattaaattttgttctaatcgttaaatatttatgaccagtttctctacatacgcttgaaatattatcgaaggcttgaaatacatctccatatttctagggtctggtacacatccaacatgtgagggtgtatttttaaagataggtagagtacatcatcaatttaggatttaagtttggtgggccgcaccagttatccatctggtcgcatgtgggtctctaagtaaacatggtgtttatgtatttccttcatcccaaaatatacaactatgtaattccttcattccaaaatatacaacgtcgatgactttttacgtaacatttgatcattcatctcattaaaaaaatataaaaatattatttattttgttgtgacttgttttattatcaaataaactataatcttaacttatacttttatatatttatactaatttttaaaataagatgaatactcaaaacgttacgtgaaaagttatcggcgtcatatttttgagacgggtgtagttctatattggagaaatatgaaacaatcgaagcactgatctacacaatacatgcattccaaaagacgagtcttattatgctttgaatttatttttcacttcaaacacgagcctacctgttacatgtaaaatagtatgattccacttatacaaattacttggaatcccaaattcacctaaatagcagtttgtttatttaatattcttttacaaaatgacacccccttcatccataaatataaatgattataggttatttggcagagatcaaggttaaataaaataacaactttgatgcccacaaaactttagttgattgggaaagatcatgcgtagcgatcgatgcgccgatgcaattagtagtgagcaatactggttggattgagaaagtggtacttcaaatttctttatatttacagataaattttaaatttaacctcacatattttgtatctgtggacggagggagtcccgagggagtagttacaaaatctccacggtgttcgcttaattagattttgcatttgtttaagaaaaacaagattggtcctttacgagtagtgtggggcatggaccaaaataggcacggaaaaggtcttaagggaaaaacatgatcatggcgactttgacatttggtgaagaatctctggagttggcaataggtcagacagcgtgacaggcgtatgttgttcaccatttttctgaagaaagattttttttttaaggaagttgttcaccattttgagccgacggaaagtttagaatggatagtttagtggtatagtaaaaatagtatggatagttagtatggccccattatcaccttaaattaatagtccagatccaccctcctttcaccacgaaaatataggtaaaatatgctatatttcattttaaaacaaagaaagcacatatttagctggattatgccacaaggctatatgagttatggatggacagcccttcgatgtcgcctgagctagtgaactcataatagtaggacactgttagcaagaaaaaaaaacaaaacatcaccgcataattaaagagtattggtctccagatctcaattattaatttgcgagctctactattaataaaaaaataatctactactaatcgttagacggtactacctccgttttaaagtataacaactctcaactacgaatttagacatatgcttgtttaaattcgtagaaaaaaatagtttaatttagaataaagggagtagtataaatagatataaatgataaaaaaatataaacagatatgatccattgaaaaaatatggaaagtctgaaatatatttcaggtgagtgaatactttgaaatctcagccgtttcttctgccgttggatgcataataaagggtggatgctaaaaacccgcaaaaccaactgggtgtattaatggatctgtttgcaggctcgttaagcatgtgacaaggccagaatatacaagaaaaaagattgggctttttgtattgcccttgtctatgggctaggctttgtgtgcattgtcgggtttatgggctttgtgagctgggctttgatctttgggctttttatgtgctaaaagtgtgcttttgtgggctttgcccgtgtagctacatttattgggctttcatggctacaatcagaaatcctaaaatataacaaattataactataaatttggacagacaagtatttgttcagattgatagctaataaaaagcttactatattttagaacgaagagataattattactataggataaaaaaggcctttcagatatgcaaaggattattatcttcaatcatgctccgatgctcgccctcttgttataatgatattatcagttcccttttcgggcatgttttttgcaatttttccgattcaacattctcccaattccacagataaaaattcatatgaaattctcaatctgcatgaacatatcctatcccctttttatgtttgaaatatcagccccggtgctttgtttttcgctagttttggatgagagaaattaacttgtagtacctgatttgctaggttcaaattacattatccctccaccataaaataaaataaaaagttatatattcgaaactggacgtaggttatgttcacattcatactaccaccgtaccaaaaaacttgttcttttgagttttcgtttgtaatatttgaccattcatcttattcaaaagattataaaactattatttattttgtttgggacttgctttattatcgtaagtactctaagtatgacttttttttatatttaaactattttttagtgagacaaatgatcaaacgttaaaaaaaaaatcaaaacgatacctaatttgggggagtatctataaaagttgactaatttagggagggagctactaaattaaaattcagattaaatgcttgctactatcaaaattacactttacatgacaccgaaaacgttgcattaaaaaaacatttaccccggggcttgtgctgtgtcaggtgtggggcccacttgtctgtcgttgctcgctgagtccgacgtggactcgacgcggccacccttatccctgcgctttttccagcctacgtggcatggatggtcccacacgcaccatttgcactgcacttgccaatagtccatttatctctttttttttgtttgttttctcttgccagagaggaccaataatttgtggccacgaatccatcgagcgtcaataggttgggttaaaactaacagaaatcaaatctcacaagcgtcaattttgtagagaaattaaaaggagatctttttaccaagcactcaatcccattggcatcatatccatgaatttataatggtacaatcgcattaagctagtgcccaaatttattggactggaaacgaaattaccaactgaactgaaaaaatatattttttcagcatggttgaattattttgcaaaacgtatatgttttattttttatgggacatgtattttccgactcaattcaggtcccgtcgctgtctccggtttggaaatttctttgattgtctgttatacgtattttcacgaattgtgattatcctaatcgttcaagggaacatgtggttgattttgtaaacttaatcgaagttggtcaaaatcaacttttagtttgctttgcacgagaggttatttattggtcaacagtatgtaaaacggtttattaaaactttggtcaggtcatgagaacatgccttttttgacattgatgaataaagtcataaagatgctacttatcactaatttacatcacaaaagaattaccggccccaacaaaataataatctaagaaaaatactttttcagaaaaaagaatatagatatgattttcatcgacccaatcgaaatatattaaaataaagcttcacctgaaacattctaaaataacatgttttcgtaccaagagagcgagtatatatatatatatatatatatatttattaaagcatgtcccatggtacaataatctcgaattagtggttcaagaattttgtcaaccaatgatgacacctaatcggaacaaaaataaaaacatgatactactactactctctccgtcccacaatataagggattttgagtttttaattgcaacgtttgatcactcgtcttattcaaattttttttgcaaatataaaaaacgaaaagttgtgattaagttactgtagataataaagtaagtcacaaataaaataaataataattttaaaaaaatttgaataagacgaatggtcaaacgttgtaagtaaaaacttaaaatcccttgtattatgggacggtgagagtacttaacaacccacagaaaaataaaataaaactataaaagcaaggaaaatatctggagtaaggaaataaaaacaagaggcaggagaagctttacacacaagcacaatagactatataaaaacaaaaaagaaacaaccaaataatataataataataataataataaattccctttcccttcaaaagaagaagcagagcgacctgcttttcaagaagccatggccgcctcctcctgaaatcgccgccggtttccctctccggctctcccccacctaaatgcatgtcgcccgccggtggcggtcggcggccgtggcgatctgcctgctgccggtcgtcctgccgctggcgctcctctgcctcccgctgctctgcttcgccgtgaccgtcgtccggttcccccgccggcgtcggctaagtatgtccgcgaggaaggggaaggcgcccggctgctgcttcgtcaacggggaggagcgaacgtctccgtaaaagaaggagggcggcgggatccgcgcggcgctgctgctccagtatctggaggaccagatggagctcgtcggcgtcggcaacgccggctaggcggaggagggcaaaaaagcatcggccccaattggagacgagcatcacgagcttagctaagcttggagatcaagattaatttgacgattttttttttgttgttgttgtttgattgatgatatcctctgcttcttggagaacccaccttcgttacatgcccaaaaaaaattaagaaaatatttccttttctttgctcgagtttttttttttgttgctgcagtagtagatatatattattaggagaggtgtcgttgagagcatgtgatctaggagtatttgattagatgattcatgcaggtgatgcctgacagcttcatctgttagacaattggattgggagttgattgttcctctgccctgtttatcctctgctttttttttgctcatctgtcttcttgtttcagttattaagcctaagtatatcatctgatcctatagttgcagtttttttttttgcaagttagttgcagttgttgagagctactcttgattagttgtaacatcccggcctagggcttaataggattaatagaatactcataccaataagttacaacttcttttccggaagccaatctccaaagaactctagggttaagcgtgcttggcctggagcaatttgggatgggtgaccgacctggaaattctttccgggtgcacacgagtgaggacaaagtgtgtagaaaagacatgtgaggcatggtgcgcatggcacatgcgctggcactggacacatggacgtggccaagagagtgagggcagtctatgacctatgaaagctatcagatgtaagtgggcccggacgttacaaagtggtatcagagccgactctcgcggtttcacgggcgcgtgtgtcgcagttgcgcaggcatggtgcgcatggctggtgttacaaagtggtatcagagccgactctcgcggtttcacgggcgcgtgtgtcgcagttgcgcaggcatggtgcgcatggctggtgtagaccgggagtggttacacagcatggcacatgcgctggcactggacacatggacgtggccaaaagaggacgttcctggcctatggttgatcgacgggggcgtcgatctctcttaagggggtgagggtgtaacatcccggcctagggcttaataggattaatagaatactcataccaataagttgcaacttcctttgcaacttcttttacggaagccaatctccaaagaactccagggttaagcgtaagacatgtgttggtctgtgagggcagtctataacctatgaaagctatcagatgtaagtgggcccggcctgggggaggcgggacgttacattagtacttccttcatatttgaatgtaccacaccggtgacttttcgactaatgtttgaccattcgttttatttaaatttttatgttaatatgaaaatatttatgtcatgcttaaagaatatttgatgacaaatcaagtcacaataaaataaatgataattgcatagattttttgaataaaacgaatggtcaaacggtggacaaaaagtccacggtgtcatacattaaaatatggatgtagtactagattaattgtgctagagacgcttgatagcttcatctattagccaattagactggaagggttttgctcctctggtgagtcatcctctgaacttttgccgcctcagatcacaacagatcctagatataactcttgactgagcttcaagagaaagggttagatttttgagtgtcaggatggaaatacatctattgtatttatggcgtgtgacacatagctgtgaagaggggatcaccagtttatcatctgccttttgctacccgacttataatcgtagagagtgaggatttaacagccgtgcttctgcatacaagataacgatgtgtacccgttatattcttgttggatccacccagaagcgtcatacttctactgatggatcttgactaatagggcgaccttttctttttagttctcacatagctccacacgacacatacttttgatttacagctagaagatgtttcatgtggctatcagatgccctcacgctttcttatacccaatagacgg

SEQ ID NO: 60314 - DNA, 2981 bp, Oryza sativa
tctttttcttcttcgcggggtggttggtcgccatgaccgccttcgtctacctcctcttgccggagaccaagggtttgcccatcgagcaggtcgggaagctgtgggcgcgccattggttttggaggaggttcgtcgtcaccgactccggcgtcgacggcgaggaggaaggcgaagccattgacgccgataagctctgaacagttaaccgtgcagatcactgactgactatctgattgtctgactgatccggccacggttgtttcagaacagaactggctatatccaacaacatgtgaagactagctagcagcacattttttagctggatttaagtatgtaacaatacatatttgattacacaaaccaatgcttaaacaagcatttagtagtaacttccttttgttttggaggccttacaatcatactagattatacatgtataacattttactaggaggaaatatgcctcaaaattaaagaaactgaaacttaagtttatatatggcagtaggtggatgctacctcccttcggagaggccagagatggtgccatcgctcaccactgattggcaatatgcaacgggtgagtccacctgacggttctgcaccatgtccattggcgccaactcgggaaatggcaagtcatggttaagatactgcatgacatgccacatgcttggctttgcagcaggggattggtgtgagcaaagcaatcctagtttcagcgctaggcatgcttcatcagcatcatactcattttggagctttggatccattgtctcaagaagtgatccctcgttccaacaatccatcacccagtctaccaacaggagcttgtcactattcatcttatgttcaatgggtcttcgtccacaagtaacctcaagaacaaatatgccaaaggcgaagacatcggtgaggggtgaagctttacctcttcgtactagctcaggggcaagatatcctatagtgccaactaggtgtgtggtttgcatgtcagtaccatggtcatataatcttgcaaggccaaaatcacctaagcgtgcattcatttctgcatcaagaagcacattgctagccttgacgtctcgatggatgacaactttctcccagtctccatgaaggtacaataaaccagatgcaacgcctttgattattcggaaacgttgaatccaatctaaagtaggatggttgctatgacaatacaagtatttatcaaggctaccatgtggcatatattcatagaccaatataagttcatctttgcgccggcaatagccaagtaactgcacaatattccgatgccgaaggcgaccgatgctaacaatctctgcaacaaattctcttatgccttgccttgattcatgggacacacgcttcacagcaatctgcatgttagatttggaaaggagacccttgtacactcttccaaatcctcctgtgcctaagaggtgactattcttgaacccttcagttgcaaaatataggtccttaaatgagaacctgtgcggtccaaactgaatttcccaatcttctcgcagctcagcatatctcaaacgcctccgcacaaataggaagacagccaaggttatcagtaagacagatgtggcggttactataggaacaattatcggcaataccttgcgccgtgaagcttcttgagctctacgaggtagatctggtagttgagcagtgaagaaaggaggagtgggtccattcatgctaaagctccagcctagaatataatgactcgaccctgctaagcctgttgcagctgataaacctacatatgcaacatctgagatcactgatgagaggtcatagggcattgacagtagtggcttggtgggtttggccattttgaatggagccaaggccacgtcaatctgctttgcccctccatcgtagtcgatccaaatttgcatcgcctcaccactgattagactcaagttatggaagccaccggtgctgttgtcgtagtagcccgctgaatgagatgtcacggagcgaagatcacatatgtcgatgccgatatggttgtcatcgatgtccataaactcgctattcaatatggtgttgatctcaacggcaaaaacatggttactacgattgccaatgtttctaatgttgaacagacccaggtactgtgcggctaacgcatcagaaaaattagtgcttggggcaaccaagaaaaccatgccttgtgacccaagatcaatgtaaggggagatgatgccaaacaccaaggaggcggagaaggactgcaccgtagtgttgggcgacttgcgaagccggaaaggagtcggatggaaggcatggcctttcatattggccgtactgttggtcagctgtagcaagccccctggcagcaccatggcagctccatcgacggtgagactgctgttggagaagccatagtacccgaactgaccatcgccaatggctgcagtggaggatggaaacgtgataattatcaggatgatggtgaagaaatggagtaccgcaagaaagcaccgacgattctcgccagggacaggcatggctccaaacaaaacctggaagagaggagggaaggttcaacaatagggcatgcaggaagctgcatattacgatgttgcagtgtgctggtatagtgatacagatatggctgccttgctcttcagtcaacgtagcttcatgacaagtctaaaattgtgtgctgtcattcaatctaagtctgctgtgttgacgggccaaatcagtttttccacaaattttgataattcgatcctttgcagaaactatttttacaaatgaaccgttgccaaaacttatttgaaatctgacccttttgctcaacgccaaatcttgtggcgctgaacttagaaacctcagcgccaaatagcatggcgctgaatgtacgttggcatgctgacttagtctctcatccgtcgtggcacggcattcagcgccagctgacgtggcgctgaggtgtctaagtt

SEQ ID NO: 60315 - DNA, 1134 bp, Oryza sativa
gcgccacacgatttgacgttgagcaaaagggtcagatttgaaataagttttggcagcggttcatttgtaaaaatagttcttgcaaagagtcaacttgtcaaaatttgtgcagtttttccatactgcaccttccttcaaattaccagtgaaaataaccgggcctgattattttgatggcccagagaaagcgatcctctgacttaattactgtgtagttgagagtcactgacatgtggacgatagtaaagtaggaccacatgttagtgatttaactgcatgctcagttaagtcagaggatccgtttccgtggctcaggatgaaacttgaaataaggacccttaatactatatctaatttaatcaatatgtatacatacatataattaatgttaccggtaagcattgaaattaagtgcaccaaaagcaatgtctataataaaaaaaacttcataaatatttccttattaaaaaatatttttagatataaaagcatagattaattcacacattcttttttctgtaaaagagcaaaaggattgcatgttaattagaagaaagcaaacattattagtacacatggtgatcacctggaagccatagcagacaagagacacgaaccagttaggatagcggcagattacagaaaatttaaagagatcctatgcagtcgattgtaccataccattatcatttacatgtagcgactgcagaggatctcaaaatccgtaccaatattggtggttgcaagcgcggagtgtgtgcatactgtactatgcctaacatcactgattgactatataattgtctgactgatccggccacacggttgtttcagaacagcactggctatacccaacaacatgtacagactagcaacacattttttagctggatttaagtatgtaataatacatatttgattacacaaaccaatgcttaaacaagcatttcagatgtcaaagggcatgcagtctagtggttgcagtggccctgttcgataggctaagttcctatctatctattatatactaaaagtccattaaacttcctacaaacgcttttaagccgccacgtgtcacttctacaaacgctcttaagtcgccacatcgcacaatctaatctcaccgtcgatttt

SEQ ID NO: 60316 - DNA, 18306 bp, Oryza sativa
catacatgatagatagttaatttgctacaatacaacccttaattcatcacaagaattatgtattttctttgccaagtagtattggaaaaacatgaataatccaataaaatacgcataaaactacttatgttatatttttttatagttgatagagattctaatataccgggtataattgatggacaaatgttatacaccactaaacccaactgtaagtgcactctagcgaattatttaatgtaaataagtttgtgaaaataagtacattcttagtattagtaaatgagtctcgtattcttagtattagtaaatgagtctcgtatagttgcttacaacatatggtggaaacaaatttggcgctaaagtataaatctttatcaaaatataaataatgatatggtgttttgcatattctcatggtggtatgtctctttagctatagtttttattaagtagtgtgaaatgattaaccccactcatttgaaatacatcatattatatatattccattaaaatttgagaagtacttattactaacttcatatgaaaaaaatgcattttcatcacctcctcctttatgtccctctgtccttgaatgcagggtgcagtacttgcaataccatcctaaatattgcatgggtatgtacatggttgtgttaaggtggtgtctgtgaaaggccaccataggcagtgtgactaaagtgacatacttaccatataatcatttgtgagtgtactgataataaactaagtgttaaaattatactctaggatggtttttaggggtatggctacatcgatgcggaacctatatgtttcaaggcagtacatacaaaagccttcgttcgcagatacagtcgacttcatccattagagagacattcatgtttattttaaacagagttatcgtattattcggtagatatggtatatttagactatttatatatagatgcaaaaataagtgatgaacaccgggttatgcaggtcgatgaattttttagtgtattaaaaatgtattatttgttttagtggtactaatacagttttatttattaaaagttgacctaattcttaaaacaatgatagtaagtagtgatgacaaacgaccagtttatatatgaccaggacaaaggtatttttatttaaatctaagagacattattatcacgttagaagtatattaaaatctaccgtctattttatggtaaatatatctcttatttttcttattgtagggtaatctaaattctcttacagtgtgtgtctctctctatatatatatgattccttttagcattattttttttaataacaaataagatgcctgtgcatatgtgtgaatttcctttccgatttatatttcataaatgttctccggtttatatccagtcattatatagtttgaaacacaaactataatacatgcccgcgcgaatgcgcgggctaccttcctagtttaaaaaaaaggctgcatatatccgattggatccagaggccgggtaaaaaataccattgtctaaaaaaatgcttaaacaagcatttagtagctagtaaccattttttttattttagagccctgacaagcaaacaatagtaatacatatacgtgtacactccctccatcttataatttcgcaccatgtccatcgcccccttctcaaaaaaaaaaaaagcttaaacaagcatttagtagctagtaaccagttttttttattttagagccctgacaagcaaacaatagtattatatatacgtgtatactccctccatcttataatttcgcaccatgtccatcgccctctcaatggctcacctcccatcactgctgccgcctcccgtggacaggctcgccatcccttggccctctccccgccagtgagctcctcggggagagggggagaggtgaaaggccaattacatgtgggtcccacatgttctttaatattttttttctaactaggatgtcatgccatccaaaacaattatccatagtgtcattgggtctaacttaaatggttttgtcaagcttgaggtgaagttttttgtattataatttacagatgtcaattaaacttgatataaagatgagggataaaaagtagacttactccgtataaattataggagagtacgaattaccccccgaactatcgcggtcggctgaattccccccgaacctgaaaacagacatcactcaccctgaactttcaatgccggacgaattactccccttgacccaatccagagtggttttgtcctacgtggcgtacgcgtggcaatccagtcagcattttctttctttaatggcagggtccacatgtcatatatactctctctcctcttcccctcttccacacattctctctccctctctctctcgtctccgtcgtcgagcggcgggtggcggcgtgggacgcagaggcaggagcggacacggaggcggcagtggcgagggatgcagaggcggcggcggcggcagggcgggatgcggacccactccctccggcggagccacctgttccaagcagccgcagcacatggacgagcaccaccaccaccagccgatggcgccgcatggtggcctggtggggaggcgctcgagggcgacctgaaatggcccaatgggctgtcgttcttcaccgcgctcaccgcccggaccgaggatgtgaagctcctgtttggcgacggcggcggcggcgcggatgacgggagcaagatggcggcagcggcagcggcggcgcaggacgtggggcacggcggcgtggagaatgtggaggagtacctgagcctggagagcaccaagttcaagaggagcttcacgttgccagcgaggatgagctcgtccaccacgtcgacgccccgtcggtgtgtcaacggcaccggtgccaccgtcgcagcagcagtagcaaagggatggagtacaggtgcccacacgagggccgcgtctactcggacctaatggagacgttcttggagtagcctaagctagcttgctaccacaccaagccgaacgacgaggaacaggaatccgagcgtgtcaacggcgatggaagctcgacggatgaggatctcgcggaggaggtagtcgctgagcacctcgacgccgccgccactgggcccgcgctgccgcccgccacggtggggaaagagaaggaggaggattgccgggttgtcccggcagatcccgacgccgccgggagggagcgggtccgcgtcccgcgcgccctgccgccgccccctctgcgtcccttgccaccgccgcctcgcatccgctcccgcctctgcgtcccgcgccgccgcccgccacgtcgacgacggagacgagagagagggagagagagtgtgtggaagaggggaagagaagagagactatatatgacatgtgggccccgccattaaaaaaaaagaaaatgctgactggattgtcacgcgtacgccacgtaggacaaaaacgctttggattgggtcgaggtgggtaattcgtccggtattaaaagtcagggtgagtgatgtctggtttttagcttcaggggggaattcagcctaccgcgatagttcggggggataattcgtactttttcctaaattatatcatgtcaacaatattttacatgctgggctcaaaattcatatgcttggatcggcccaatatgacggaagtcaggctcggcccactccagcctactccggcgccatggtggcactgccgcggcgacgaagacgacatcatcatggacgcggtggaggccgcgaacgccatcgccggcgtggcgagcttcaggcgaggatgtgtggccttcgtcggcttctgctgctcctcacttcctttctctggtttggcagcgtgattcgtgatttggggatatcaggaggatgaggtaggagaggtggtttcgcgccttgttgtttgatctattgtacaatttgatgtcgttccgttctcaaatttcgatgatagtactgatttaatctgtaccttttcttttattggttgccaaactattcattttgagatggatgtttagatctgaaagactgaaactgctggtatgttcatacttaatgaaccttgtgcaaatcattgagctgggttaccaagatttaaagagtcaattcatcatatctctctctcctgggttccttgatccctaggattttttttccttttttgggggggcttatgccttgcgacagtataatgttgtatgtacctggctctttttttctctcttcttaatacaatatggttggtcgatttttcggccgacccggctaaaaaaatatctctctctcctttctcctaaatgaggttgctcaactagcactacatttgtttacatttactcatcttttttaaaaaaaaatccatttttgtgtttgagaatatttgtcactttacctttttggaacaattttgtttttcatttacatatgatcccatgatatttccatatagtactgaaacatgtaagataaacaaaagaaaagaaagaagacgaacaaagtcctcccatttgtaggcagtttattggtcatctggacaaaggaagtcgatggaattgtcttgtcctagtgccatggttaatagtcaattaaacaaaacgaagggggtaattgacactgacagtgtggaataacgctggtgggttgcttggaaagttaggcatcgggcattgttggttaacaggactgtataatttgtctgatgcttctgcaacttttgctttcactagacgatgacgttactctaatcagccctttttattctttaaaaaaaaaagaagtctcgcaaagacttccttttccaaattgacttcaagagtcaatccattctttttcttccctttgtgaggtgcgatgaacagtgtgcatgcatcgttgttaatttgctacttttaacttttctgtctgttaagaatatttgcaactccatgtttttcaaggtggaaatttcagttttatgtttttatggggccataatatttaaccatttggtattaaaacaaagttaaaaagtattgcatttttcctttaaccaaagaaaatatttaaaacaagctcaatcccacttagggcccctttgaattgcaggaatggaaaaacggaggaataggaaaacgcaggattctaataggaatacaggtgtaaaacagaggattggaaaatacaggaaaaacacaggaatgaccgtttgattggaccacaggaaaaatacaggaatcggatgagagagatagactcagggcccctttgaatcgcagggtagaaaaaaacggaggaataggaaaaacacaggattctgacaggaattgaagtgtaaaacagaggattgcaaaacacaggaatggtcgtttgattggagcgcaggaaaaacgcaggaatcggatgagagagatagactcaaaggaaattttccaagaggttggagctcttgctaaatttcctccaaaatccacatgcaatatgccattccataggaatttcataggatttggaaagcttcaatcctttgaatcaaagggccaaataggaaaatttcctataggatttgaatcctatgaaattcctacataaatcctttaattcaaaggggccctcaaagaaatttttccaataagttggacctcttgctaactttcctccaaaatctctataggatcacccattccataggaattttaaaggatagtataggattcaatcctttgttttaaaagggttttataggaaatttttccataggattgaaatccttcaaatttcctatgcttttcctataaatcaaaggggcccttaggcttttttttttctgactggtagtagcattacatcatgctagaattaaagaagaggacaactgaaggggcaaagaaaaaattgatttccatcttgtcacaactaggccttgtttgaatctgcaatttagtttagcctttttttttttaggagaaatttggtttagctttttggcaacatgtaaaacgagataatccattagcacttagaaacttaagaattgggtttatttgattttttttaacaaacttctatgtaaaatgttcttaaaaacacacaccgtttagcagtttggtaagtgtgctaatggaaaatgagtaagttctattttggagttgaagaaaagaatgcagctggatggtatttgtctgcataccatggtcgtggtgcgtcaccaagtcactgttcattattattatttggttgacatactggcaacgcgtatctgtagccaaatctaactactactccctccatttcataatgtaagactttctagcattatccacgttcatatagatgttaatgaatttagatacacatatatgtttagatttattaacatcgatatgaatgtagccaatgctagaatgacttacattatgaaacgaagaaagtatatatattttgctattgccactccagctttgcattggtactactactactacactagccagctagttatacattgctactccagtgttgagatgatcatcccatctactcacatcatgctgtcggtggtggtcttgctgctgctagctgcagctctgcccatgagctgcagcaatgacactgacctcactgctctacttgctttcagagctcaggtgtctgatcctctcggcatccttcgtgttaactggacaaccggcacatccttctgcagctggatcggcgtctcctgcagccaccatcgtcggcgacggcgcgccgtcgctgccttggagctccccaacattcctctacatggcatggttacccctcatcttggtaatctctccttcctgtctttcatcaatctcaccaacacggggctagaaggccccatcccagatgatcttggaaggttaactcgtctcagggttcttgatctcagtagaaacagattgtcaggcagtgtaccatcatccataggaaatttgaccagaatccaagttcttgttctaagctacaacaacctgtcagggcacatcttaacagagctaggaaacctgcatgacattaggtacatgagtttcatcaagaatgacttgagtgggaacatacctgaaaacatattcaacaacacacctctgttaacctacataaactttgggaacaatagcttgtcaggatccataccagatggaatcggttcatcattgcccaatcttgaatacctatgcttgcatgtgaatcagctcgaggggccagtgcctccctccatattcaacaagtctagactgcaagagctgttcctatggggaaactacaagctcactggacctatacctgacaatggaagcttcagtcttcccatgttgagatggatcgatctccattggaacagtttcagaggccagattcctactggattggcagcatgtcgacatctcgagagaattaatctgatccacaattcattcacagatgttttgccaacatggttagctaagctaccaaagctaattgtcatcgccttgggcaacaacaacattttcggaccaatcccaaacgtgcttggtaatctcactgggcttcttcatctagagcttgcattctgtaatctaactggtgtaattccaccaggattggtacacatgagaaaactttcaagattgcatctctcacacaatcaactaactggcccatttcctgcttttgttggtaacctaactgaactatcttttctggttgtgaaatccaactcattgacaggatctgtaccagccacatttgggaatagcaaagccctgaacatagtgagcatcggatggaacttgcttcatggtgggcttgatttcttgccaactctttccaattgcagacaactccaaactctcgacatatcgaatagtttctttactggtaatctccctgactatatgggcaacttctctaatcagttggtaattttttttgcatttggcaaccagttaactggtggcatccctgcatctctgtcaaatctaagtgctctcaacttattggatctttcaaacaaccaaatgagcaatataattccagaatccatcatgatgttgaaaaaccttcggatgcttgacttctccggcaatagcttgtctggtcccataccaacagaaatctctgctctgaacagcttagaacgattgcttcttcacgacaataaattatccggtgttttaccacttggccttggtaatctcactaacctgcaatacatttcgctgtccaataaccagttcttttcagttataccaccaagcattttccaccttaactatcttcttgtaatcaatatgtctcacaattccttgactggtttattaccattaccagatgatattagcagcttgacacaaattaaccagattgatctatctgctaaccatttgttcggtagccttccggcttcactcgggaagcttcaaatgctaacctacttgaatttgtcatataacatgtttgatgactcaattccagactctttcaggaaactatcaaatatagccatactggacctgtcctccaacaatttatctggtagaattcccagctactttgccaatttgacctacctcacaaacgttaatttctccttcaataatctacaaggtcaggtaccagaaggaggtgtgttcttgaacattactatgcagtctttaatgggtaatcctgggctgtgtggtgcctctcgtttaggactttcaccatgcctgggaaattctcactcagctcatgcacacatcctaaagtttgtattccctgcaattgtggcagtaggacttgtagttgcaacttgcttgtacctactgagcagaaagaaaaatgcaaagcagagggaggtaataatggattctgcaatgatggttgatgctgtcagccacaagataatctcctactatgatattgtccgtgcaactgataatttcagtgagcagaatttgttgggatcaggaagctttggcaaggtttacaagggccagctgagtgacaatttggttgtcgcaataaaagtccttaacatgcagctagaagaagctacgaggagttttgattccgaatgccgagtactgcgcatggctcggcaccgcaacttgatgagaattctcaacacctgttccaatctggacttcagagcattgttgcttgagttcatgcctaatgggagcttacagaaacacctacactcggaagggatgccgcgccttgggttcctcaagagattggacactatgctggatgtgtctatggcaatggattacttacacaaccagcactatgaggttgtgctgcattgtgacttgaaacctagcaacgtgctatttgatgatgagatgacagcacatgttgccgatttcggcattgcgaaactgttgctaggtgatgagagctccatggtttcagtaagcatgcttggaacaattgggtacatggcacatggtaattaatttgactatctttattcctttatgcagcagctcctctgtcattacatccgttgattgatacttctgtagctaaacccagcttttgttttgcaataatttttgttgtcagagtattgttccatggctaaagcctcgaggaagacgatgtgttcagctacgggatcatgctactggaagttttcactgggaagatgccgacagatcccatgtttgctggagagctgagcctcagggagtgggttcatcaagcatttccactgaggcttactgatgttgtggacagcaatcttctgcaggactgtgacaaagattgtggtactaaccacaatgataatgcacatgaagatgctgcttctagcaggctgatcactgaccttcttgtaccaatatttgaggtgggcctaatgtgttgcagccatgcacctgatgaaaggccaactatgaaggatgttgttgtgaagttggagaggataaaaagggactatgctgattctacagggagccagaggactgaataatatctgtacaccttccgttccaaaaagaatcaaatcctgactataaatctacataagtgtttgtttagattcataactaggatttgatttattttttttaggacgaagggagtactagtttgagagttgtaatatatatgcagattggggagaagatattaaagtattcagcttgaagtgttctctttattactggtcattgtgttgatttagttgtccaagtagccgatgtactgtttttcactgatcaaaactatggttgattagtaaactgatttttctctgaaacttttaccatgatatgatttttgttttcctgtgcctactgcctaacatcactgactgacatccgattgtctgactatcagtgtttcagaacagagaacaccactggccatctccaggtttgcctcatctccaagaatacagactcttcactctacggactagtaacaagatttttagacatccccgcaaaaaaaaagaaagactttttttagatggttgtaagtatgcaacaatacgtatttgattacacaaacccatgcttaaacaagcatttagtagtaactttttttttattttagaagcctgacaatcatactagaattaactaggaggaaatatacctcaaaattacaaaactaaatcaagtaactaggtgtacatatggcaatagatggatgctacctcccttcagacaggccagacatggtgccatcgctcgccactgattggcaatattcaataggtgagtccacccattggtttcgcaccatgtccatcgccatcaactctggaaatggcaagtcatggttaagatactgcatgacatgccacatggttggccttgcaataggtgatgggtgtgagcaaagcaatcctagttttagagctaggcatgcctcatcatcatcatatccattttggagctttggatccattacctcaagaagtgatccctcgtgccaacgatcaatcacccaatctaccaacgtgaacttgtactcactattcattccgtgctcaatgggccttcgtccacaagcaacctcaagaacaaatatgccgaaggagaaaacatcggtggcgggtgaagccttacctgtgtttgccagctcaggggcaagataccctatggtgccaaccaggtgtgtggtttgcatgtcggtgccatgatcatataaccttgcaaggccaaaatcacctaagcgggcattcatctcttcgtcaagaagcacattgctggctttgacatctctatggatgacaacttgctcccactctccatgaaggtaccataaaccagatgcaacacccttgattattcgaaaccgttgattccaatctaaactaggacgggtactattacagtgcaaatatttatcaaggctaccatttggcatatagtcatagaccaagagaagttcacctttacgccggcaataaccaagtaactgcacgatgttgcgatgccgaaggcggccgatgctaacaatctctgcaataaattctcttataccttgtctcgattcatgggacaccctcttcacggcaatctgtagcttagattcaaaaagaaaacccttgtacacccttccaaaccctcctgtacctaataggtgcctattcttaaacccttcagtagcaaaatataggttcttaaatgagaacctatgtggtccaaaatcaatttcccaatcttcccgtagctcggcatacttaaaccaccttcgcacaaagaggaagacggccaagctcaccgcaacagcagatgtggcagttgctataggcacaattatcagcaataccttggaccgacgagaaccttttcgatctgtacctctacgaggtaagtcaggtagctgagctgtgaggaatgatggagctgatccattcatgctgaagctccagcctaagatgtagtgacttgtttctagtggcccagttgctgctgacaatccaacatatgcgacatctgtcagcaccattgagaggttataggacatcaacagtagtggcttggtaggtttggccattttgaatggagccaatgccacatcaatccgcattgcccgtgcatcataatcgatccaaatttgaatcgcctcaccactaatcaaactcatgttctggaatccaccggtgttatcatcatagtatcctgccgaagaagaattcactgagcgaagatcactgatgtcgatgccgatgtggttgctgtcgatgtccataaactcgttgtttcgtacggtgtcgatctcgacagcaaaaacatggttgctcatatttccattgtttttgtaattgaacaggcccaggtgttgcgccgcattcgcgtcggagaagttagagctcggggcgatcaagaaggccatgccgtccgtgccaacctcacggtaggcagagatgataccaaacacgatggacacggagaaggagtgcagcgtcgtaccgggcgattcgcgaaagcggaaaggagttggatggaaggcatggcctttcatcatgccggtgccattggtcagctggagcaatccccctggcagcaccatggctgctccatcgacggtgagactactgttgaggaagccgttgaacacaaactggccatcgtcgacagctgtagtgaaggatggaagaagaccgataccgagcttgatgacgatgatgatgaaaaatagtggaagaaagctcgaacggttcatgccagacatggctctatgaaaacctgagagagagatcattcagggaagaggtttaacaacagggggaagctgcatttgttgcagtgtgctgctatgtggttgcacttgctcttcagtcaatatagcttcatgtcaagtgtgtacgggtaaatagctagtctgctactagaaatgggagaggtgggcactctctttctcgaagaaagaaaagaagttcatgtcagagtctaaagctgtgctttgttttgtctaagtttgaattgaccgggtgtcccagttagcagtttttccacactgcacctgcaaattagtagcgcaaatgagaacatagaaaatctcctatgcagggtttaatagtaagctcccttcaatcacacagacacacacaaaaaattcatgcagccaaattatatgggcagtgatctaatctcaggattaattggacttccctagattttcctgatttctctttttgtaatgaactattgttaaagagtttttttactgtccaacgtaccacgcggtaccatagcggtaccaaatgctggccgttggatctggcctgatccaatggctggtgttgcgtggtaccgcacggtaccaaaaatgtcccttaggtggtcccgcatggagaagagagttggaagggtaaaagagtaacttcgtgtgcaatagatgggtctggattgggcggctcgaaccctagctatgctagatgatttttgccgccgccgccgtgttcctcttcctcgccgccgccggacttattcctcttccgccaccgccgaacttgttcctcttccgccgccggacttgttcctctcccgcgccgccgtccttcccttgttcctctccggcgctgccgtcgttctcttttttctctcgcgcgccgccaccggactttatcctctcccgcgccactggcgttgccttgttgctctgcgccgccccaggaacggactcgaacgccgcatccacccttgctcatcttttctctcccgatcctacccatcccggattcaacggtagatgtgttttggttctgcggggtaccagtaccgcccgatacaacctgttgggccgtagcaatcctctttgttaaacgttttggttgcatcttagttaatttcagtatggttttgtcacattgatgtaattgggagttcagtaatagcttcttttatattaaaaaataggtttgaccattttgggcacatcaaaaatgatatttgctgaaaaaatgattttgcagtattttacttaggtaatcgttaatgatatttgaagtttcaaacaacaaaaaaattgaacggatgaggtacttcgtgaaccccctatatgctctctacttctactcttatagcggtgtttaaaaatccatgcaaatgaacgtttcaattttgaaagattagtaactataaataattggatactattgcaagttggaattgaaggtctcaaaagtacgggtcacagtcacaacttacagaccataaaaaactattagtgtcatgcaattcacactgcagggtacacctaccaaataagagtcaacagaatttatatatttttagaaaatggattaaaacctagtctctgcatccacaaggattgaatggaaaatgacataaacaaaacaaaggggttgccggtggttgtcggtgtcggcgtgacacccacatcggcctattcaaggggtggacgctgttcttctccgtagctcccaggtgcttatgccgtaggttacagttttataccagcaaaagattttctttttacaagagatattcaatataatacaaagttacggtttttagagcaagttttgaacacgaactcgaaaactctcttaagaaatttcagctggacagggaatcatctttaaattatctagagggaagagggagaagtatagcggacttcttcaagatgagccatcgatagatgcatccttttttggtggcgacgatatccaaagtctaaactacggaaagagatcgagggattagccttttggtgttgggtggtgatgagaagggggtagatggcatggtttggagggatggctgttttggtcattgttccaaaaatccatatatatatatagtcaatataagttagctttagctatcattcttacttttgaaatattacaaaattttccatttttagtatatcaaaagcttttttaatagaaaaagcttggtagcattatatttatgtaactatttctttttttatacaagagaattacatgatcaaagttatgctctattgactcccaaaagtatgaaacaacatttttctttaattggatggagtaaattaactgtcctcctgtttggttcggctatatatttgggtggtagcatataattcttaattatagccgaatatgcgcaatctagatagaaggcccatcgaaatttcagaatttagggccttccgtaccatgagaagtgagaactaaaaacatggacaagcccacagatgttcaattaaacaacacaaagcccatttaactaaaaagaaaacaaaagggaaaagatggacaagacacaagatcacagatactaccttcgttttcatataatagatagtgggcactattcattttcaaactttgatcagtcttggctgtgtacatcctccttcagagccgggttttctaatccattttctaaaaaaagactttgatccctcgtccttttttttaaaaaaatacaaatattacaaaagatacaaactgtatttcatcttaaatataaccaagatgctctcattcgttgtagtataaccatttaagagtaattatcgatcaaagttgaaatagtaatagttatggttcagttattgaaaattggggtagctttttttaaagccaaattaacatgcacatcagcctgaactttcagatacaattgcctgatcaatcttctgagtacaggtctcccagttacaagtatggctccacagtcaaaacagactgcctgttcacctccgtgagactgaggacatatggatagactgaccagaggccatcgatcgccttcacgttagaatcggttcacccccatgaatagtggcagatggggacgaacgacggcttgaagatggaagaaggaactcgcagctgagctgttcatggctttatcagaacacaggaattttacaggatttttaaaggaaatgttcggttcctccaaaattaattcttgctaaaatttctccaatccgactaggcatttagtgtgaacaaaaacaaaaaaaaataggagcgagataactacaagtacataaataatgttacatacgttagatttccctcaacggtgctcaaaatttttctagcaactatcaactatgcaaataacaactagtactaacaaagaaaaacacatgttgagaggcctatttcctatgtgtgtaaattctatattataaaattataaaaatgttaagatatgaagtccaattatctaaaaaaaattaagtggagggctatgttgtctacttcgtattgtcccaacggaggcttcggttgattttgactaaagtccatgttaggtttgagcaaacttgcattgagagcttatcttcctccggagaggtcagttgatactgtaccaaagcttgtcgacggtggcggagaagacacgatgatatgctcctgcccttcatggcttaggagttgtgccaatacctcatctgggaatgatatatcgccatccaagaattgcatgacttgcctcatgttgggccttgcactaggcaaggaatgtgagcatagcagccctagctttagtgctaggcatgcctcatcaatattgtattcattttgaagcctcttgtcgacgacatcaataagtgattcattgcgccaatgtagaagcaccaaatcaaccaacatgatagggcaatcttgctcttcactttgcataatgggtcttcgtccacatgtcacctcaagaaggaacatgccaaatgcaaacacatcggtgagaacagaggccctgcccatgcgtgctagctctggagctatgtatcccatggtgccaaccacatgtgtagtttgtgggtcactgccatggtcatataatcttgcaaggccaaagtcgcctagccgaccattcatctctgcatcaacaagcacgttgcttgccttgatatctcggtggacaacaactttctcccaatcctcatggagatagagtaggccagatgcaactcctttgatgatgtggaacctttgagaccaatctaggttttgttggttatcatggttgtgcaagtatttatcaaggcttccatttggcatatgatcgtacaccaatagaagctctcctttacgtcgacagtagccatgtagttgcacaatattcttgtgacgaaggcggccaatactaacaacctcagcaatgaactccctcattccttgccttgattcatgtgacactcttttcactgcaacttccgactttgattttgtaagcactcccttgtacactctcccaaatcctccgatgccaagcaagtgtttgtctttgaacccttccgtagcatggaataggtccttgtaagagaaccggtgaggaccaaattcaacttcccaatcttcgcgcagctcagcatacctcatttgccgtcgtctaagtacaactatgccactaacaatagcaagtactaatgttgcagtagctacaggaaggatgattatcaataacttggattgtggctttgggcctaaacgaggcagctttggtagtttcttgacatcgatgaccggagctggttggttcataccaaaactacaaccaagcacgtagtgatgtgtatcaagaatacccgttgaggatgaaaaaccaacatatgattgattcttgagaacctgtgataggtcataagtggttgtaagcaatgcccttgctggtttggccatatgaagaggggccaaggtcacactgattaacttcctctcgccattgtagtccacccatacttgcattgcatcgaaagaagcaagagttaggttgcagaaggtaccattcttgtcatcataatagccagcgttgtaggaatccacggacctaagatcattgatgtcgatgccaacatggttgtcattgatgtcttgcatatcgttgtttagaacggtgtcaagctcaacggcaaagatatggttgcttgtgttgccgttgttcttcttgttgaggaggccaagaaactggttggagaaggctcttgagaagttcttggtcggggagacgaagaaggtgaggccctgcgcgctcactccgggggcgatagaacggatggcaaacacgaaagagcggagaaggatcgcaccctcgtaccattggaaccatgctcgtggaagcgcagtggtgttgggtggatcgcatgacctttggactgtgccatgccattggtgagctggaggaggccatttggggtgaccatggccataccgttgacgaggatgtcggtgccagagaagccagagtagaggaatcgctcctcttctccagcagcagcgaagaacttatggctgagagcaaggaagagaaagaatgttttggttatgattttgatgcccacccattgctctggaaaacggatgaagctagtttgcttcaagccatg

SEQ ID NO: 60317 - DNA, 10185 bp, Oryza sativa
attcctgcagcccgaagctagtttgcttcaagccatggtgcaggtggtttgttgcctgcagttgcagtctataattaaggcagaatatatatacagtagaagttgcactattttattccagttctgaaccgtacctgagctgtttatgactgttaattactcgatcaacgctgaagaatatggtcatgcaagtacattagttcagtcctttcaaaatcagtgaccatggctaatcatacacgtttatgtcctcctcataatctaactcaacgtgggaacacgccattggattaaaattaagttatctttgcatcattaagtcataattttctagttcgagttgagcttgagctatgatctagcacgagttgctcaactctgactggtcatcacaaatataacaaattacttagcattctagaaaaaaaatgaatggaacaaacaagagactatgtatcgatggttcagtctattcagaattataacgacatccatccaatcatatttctccaaactaatccttaattcacagaaggaacaagtcttttcagcatataatttgtcaaaacattttgctcccaaatagttttgatacttcataaggtgattcagtcacagtagtgtttcttttctttttagtgattaccaggtatattggacatgtgcaattagtcgaaaaaagaacagtagtttcgtagtcaaagattcctatagaatagagaaacggttttcctaagaccatctctgggggtttggcttatcaataatttggagaccattcaatggtcaacttcatagcatgtggggctgctaagcttatcgagagcaaataaagttacaaaattaaggatattattctacagtcaataattgataaagaaaaggaaaagaaagaagacgtcgaaaatggaatgtccaaggacaataatatggatgaccaagttgacaatttcacgcaccataatatccgcatactcatccactttccttcctcgcccttctcattcgttcctcttcgcttcagccgtcctccttccttgaagggtatattggtcatatatcatatgatttatttacgattttagtgataagtgtgtatttatcaatttgtgcactatatagattaaatcaacaccttgatttcacacaaataccccttcctatccaaaatgcaagtcattgagagtattgacaaggtctataaagcaggcaatttgatctgagtaccaatttctagaaaactataggctttgatcggttgaactatagttgattagccttagaaaaatgagcgaagcaactgaaaaacagttaatgaataaaacttttatgtatgtttctattaggagatttattccggtccaacaaaaaatacctcgagataacggtaccttacggtactaaatcgtttccgatcgttggatctagctgagcagaatgggcattgttagattcaatgatcggaaaggatttagtaccgtaagttaccgctacctcgaggtactttttgttgaaccagagcaaatatcttctattagagatttaaaagccacggttcaaaaatagactacattaaaaaaaatcaaaatcaactctaaagctaagttttataattaaaattttagcagtggctacatgttatgaaagtatttttcctgatgaatacaacaacaacaacattacgtctccagtctacacaacattgatggtcaaacaaaacagtttgccaacacattctaaaaccatattttgggttgaaggtaaaaactaaaaaaaaaaaggccttttcctctcttttaatttttttggtcttgtgaaccaaagcaacaagccggggcccaaaccattgttgacggtgaatttcgacagtggagaccactccagatctagggaatgaaccttagctaagaaaagaaaaacagatcagccttaattaacagagacagataatgcagacacatgatatgtagacatgagcctgatcgactgtccaattaatctgcaggcccagactgatgaaaataagcactagtgtaatccaaagtgcatctcagggtgtgtttagtttacgtcaaaattgaaagtttggttgaaattggaacgatgtgatagaaaaattgaaagtttgtgtatgtaggaaagttttgatgtgatggaaaagttggaagtttgaagaaatagtttggatctaaactaggcctcattgtagtaatgtactatgctctgctccgagaaattccgaaacagatctcatttggcaggaggaagaaattggcagagagaagaagaagaatggggaacagtaggtgactgtgagtgaatgtgtgatggactcgcagtaaagtgaagtaaagaaaagcagatatgaatatgatcttgctgtcaaagaagaaattgaattgaaagaaagtaggagtagcagtattagtacagtgcagtgggggactgatggtggggggtgagctagctaggtagcttagctgtgtgcagattgtcggcatccggggagaatcccccacaaccacctttgctctttcttggatcatgtcatcctggactcaatcaatcaagtggtcatgttcatctcccagctctctctctctctctcaattctcacgtcctttttgttgtacgtgtcgatgtgttcatggcttttgctcctttaatctggcactacacttccagcctgtcttgccctcctctcctgatgatgatttcagtggtacagttttatatgctcaccatttttgacaatgttgcagatccatctgttatgctagcaaagtagcaagtcagtattaggttttactcgctttgtcgactctttcttttttcccgagggaacaggcaaggagttcatgcaattcattatagaagaagagaattgatctagtttataaggaaaaccagacccaaaaaccttacaacagtatggttaatttgtgaaaaccaacgaaaactctagcattgacagactaaacctaaaaactaaggacagccgtccattaaggaaaaaactcctaaaacgatgccctcaagaaggacacgccgaccgaacggcgacattgtccgatcctacgaatctaggattttcacccggagaaaccccttgatgtggagttgaatgagggctccaatagcaatgccttcaagaaggtgaacggtgcatgagagcgtcaccgttgttagcatcagcaagccgagtaaggctttcaccttggagtctcatccaaacaaagtaaccgcaatggaagccaccaaatgccacttgcacatcgaaggtatctgttatatgcacacaaccacctgcacattgttgacgacctgctcagccaccacgccggaccggcggagcttgccggcgccacccgaactccaccaccgtcggtttgcactggcctcacgccaggacctgcggagctgcaggagaggtgccggatctgggcctacgcggccagatccgaccgtccccgcgcggccctcgtcgtcgaaccgggagaggagacgccgctagcccgaggacgaaggccactggcgctgggtggaggaggcaagccgccggacaccccagatctggagaaaaggagggagggagagaagagaaaggatgaagaaggagacgggaagaggtagggagccgccgccgtcgccagcactaccatcaccggcggcctcgctggcggcggcaacacaagcgagaagcggccggggagcccccgcgcgcacaggctggcacagctagggcgagcgacatggaagtcacaggaacatcatggggattcggagatcctgacgctcccctctataatcatgacaaaattctttttcttaaaaaaaatagtatacgctaaatttcgggtgactgaagtttccccaaatctcattgaattgaaatataacatcgtcttcaacctttagatgatggagagagagaccatgggaatagggtggtttctcggggattagtgggatggatgggaagaaggcgaatcagcagtgggcaagaggcgccgttgccgccacgggagctatggggctagatcaggaaagtggtgggcgaggttagcgacgaggatgtcttggtggtgcgagctatcggaaacatggaagacgagcgaggtaggggaatatttgccacactatttggggaggagaatatgagaggggtgagaggggggaggggtgggaagagggaagcgataggcacaggcagcgctcattgttagcagtgggactaggaagtagcgaattggggatagggagatgttgtcgtagtgcgagtggctcaatctggtcgacgcattgtggaatcgggggagagagggtagaggggaagatagggtttcatgtgctgcatgaatctcggtgcaatctaagccgtccaaacgtgactaatttttttttgatactttcaggttacttgaaactaaacagttccattaaaaaaaactaaaaattgtggcgttcctattcttcactaatctgcttttatctctcttttgctgatgctaactagcgctttaattaataatttcagctgatcatcaggctcaactactgctagaagacagtcctatcagcaaaaacaaattggtactggtattagtaagctgagggttgtcacgtacgacacgcacacgcgcactctgccaacactaccaacacaaataaattcagcagctactctccacaatccacattactccagcagcacacacactggtactgcactgcactactgctgctctgcctgatcacacacactcacctctcaccactcaccacatgaggtttatcaatgctgcactcactcacctccatgacacctggaaacaccagccacctgcctcaccaattggcctcttcatttcactcctctcactcccagtagctgcaaaaccaaacaccctatcttcttcttcctcaactactactcctgttcttgctactgcctagctcagctactctgcttgcccccaacctatccaacctactaacattgtagtacactacacacaagcctagcttagcttaggttgcagctgtgtgaggtggggatccagatcagctttgctgttggagagatccatccatccatatagctagctgtaactacatacagttgttcattcagattcaggcattcagccactgcctgatttaggtgagggaagaagaaggttcaagcaactgcacaccagatggtccatctcttgccatgcacccatgctcacttgcccctgcctctcttcttctccatcctcctcctcatcttctccatggaggtggcacattcagatgcaagtaagataccaagatccctctctctttttgctttctttctagcattagcttctcactcaaccatatttgtacttcttcatatgcatagggaggttgccactgaagcttctagaagttggcaacatcaaggtaatcaatcaaacaaccaaccaaatgagttcttgcttctgccacattgttttcctttcaatcaatctgagtttgcatatgtgtgtgatgttgagtaggaggagcctgatgaaaccattggagagaagatggagatggagatggaagggaggaggctgataggatcaaggccaccaaggtgtgagagggtgtgcatgtcctgtggccactgtgaggcagtgcaagtgcccattgtgccacaggtgattcagaagacacaaaccaaagctgctgctgctgctgctgccgagcaagaacagcatgtggtggtgagtgctactgccatcagtgctgcagtgttcacctacagggtgaatggcctctcaaactacaagccattgagctggaaatgcaagtgtggtggcatcatccttgatccataatgttccaactcatggcagatcacttcaacattgtgcaaaaatgtaaacaacttgctcctctgcttgttcatctgaatttttctttctttgttgttctactactagctagtagctacttcctccttttgatttctatctaggccagagattgaaaatgtggggagatggagatgaaaagctgcatgtttgttgtacatttaggcagcaattttgtgaaaatgaatgaatgaatgaatgcctgatttaggcattgaatgcattttgatttggccctgacttggaggcacaggatattaaattgttgtgtgcattcaagccaatgaaatgagccatgaggcatggtagggacaaacatctgctctgctctctctctctctctctctctctaattgtgtgagtgtgagagaacagcagacagtacaccagaccagtgttaggtagttgtcattgctacagtgaaataaatatatatatacatatatgttttcttattcaatattaatcagaaggcatcatatttgttcaacaaatgcaataatattactacaaacagcatataaaaataattcaaactgaggataaagcctaggaaacactctcaattgttggtgtacttgaagaaaaggcgcgtgtccacaaaatgctgattatacaacaagttagtactcctatccagggtttacctttcagtttccaaagtgaaaaccgctcccttccggtttatcaaaaccaactaaaaacaggtaaaaaacgatgactttctattaacattgcacgaaaccagctaaaactaatcgatttccacgaattgacaaccaacagtttcacgaaaaccgactggttttgttaacttgctcattcatagggaggattgaaggaaatgcattgacaaagaaattaaaagaaaaaaaaatagaaaggtagaataagaaaagttttgtgatgattggacctttctgcagcaagcaatggcggaccactagaaaagcaggaggcaggccagggaggcagagagagagagcttgaccagagccatggctgctagcccggtggatgggatgatgcagatttgcacatcatgcagaggcagatcgaacaggtgtgtgtccatccatcgtccatgcatgtgacaatgtgagcagcaacatttagggtttgttttgggagcttctagcagctgcagcttctccaaacagtctagctttttacccaagttctaagaatctgtagttgtagaatctggaaaatgaactagaagacagaagctgggtttcccagcttacccagttctccagattctcaccagctagcttctcgctgcttctcagaattttaaactccccaaacaggcacttagctagagtagatgcagatagagagatagtaggagtagatagatgcatgcattgatctggtctggtctggtcaggtgtgctctccctttcatggcacggctggactggtcactgccatcggcccatcgctacatgctgcaccatgccattccaatgttcattacttcagatatataggagcatttctaggcatttgatattttgattcacatgcataagtatttttggagcactactttcttaattcaatcaccttaaattttaaaatgtagtcggttggtcgaacgctgattatgggtaaaaacgtttatatccgtccttattgattgaacgagaaataaaatgtaatggaataaccttaaattcaacttcaaaattaagttttaaatttaatttttgtcagtggcttgtaggattctctataccattgcatcattgtacatgatttttgtaaactactatagtaaattcttagaggcatcacaataatatctgcaaaaactacgagatatgattaattacatcggaagcgtagcctatgcacacgggctctcacatgtacacactgtgtataccaactaaaaattatcacaaaaaattctagaaaaattcatacatgtactttcgtactccttccgttttaggttataaaacgttttgactttagtcaaagtcaaactgttttaagtttgaccaagtttgtagaataaagtagtaacatttttaatccaaggcaaatttattatgaaaatatattcaattattgatttgatgaaactaatgtagtattataaatattattatattatctataaacttagtcaaacttaaaacagtttgactttgatcaaaattaaaatgtcttataacctgaaacggaaggagtattacatctacatgcaaagtcgcatctccaaaatcattttacatagagagtaaaaaaaaacaaaatcctgacagaattacaacctcaaaattgtaagatttttttaggctaaaatataataaatttgaggttacgattttattcctaggtgtaatacaattgaaagtatatgtatgaattttttctaaattttttggtgacatttgttagttggtgtgcatgtgtgtacatgtgagatcttgtgtgcatatataggatatgttgtctaattatatcatgggcggagtactatttaaaaatagtttatttttaaaaaatggattttcttttagatgcggttacttaagaccactgtctctggaaatataaacaaccgtatttcaataaaaataatcataacattttcatatgaagttaaatgggataaattttatatgaaaactttagccctagacgagttgtattactttgaagtcgaaaggcttttcatttcaaattgtttaggggtcaaatattcgctacaagttcctagtctcttctgaattttattttttttcttttgtatttttcaagcaacctaggatagagataatctatatcaaagttatatagaagttttatagctcagcaaggttcggagaggtgaattaagaagagataatctattctataccactgagtttgtgtgagttcaattatttgccatcgacattgtatctttctataatataccggccactttatcaattgttctacaatacgtcactaggttggacattcttttcaaaaatacccaaaatacccttatgaacatacaaggttaacaattgatttatctcactagaaattccaaaaaaatatgaaaacttttatgtggcctctttacacaacatggaaatttttataggagtttcaagttttttcatttctttttttaaattataacttatatgttatattgtatataaaaatattttttattattgtttttaatataaatcatatttcacacactacataagatatttttatgctatcatctcctttataagcgatttatctcatataccacgtaaaaatattttttgtaaaaatataaatataccaaaaaaaatttaaaacttgtatacaaacttccatgttgtgtaaggaggccacataaaaattttcatatttttttgaaacttctaatgagataaatcaattgtttatcttgtatgtctctaagggtattttaggtatttttgaaaagaaggtccagcccaatggcatatcatagaacaattgctaaagtcgtcggtatattatagaaagagataatgttgatgacaaatagttgaactcgaacaaactcgatggtatagaatagattctctcaattaaggaatagggaacatcctcctttagtcaagtgatccataagtgagttaaggaggttacggcccatttgattcagattattgagcggattattatcgtgaaatatctaattaattaccaggcaacttaaaattttaataaataaacttaacaaacaacttaaattaagtggtaagtaatgcaatacaagaaaatatatctttttaaaaaatatatcttttaatgtatgaagcaaataatccatttcaatgatcccgtaaataatccgaaaagaacaggacaccacacatggagagagagaggtccaagagaccaagagcgtatatcatgttcaaaatcgcgtgacttgtggcatagaccatggatttagtgattttgtttctctgagaagaagctataagcagcttattgtccctatgggtttagtgatttgtgctcaacttacaattagagcaaggataataatgggctataagcaagctatatgcttatatgaaagagaaagataaagaaaagtgggtagtgttggctcttatacaagagccagcttcacataagctccaagaaatatgaattaaattcatagagtgagaaagagagagaatggaaaaaataaagttaaacttatagctaatttattatacaagttaactctaacattaacttatagcaagtagtgagctattgtattaaacttgctcttacatgg

SEQ ID NO: 60318 - DNA, 6508 bp, Oryza sativa
taaacatcactctgtcatctttgtttgtttgcctacctaatcccttctttcttctgtatagttggtatgcacttaactcattcattgctataaagctgatcccacagtaagccacgtcatcaaaattaagtaggccgttggattttgatctgaacgatcagtattccctagctggctggctcacaaaactggcggctatatcttcctctcgcaggatctgtttcttccatccctaggtaatggcgtaatgttactctagcggctgcttccttcctttcttcagagtatggtttgctagagcaatcacaggttactactcgccttcgattcctcactttgagtgctactgccacatcttggtcttcattcatcttttcttgactatgtgaattgaagagttaacccttctaattttaatatagctgtacttacaaattctctaactaggagtatgtatcagcattttctctacaggatgaagctggtatcctggtagtcaactagattgtgccaaaatagccaaacaaggcagatcgatcggatggtaagtccatttctatcctacacacatttactactgttaatttcacatttgcttcaggatgatttttcatatacattatatttgatctgagaaattgcaggatgcatgtacatgaccatattatctacaaatttatcctaattagtcgttgattaagagaagattcagaccaaccgtaagtttcttgacaggaagcgaatgcgctaaataggaattcaaagatcagtatttcctttttaaaataaccttcagttccaactatttatttcgtgtgctgatgtttgatctgtatgcataaagataaaatctttgttgacttttaataaaacttatggttagctcttttatgtagtgcacacatcttttcaaagttatttgtctacacaactatcccgcagcaaagcgcggggtgtccactagttaatttgagagtggcccgagggtaagaattccagttattagtaatatagataactagtttgttgatattccacgctttgctgcaggatatgtggatgaatacatgttatatgttatacattatggaagtggtagatatatatatatatttaaataatataaaaattatgagaagataatgatttgacattgtctgcatattgagttctaaaaatacaaaaaaattatagataatatttatatttgcattatatttaaaatactatgtataataattatgtggcacacttacatatgatttaaaatactctagataataattgctagtgtgtgatgatgggtagacttgtatgatgagctaatctactgtagctacaagctagtactacttaaataaatatttaatgtttgacggttttatgttcttcaaaattaatttgactttgaccataattttacattaaaaatttatgtttttgtaatagtcattttcatgcaaaacaatatgctatttttatggttttagaataagtatgttagaaattattaatggtgtttttaaaatcttaactggattttattattatacatgtcgaatatatatatatatatatatatatatatatatatatatatatatatatatatatatatatatataaaagactattctacacccggagtatagaatagctattctataccccccttctaagggccaaatctatctcccacattagtctaaggctagtcaaagtgcttccacgtcggtcaaacctcaggtcaaatccgcctgtgacttctcccatcacccaccctttttcagctctcgtctcgcagagacggtgcagtaacgtgacggtcattgtgtagtaacgcgtagtttacttgcagtaacaacggtaaaatatagttaaaatatagtcatgacggatctacttttaacaagtacttttttttctagcatcatggcgcaaacggttttaaaaaataatgcatattttgcgagatattgctcttcaaaggttagcattttgaagtttaatcctccacatgtagtaacactatagcattattgttactaccatttgatccgtgttactgcgagagtgcagtaactactacaacttttgcagtaaaagtgtgttattgcaattgcttggtaatgttaccacaagaacgtaataacaaccaataaattttacatagagaaaaaacaaatggtttgctttatgatgaggaggacatgtgagaggcgaggggtggtgagtgtttgcttgaatcgggaatattaggagtgcgatgggaggccacgaaccaccaccaattttgcttaactagtcaaagtgaatccatgatgtgtaatctcgttcaaactcccaagcggatgcaacattcatcttgtgaaaattgtgcagtaacgttagtgcccgcgtacagcaacaatatatgtgttttgcagtttactgcaattccatgatgatgttactaagaaattgtaacggaattgatttgcttctttcatggaggtagaaataatctaccttgtttttgtttgaatagcgtactaaacaatatgtgatagcatattagaatgaaaatgatactatacaaactgtccaatcttggtcaaaccctcaagcggatgctacatatatctagttagaattgtgcagtaatatagtgctaaatagcagtaataacttgtgttttgtgtagtaacctagcatgttactttaattccgtgatgatggttactacgaaattgtaccatgtatcttacacgtgctaaatttaatttactatgtgtttttgtttgaacaatgtattgaatggtacggacgagggaggagagtgcacacaaggcgggtgaggagacatgcgtggtagggcaaaaaaaggatgtgttttgacatgataggttaaagcatcacatgctaaccgtatacttattactgcacaaaagtataagtgttactacatgataggtgcatgttactacttccaagtagttatgttactacttccaagtagctatgttactgcacgataattgtagcgttactatgtcaattttacgagatgaagatcgaataggtaggccataggtaaagtctgtaggtggctttgagcgaggtctaattgatgtatgagtgttttgaataattttatacatttggtaaaaccatgttactgcatgtatatgccattgttactgtaaattatacattttgttactgcatgtggagggctaaagttcaaaatgttctttgaaaagcaatatctcacaagatatatattatttaaaaccgtttccaccatgatgctatggtgttactgcatgtggagggttaaacttcaaaatgcatctacgtactcccctcctcaagaaaccgttcttcctctctcttctcaagaaaaccggtatcctccctccaatatagtgttactgcatgtatatgacgttactgcacttttgacagtaatattgtggtgaattatagtaaattaggaattgaaacaaaaattatatgtgttaaaagtcttatatgccaaccatatacttgttactacgtaaaagtaaaagagttactacacgacagatacatgttaccacgtttatgcagtaacactatccaaaaatgcagtaagacactttgttactacaaaacttatagtctttactatactttttacagtaacatcgtgatagtaacacttatgatatagtattcatatagtattattacttgtgaagagttaaattttaaaagactaatctttgaagataatatctctccaccctttgccccgcgagtaaactgagccaattccacatattcttgtagtaacgttatcaagtaattgcagtagcacactatgttactgtgaaacttataatcgttactacatcttgtagtaacgacatgatgtgattgcagtaacgcaaaacaggcagtaataacacttttgatatagtattactgcttgtggagagttaatttttcaaaacaaatctttgaagggtaatatctctcacatcatttactaattttaaaaactgtttgcaccatgatgttcaaaaaaaaagtgcttatcaaaagtagatccatcatggctatattatgactaaattttaattttgttactgcaagtaaaacacggtgttactgcacgatgaacaagacgttactacgtcgttctgagacgagagctaagaagagagggggtggtggggaaagtcaccggcgggtttgaccgagatttgaccgacgtgggagacctttgaccggcctttgactgaggtgggaggtgggttttgggcccttagggggaggggaggtgggttggagggaggggggtatagaaaagctattctatacccgagtgtagaatagttttatatatatatatatatatatatatatatatatataatcaccaaagtaaattatcaggatttattttttcttttaaagggcaagatattttattattatgtatgagaggcggccgttcgatatttctcccatagatcggacgctcgattcgtagtttcttcctgcatggacacgtacctgcggacgagactaccgatcgggcgcccgatgaggagtggaaaaatcgggcgcccacatcatgctgacgtcagcatgacgcatgcatgcaaaaatactttaaactattttttctcttaaattatttatccaaatcatgatccgattacaccattaaattcgttgcaattaaatctttaaaacaagaccatacatggatatattctgatgaaaaaataattagcttattattgaattatttttaaatgttgcacagtgttccatcgagtatatcggaattgtctcactaagtagatcgaaaatgtttcaatagtttaaattggacgatgtttcaccttatataaaaacaatgtttcagcaaatagcgaaagaatgtttcaactcactgcaacatttgatctatacatagtgaaacattataagtacactaggtgaaacattttgtgtggcgctgtttcaccttatataaaaaataaatgtttcagcaaatagcgaaagaatgtttcaattcactgcaacatttaatccatacatagtgaaacattataagtacactaggtgaaacattttttgtggaacaaaaattaaaacgaattcccttaatagagggtttctacaatatgtgtgtcagggttatggataccacatacctaatagtagttgactaaatctcggcaggacccatcacataccatgtcctttacggaaacaaccttcagatattgagggagttccggataaggaaagacaactagagttctatatggaaatgacaaggactactcggattgtatccatattggtttctctagttctaatttgacaaggggacacctatgggtataaatacgagacctcctaggaggagaggacgaccacctcaatcaacacccaccatagacgacgcggaacaatagatcaagacagaagatcgacatacaagccaacatacaccaagacaagacgccggatatcgacttcagagataggcacggctagtcccctacggtgtctcaagatactgataggagagacattgcgctgtctctgatcacgccgggcacgaactcgaggaggaatactaccctgttgtcgactatgagtcagaccttcagaccgccatatcgacaacaattagataggctatcccaaatattgtattggtgtgattatgatgaataagagcaatatcggcttcggccaacaggatgtagggttattacctgataatttaggggcccgaacctgtataaaaatccatgtctttgtctcttttacctcagtctcgcgtatatcctagtgccaacgatccccatactatgcaaataccgcaatcgcgacatcaaacgtcgacaatatggttgatttgttgcaaaagaatgttttaattcactacaatattagatctatacataatgaaacattatgagtgtactaggtgaaacattttttatggaataaaaataaaacgaattcccttaatagagggtttgtaaaatatgtgtgtgatttgtttcaacggattaggtgtgtggagttacgtggcaggtggacagagccatatggtggggccagggggacacgtgcgcttagcgccagaaattttccctcccccggccgatagcgagcaattccgcgtacatgccaggaagccgtgtatgtgtttccttcgcgtgggcaagtgcatgtactactggtcactaacaatgctcatttaatttcgcttttgacctcaaattaatcatctgaacagcatgaaggcccgttgcaggaataatcctatttattctctcacctactcacccacccaggccacacgccgtaaacactgaaacacaccaattcttcagagttttttcgctctgaactttcttcagcaaacaggcctgcataagatagctagctagctactactacatatacactatatggtttttggctgatcgatttgctatcatcctaactg

SEQ ID NO: 60319 - DNA, 663 bp, Oryza sativa
ccctttcctctcctcccctcccctctcccaccttttctctctcggcatggattccggtcagaacaagcggtggctgcgcagagggtggaaccagtggcagatcccctccctcttcctagatccggtggagggcggaggcggcgtggagggtggatgcggcagcggctccgtcgggagggagaggtcggtggcggcggcgaccctcccctccgaatctagcgcggtggctacgcctgcggctggatccacagccgccgttagatctggcgaccgaaaaagatggcgcggtggaggaggatgaccgcgataggcgctggtgacggagtggcgtaggccgatgggtgcggcaccatcttcaccttcatcgtctgccgcccttgcacgggacatcgcgtgcacgtcggcgtcagtgcgcccctcgccccttctccttcccctcgcggcgatgtcgaagccggcgccagtgcccctacccctttttctcccttccctagcggcgacgttgggtcggaggcagcgtcggtgtcgcccccccctccctccgctcacggtggcgtcggggcgggtggtgcgttggtgcgtcggagccgacgccggtggccccggtctactttgagtgctccatcgacgtcgtgtcctacaattgcgctgcctactccagtt

SEQ ID NO: 60320 - DNA, 6625 bp, Oryza sativa
aattcctgcagcccattcctctttcacgtagaggggccggcatttgattgtactaacaatcataaggaatcatcatatgtacaccctcagtcctagaataagttaatctagtactcgctccatctctaaatataagagattttggttggatgtgacttatcgatttattgtagtaggatgtgtcatatccaaccaaaattccttatatttagggagagagagtacttgatataacacattttagtgtccaaattatagtattaggatgtgtcatgtgcagtagcactagagggtgtatagtaattttcggtaggtacgtggatgttaattgtggtgacagggaaagtagactgctgctagagagaggaacatttggtttgaagcacaggtgttttttctgtgtgattctcaaggagcagggcatgtgagagcctgcagtttaaaagcctttgcatcattctatacacctctgcaacaccatccatctttaaattctctaaacttcattagtagtactattttttaatctgtctcagtttccaatggctgcatatcacccatagctccatcatcagtcatcagagcaagtttaacagtatagtcaactattagctccaattcatttatagccaatctaatagctcatttatacaatagttacatactacactattaatacctggtctcacttatcatacacacactgcatcttggagtctgtgctacagctggctataaatttgtagcccgttgctattctctctccttatttatttacttaaaatatgtttgcagttggcttatagcctgctattgtacctgctctcacaatgcgtggcttgagtggcttcctcgtttttttcttttctgaaacaatagactgcattgctttctgaacccgaagagtgaaacggaagtgattgcaagtttgcaacagagaatgtggagaaagataaaataattagactgctggacgaaccgcaaaggcacccatctgatatagctgaagcgctgatgatgttgatggtgctgatactcatgggataggattcttctgtctatcttttttcagttacacaaaacacacatagaagtaatttatagagccgccaaccatgtgaaaaatgaatagggatatgttggtgatttccctagataatgtctaagggtggtttctcaactacactttcccaacttacactctatcgtttttcacatatacgcttcctaaactaataaacgatacgttataaaaacagtacatattgatattaatagattttttaaaaaaaaatctatagaaaagatatatttttttaagtttttagctaatactgtgctaatccatcattccgttttacgtgttggataagaagggtacctaattccttcaaacgaacacagcctttaggccccctttgaatcaaaggaaaaaccataggaattctagagtattttatcctatgggaaataatcttatagagtcctttgaaacaaaggattgtttcctatcaattactttgaaattcctatggaatgaatcttactagagcaattttggaggaaaataagcatgaggtctcacctcatgttttcctcttcatgtgtctaagattcctgcgtttttcctatgtgctaatcaaacgacagtttgaagactttcttgtgcttcaaaatcccataggaatccaataagtatggcattcaattcctacatttttcctattcctatgttttttcaatcctgcgattcaaagggtccctaaatctctccaccctcggaccgggatccatctgtccgtggaggatccaaaggccagaacggcggcatcaacggctagcacgaagacattgacatgagcaccacaaactctaactccttgaaacggcttaggtcaacggtagaggggagcaaacatcgccagctgttccttgaaacggcggcccaataggttaatcgtgatagcgtttacctcttgttccattccctatacatgttttttgaccagactcaggtaactcatggtagtactcatctcgtcattaacttgccgcacagcaatctaccagggcaggctgcaaaattatgctggtgattttagatgtatactacttccaccccaaaaatataccaaatacatagccaggatccctacattttcggacgaaggtagcatgtattaacactaggtggtctataaaggaaactgacagaaaatagaagaaatatataataccattacaaatcgacaatcgcatacatatattgcagtacatggttagctggggaagcttgtgaaatagaactggttaaatggacttacattacatgtcactggaagaaacaaaaagattaagatttaaaaaaaaaaacagtttctgccagatccaaagacttcagttttgcagcaaattaacaagtcagcatctttggtggagttgccagaaaaaactcaagtctgcagaagggcatagttctgagcaatgtacattccatgactatggggtttacaggagtaacattcagtctaattatttaagacgtgaccacgtgaatgatcaggattaacattacacattacctagtggaagctacaatttatctgaggatgagaaaaaggggaaatgattatgtacatctcagccattacatatatctaaaatatcaggggacaaccaatatagaccgaatccgttaaaagccggttgttattactggttttcgccaggttgagccttttctcacattcctcagatggtcaggattcaggaaccctccagcatgaaacaaggtaattaataactttgcccatcttgcaagtctgtcaaacttagaatattctcaacgcatggaccattgcatttttcacctcatctcactgaagctgagacctgctactgctttcaggccagtggaagctaggtgcactgttgtattgagacaaatcgaatgaaatagtctccacctagaaagcaaacacaattttgaaaaaaaaaagtgagaagggttttatctacatcagatccaccaatacagaaagaacagataaggagaaaaacatgggatgtgtatatttgatcttactccataagggaaggtttcgtgtgcaccagtagatgtcaatggccatccctcattaacttgattatgctgcacctaatgagaaaaacttcaatattagacgaccacaaggaaaaaatttcaactaactcagcggatcttattacaatacatacatttgtggcgtcagttatgctttcggttgtggtgactgccgtgtttaaggtatttgccatggcattccttctcttgttatatgctcttttagttttcttcttcaaggtgtcaagaacattcggggttgccagtttcttcttgcgggaacgttttgactgaccttgtacaacatcccatccttttgtactaagagaaatgggcaaagtgtcatcattaaaatcctcattcactggattgtatgcaaaatttgcggttgaaacatgactatcaaccctctgatctcttagtgacttctcataagaaatcactttatcccttatctccctcatgattgataaagcatagccctttgattctgagttcacagaaccaaattccactacttctgtgaaatattggtgagtgagtttgtagagatcatcatagcctcctgtttcctgattacttaatgatacaggctgtgacatggaagaacaagtttgtttacaatccttgcaccagcgatggatgatgtattttggtggaatcattggtacaaactcctgcctcagtacagtaagagcatgcctgcataatatacctttgaattggaacaatcggcagagacacaatatgtcatcttcgacattatcataagcaactttgtagtccaccttctttgtttcatcaatgtgatctgaaactatgtatgtaaccactgattcattccggtcaagtatactataattgcaatgaaaagaatgcccgatttcatctaagaacttctgaaatatctccaatgtgtacatctttgctgcttgctcctccacagatacaccagtcatcaccggtggcctcatctgagatgaccgtaaatcctcatagttttccttttctaacttaactttcacagcagactcatactgctcaacaaacatttttacagaggtatctggcatcaaccagccatcaaaatagtcagatgcactatcacttctttctgtaatagacattcctgcccaaaaggaatccttcacataaacaggagcccactgtgtcctgacctcaaatagtttggacaaccattcgtttccctctagatgaaattgttcgaccatttcttgccaatctttgtcaaaatcaggcatggtaatggaatcaaaggctagtgagctaaatgcagaaactatttcatccttcttttctgtttcctccaacttttcaggaagctcatttaagatgtcgagaaggcaaaagcggtaacgtgcattagggaaaacctttttaacagctattgcaacatcatgacagtagtttgtaattactgaaggtggtggcgtgctgttcatacatcttacccatgtatcaaaaagccagacgtaagctccaagagatctaccagcaagaagaccacaccctagtaatacttgctgagcatggtggttagtgcccacaaatgacacaaactgtatttcatattggtcgctaaagtttctgacattaatagcaacaacatcaccaaagtaattgtaagaagaacgtgatttggcatcagcccaaaatacattccttagttgtccttgctcattcatatccaaactgtaaaagaagtacggattttggtcttgcattttgttgagaaaactcaataaggcatctagatcaccttcagcaagcttcagtttcctatttctatctatcttggtcctgaattcaatctgggtagacaaaggtatgccgctatcaccgcctctgctagaaagcgcagcagctgagctactgtctggtgcttcaagcataagaggtggattctgaaggaaaggagagttctttagctgcttcttaaatttaagtaagctaggatccaacggatggttatgttccaactctagaacaataacttcccagcggttttgaaaatgagcatccttaacaatcatcttagccttgcatccagtctttgtgcctcgttttcttgcggatctcgtcgcgccagacctcagtctagactgccctcctttagagcatatgaatgtagagcgatagcggaaaccatcgaaggtattgttcgatcttcttgtgataccaaaaccagagcggcagccgtaagacacatagaactgaaaggcgtcttcctccgactcaaacaccatccctacttttggtacaaacgcgggatctatatcaaccggcttgaagatatcaccctcggcaacatttccttgtttctcaccatcatcttcttgcatgtcttcctcattagacgattccgtattgtactcctcctcttccattggccccaaataatctagtcaggcagaaaatagaggaaataaatcatgccctgtgtacatacatatccttgacaaaagaatggtggccactaacagaacactctgcgcgtcatcatcacatacgaaggtaaataaactgataagcggaaacagtttataaaacaaagcttcctaggctttgcaacacccagtgcaaatttccaactctactgacagtggcggatctaacatgggacattgggggttcagttgaaccccccaaaccttcttaggaaccatcaaacagttactagtattaaggttaaggcaaatttctagagcagaagctagggttaacgcaaattcgagaaaaaaagtgcgtgggtagagagagagagatgggaaagaggatgtgcgtaacggatgcggcggaagcagcaggacgagcgacggcgacccagctcgctcgctcgctcgcacgcgcgattggatggggatcggcggtggcggaggatgtgctcaccaggatgcagcaggatgaatgacggcgccctgctcgctcgcgggatggatggggatcgccggagccggagccggaggcggcagcggtgggcaagagcaaactaaagaggaggggtcgtcaggataagggttaaggcagtgttcttccccataaattgcacccacggtgcaacaacttgtcaggtgggtacaaataatttttaaaagttactttaaaaatcatatcaatctatgttttaatttttttaattaatacttaattaatcacgtgttaataggcaacaccgattttcgtgtgtggaggtggagtcgaactcagcctaattagatccatgtcattataaatttgctgttttagaaaaatagcattactatttacgaaattagaaacatgccattacaatttaataggtcttcgagatatactactgcttaccccttcaccatgctttctaattttttcggaccaaattatcctcgcgttcttcctcttctcatttctctctctcatctcacccctcttctctcttccattggtcaacgccatttctccgtcgatgagctccattgggagatggatatggagggtggcggaaggcggggctgcaggaat

SEQ ID NO: 60321 - DNA, 4001 bp, Oryza sativa
tagacaacgtattgagtggtattttatccggtgcattgtattaagtagcatttcatccgaacccaatctatagggtggcatactgtccattttctcgctttaccatgggatctcgtttggacaatacgataccaaggaggtatatcagaattagatcggatactcatcaggtatcatctcatatctcgtagttactagctaatacttatcggtaccaagtcgatacccaacggccaatggtacagctcgatatccatcgggtattagatctgagctaaaaggagctaaaaggagggagagaataagggaaggagttggttacttgtatcggtttgctcatctagaaacgatgacgacgacgaggtcgggcaacgtcaaatctgatcggtaggatttcagagtttcaaatccgcctcggacaagcaacggggagggcatagatatttgctttaaccattcccattccctgttgtgtgaacatgagatcctaatttcgacagcaacaattgctttctccctcaacgtgacgatttcggctacaacgatcacgactatcgcatggctacctcgataaccatacaagggctatcatcattaagttttcttgttggtttgtactcagttctaagcggcatgggttatgcctgaactgcatgggattttggagtatatgattaagatcgatacaatatatagttgttatggttgatactgttatgctagatattacatctttagaattggttaacatccaaatcaattgtattcttttctgcaaagaatggttcattacaatcgaaccattgtatgcggtacatctccccttacacaagctttcagaatttcagttttctgatgggccaatttgtacttgggtggagacatccttacacgtctgaccaacctaccaaaggcttctgccgtcacttgtgttctttctatttatctaaaaactcgtgttgtttctgcagagcaaagcatctctttagcatcatcactcaagttctcatcaatattcaagatcatcctgaatgtcaattgtgatacagaagcaacaggaaaaaaaaagaaagaaaaatgtctgcaaaagaaacaaaagccattcaaccaaactgctatcagaaagcttaccagcgtcacagagtgagagacaaggagaccaaactgcagagattaccatgatgaaaaagcagagtcaaaagagaggagtgaaaaaaaaaaagcagcaactgtgcttgagcaagcaagaggaagcttgaaacaagctggaattctactaatgcaattctattcccctaaatcgatcataatttatgctgcaaataaaataaattgaaatgaaaaaaattgcatgcttctcactcctacagatcgatcagaattcagaacccaaagaatttctcccgatctgaacaaaacccaccccgaatctctgatcaagaaagggatcagatcaaattggtgcgacgttttcaggtgtcgagctctgaatctgcccatggagtcttccgtttctactagccattgagcgcaatggcatcgagtgatccatcctcgcaagaatcccggcggccatggcggcggcggtcagctgctggagttggggccgtagcacgcgccgcggacggggttccagagccactgcaccatgaaccgccggccgttgacgccgttgacgttgtaggaggcgccgtcggcggcgcgcgacacgttcccgacgagcccgcccgcgccgccgccgtcgccgtacacgccgaggcagaggtcggcgatctccgtcggcgccgtgggcgtgtctccggcgtaccacgcgttcaccagcgggttcgtcgccagctccgccagctcgtgcccgagcacgatcaccatcccgtccaccccgacgtcgccgttcggcggccgcagcacctgctgcccaccggcgccgccgccgtagtccggcgcggcgaacgggtacgcgcacttgcccgggcactgcgtggcgctgttcccgacccacgcgtacggcacggtgacgccgacgacggaggcgaaggtgaagtagtggaagccgcagacggcgcggcagaactcctccacctggacgtccggcgaggtgagcaccaggtagacgccgctgtaggggtcgagcgggagcgggtccgggtaggcgtacacggcggagcggatgacggactgcatgtcgatccgccgcagcgacgcgccgtgcgagtacccggcgtcggagcgctcgccggcgacggcgaacgcgccagtcacgtgggcgcccgtctggtccgcgtacagccgcggcgcgcgcgcccaccagtcggacaccgccggggacggcgccgccggggccgagagcgaggcgaggaagtctcggagcaccgcctgcgccgcggcctcccaccggccgtaccagatgaggtagaggttcgtcggcgaccccgacacgacggggcccatgtggtactgcatgtccaccagctggttgccgtccaccaggtagtcagcccggtacaccggcgcgccgccggcggtggagacggcggcggcggcgaggaggaggaggagtggaagcctccccatttttctcgacgagtggagtggaggagtgagagcgtgggggaagtgaagtggagtttttggtggtttttgagtttgaattccgactctttttaacttcaaagtttggttgtactaccaatgtggtgataaaaattgtgacttccaaaaaagaaatttgatggacttgcattgggagggaggccgacaggtgggccccatgatgtttgtgcgtaaatatccaccatctgatttgaagatttaaacccgggtttataaaaacgtgcaattcgaatgcttcaattcgaaacggacatttttttatatatacttctaaatataaaaattacataaaaagatatattgcaattttttcataatataaatatactagtataattttaaacatttaattatgatatactgagtacatctttattttatcaattatttaagattttaaggtttgactgtatacattatctgtttggaaatgaatggaatacatcagctgatctttaacggtataatccacggaatgaattatatacacactcttctatttataaaatcagacttgtgagtggatttcagatcaaatttgcccaagttgatttaaactaggtggcatatgtggccagaccaggggaggcttcctgctagatctttttaatcagactggacccacctacttgatgtgcatttgcgaatagcatggaccacatgtcaacggctgcacgaagctcgaacatggcccttggttctagaagcagtgcggatgacgtgtgggccccacccagcggtaaggaatcatcatggcagtcacttgttgctggcttgcttccagtggaaagcctgaagacttgtggtacaactgttaactaaggccctgtttagataggactaaaacttttaaaagtccctatcacatcggatgtttgaaaattaattataaatattaaacgtagactattaataaaacccatccataatcttggactaattcgcgagacgaatctattgagcctaattaatctatgattagactatgtgatgctacagtaaacattctctaattatggattaattaggcttaaaaaatttgtcttgcaaattagctttcatttatgtaattagttttgtaagtagtctatatttaatactctaaattaatgtctaaatatagagactaaaattaagtccctggatctaaacaccacctaaacccaattcagcaatattgaatgattcggcagacgatgtaactaagagtacaatataaatactccttccgtcaagaattagatttaacataatctaatacaataaatctggacaggctctatgcttagttattttagatgaaaaaaggagtataatctaatacatatatgacatatcgtaacactacaattctaaacactgtctaaaatatgaattcctctttcacgtag

SEQ ID NO: 60322 - DNA, 614 bp, Oryza sativa
agtcacatagataaacattagttaacctacaaagaaaagtatcaatacatgtgtctgcagccttgcactttcgaagttcagctataattttcaccatgttcagagaaaagaagaattactacccatgctggtgaaaccattgatgccaagctatcaataaagagactaattaagaaattaaagccgaccaagtataaatatttggtacacagctgagacaacagaaaacacaactctctggaggaattaacaatggatacagtctcaggtacactacaaccaagcaatctcctcatcacacatgcacatacatgaccagggacaagtaagaaatcaatccatttcagctgtctgtcttcaggccggtcgatcacagattcacagtatgcaggttctttgaaggagaaactcaacagggatcgaaactacaactagctgaagcaacaccatacatgcagtactgcagcatatgatgaactgataaataaataaatatatatatatatatatatatatatgtagcagatatctccaggcgatgtcgatcaattgaacggcaatggagacacgccagatgacggtcagttcgatgtcatggtattagctgatgtgga

SEQ ID NO: 60323 - DNA, 24074 bp, Oryza sativa
  unsure (1)..(24074): unsure at all n locations
ggcccaatcaaatatattccactttggcataagttcacattggcttcctcaaatatatatagntttaatctaattcttatctctcaatcgctcctctaattattaaaatcgatgcaaaatgacccccttgatggttttgagagcggtttttttgctaatgtagctcattgacttagtttgaccggctgattcagtgtgagacccatatgtcagtgcatcctcctcttctttctatttttctctctctcctccctcctcttctcttcttggtcttcttggaggcaggggacgatattgtacatgcatgggtggcagccgagcttagcgcctacggcgaggccgtgtgggtcctcgacgccaagcaagaggtgttgagcctgttggcaccggtgacaccatgtgcgtggtgcgatgtcatcggaagtgaggagccaaggagctcaatcacccgctccacggtggtgaagggaggcgaggagccaaggcgcatgggcggtgcccgagctctgcgtctatggcgaggccgcacgggtcgttctcgacgccaaacaagaggtgttgagctggtcggcgctagccacgccatatgtgcggcgtgatgtcatcggtaactaatataaatgaattaattactaatgatatcaatttttttttcagaacagatatcaattagagtagttaattgatggaaacccacctgagttcgtcgccgcggtatcgcagtgcgcgcgacgacaagcggcggtgtcgcggggctagcattaatttggtcccttttctatagtgtacaattcttgttccaaattaatctatacgctctagaaggatgattaaatttggaaatatattaggatgtaattttttttggcacaaatataccattgatatcgctaaatctttgcacgaatataacgatggcgtgacgagtcgacgaagagcgccacggtctcgtgggacgcgagatgggcggtgtcacagtgcgttggcccgaaatggacaacgttgtcgtagaccaatcttcaaactttgaagattagtaattaaagcaaaccttgcatgaattaagtcttccttattacacggggcacatatgtggtagaaatttagtactcccgacattccatatggcttgcactagtcaacacagtgcatgttaaactgttaagccatatggaatgtcgggactggtactttgataatagaatatttatacctttttttttcataaagatgagtggtccaagtttatacatgaatagtatcttatatcaagtaagagggaacggagggaataatagcatcaacaattaagccaacctagcatgaagatcaatggaagacataaacgttgtactcgacaatggcatcaagtccgtttgggtcgagaaagtaggtgcgggcttgggcatagccacgagcgaagcgaaagtggccggttccgcccaaaatcggcatctcatggataatgtcggatatgtggttgctgccaagcactatgaccacgcttccattatacgacccagcggtgagcacgatattcatggcctgcaagaagcctatccgggcttggtcagacgagacatacatgccctgggcatggcccacgagctttgatgcgggatcgggccgttcggtcaatgggtcatccatgacaaccaccatccccaagaaggtcaacgatgtgttgtttggggggtttactaccctcaccgctgacggtgacggactggtcaccttgtcatggaagtattagtgtaagtgcgtcggcactaaactgttgcctaaggcgttgggcctagacctgtctttcatgtcagccttagtagtagtggccaacacaaataagagtacactcatcaccggcaatcctcttgccattttgatcttagaatcgaatttgcgttaatttgagtcgagtggatgatatactcatgacctatttatggaggcaagggataggacaagtgtgaagcagtgattgagggaatcatggatatctattgtctcctcatgagcaatggatatttcattgacctgtccttgtagaccgagtgaacaaccgaaagagaataagagattgtaatgttttgcatttaaattgtgtatatgtgtggacagtattgaggtacatatatgaaaaatgttactatcactaaaataccccaaactagttggctatttttagttctccaaactgaaggatgcgttaagttaatttggcacattatacgtacaaggaaagactgaaagcaaggtcctaaccagcagcatcatagctagtcaatcaatgcccaaagtccacacggtgcaatatcagttgtgcacaaaaatatgctcctagagggaaaaaatatatgtttgaaccaaatcctagaaaaaaaaaatgaattgcgtgatgcattaagattttcagcgccaacaatgtagtataaatgaacaggaagcaatggtaaagaaattaagcacaaaaaaaacatgctgtaaaaaaatggaaacattgacaattgtgaagatattatttatgtggaatgtactacgttacacttctcacatagtattacctccatcccataataattacatttctagaaattagagatagattaacatcaaacacaatttatcacaataaccatatatatttaataactacactgcatgcgcatattctatatgtctatacttgattaaaaggaaagttgagcaacacattcgatatgtaaacttaattaaaatgaaggttgggggtacacattccatttgttgttgtgtcccatcttaccagaaatacaattttttaagataaaatttgaatggtagaaatacaattattatgggacggagataattcttctataaaaatcaagcaatataattatacttgcgtgtagtagtatgcagaggaaatagttaacatttggcaacaaacatccatgaaattgctgtataaggcccttaacaaacttgttgcctctgtagaaaaaaaaaaacttgtgttttcagactactcgagacaatcacaaaaacttctgtaatatggcatggttggcattatcgttctaaaaaaaacagtttgttcacattcaggtttcataattgtttacatatgcattttgtacccgtttctacaacgaggctttgatgaagtggcttaacaaaagtttgttctaatttatctcgttttcttgagaaagataaattaacttgcacatctaaccggggaaaaaattagcaggatggacataaattaacttgcacatataaaagatgattaaaaaaaatcaaaatctcttatactgtgaaacggaggcagtaccttaacattacaacttaattaaaatccaatggcaacatgatatagtttgaaaggttcgctcaagaaaagaattattgtgagttcacttacgaatttaagcatctattgcagctggttgcagtgactgcggcacatcacatggatctatcgagcttaattcagttggaaaccacctggcccgggtgaccgtctccaagaaactgtgaagcgacaaaagaaaatctcacaagaaaacagttcatcataagatgcaaacaaattttaaagtggtttgcttgcttggatttttttttctggtattcatgcccccatctccggcggccggcagcgccacagccaccgacactagcatgggcctcttccgcacggtctgtcttgctcgtcggtgcagaagaggccgtaaataggcccatcgagatatgggccgtttcatcggtactctctctgtttcacaatgtaagtcattttagcatttcctacattcatattgatgttaatgaatctaaatagatatatatatatgtttagattcattaacatcaatacgaatgtaaaaaatgctagaatgacttacattgtgaaacggaggaagtacgttttatatttgatctttaccttacccatgaattaagactcaaattaatttagagtaaatttcaactaaccccatgtactattatggtctaaattgtacagaaccacgtgggttttgacacgtaacacataaccttgattattatggccatgaagttttacaaaaccacactattgatcattttgaattataagctatttattccttatataagtgttacatacatgtaaacatacaattttgaattttgatataggagtatgtcgatttggttaacgccatgtgttgatggactatggtgcccacctacgatatttgtagagtatgaaaaacgttgagatcatatctagctagcagacaagggacaagtgtttatattggttcggggccttaagatgactaataaccctacttccatttatatgtatatcagggaaaaagtagattacaatcaacgactagggctttggcttcctccgaattgtatctcgatattgctcttgttatggcttgtaattcaatatcctccccttattgggaccctgtatttatagggatgatcatctttttctcaaagtagaaatcagagaacctgaattagatatggtccaagaagaccttattttctctgaatatgactttgacatcttctatccctagaaaacaatttcctttcggatcaccgtattaccttaattgactatatattcctgtatattattaggtatgtggtactttcatatagcacaaacccaaatataagaggtatgtcttatccttaacagttaacactaatagtgtggttttagaaaacttttggaccataattatgtgtcacatgctaaaatctatggttttatgtaaattggctcatgataagtggggttttataaaatttagataattttttacctagcttaatattactgttacaggaagatctgtgatcgagacaagagttgttggctggaatagacacaccacataataatctctatttggcaagcattacaacggcagcttaattttaaaccaaacaaaatcttgatctttttaaaaaaacaaaaaaaaagaagtaacgacagcacgtacgatgcatgagaaggtgagttgttataatcaagcccacagatatatcatatatagcggtatacccctgccgatcaatggaggcacgtgtagaagaggcatcaaaatttaaataactaaagcatgcatttccaccaagtatctccatccatcctaaaatataaggcagaagattttggtgaataaaacatatcctaataccatgaatatgaatagagagttgtccagattcataaggcttgtttgggggagcttaaaattttgagaagcagcaactgagaaactagctagtgagaatctggagaagctgggaaacccagcttctgtcttctagttcattttccagattctacaaccacaaattcttagaatttggataaaaagctggactgttttggtgagcttctggcaagtggtaagtactggagattctaggagaagctacagctgctaaaagctccccaaacagacccatagtagcagaatgtgtctcatcgaatatcatagtcctttttatattttgggatggagaaaataagtgttaaacaagattgaagaaatctaaaccaagccagctgatcttcacctactgcatctactacttctgtcagcttcctcagagtccatatatatcccaacttgcagcgtgtatgccgtaaaagtatctagtatggactatggattacttcattacaaattaacccattacccatcatatgcaagatcagtgtaatcatgtaatgtaaaggcacaatctcgtgctgttttcccttaaaagaattgtaatgtaaagtgaatactaaactgatgaacacacaagatcagctaaaatcaattaactaatcctccattgctagctagatgtattgcatgccgcatgtgcagatgtgctagcttgcagagctagttgtcttcgtcttcgtcttgtcctttgtctagagatttgtctagggagtagagacgacgatgacgacgacgaaatcatcgaactaaacacaaccaccaccacccccttgcctttttatgtagatcaccctatagctacctagctttaattatatcgataaattacctgtgaagaatatggatattccatatctacatgccagttataatttaatcggatatccggtaccaaatatagatagaatatctttatgaagactcgggttagttttttacttgtatgtcaaggaaatacccgagatcttagtcggtcacaattgtattttatctataatcccatattccgttacgataagagttgtattttgtaaagcggactccttcccctatataaggatggtccgtgtgtctctcggggcgcgattcttttttccaatttatacaatcaataacgtactcggcggaatcatccccggacatgagtagggtattacttcatgaatatgaaggcctgaacctgtataaaattcattgtctccaaaaccatcaactttcctagcttgatagccacccccttttattattgccgaaatcttgtttcgacagttggcgcgccaggtaggggcagcgtcaagtttttgccgactaagtgcgatgggttccgtttctggcatcgacaacttcgccttccctcccgggcaggcgttctggttcggcagcctcaacttcatcaccaacgacttcggcaagatctctctccttgactcggattcgaaccagtcggggagagaccaggtccccgtgccgtttggtattccgaactcggccgaggcctactccaagatcatatcttccgagtcggcttcaaaccactcggacgagatccaatctactcctccgcgaccagatcaagacgacgggtcctatccttcaatcttgatgaaacttcctgatgacttggctgccgtcttcacagccaaaacatctcccactcggagatctaggcgagctccggcatcggccccgatctagtctagatccagggaggttggcgttatactccaacctcttgggacagtctcgacggaagagatggatggctacctcagctcccccggcgtcagttcttgaccaaccaagatcctcgactacgacgacttcggctaccactatgaccacggcgacctcgacaacttcgacgacagctatgaggataactacacgcccctcttcttcggcgtattcatggctgccaacgaaacggaggaacagcgccgagcccgagaagcggaccaagatcgcgcacggcaagaagctgaacgtcgccgactggaggaagagcgacagcgacaggagcgagaacgactacagcgtgagcaacaagatcacgaaaggattgcaaaggaggctgaagatcgacggcaacgcgccttggaatccgggcggcgagcgagatagctcattgggcaacaagacgtcgacggaacagcggtctttcgcatcccccagcagaacgcggttgcagcaatcactctcctcgacaccctcctcaaggaagacgcactcaactaagctgatcatgttgtcaacatcttgaaccagacgaagaccatgatcgctgcctcggttccagccaactctgcaagcacccgcaccccgactagtagccaagtccctcatcttcgatctcaagactatcaccagccaagcctcagcattgccggcgccggatctagtcgcaggagcagaggacatgatgaacggtctgttcgttcgcctcccgaacgatatagggagcgtcgagttgaacgaccacactccccacatcgaaggcgccccatcgatcttcgcgacaccatcaaccagcgccgcgcagcaagaggccaccattcaccagatcgttatgacgatgatgtggacggcgttgctgccttcacaagcgatctgcgtcgagtggattggccagccggctttaagccgactgaaatcgagaaatatgacggcaccaccaaccctgagtcttggctcaccgtctatggtctcgcaatccacgcagcaggaggagatagcaaggccatggcaaactatctgcctgtggctctagcggattccgcccgatcctagcttcacggactaccccgtggcatgatcggatcatgggcagaacttcgtgatcacttcattggcaacttcagggcacctttgaacgccccggcacacagtttgatctctacaacgtcgttcagaagtctggagaatcccttcgagattacatccggcgcttctccgagcaacgcaacaagatctccgacatcaccgacgacgtcatcattgccgcctttactaaaggcattcgccacgaggacctagtcggcaagttcggacgcaaacctcccaagacggtcaagcagatgtttgaaaaagccaacgagtatgccaaagccgaagatgctattacggcgtccaagcagtcaggcaccacttggaagccaaagaaggacacgccgaccgcaggagggagtggaagtaacaaccgcaaggatcgcaagtgtaagcccgaagaacttgtggcaacaacctctccatcttcccgacaacgtccccgcgtcaacacattcgacaagataatgaactcccaatgtccgcatcatcctaactccaaccacgtggccaaagactgcttcgtctacaaacaatttgcggagcaatacgtcaagaatgcacttaagccttcaaacggagagcaaggcacatcaaagaagaaagacgatgaagacgatgccccgactggttttcaagatcatcgcaaagaactcaatcacatcttcggtggacctctggcttatgaatctaagagaaagcagaagctaacagaacgggagatcaatgtgattcagcccaacatgccccaataccttcggtggtcagaaatagcaatcaagtttgaccgctcggatcatcccgaccgagtggtccacccggggcggtaccccctggtactagacccagtggttcgcaatgtcaagctccgaagaactctcatcgatggtggcagtgcactcaacatccttttcgctaagaccctggacgatatgcagattcctcgcacggaattaaagccgagtaatgcatccttccacggtgttatcccaggattatcagctacaccactcggccagatcactcttccggtcactttcggcactcgggagaattttcgcatagaaaatgtttgtttcgaagtcgctgatttcgagacagcgtaccatgctatacttggatgaccggccctagccaaactcatggccgtcccacactacacctacatgatgatgaagatgcctggtcctcgaggagtcatatcactacgaagcgacatcaagcaagccgtcacatgtgacaaagaacgttgcgagatggcccagacccgcgagattacactcgaccgagaagagatccgactggctacgaccatggcaagcgaaggagaagtgcccgcaaccaagatgctcaaaagcggagaaagcaatgctaagacgaaaaagattcccttagatccctctaatcctgataagactgctgtaataggcgctgagttagattgtaaataggaatgcgcgctcatcacctttcttcaaaataataaagatatctttgcatggaaaccatccgatatgcctggtattcctagagaggtgattgagcactctttacatgttaaggaagacgccaaacccatcaagcaacgactccgccattttgcacaggacaggaaggatgcgatcaaggaggaattaaccaagctgttagcagcgggcttcatcaaggaagtccttcatccagactggctggctaacccagtcctggttcggaaaaagacggggcaatggcgcatgtgtgttgattacaccgacctcaacaagtcttgccccaaagacccttttgggttacctcgcattgactaggtggttgactcaacggcaggctgcgagttactcagtttcttggactgctactcgggatatcatcagattcgactgaaagaatccgactgcttgaagtcctcgtttattacacccttcggggcctactgctacatcaccatgccctttggattgaagaacgcaggagcaacctatcaacgcatgattcagagatatttctcgactcagatcggccgcaatgttgaagcttatgttgatgatgtagtcgtcaagaccaagcagaaggatgacctgatcacagatttagaggaaacttttacaagcattcatgctttcaggatgaaactaaaccctgaaaagtgcatcttcagagtaccgtcagggaagttgctcgaatttatgatatctcaaagaggcatacaggccaacccggagaaaatcaacgccatccttaacatgaaaccgccaagctcccaaaaagacgtccaaaagctgactggttgcatggcggcactcagccggttcgtctcacgactcggcgagcgggggatgccctttttcaagctgctgaagaagactgacaattttcagtggggacccgaagcacaaaaagcctttaaagacttcaagagacttctcaccactccaccagttttggcctcgccgcatccacaagagccgctactgttatatgtgttggcgacctcccaggttgtgagcacgatcctggttgttgagcatgaagaggaaggccatattcaaaaagtccaacgaccaatttattttgtcagcgaggttttagccgactccaagacaaggtatcctcaggttcaaaagttattatatggtgtcttaattaccgtcaggaaattatctcactactttcaaagtcactcggtcacggtggtcacatcgtttccactcggggatatacttcataatcgcgaagcaaacggacggattgcgaagttggccttagaattgatgtctttggacatatcgttcaaaccacgaacttcgaccaagtcacaagctttagctgatttccttgccgagtggaccgagtgccaagaagacatgccagaggaaaagatggaatattggactatgcattttgatgggtcgaagaggcttacaggcactggagctggggttgttttaatctccccgattggagaaagattgagctacgtattgtggatacatttttctgcgtcccataacgtggcggaatacgaggcgctactccatggattaaggattgccatctctctaggcattcgccgattaattgtccgaggggactctcagttggttgttaatcaagtcatgaaagagtggtcctgtctagatgatactatgaccgcttatcgacaagaggtacgcaagttggaagacaaattcgatggactcgagctcacccatgtccttcgacataacaatgaggcagccgacaggctggccaattttggttcaaaacgggaagcagctccttcagatcagatgtgttcgttgaacatctttacgaaccaaccgtgcccagaaaagagacaattgaagccatggatactcaaggcgtgagcatgatcgaagccgactggaaagaaccgttcataaaatttttgagcaaacaagaacttcctcaagacaaaaatgaagccgagcggatttctcggcgcagcagactttacattattcatgaaacttatctgtacaagaaaagtccatcaggaatactgcaacgatgtgtgtctttggaagaagaagacaattgttgaaggatatacattctggtatttgtggtaaccatgccgctgcacggactattgtcggcaaagcttaccggcaaggttttttctggcctatagctgtatctgatgctgacaagattgtgcggacgtgcgagggttgtcaattttttgccagacaaattcacctaccagcccaagagttgcaaaccatcccgttgtcctggccgtttgcggtctgggggcttgacatggtcggcccgtttaaaagggcagtcgggggttacatgcatctctttgtggctattgacaaattctccaaatggattgaggctaaaccggtcatcacgattacggcagataaagctagatattttttcattaacattgtgcatcggtttggggtacctaatcggatcatcactgataatggcactcaattcactggcggagcatttaaagacttttgtgaagacttcggtataaaaatttgctatgccaccgtggcacacaccatgagtaacggacaagtcgagcgtgctaatggcatgatacttcaagggataaaagcacgagttttcgaccgactacgtccctatgctggcaagtgggtcaatcagctgtcgtccgtactttggtctttacgcactactcccagtcgggctaccgggcagtcgccgttctttttggtttatggtgcagaagcaatgttgccaagtgaagtggaatttgaatcactacgattttggaacttcaacgaggagcgttatgaagagggccgagtagacgacatcaatcgattagaagaagcccgtgaagcagctttaattcagtcgactcggtatttgcaagggttgcgccgttatcataatcggaatgttcgatcgcgagcctttttagtcggcgacctggttctgaggaaaattcaaaccacacaggatcggcataaattatctcccttatgggaaggaccgtttataattgctgaagttactcggccagtgtcacatcctgattttcgtttcaggatttataaattatttaataaattaataatagaatttatattaaatgttcattaatttacaagtgaagttaaatgtgggaaataaaatttcctaaatataaagcatggttggatttaatttttattaaattctccatggttaattatactctctggaattttctcggattcttcggagctcaattcttaattttaatcatacaaagagcatttcagtaattacccacatattaaattaatcattaaatggtctaattataatttttttaagtactttgagtgtccaagtattttcagaatttttcttgaaattatttgagcattggaagtatttttaacaattgaaagatcatttaagtgattattttaattggaaaaagtttttaaatccttccctaagtcgttgggccgatttcggcccaactctttctctcttcgcgcggccgaatcggcccaatcggcccagctggcgccgaccgccccctcctctctctctctgtcaaagtctgttttgcctccctccttcaatcgggccgaggaaaatgaagcccgtcaaaagtctactttgcctccctgctacagtgtcgtccctaaccttcagccggctgcagccaggccgagcccgagccgccaccttgcgccgcctttcgacttcaaatccgctccaatccgaccccgtttcttccggatttttgaggggttttgatcctctcatccttctctatcttttcccccaagaatcggagcaaatcgttgggtattttatccgaatcaaactcgttttcgagtttatctccaaaaccgagttttgattttcccggatcgatttcttgcgggaggagtccgatctcttcaatccaaggctataaataggaccccctagtcctcctctttcgtttgccccctctcccgtcctctcccgtgacccgtagagccgtcgccaccgtgcaagccgagtcgccggccgtcgtcgttcgtcgtttggcacgagggtgagtatcgttgggttcgtctcgtcgtcctctacgtgttcatgtcctccaaatccgcagccggtcgctctatctccggcgaggtcgccatcttggtccggccattgatgatgtcatcatgacgtcatcatcgtttttctttttcctgtttttctaatagattaaatcttcggaaattcataactaaatcatggtaactcggttttgagtggttcaagttgctaaattcatctaaaatcatgatctacatgtttgtttactttatatgtactgtttatttggtttttattagtctttttcttcgttttgcgtgttagcttgtcgtttccgtcgttgcgaaggttcgtgagtgcgtcggaagtgatcaagaagattacttgaagaccgattattgcaaggcaagtcacacagatcctaaacacaatcctttgagcatgttgatcctatatttaaattctctatttatttcaactgtgcatttattttcgaatgtcaccgggtggtgtgaacttattcctttgttatggccaatttacattgattactttattccttgataccttgggttattataacttgactagttgggctttatatattggttcagctagatattagttatgattgcttagccatgcttagaaacattagcacactattgggataacttatgactcactattatttaaggatggcttaatgatagttcacgatggttaatcgtgattggttaattaattacttgccaactaaaacttgataatggtgggttgtgagcatatggttttgatggttgtgctcatgacaattaaggaccggttcgcgagctactgttgtgaaacatttaccgtgccaaccacaagccagcatgggcaacggctttatcttttgtatagcgtgattcattatagtgcgccagactgagaagtggcgagaagtccacgggggtcgctggggagtccatgccttgtttataagggggtgattatgatccaggaaaggtgcgctgtaatgggttatgttgtgcaaggggtattgtcacaactcctttccgaggtaccgtggtggtattgaggcacatggtgacatgatgtggggttgtgtcttgtgggtacagtggtacacctctggccagagtaaaactattcgaatagccgtgcccgcggttatgggcgggttgagcaatgtttttcgtgattagtctcacacctctcacgataattatggatgctataactggtaataatttgcttagctcctggtttggagttagatctgtacagccgggtatggttgttcaggatggttgggcctgtgcagcatgggtgtgctgttcagtgttgattaaaatttttaattaattactctactgttttactactcttaactctttgctaaatgctgctttcgcaaatgagcctatattatgccatcctttggaatccttgtgcacttgcatatttgctgtgtggcttgttgagtatgtcatatgctcattcttgcaataatcaatcaacctcagttgaagataaaggatccagaaggagaagacgtttggcttataccccagttgagctgcctgtgggagtggagccggagcttcgctagattttatttttccgctgcagttttcttcatggtgaggactaagtgcctcttaagtaagtatttatcgttttagttaatgtgataaatctatatattaaattgtcagtttgtgtacctcggctgattcctggacgagggtttaatgcacaaataagttcggaaattactagtgaatttccgggcgtgacagccaggttcttatcgactcaagcgcgaagatggtactcccatcaacaattcttagaatattgaacaccttcatcaattttatgcttaggcattacgtttgtatctttcctctttgactgctaacctcaagtttttccttgaagttttcagtcggggggctactatgataataattgagtgtgatttttatcaattcaatttgcttacttgatttatcattgccctgtttggtctttcgacttagtcaatgaggactgaaggtttttaatagcttttgcgggttttaggctcaataaggctagataaaggcttttaagaaatcaaaagctaagtatggaacaccaagcatagcataaattcatcagtattgtacaaattgagcctccatcatcattaattatcaaaatcattgttatatcaatcagtatcagttttttcatcatcagacttatcagatccagtcggccgaaggtcgacttcttggaatctttcaaccacatcagcagcaatcttgtcagcggctttctgtgcatcgttaatgaggtcaagagcagcttcttcgctcgtcccgtctgcaaagccatcaatggcatccatatcaacccttggataaagggatttggtcatcgccaatgccagacttgctcccatacttccagcttctttgatattcttgaaataagtatctggagcgactctcagcttgtcgaagatttcggcagtatcaagtgtactcgaaccggcgttattgaagaacattgcctggatgagtggagtagcggcattagcgactttatccctggctccttcaagcttgttgatcttgtcaactaagacatcaaactgtgcttgagacttgatcttgcggtctgcatcaacagattcacattaatgaatcagcatatagaagataatggcttttgaggtattgattattggtaccttcaacctcctttaaagccgaatcccactgtcttgccagctctgccttgtcattttccagagtttggatctgcttctctagttgagatatcttggcagcttgcactacattaacttcggttaatcaagattacagagataacagcacaaatcagttgggcagagtttgcgcgaacctttggatgagccactcagttcaaaattggattcctggagcttagcaatccgatccctcagatcgtgttcattctttctggcaagttctctggcctcgtgcagttgactcctggtggtttcaagggttccaagatgaggaactagtttctcaagggttgcggttttcgcctcgtttctaagatgaatcctctgcagagcagtttaatcagcgctcgagccagacggcaaacatgatggctgaggtcaggtgtcaaggaacttacatttacaatgcaagtcgcttggttgagtgccttcttcagtaggcagacttcttcatcttctttttgccggtttattacaattccttgaggttgcaagttgtcatcccaccacttgaccagaatgggagagcacgaatcttcggcaaagtgtatccacttgaccacggtgaatttcttcttcatcaccaatcattggtcctaatgtatccactgacaaaggttagacaattgatcagagttatttgggtcaacatggtttcagacaaagtgtttacccgtaatgatttctggacgaggacgagtggattcggatgcccttaaaggagatccagatctccagtcattgctggcgtcttgtccgcgagggttgtctgcttgggtttcaacttctagaatctcttggcttggccctgcgtccgactggtttccagtcgggggctcctgattaactccggcttcggcttcggccgactggtttccagtcgggggttcgtcgctgggttctacattgttgctggcctacagattatcactcgggagatcttttgcagtcggcccggtttcttttgaggaactcgcctccatgttggtcgggtcagagtcttttccagatgggtctatatcagatggtttcctgcaagtttgattgtcagtactattatcgcaatgggtacgcatcaatgcaatgaagatcgtaatatgagttgcacctagaagacttcctgatctttggcacaagacgactggatgttttcttccttggagtagcctgcttcggcagtttattggttgcctctcggtctccaagctttctagcagtgtcgccttcgtcgtcacttagaaccagcttcctcttgcgagaatttggctggccgactggatcaggagcacttggttgagtttcagaccggattcttggtcctccgcttccctgaccagtttggcggtgaggtgattggcgttgagcgattggcggatccgatttcatcagagcaaattcctgggcgtgacatcctttattgttaactgattcaacaaacagataagaccgtattctgtgaaaagttgaagtgttcggttacataccggtggaggaggattaaaggcattgaatggcacgactggcagcaagtgtgaatagctgacaacgatagcattagagaagatcttatacatcctttccttcatgaccttgaagtcaagagaatctggatcttcacgatttgggtcgtgcttgccgtcaaattcgaaggctgtgcgagatctctctttgattggagctaaccgacacttgataaagtgccgtgtgatctgttctccctgaaggccttgttctttcagctttatcatgcgctccatcagttccactgcttgtgcagcttcgtctcccattggcagtgagttccaagtatcccgataaactggaggaagacaggagtactcggggagagcaggctcagggttttgaacataaaaccaatttgcatgccagcctttgtttgaggtcttgaagggcatggagaagtatttttggcttagcgttccccggagttggaaaccagcacccccaacaacacatggtttgcttttgtttggctggggcttgaggaagaagatgcggcagaacaaggcgaaatgaggcctaatgcccagaaaagcttcgcaggcatgaataaaattggcgatatgcactatagagtttggattcagatgatgcaagctaatcctgtagaagttcataattccccggaagaaccttgaggttggaagagaaaatccgccatagaagaaatgagcaaataccacgatttcgtgtgtatcgggggtcgggaatgcttcgccgaatgctggtcgccatccgatgatctcctttgctggaagaacgccgtgcgccaccatctcctttagattatcttccgtcacatcggaggacgcccactggctctcgaagctttctctctcttccgccatgaatgtggactggatggtttgatttggtccgagatacggctggaaagggatggggaattggagcggtgaatgcgggtagaaattttgtggagtgtttgaggatggattggagcggattgctgaaccctagcttggccggcgcagtttgtactgtagcaggaaatggggaaaatggtgagagtctcggcggggaagacgaagagacatttttcacttcggtgatattagagtatcgggagcgctagcaggcctgggccggcacagtacttcagcccaattttatttccagcgtggcccattgtgatccttagggacttaggcactttttgctttggcaatttgtgctcacaatgatgtggtccaatgctgttaaaaccctttttaatgcggtttgataattctttggaattaacacgatgcaaacaaaaggtgcccgacagaaaggtgttataccatttttgtaagctttattaggctgcaaaagctgtttgggttgatttgagatgactggtttactaatagttattcttttagcatgttatatgcttattttggttattgtaagggtcacagcctaggctattagacccattaatcaccgtgattttttatcatgtttggtgaatcattttaagagtttcttactcggattcctatcaaatatgtctatttttggaccttttgagtgttaatcactcggccctttcatatttttttatccttgatatgttcaaggagtgttgataaaaccactcggttcttgactacgtgtttagtttttcaactaattacatagtcgggggctatacctaattaggtgcatctactcgatgcaccatgttttattttcgcccttcgcagtctttgattttagcactcggcaaactggagcaagttgaattgaagcactcggattgctgttttttgtttcgagaaggttgttttgtcaactgcgaaggtctcgggggctactgtggagaatatggatatcccatttctacatgacagttataatttagtcggatatacggtaccaaatatagatagaatatctttatgaagactcgggttagttttttacttgtatgtcaaggaaatacccgagatcttagtcggttacgattgtattttatctataatcccatattccgttaggatatgggctgtattttgtaaagcggactccttcccctatataaggagggtccgtgtgcctctcggggcgcgattcttttttccaatttatacaatcaataacgtactcggcggaatcatctccggacaggagtaggatattacttgttgaataagaaggcctgaacctatataaaattccttgtcttcaaactcatccactttcctagcttgatagccaccccttttattattgccgaaatcttgtttcgacattaatctagctaattaagcaatggcagcctcgtcgtccttcgtgctcgcggcggcggcgctactcctccaggccgtgacggcggcggcggaggcggcggggcaacaaaaggagatgcggatgcgtgtgtactggcacgatgtggtgaccgggccgaactcgacggtggcgaaggtggcggaggcgccgacgtcgagggcctccgcgacggtgttcggcactgtgtacgtcatcgacgacccgctcaccgacgggcccagcctgacggcgccgtcgaggctggtcggccatgcgcaggggatgtacgtgagcgccgggaaggagacgatgtcgctgctgatggcgatgagcttcgtgttcgccgccgatgagccgtacaacggcagcagcgttgccatcttcgggcccaacccggcgaggccggtgagtgagatccccgtggtcggcggcaccggcgcgttccgcttcgcccgcggctactgccgcgccaccacgtactggtacaacgccgccggcgacgccaccgtcccgtacgatatccatatccgccacgattaactgattcattattattcctttgtgtcaaaatataagaacctaattaatatcggataggacgtatgaaatatctaatccgatcatagaagtttatattttaaaacggagggagtaattagttagccaggtagcgatacgttgtgtgtcaattactactgtatcatgtactacctctccatcccgtaataaagttcattttaattagcaccttctatttagcataaaataaatttatttttagagtaattattaaattagaatttattataataaaaattattattttaaaataaggtgaaaaatagttacattgcgatttgataaattaagagtaatttagctttcttggttttatattggtatacatgagatggatgaaaaatgaaattattttaggatgagaatagtattaggtacatggggaaaatgattttatctctcgagggatatccctagtttcgtgcataccacctaatagtcataaaaaatatgaaaagaaaattagcaacatagattaatataaaatatatcactccacaaacataagcaagttaaaatttaacttctacaagttataacaaaaataacaaatatagttgcgaatatacgataactatttttagtttaatttgttatttttgttacaacttgtagaagttgaatttggtcttgcatgtttgtggagtgatatattttgtattaatctatattataaatttttttaaaaaattttataaatatttagatggtatataaataacgaaggatgttccgtcgaggaatgaaaatccgtatcctagctacatgttgcatgcgggcatggaacccaaaacaaccatcaacattttaacaaaacaaattaagataatatgttacgttgtaatgagtactccttattaacatagacgtcacgtcagtcatacttcgagcttgatattattttgacattttatttaatgagaaaatatattatagttgactttaccgttgagtatcgtgattaaaactctggcctcaaataagatacgtcaagcgatatgggcggctgttaacagtgaaatttgataatcggtaaagacgccatccgcttagaatcattatcggctgcagcatctcggaatcagccgatgggagttatcaagtcgccaatagtcggattcctgctatattcggttaaggaaatcaatctattaaagggagcttatccctaagtgaccgagtttaaagaggatacggcatggcagtttatctattaattaggaatagtttgttagtttccttttatctttaggaaagtgtgtttagtgtccgataaggactttatattttccttttatatttaggttagtttctttcttatctttaggttagtttctttcttgtccgacaaggacttgtatcaacccctgggtataaatatgtacacccggggtctatgtaatctatctccacgatcaatacaattcggagcatcgccaccctttttatttctacttttgtttttacgtttcggcggaacttggcacccgacgcggggctgcatcgtcttcgatctccggtgaagggataagtccaatattccatcggcccaggcaattgtatcgtttacgtcggcgtcgttgaaggctgcatcagtacattcgacctcttggattgctctggtttggatgatatacttgcctatctatttatcatatatctctgttaatctagtcttagcatatcaatttagttctatcggctgcttctcattttagggtttctgccggtatcggctaaatcgcgttgctagattagattagcttagacatctaccaccctgaaaactcagtcaacggcttgattgtctagatattatatttcttttcatacttagtgctgcatcagttaagtttgatctactaagtcgtgcttagaactataatctctagcctgcttcttgattgccaataagtgtttcatcggggtttcagccggtgagttatctggacgttgcatcggctcataaggattgcatatacatataagttggatttagccgatgacaacaaaggcttcattgtttaagctaatcttgtggatttcatgacatcggacctccagccgatgtgtgctttgaccttcggatcgatgcttatttatcatatcattatttgctgattggtttatacttgattacattgttattttattacatcatcgtcagccgattgcctttatatcattatctacattggacatatagtcgattgcttaaaccctatcgctatcggctggtatcggcatcggctattatcggcatcggctggaactactccatcggcttgtcggccgatcggctgttttaatctactatttgcatatcttgtcagttgcaggatcaaactgactggcacgctcgcatctcaccaatctttggacctgcactggagttaagcagatctcccaggccgatgtgttcgattttttcgtcaacagctttagcagtccctgactccccctctcattttccacacgtatgtttttcaaactataaaacattacgttcttttttaaaaaaaattctatacgaaaattgattaaaaaatcatacttattcatttattttaaaaaatagctagtagtgcttaattaattacgtgctaacgaccgcccgttttcaccaacgaaggcagcccatggtgtctcacgttttatgtgggccaattaggcccatcaagtagccgtcatggtcaaagactcaaagttgaccacagccagccgttagatctaatctgaacggttcgcgttgtctcggaatcatcgcctgcatcacacttgacctgtggacctatggtgcgcgcggcggctagcgaaaccgccatggccgcggcgacgatcgagatcccgcgctcgccggcgttccggctgcttctcgtcaccgcggcgaggaagaatctcctttcgggcggcgatcctcgcgctcgccgactcgattgccggccgacgtggggagcaacgcatcgctcgattacacttacacaatccgagtaggaatcgaagtaaacctctctgtatttaatttgcaaggtaaatttgcaaccgacccatcgagcgatcgatctccgaacgaattcgatggcttccacgtcgaggaaacgttcggcgcgtagcctgcaagaagatgagcagacctcatcggcggcagaagcgccggcggcggtgcgagaagaccaagagcagctttccgttgcnggcattgaagcctggaggtttcgggtctcgagattctactggntttccgcgttaaagtcgaccccaccgacgccgacatggttggctgctatcttctaccgagcggg

SEQ ID NO: 60324 - DNA, 1012 bp, Oryza sativa
  unsure (1)..(1012): unsure at all n locations
caacttctacaagttgtagaatttgaattttaacttgcatgcttgtggagtgatatattacatattgatctatcttgttcatattttttcaatttttttcatatttatttaatgnatatgcaatanacgggtagacatccactcaagttgttaaaacagtttccctgttatatatattctctggatcattcttgactcttgagtagttggttgaatcgcggaggacggtaactatattgcagggcagttgtagcgtagtactaacacctcttgtttaatttcagttcagttaagatttttctggaatgctaactacttacttgaatttttactgttgctggaactttgtatattccacctacgtaacagggcacaagaagcatgttatatattatctacaaaagcccaatgcaactgtagagaattcatttacctggtctaacatgtacatgcaaatttatttgtgattaacatcactgcttctgcataaaattgttctaggtgctcgtacatagattaaactgtttcaggatgatgctgattttaataaccttacaatttacttgaagtcagcatcaccggtatgtactagctgctccttatgactttcctagtagccgcttggtggtcactggtcagcatcactaacatgtattagttggtccttatgacttttcaggcccaaatcaacttcaaattctggtttttctgcagcctgcaggtaaccacccatttctcacttcctgccactttttttttctgctgaaaggggataattccaaccatggaaataaaattcgatctaaaacaacaccgatgctttatatttgcaatttccaggaacattatatggccttatcctgtattcctgtactcctgcagttttgccaccgtgcaatagttttttacagactcataggagcttgttgaatattgcaaaaaatatattttagtcgcatgcttaggggcaacaccgtaaaagctcattccttttggattggagcaaggccag

SEQ ID NO: 60325 - DNA, 4810 bp, Oryza sativa
tgatcacaaatgagcattagaacttttgagcaatgagctcaaatgcttatttttcttccatttagcgctgagattttccctttcccaatggtttccagtgtgtggaggtatcaggtacctgccttttgtgtttgtatgcttagcccagaatccagatagagtaaaaatccagggactagtagtttagccctctagtccagcgggagcaaactctcgaaagcctctatatacatgaagtgtatattttcagacatggtaccttggacatggacaagtattcatttatttatgcgtgtatgatttagatagtccgtttaccaccccactcccagggttacaatttagaaatactacatgtttgtctatggaaaaaaaaatcctggttacctttttaatccttgtgttcttcagtttttgttgttcgaattatccatttccttgatacatagtgccttgctgccattacttgattaaaaatggatgaaaatgcttcatattcagtgggctaatcgagtatgctccaaatgatggaagctatcacggtactccctaaaagccatgaacaaaacaagaaagcctggtcccgaaacggacctgcaaatttattttcggccttcatcagtctatgttacaggttaaggggttaagggcctttgaatcaaaggatttatgtaggaatttcataggattcaaatcctataggaaatttttctatttgaccctttgattcaaaggattgaagctttccaaatcctatgaaattcctatggaatggcacattgcaggtggattttggaggaaatttagcaagagctccaacctcttaaaaaatttcctttgaatctatctctctcatccgattcctgtgttttttatacgctccaatctaacgactatttatatgtttttcctgtgttttgtaatcctctgttttacacttcaattcctgtcagaatcctgtgttttttctattcctccgttttttctaccctgcgattcaaagggtccctaagttatcaatgtgtgcaaaaataattcttgcaggttggaagttgattcatacagcaacatgcaccattgaccgttcatttaaaaagaacacaaagtacagtgcctagatcacagcggatgaggatactaactttacttctctctaacttcgagtcattgacaaatgactccgttgagtagaggatccacatctcagtgacccatattagagaggatccacatctcagtgacccatattagagggaagtaagtcaaaggatctcgatccgatcacagcacatctgaatataacacaatcgcagcagtaagtaggttacatttacagatgctcaagctcaatgttctcaacggcgtttggtgtcagactgtcagtaatcttggtatgcatttctacatccatttggcgtcagcaatacatttctagctcctcactcctcagcatgtaggtgagatcattaaactactgatccaaccctgcaattcaaaacatatccaaggttggtaatgcatctaaatttacagagacctgctcctgcagaagagaattcagatgtgcgcgtgttagtaacatgtaaaagtgccgtaatttttaaagctttttgtagaacataatgtaacatgacaacaaaacaaacaaggctgttctcaggctaggctagattgtaactaaagcttgagttggcagatcctagccttgcatgagaaccacaaaccagtccttagaccctactttaccttgaaaaaactgaaaatactccttagtgcttcaacttaaaggcattattatgtcttttaacagtacatcgtgtggaaagttaaatgagataacagttatcatggttcagtaaaacttaactctaaatcttgctgggaggcagtccatccgggttcataggcttccagaaacatgagctttgctttgtttggaaggtcatgtggatggacaaatggaacccctggcggccatccgatttcagttctgatgttctcacatggacggtctaacgattttatgtggctttcacagtccctgagactgcaaaatctcagcttgatgcctttcttatccgcaatatcctggacacgctccttgagcaccctctgcgcctctaggcgaagtcttttggaaggagggagtgcctttgtttttctaccttccttctttctcttcatcacaaagttatacgatgctacaccagacaattgaagaagccatcaattcacagtattccaatgaagtcataagctcaaatcacttaggatgggtagaatgaggcatgcatcagcatgtacatgtagaaataacactctaggagacttcaaaaagaggtcaacgacaacgcgtccgtcatagagcatagtaccccattagaatgttccaagagaaatatcaactaatcttgtttcaacatgtcacagtatattattaactagaggcagagaaagacttggcctgaccctcatgttgtgctttcttgtattagaggtgtaagcctgatccgtgcacggatattgcagctaatgaaaatgcacaaaatgatatcaatgacaaataatattatcctataaagaacacacaattattatttcttgttggtcttctttttctctaaactagtttatcttcaccctaagtcagtggggacaaaaaaaaggacttcacaactgtggacatcacattccaccaccccgaacttatttgatgaatcgttatggcaaaaccacatcttgttataatataatgtagatcacgaagaacatattaaaggcaagatgtaccagatatagcaagtactggatgtagataaggaattttacgatggctaacatgaggatgtagcaattggtgccacactgccacttagcagttatttcttctgaatgaaaaaaatgtatcataaatcataaagtattataatgcaccaatgtagagttggcctgaaggtatagcaacttggtatgggactatggggtacataaacagttaccttcctgttcaacatgtggtgatggttcattgttcttgggaaaaagttgatttgctgaatgttctgtctgcatgaaatcattaactagtatggggacctgaaactgagcatcaacaccatggccagcagccctcatctcttcaccactcagccttgcaactgacctaggcatgagcttgaacaccaacgaacaccgcccaaacatacattcctgcaagttgccgacctccgtcttgtgcacagctgggtttacatagccagctgtttcccgataaagcgcaaggccaggatagacaacaatatcaagcggaccaagatccccatcgacaagaatccagcgcccttgcaaatctttgatatacaggcccgacctatccgacttaaccagcgtaagcaaagtcttgtcaatctggttctcctgatccgaaaacatgagcaattgttcatcatcctgagaagcgacgctatgctgctgtgctccttccatcgacggcctcgaatgacaacatgccgaaagaacagaagatgatacctcctggcttctcaagggtatgttgtcaagcaactccgtaaatgtggagctacgcagattcagcgagaagctaatcgcgtccaagacctcccgggaaaccttcccaagcaccgaaaacatatcaggcaacccggacggcggcaattccgccacaccgttcggctctaccggcgtgatgccgggcctgaaatcatacatttccagccacatctgaggatcagcatagtagccagacgtcttgcaccactcccgggcatcacccgagccgccgccaccgccgccgccgccggcctcgccggatccgtaccctcgctggtggaagaagaggcgtgcggagtccagccccgacctcagcagggcgccgtcggccggaggcagctcgacgacggccgccgagtactgcgccagcgactgcatcagggccgacacgcacatcttgtagccgtcggacgggaggccgtcggcggcggcgaggtcgcagaggcgcacgcggccgagggacgcgaggatgttcgcctccgcgtcatccatccggggaggggatggttcttggatcttcttggaattcacctcagggtcaggggcaccatccaatcgccgccgggaaggccaagattcgtagctacgcgagtggaagcgcccctaccaactcgctcgccgggaagatgcctgcggcggcggcttcacggcatgatcaccggcgaaccagctaagatttcaaggcggtacacgacacaccgtacctttcacgggtggtagtagcattcgattctctgcctctggagctgcggattcgtctcccgaggcgagctcgccggagaagaagtggtggtcggggatggagatgggcgtggcggcgccggcgccggcgagggcctcggtcgaactgtagaaggggattctcgtcaatgtaatgtacgaaaccaccgtcgccatcgtccgtccgataggaaaccgacggaccacaacacttcctgtaattcacaccgtgtatagtgtgtattggggctgctttagcagagaaaacagacgatatgcctctctatatattgggttcggataaaataccacttaatacaacacaccggataaaatgctactcaatacgttgcctaccggatgaaatgccactttacctgcccccgccgttgccgcctccggcgaacacgcgggtaggcgtccttgccgtcccgtcgcctcctcctccctctacctcgtcgtcctcgccaccgctcaccctccgccctatccttctcccccgtcatccctgtcggtcggc

SEQ ID NO: 60326 - DNA, 525 bp, Oryza sativa
cactttcccccgtgttttgtgcacagtacactgcccgccctgccgctcgatcgatctggcctttccgccggaccgccgcgcggcgccccgaccgtcgtgcggccgcaggaggatgcaggcacccttcctttcgccgcttttctcctctggaagaagggctctcccatagacaacggctaagaattacaaggctgcttctttcgggagtagtttttctgttaattttacaagggaaataggtgagatttctgaggtgtaaaaagagaattagtagtgctgtggctggggaagatgaccaagatcagctgcttctctgctcttctcgccggcaagaggaagttatcaaaggttggtggattatattcttaggagacccagttctttgatgaattttgggttaagtttttgtttcttatcagctctgaacatggcaggttacgagcaagattggttacggcaagaagtctgggggcaatgagttccataaggtgaaaccggtggagttcatggaggggacggacaccg

SEQ ID NO: 60327 - DNA, 918 bp, Oryza sativa
aatgtataacatacattcatccacatatcccgtagcaaagcatggggtatcaactagtatgtactctctccgttcgtggatataagggattttgacttttgcttgcaccatttgaccattcgtcttattcaaaaaattttggaattattattatttttatttgtgacttactttattatccaaagtactttaagcacaactttttgttttttatatttacacaaattttttgaataagacgagtggtcaaaccgttacacgtgaatagtgaaaatcccttatattctcggacagagggagtataaataagtataactgttctgccaccaaaatggaagggagcaaataacatcccacctgttgcttaaaaatgctaagtttgttgctagcgtagcgaggagccaacacacaatggacaccagaatgcctgaaaaacttccgagcttcctcgtcatgtgtatgcatgagtccatcctgcattcaacctacatcatttccatcagactactctttcctaaagaaaacagcattcaaacaaatgcatttgcagtaagaattttgttcatcaagatttatctcataaacaattttatataagttgagctacaatacaaccgaaacataaaggagtactttggatatttagcttctcagcagtcctaccaaagctcccatgacaccagtaccaagagggaagatattacctaccatttatttttcccacccttttcagtttatattttcagcactcaccacctttttattattaatgtagtagcatgtagagatattagataagcacttttagctttataatcattgtccctttgtcaaaagcatgtattctactagcataataaccaaaaatggaaggtcacaacacttcaaaacgcagagtaaatttcatatatagccatt

SEQ ID NO: 60328 - DNA, 2043 bp, Oryza sativa
gtcataaagatgaagcactaatcttgagaacacaagtggttataccaagttttacctcttgttgaagatcgaaacggatgcagctcaacccaaaagcaagaactggtggaaccaaaataaaagcaaaagggtggcgatgcgcagaaattgtattgaacgtgtgtgttaaaaattacatagggctcggggtctatttatgtcatgaccggaaataacccaacgggcgttccttacgtgcgtgtattattctttgtcccaggaggcaaggtacaccaaaagttgatacatttcagactttctcaagcggaagcgtaaataattaatttattacatgggcggcgaaggcccagcacacacaaagacaaacgggaaacagcggaagactagggcgacgaccacaggcgcttgacgacaggcacgagctagacaccaaagccttcatcttccaggaactcctcttccgggtttgggaaaaattgagcaagactgagtacaaccaccgtactcaacaagacacacccacaagtgcagaataaatgcaagggagtacaaggggggttataatataagggttagggtttgcagtaaacagcattaaaagacccttcgttgctcaaagctattttgtaaatacgatcctagagctatacaatattattaatcaaggccgtgaacccacacgaacctgccttaacccaaggcctacgatgattcggaccgaactagcaacccgaccctgggtcccagctcgtcccaagccaacccaggccaaccattccacattttagttgttaagcaggttttaagaattaaaacactaacttgggtacattgctcggcttggccataaccgagggcgcggctattcgaatagcttatactctgatcagaggtgtacatctttacccacaagacacatcttcctcacgtgtaaccacgtgccacataccaccacggtatacggacggaagacgtcacatagtttcggggatcctaccatagacaagagtcgacccacacgcatgcaagctcgaaacctccgggacaggtaggcaggactgagcccctaacagcaggacaccggccctgtgccatgacatctcgactaccgggccgcagctcgtgtagccttcatttgccctagagatgtccatcgagccccgacttcatccatctccatccgtgtactatctccatccgtgtacttttgtttataaccagactgagccacaaactaagccttacccactagacatgtggaagtacggtagtgctttgcaatagaggcccgaagaccggtccttatatggccgaggtgctactatcaaaaccatgcaccccaagcccagcctaaaaccattttgagggttttgaatagagggggaggtgtgaatccaattccacaataatccaaccattccatagtgtccaggtgatatgaatattcccaaagtctagagttgtaaaaccacctaatgttgcctaattaaccagcgaagcatctacctaaaatcatactagtggtaccatgagtagagtgtccactagttggggttttgtttattctagggtgaacaaggtaataataacaatagcaatactaataaggtcataacaaaggtaaataggcatggctaaataaaacattgataacgcgggaatttaaataaagcgataatgtaaaaatttaaatcaaaataattttgtaaactgggattcaatatgttccaggatgatgtgacttgtcttgctcgctttcccaaacgtcggcttcaacctccacgaagagcggatcttccgaagctgcggcgtctacacaaccaacggaaaagaaaaggcttttactctaataaactccatataacaagcaggaacaaagcacaaaattgggttcttgacttcttaaggaaaaattagagacttgaacggtccaattccgggaattcaaaaggccaagttatggcatttgaagtttatatgctctttaaatgaatatttgcaaatttcttcatttaaattttaattttaaaaagggtctattgc

SEQ ID NO: 60329 - DNA, 6373 bp, Oryza sativa
  unsure (1)..(6373): unsure at all n locations
agggcgaggtggcgatcctcaccatcgtccgcggcggcggcggaggcggaggcgagctcgacgtggtgtacaagcggcgcaacctgagcttccaccgccgcggcgagagctcctcctccggatgggtcatgcacgagtacgagatcacctcgccgccgctccccgccaccgtgctctcccggatcagggccacccccagggccaaggacaagaagctgtgcatcaaggaggagccctcctgctccacctccgccgccggcgagcgctctggccctaacccagaccacaccgccgccggcgccggtgacagcgccactgccaaccacaacaatacaacgtcggcggcgacaacaactatggcagcggcggtgtagtctaatattatccagaccagccgggtccgagccaccaatatggttacggcgagcaggtcgccggcaatggctttgtggccggcgacgggtggcggcggcgagccattgcacttgtgtgaggactgtgacggcaataacgtttatggctacggctctttgacagggaagagccgctgccgcgagctgactggacaatgtcgctggcctcgagagcagtcgatccacctccaatggcctcaggagtgacggatccaccgtcggcggcacaggaatggtgacctccatcgcctctccccgtccctcgcttcccacggttgagctttgggtagtggcagcacgcttcaggctcgttggatctggtggagctcgacgtgggggacaatgatgacagcttcatcgcctcttctcatacctcgctttgggcagctacgacgctagccttcaagcttacccgatttgacggtggctaggggtataaattatcttggagattttatggctaaaattcttttgcaggagaacatcttcacatgtccgcttacgaaaataagattttgcatgtggttacggtgccagcccataacaatcagtatttttatacatgtttggcgtctgtttgaaaaagctgaatatatatgatcgtttgagaaaaagctttctgtaggagtgcctttctctttagagtgttgtctgttgtagacattggctttaacgagctgtaaataagtattgtacagttacaatttctgtacgatttaattgccaatacttggactatagacaaaatatttttggactgaactataaactgatttgtttttctgttgacccgacttgacccggaataagcctagcacaaacgaagttaaactagaggccttgtcagcaagaacttctaagcgttcaaaaaaaaatctgttgatttttgaacatacagaagcaacataactttgctataattctgttatcacaatttggatagacacgtacagacgttccaaagaccaaaggtgatgatcggagcatatttaattacatcaatagatttctagaacatatataccgaagaagcttggaaattaattaaaccaagcatgccttcatctcaccaaatacctatatacgcggctacgcgtgctaatttcaccttaaaaaagaaaagaagaagaaaaccccagagatcgatgcgagtagttcatacgtaccaattcacagtcagcacttcacctactgcatctgttgccagcttcttcaaaagtccgatcaccgacccagtccattcctaccctctcacacgccaaaagaatttaaaataaattaacatatccaacttgcatgcatgcacgcaagaatgccataagaatttctacatgtagttaatccaagcatgcaagaattattgaagaatgcaatgtaaattaatcaaagtctaaattgaacacacgatcagctagagctaaccttaagaaggtgtcagaagataatatattttttcatcttttagagaaggtattatgagatatcgtattttttatgtaaaatttggtatatcttcaactactagatattccatgataccaaaatttttatgtgtaaataatttagatatctcaagatgggccaaaagtgatcatttttgcatgcggaactctggcccgtctaccaggaaagttatgaaaaaatctctctttttctatgctagtggagcacccgcatacgaaaattcaacttttgcatgcgggtgcttatatcgtccgcacttaaaaataaaaatctgaaaaaattaaaaatcgcaaaaaaattctagccaccgccgccgggctcctccctctgccagcagatccgggcggtgcccgccgcccgctggatccgcgtgggagccgctttcgccacattcgacgtgtgacggagcctgccgccgtgctccatcgctgccgctcgccgcccgactgttccgtgcaaggaagctgtcgttgcctccttcaacgtgcgggggagcccgccaccgtggtccgttgctaccacccactgcccgctgtcagccacgccatccgccgcccattacgaggccggcggaggcggatccgctcgccgcttgccgtcaaccacacagcccgctgctcgttgtcagccgcgtcgcccgccacaaaaatatatttaagaggcccgcctgcgaaacgggcgtctctttgagaggttcgcctgtaaaaataagcttattttagcgtgcgaatccttaagaggaccacttgtgaaaatcgatttttgcgtgcggtcctattaaggagctgtatgcgaaaatggagtacgattttttacatactggactagttacggtctgtctgcaatctaaagaggatcttgtctagaaaaattatttctgtagtagtgcataccgccatggcaaggaatggctcgctctttcatctactcgctggattggagacgtattgtttggcggcggccggtggcggtggcccgtgcggtggccgggcgcaaggaggccagcagcccacggtcgggcggcgacaacagcgactggattttttttattttgtgaatttttgtagtgaatgatgaatggtttgtatattttattggatattttttttgttgatttggggatgatctcacaagatttgtagattgtggatgtgtatgtattggggatgatttttgttgtgcttgatttgtggaaatttttattgggcatgattgatgatttgtgtggatttggctgggggaatagatacaagcagcaaaaagaaccaataaataaaagaaaaaaaacagttgggatgtggcccctatccatctttaaagatggatttttaagcccggttatttcacccgagactaaagatacctatctttagtcctgaattcgtccttcctgttgtaaaacccggagtacaggggttcccaagagggagtaaaacccctttctccactagtgttaactaatttatcctccattatatttctaacctgactgtttgcatatatccgaccatttttgcagtcgccttcctcgcggtgtagacgacgatcgaagaaccttcgaatccagcacacaccaaccacgtccccgacctccccctttaaattcacccatgcacacgtcgtcgcaaatcacatcacacagctaaagctagcttaatccgaaccaagcaatggcggcctcctccctcctccttggtgttcgcggcggcgctcctcgtccctgccgaccgncaacggcggcccaggccgcaaaggaagacgaaacctgcgggtgttctgggcacgacgtggtgaccggcgggcccaaactccacggtggcgcaggtgncggaggcgccgacaacgaacgcctcgacgacgggggtcgggcacggtggtggtgatcgacgacccgctcaccgacgggcccaacctgacggcctcgcgnctggtcggccgcgcgcaggggatgtacgtcgccgccggcaaggacgcgctgtcgctgatgatggcgatgaacttcgtgttcgccggcgacggcccgtacaacggcagcagcctcgcgatcctcggcgccaacccggcggagcgcgccgtgcgggagatgccggtggtgggcggcaccggcgtgttccggttcgcgcgcggctactgccaggcgaccacgtggtggttcaacgccaccaccggcgacgccaccgtcgagtacaacatccatctccgcctcgattaattcattcattcattctcattacttgagacgatgatattgaagatgatgatcgtgttgatcagttcattttactgccggtttttgctgtgtgttgaccagttgattactagaatatataagctgggtgtggtgtcatatgctttttttttccctgtaaaaaaacgctagctatgatttttgttgttgttgttgttggtaggggtgtattcttgaggatgattattgtttataagttcttaatgtgttttagaataatgagagcttcattagcttacctttgttacaattttttattttgatggatggtaatattcctccaagatttttgtgcacgccttggttcacctaacactgaccatcccgtcaagataacatatactcaaaataatcatggaaaattttccccactaaccgagcgtcgtatccacacaagtgttgccgtttccgactctaacaatatataaattttagttttttctaatttattcgatcttcttgttgacactaaatagttggtcaattccagattaatcgataatatttttcgaacagatgctaccaattctatccgtttctatccttagggagcgttcgttctgataagttagggtgagaaaatacatcatagtccacgcacacgcttcccaaactactaaacggtgtgtttttggcaaaaaatttctataggaaagttgctttaaaaaatcatattaatctatttttaaaatttaaaatagtttatactcaattaataatgcgctaatggctcacctcgttttgcgtatcttcccaatcttctcaatcccctatccctcaaactcacccttagagcaagtttaatagtatagcccactactagctccaattcatctacaactaatctaatagccaattcatacaatagttgcttactatactattaatatatggtcccacatgtcatgcacacattacatcttgaagtctgtgctgcagctcttctctctcttattataaaatatgtttatagctggcttattttgttttcactttctgtaatgggatcagcattaatacattttatagataatttttggtaaaattctgcacgaaactcagcaataacaaggtacaccatcggttttatattattaagtcatttcgattttttttttctattcaaacatttttaagtttgatcagaaaagatatagcaacatttcaaacgcaaaataaatatattatcataatatatataatgttatatttaatgaaactaatttggtgttataatatgttactaacttttgttataaacttggtcaactagtaaaaagttgtaatatgaacgaagggagtatttcatatagctgcttgctaatgtaatacatatagaaaacatagcactgaaacatagtcgacgacttaatttaatttttcgcagaaaagcatatagcaatcaaagatcaattaagccccatgtaaatctgttactaattctcataataattcctggcttactttgatgcaacgataacgatcagtatcaccttccaattatctagacaagatcatcgccttgcaccggcgagctgttcgacgcggactccggcgacgtcgacggcggcgacttcgccgggcagctgatgatgtcgcgggcggcgaaatgtagccgaagaaggcggcgtgtggcgacggcgtctaaaaagatgacggccattccggcggcggcgctgaggtgcttggcgacggtgaaggcgacgagcgcgacgtatgtcacgcggaagatgccgcgagcgcgcctatcccggtgaggacgccgacccacccggcgagcgcgccgcacgtcgccgacgagagcgcccacacgacggccgccggctcgccgccagcgcggtacagcgcccacacgccgagcgccacgcacaggaccgacagcgaggagaggccgcacgtggtgccgtagtcgtcgccgccgccgaccttctcctccccggcgccgtgcccggatgttcgccctgaacagcaccaccggcgtcggcggtggcgaccgcggcgacggcgcgtctgtcgtcgtccagctcgtcgtcggagttggccgtgacggtgtcgtaggcggcggagttcatcttgcgtggtggcgttggtgtttggtgcgacatcttggcgacgagagcgaacaagctagggctacgtgaaattatactatgaaattaattgctgggatttactaaggtcttaataatcggtggataaaactaaaccccggtaaaaaggtagtaatattaccacgaatattttggat

SEQ ID NO: 60330 - DNA, 3625 bp, Oryza sativa
ctggccaatggatcatcatatgcatacacaaaaggccatgctttcttcccttctcccatccaatcgcgcaactccacagatggctccatcttctccttctcggcaacctttatcttcgctatgcttcacacgcttcctttggaggagggcgatgggattgccttcttcctagctgcacacaccaacttcaccggaacaggtatttctggcgactttggtcttcctgctgaagatgacaatggcaaatcgttggaccatatcctgtccatagagctagataccttacacaatgaaagatttggggacatcgatgacaaccatgttggcatcaacatcaacagcttgaactcctcccagtcctctccagccggctactacacagatgaaccctactctattttgcacccgctgcggctcaagagtggtgaggagatgcaagtatggatagattacgaccaccggcgcatgcagctcaatgtcaccttagctccagtccccatggccaagcccaagcgccctctcttatctgcaactcataatctctcaaaactgttgttggaccacatgtatgttggcttctcttcatcgtcgtcagcggccttgtatattagtggtcatgctcatggtcattttattgccggcttctgcttcaggctagatggaaaacctgcatcactgcaatactccaagctacccaagataaacacatctgatctacctgatcatgtcacctatggtactggaagggggagctcgatttattggccagattttttgacacttccattgatatatgcctcagctcttggtggtgcaatatcgatgcctgttatcctctacctaattgtgagaagatgtcgcaggtaccaggagttacatgaagattgggaggtcgagtttggcccgcataggttctcattcaaggagttgttcaaagctaccaatggctttgttgacaagcagttgctcggagtaggagggttcgggaaggtgtacaaaggagtgcttccatcatccaaattggaggttggtgtcaaggtgatgtcccatgattcaaaacaagggatgaaggagttcgtcgcggaggttgtaagcatgggccgacttcgacatcggaacctagtacagttacttggatattgccgtcgcaagggtgaacttctactagtatatgagtacatgccaaatggcagtcttgataagtacttgtatgaccaggataaaccctcgccgaattggattcaaaggtttgagatcatcaagggtgttgcatcaggtcttctctacctacacgaagaatgggagcaggtcgtcatccaccgtgatatcaaggcaagcaacgtcctcctcgacagtgagatgaatggtcgactaggcgattttggcctagcacgattacacgaccatggagttgatgcacacacgacatgtgtggcagggaccagaggctacatctcccctgaactagcgaggctgggcaaggcgaccaaggcaaccgacgtgttcgcgttcggtgcattcatcctcgaggtcgcctgtggccgtcgcccgataggcatgaactcatcaggagaattgcaagtgttggtggacttcgtgctcagattctggcagcgagatctgatcctgtgcatgttggataccaggttgggaggagagtttgtgacggaggaggcagagctagtgctcaagcttgggcttctctgctcgcacccgtcgccagcttcaaggccaagcatgaggcttgtgatgcaatatttgtgcggcgatgtgctgttaccggcgatgccggagagttaccggagcatccggagtttcagtgagatgcaggttgaaggtgatcagcttgatgagaatcccttattaagacagtatctgtcggtgcaaacgagtataaccggtctctctggtgggagatgatactgtcaagtgtcaacaactagagtttaattagccgataccaaggagaagagaaatcttgatatggattaaattaagaagagatttaggtaatttgagccagagcagacccgaacagaggtttttagttcagtgaacacacgggaagatcggcctcgatatatatattttgtgattttattattttgcggtttcatttagacttaaagatacgctttatttgtgcgtgtaactacttttataccgagcaggacacaatatgctagccagtccgaattccatcgaaacaggaatggaagctacggctgtgtttagttccacgtcaaaattggaagtttgaagaaattggaatgatgtgacggaaaagttggaagtttgtatgtgtaggaaagttcgatgtgacggaaaagttgaaacggaaaagttgaaagtttgatgaaaaaagttggaatctaaacagggcctgagtagtgatgtgtatgcaccatgcatttatttctctatgtaggtgatgagctcctagtctatgcatcaaacgagaaatgtactcgtgtactccctccgtccaagtatttgacaccgttaattttttaaaatatgtttgatcgtttgtcttattcaaaaaatttaagtaattattaattattttcttatcatttgattcattgttaaatatacttttatgtatacatatagttttacatatttcacaaaagtttttgaataagacgaacggtcaaacatattttaaaaaatcaacggcgtcaaatatttagggacggagggagtatatataagcaatatgtatcatacatgtacaatactatacagtgtgtaagcgcctggtatagctgtttgttcattttccatgcaacttcatatacatatatatatatatatatatatatacactcatcatacagctccttgtcattggagctagccggcacacatttttgttgaggtttgctgcacagcatataaaaatgaactgcaccggtaaactgaaaaacggacatatcttgttggttcgttggttggcaagtgtgcgtagcctgctaaaacggcccagcctagagcccacgtactatatgacgggcttagtagatgaagcccactaacttgaaaagcctagttcaccggcggaaaaagtgcaccgaaggtccctcaacttatcatcgggatacaaaaacatcctcgagccgcaaaactagatacgcggggtcccttaactatacaaaaccggtcacccgagatccttgggtggttttagccccggttttggtctacgtggcggctgagtcagtgtgggacccatgtgggccccacatgtcagtgtgatacacgtcatctctctttccacttttttttctcttcttttttttactccatccaggcgttcctcgacaagcttgccgacgacctgggcgtcgtgctgcacgccatgcttgccaagaaggaggagctgaccgcggtcggcaacaacgggtccgatccctgcaagaggctgcggatcggggccgacacgggggcggtggcgtggggacccggcggcgacgcggccgagatggcgcagagcagaggcatcgtgccgttcccgtgctctgctggcggcgctgccatcggagtcgtgctgggtgccgcccatggacgaggacgactactcgtcgctgtccccgtggatgatcctgtcgaccaccaagtc

SEQ ID NO: 60331 - DNA, 2188 bp, Oryza sativa
aggagggcggctgtctgccgaggagaaggccgatgtcggggccaccgccacggcagtccgctccatcgacgggcgcacggccatcgccgcggcgtcgggcggggtagcggccatgggcaaccccaccgccgccccttcgccaccccgtcctccaggggcctgctgctggggcggccggcgaggccgacgcggagctcgtggccgcgcaggaggtggccgtggaggttgcggcaagcgctgcgggtcgtcccgtcatcccgatggctggcgagggagggagaagcggggcacaccgtcgatgtggtggcggcggaggaggaggacgccgggcaccgctccgtggctggatccggccgcggaggaggaggagacgaggaggacaccgacaaccactatggcaacgccgacgaccaccatgctcaccagccgccgcgcgctcgcacgccgcctccgccgcccgccgctcagccctgctcgccgccgcccgttcttgctactcccctgccgcaaagagaagtaaaaaagaagagaaaaaaagaaaggggaaagagagagatgacgtggcacgctgacacgtgggtcccacgctgactcagccgccacgtaaaccaaaaccgtggtcaaaaccaccgaaggatctcggggtgatcggttttgtatagttaagataccccgtgtatctggttttgcggttcgaggacgtattttatcccgatgataagttgagggaccttcggtacactttttccttcaccggccggccacgccggacaagctacaggtgcggcatgggctgtaaagcgcatggagaggcccaactctctaacagttacgaataaattactttgagtttggtcgaagtcggttatagacaaatataataatatttatattactaaattaattttattaaattaataattaaatatgtttttataataaattaatcttaggtcgaaagtattactatttattttataaactttattatacttgaagcagtttgattttaaccaaagttaaaacattttataacttgaaacggagggtgtaatgtatttgttgattatcactggattttcaaagaaaaaggaaatcaattcattattctattatccatcaagaaattaaaacgaaagcagtcagcagcttagtcaaagggaaacgtacaaactaatgtccaatttttgaatcaatccaactcagaaataaccacacacttggcattaatcaaagggaaacaatcagaagcagcagacacagaaaggtagcgaacacaaagagccagccaacaaagccatgcaaagaaattaaacacgcattaaccagcacttaaataaacttaaacagcagatgaagaagccgcagtctcgttgtcggcggcggcggcggcgggcctggagacgatgccggcgtggttgagcagcgcccagagcagcgtgatgagctcgccgccgcgtgggcgtccaggttgtcggacggcgccaggtacaggatgatctccgaccaaaactccgcaagaaccccccacgccttattcccttcctcctcctcctcctgttggttttggaccaacgccaccagttgctccgcgagctgcgcgccattccttaacaccttgtgcctgcagcctgcgctgagcaatcggaccagcttctcgtactccggtggagcacgaccggcggcgagagcacggcgagcgtctgccttgacggccttgtacaggtccttgctccagccatcgtcgtcggggagcagctcgggacagcaggccaccaggtaggcgcagtagcctgacaggtgagtggcaacaaccctgttgctgctgtcagagcttgagcttgcagttgtacttggatttggatacttcacctcaaggatggtggtggcgatgtggcacaccaggaggacgtcggttgtggctgtcacatcctcccagagcagctggctgtcgctgccctgcagatgcagagacgccgtgcatgctttggtcagctgcaggctccccttgctgctcctgagcttggcgacgatggcggacttcacttggtcgggcaccttgacgatcttggttttctccggcagcggcgaccactttgctgttggacgatgcatgtccaggattgagcagaggttgatgttgtccttccatgggttattcaccagcttgcaactgcatcgcaataat

SEQ ID NO: 60332 - DNA, 1150 bp, Oryza sativa
  unsure (1)..(1150): unsure at all n locations
tcccccaattttttaatattactattttcttatcatttgattcattgttaaatatacttttatgtatacatatagttttacatatttcacaaaagtttttgaataagacgaacggtcaaacatattttaaaaaatcaacggcgtcaaatatttagggacggagggagtatatataagcaatatgtatcatacatgtacaatactatacagtgtgtaagcgcctggtatagctgtttgttcattttccatgcaacttcatatacatatatatatatatatatatatatacactcatcatacagctccttgtcattggagctagccggcacacatttttgttgaggtttgctgcacagcatataaaaatgaactgcaccggtaaactgaaaaacggacatatcttgttggttcgttggttggcaagtgtgcgtagcctgctaaaacggcccagcctagagcccacgtactatatgacgggcttagtagatgaagcccactaacttgaaaagcctagttcaccggcggaaaaagtgcaccgaaggtccctcaacttatcatcgggatacaaaaacatcctcgagccgcaaaactagatacgcggggtcccttaactatacaaaaccggtcacccgagatccttgggtggttttagccccggttatggtctacgtggcggctgagtcagtgtgggacccatgtgggccccacatgtcagtgtgatacacgtcatctctctttccacttttttttctcttcttttttttactccatccnnncttttctcttctagcttgccgacgacctgggcgtcgtgctgcacgccatgcttgtttttttgaggagctgaccgcggtcggcaacaacgggtccgatccctgcaagaggctgcggatcggggccgacacgggggcggtggcctcgggacccggcggcgacgcggccgatatggcgcagagcagaggcatcgtgccgttcccgtgctctgctggcggcgctgccatcggagtcgtgctgggtgccgcccatggacgaggacgactactcgtcgctgtccccgtggatgatcctgtcgaccaccaagtccgtcaagtacatcgacacggcgcactacgcggtgccgggcggcgcccgcgtggttgagttggtgacc

SEQ ID NO: 60333 - DNA, 840 bp, Oryza sativa
tcgcagtagatcatttcctacaaaattgttaatcactactacaacaatcaaaaagcttaaaagcatcaacagaagctcaaaagatacattaaagggtattttgctacgccattgcggccaatcctccaatctacacgcaaagaatacaccgagaacaccgctctcgtgctactggttcaatgactaaaattttgacaataggaggccccttttgctcgcccatcttcgtttttaggtcaaataccccagcaattgtaaccacagtcacctaaatcctcactgagaaggcataattcaccttgataagatcaaattaggccatccagtctgagatcccgacctagaccactcccatcagagagctccacaaaattctcccgaaggagcgccaagaaccagccagaaaacactcaaatcagcaccggaaccccccaaattcccccaaaccaagaagaattcctcccatccgcacccaaatcacagagatagaaccccgaaacaaagctccctagccaccattccaggacaaagaacttgggcctcggcgcctggcgaaccaacccaccaccaagatacccaaccaaccaaatctgacatgttcgaatcgggacgaagggcatgggcaggggggcaagggcaagtacctagacccggggggcgagcgcccgatgcgggagcgaggaggtcagccggattccggcggcggtgagcgcgaggccgcgacggagttggagacgacgacgaggaggaggagagcagcaaaccgagcgagagagaaaatggcgaaagacaaggacacccctagttaagccaaattaacgaaaaaaaaaacaaaacgaa

SEQ ID NO: 60334 - DNA, 671 bp, Oryza sativa
ctgcttaaatctgtatgtgacgagtagaatgcgtgctaaaacttgtatggcagatatgtgaaaaaatcgtgactgtagcattagaggaaactagaaacaacaccaattgttccagttgtatttttctgtccatatagttctcgtttggccctgaagagtgaagagtcagaaaagtgtacacgattggtgtttagcgtgatgttgctgttttggaaatttagaacattgggtctcgtgtctacatgattaacaagcttcttagatgattttgatgttctgacttgttatcttagatgtgcatgttctgaaccaactgaaatcgatgttatgttgacgtactatgttggtttttgttactttcctttaatataccctttgttgtctggtattaattcttaggaatgtatgtggcaaaccgtgcgtcggacaagattactcagctaactgacaatgtgtacatctgccgctctggatctgtaagtatctatattagggacttactcctttttcatgttgtctcattgtactgtggccataagatattgggaaatcacgagcttcctattcatcaagttatatatgttcttttgttatactgtgtcatgtcatcttgatcggttttcccagtcattcattgccctctcataagttacactctcattgcaatattt

SEQ ID NO: 60335 - DNA, 1803 bp, Oryza sativa
ttcctttatgagtacagagggagtattatttgtctctgtcctatctatatggattattttgatatatacattgttgttgccattacaatataaatacacgctgatacctttttcatgaaaaatttgatgacacagaagtccgtttgtaagctctcactccttctgtctcgctgagctgggctggcggttttctcctcaactatgcggcggtcatgcctctgttccgcgcgaaaacagagtgcaagttgccacgggctgcacacgaaagcggagacgaccactcggttttggaggtgggaacagcagagacccactggaggcatccaccaatctgtggtgttggtaacaccgtaagtactcctacgtaacaatgacagaaatgagcgtggcaaatccgtgggccgaacggctggagatggcagcacggaccgggacttgtgctatcatccaaagtctaggtttaatgtgttggcaagtgtgtataggaatgaacagttgtcgctgtccagaacaatgagttgacgttcacttttcaagacattaaacgtgtaatgagtaatcagggcgctctatcgtgcgagggttaagtattaacaagtcaaattcaatgatgaccttcatcaacgttaaaaactggataagttaactagctggccattgtcagcccagcagttgtgccagtagatcagatactgccaatatgtagaagcgtgtgtttatactacgtcgtacaattgctcgtatatatatatcttgagcagcccatcgttttacaatttaatatgttgatgaagtacaatactctctcaatcctaatataaatataactttgtattgatgtgactgtatgctcagatttataactatagaatataccatatttgtacaaggtaaggtttcacttgtattgagacggagggagttggagggagtagagttcaactactttagtaggtaaaactataagaataatatgtaggcctagaatgagataagttcatggggaaggattgggatcctttgcattagagtacaaaaatttgcaccatccattcacaatcaattcactaaacgaagcattttcgagacttccgcgaaagtcttcttttagcttgagttcatcggcctgttggcgtcccattttttttccgcttattactatcttctgaattaggtagagtgggagcactcgacgaggcatctacgacagtagaggctcttcctcgtttttggccggacaattctataaatagaatcaaaaaccagaagaattgtgagaaataaatcaatttattaagttgagacacatcgagggataaaacatttcatactatcataagttgattccatttacaattgaatttttttttctttttatgtgagtaaattttattttgggccatgtatttttacccatgttgcagcttgggctaggttttagctgagtttttcaccttggatcacttaatataaccatttgtttcatcctggaccatagccgctcatcttctccgagtccaacaggcgataacccatcaccaacgtgcccatccgaacaagcgttggcggcagcggcggttactgatgcgcttatttgatttgatcacaacacattagcttggttgctccatgctccacaatcccagccggccagccaagttacacctacaaccaaatgggcaatggaacatggcttccgttcactgaagcaacaaaaattgatgcaacatcattaaaattagaacaactcaaaccatgcatttgtgttgcctctgtccctaatgtaagcatcaacaaattact

SEQ ID NO: 60336 - DNA, 696 bp, Oryza sativa
tgattttggggtttttcatcatagtttattttccagcctttgtcttttagatcgctaaaaacacggatataaaaaatttatttgcaaattattttctgtttacaaatatgccgtttcacttattctgtcaataagcgaaacgatgggggtcctaatttcaatgcatgcatgcacaccttgtattatgaaacgtgaaaaaaagtagttgtgccgtatattttggaatggaggtagtagtttgcaagttatttctgaaatttgttctcgtggctatgtgcagtattttgagcactgtttttaaggtgtttaattaggtcctgtttcttcaagagcatttccacaaatcaaatattaggactgctaagaatgtattaatgctttgagtatgctaacatggatggaatgtctggattccttggtctggtgaatacacaatcatatcttgaggttgctcttgtttgtctctccgtctctccgatgtagtaacaactaacaactagcacatcagcgcaactgtgcaaataagggaaaaacagcgtgcgcaactcatgcccaggctaacattaaagatgttttggttgatgatttatctgtttgcaggttccaaaggccccctggtgcattgccatcatctatgctaggatacgaggcgctgactggttccttggatgatttcgggtttgaagattatctcaa

SEQ ID NO: 60337 - DNA, 6470 bp, Oryza sativa
ttttcgcatacggctatttaagaaacccgcataaaaatatctattttcgcaaacagacctctaaggggctatatgcaaaaaggagcatattttctcatgcgattctcaaggagccatatgtaaaaatagatttttgcatacgagccttttaaatggtccacatgggaaattgcctctcttttttcttcctttactctctctttatcctattaggacttcaaatttttttcacttcctctgctctctctctctccctcttcctctcatctcctgatattgttttcacctcctctcgatctctctcttcctcttctctcctctctctctcctctcctttcctccgaccaggagcaggcggtgggcggctcggtgacctcaggcaccactactgccaatgatgaggtggcagccagtaacagcgccatccctgtccccgcttagcacttggaggccgacgacgacaaggaggcggccaggagcggtgccaccatcgacgatgaggaggcggtcgggagtggctccatccccatccctgcctggcgccgccaccgccgacaaggccagtgacgggtggtgcacccgcatgaggttttggttttggctgctagccccatgacagcaggatccgccggcgccggtgctggcactgcgacggccagatccgcagccgccacaattggggagctagggttttgttttttttttatttttttcagatttttttttgcgtgtggacgacataagcacccgcatgcaaaaaaaaaacattactatatgcgggtgcaccaccctcatgaaaaatttgctatttccgcatacctttcctagcagattggcggtctaaccgtaaaaaaaaaggttttggttgcatgggaatatggtttttattgtagtgcttatgcaaacgtttaccagctggtatgcaaaagatataggacgattgaacatgtgttcaccaattccacttaatgaagagacctgccaaaacgtcagaaacctcgtacattcttaagcgtataaacaatttgccactaataatggaataagatatcgccacggcttcagatatagatcacctttgctcaaaactagatccttaattgtatttaagttttttagaactaattattttcaagtgaaaacttaggtatcaaaattaataccccggggacacacatcccacatatatccacgtgaggagagtaatttcatataccactacgctataagactgacgatattctatctaagcatctaaaaaagaatggatggagaacaaatgtcaacatcaaataatatgctttgtgatatcccagtgtgctcttcaacgaatacaagaaccaagtgtaccaaagagggtgaatggtttcaacaccaaaaacttaaacttttagtgcaaagacaaaaaagttaccctcaaacttaacaaaattgcactggtcacaccgctggattgctgctggttggaccgtagtactctcgccagtctaaccgcctgcacgccgacagtctgaccgccgtcttgtcacaggttggaccgctttcctgctgctggtccgcccaatgaactccggtcaaatcgtcgggattcagaaaaacacatatcgatgaaactcttgaaaatatatcaattttattgtatcaatatgtgtttacaaagtgcatataaagcactcatctctcaaatcatgaagtaggattaaaaccttggagtaaaccctaactttaaagtcaatatcttctaaactcaacgccttgtctatttatacccacaacattgctatccctagacacgaatccaactagaactaggactcctaatcacataggaaacctacccaaccaagaaaacaacatccccatacaactccacactccaacactttaaaacttggactcaaatccaaatttgactcctcttttcatactcacatatggaaaccacgtgtagtccatatgaaaagtttctcctccacatgcatcccacacgctattcttgaacgtctagaccttaacttctcctaagtctagtcctgatctattaccggctatactctcatagcctcatgcaacacatgcacaagaacaacaaagaaactccatatccaagtacaagttcaaaccaacttgacttacatcatcacacaatagtatcacatatgaatagaaactatctagaaattaaaaatatgaagcaatttaaaaattctacgaaaataacccgaaaccaactccaagcccggagtctaccggtatgactgtccggttacctagtcagaccgcccggatacccctagtctgaccggacacccattggcaacctgcactgttcaccgtctgaaacactatgtaccatattttccaaaacactcacctttgacacaattatatttgatcatcacttatttcacattcaccacgtgtacataaattgattatcacgtccattcatgcatatcacgatcaacatcgagtatttcggttatgcagtgaatattaactgtgctaatttaatttaattttgtgcttgcatccattcatttcatcggtgcctagctgcacgtacagaagtttatgtactttcaaatatggcccacctgctttgttatattcttctcttgtagctttcatgtttttgtcccctgctgagaatatattcatctgatcataccttgtttggaatggttttctttttggaaaaaaggcgaaacaccccattagctttacttgaactattaaatcagataggtatagtaagcccctaacttgttcatttggtccaaatgatctctgagcggtttcacctctatggtgtcactggtggagaaaccctttgtagtcccggttcgtaacccccctttagtcccggtttccaaaccgggactaccaatccgggactaaagatcgctatctttagtcccgggtgaaataaccgggactaaagatcgatctttagtcccggttggtaaccccaaccgggactaaagatggcttagccgtaccggttggtgttaccaaccgggactaaagatcgagctgacctttttttttgcgtggccctgttgctgcatatatatgtttcagtacatatatgcatatataatatatgcatatatatatatattattatatttatatatgtttcaatacatatgtacatgcataatatatatgtatttatacatatatatgttatgcaaatgcatatgtatatatatatatgaccaaaatatatttacattatagaaaatgtgtacacatgcatatagaaacatatgtagtcatgtattaattacaatccattatatgtcctagctagctacgatttcgacgtagtagtagtcgctagctcagaagttaaggacctatgaattgtgtttccgtcgtagtagaattcacccttgggatcaaggatttgttcgttgatgaatcccatgagttgttcttgaaccgccgcgataaattccttgtgcgtggtcaggttatccctcatgcgaataaactatatgaatgtatgaaattgattagtatttaaacaagaaatcgatacgtaatgaaattttgaatttatttgtacgtacattgagctctcttgtgatgatgatttggtctacaaggcagtggcaatactcgcacacgtaatagccgcacaagttagttcccttcttttgctttgcgcactacaaataaatgacaaacaacgagagatctaattaatatacacttgtatgtatttgaatcggagaataaatgtagagcacgtgtactcacaggaaatttgaacttccgcctaagtctttctctccatttgccgcggaccaaatgacggaaccgataccaagccctacatggagtttaaagctatgattcgtagtagcaattaacataacaagattttcttaattaacagaggaacttatgacggtacctgtctataagttcaaaaaccttgtcaaacgtagactcttttttatccattgagtcatatacgttgacggtgcaggccgacaggtcgaagagtaaaagcacccagtggaatctgcaatgtgcgtgggatgcattacatatgaaacacttagcaagttcgtacgggaatgaaatttggtataggaagacagtaaaattaaactaactctgtgttgtacggcaacagtatgaacgtcttgtaatgctgcgccttcaggagatggacgagattgtcctctgtggcttgcggatattggtcgagcattgcgacgtttactttccgagggtcgatgaatccagtatcgaaaaccccccgccgtttggtcctttgaatctccattctacaacgataaaagggagtatattattttctatagtctacttatatacaaggacctaattaattaaaggagacgtagtaagaaatctaactgaacgatatacttacaaaatccagcaactcataatagagacgtcgagggcgtccagctggtatagttcgtagattcccttgaaattgatccagagaatgtcatcttcttgcaagaagtccgtgtccctgatcctcgctccgatcatctctctaccggtggcgctcatctccatgtacagctgatggaactcgtacatttgtgtgggtagggactgcagcagctcaggcttgacaagcagtttaccgagttcgtacatgtatttcacttccgccttttcgattggtgcgactcctagcaattgatccgtagttagaccggtgtcagtaataaattcttctatcgtcatttctttaccggtcaccaacggctcgatctcctggtttggttgctctccaagctgagggactggtttggactttccagaagaagctttcttcagcgttcgctcatagtccgatagcttaatggcctccttggcaggtgcagacatacccctgaagaagttcatgacactcgggtctataggaatcttcttttctgaacttcgaggcttgaattgtctcttgacttctgatgccacgtaagtgttaagctcctcttgcatgcaatcgtaccccgggtccttcttcttggcggcgtcaactttcgccttctttgttgcccttgtgtgggcaggcggtggagcttggggggcccttgactttgaaggtgccggaagaggagcttgcggaggagtcagtgtaggagcccgaggaggagtcggtgcaggagcctgaggaggagtcggtgcaggagcctgaggtggagacggtgctggagcatgaggaggagacggtgcaggatcctgaggaggagatggcggagccggaggagatggtgcacgagacgccacttgttgcccagggaggatgatgtaccgcctgcgccatagaataatggcttggcttgtgtctcgtagatgcgtctcaccgtctcctccagggtaatccagctcgaggtcgtcgtacgcgccttcgaccaactcaacttcgaccttggagtatcctgctggaatcggcctgcagtggtaagtacctgaaggatccattgggatggccatgcccgacgccaccttcatgtggtgagaggttatttattagtaatcaacatatataagcagcaactagcggaatgggcaaatctaaaatatataaactacgagcttacctttattgataagttcttgaaaggaatatgcagctcacatggtgtccgctgagtgatgtcatcaacggggcaggtggattcgtcctgggtttgcatggcgtccaagctctgtgatcctacctgccccgttgaggcgcagctgctacggtttcctgacgggctcaccattgcaggaggaatggtcggctggggatcattggaccgatgtgcggccatgcgttcatcaaccttccttgccacctcctcttgcatgctgagctcgtagctcgataccctgaactcaagatctgcaatcttcgcctcggtatctctcttgctcctcatcccactcctgtatgtgtggatgtcctccttgaacccaatcttccaaggaatcacccctttccctcgtgtttgtcctggatgctctagagtctgcagggcgagtgacagctcgtccctctctctatccggtcgaaacgtgccgtcagaagaggcttccactgcgtctgttagtcgacgcgcagcctctcatatctgatcgccgaagaccagtgagccatcagctggtttgagtgttccaccgtgagcatagtaccagaacttcgatcgttccggccaattagcggtggccggttcgatacccctctcaagcaagctagcctccatctcctcccacttcggcattgcgacgctatagccgcctgaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcggtgtttgcccattcaggatatatttcatgtacagctcttc

SEQ ID NO: 60338 - DNA, 727 bp, Oryza sativa
tcctgcagcccttgctgcatgcatgcacttcgccactcctgtcgtcggccatccatgctttgtggcatgaggtgccatacaatttatttccgagatcgcgcggaggggactgggctttggtcaatcgcgagatcgcgagtaatcctagtcgcgtgcgagatcatgactgagcccgttcgtgaggctatataaggcgcagcgatatgatatctaacgaaggacacagtgctgcagacgcacacagagctgttcctctctcagcgccggcggcattagcttttcgctcaactaggcaacggcagcgagcagcaacgattggtgacaggtacaagcacttgtacagtgcgtataaactatacgagcacaggtaaaattttttgctagcaaccatgtttttgctttgttgaattttttttttatgtttttggtctcacaatgtttttatggaataaaaaacataattcgatatgatgaataaatatttggaaaaacggaaggcctagctaatgctctacacgaccgtgtcatcaatctgcagattaatatctagacgaccctcaatgttatgattttttccggtcaatgacatttttctttaatttgatctgacaacgtcgcaaggggaaaaacttaatttgttgtgatgaataatggtttgacagttgatttgatccaagatgagtcgtcctcgctcctcgtttcagcggcttgtggatgaatcatcgtc

SEQ ID NO: 60339 - DNA, 653 bp, Oryza sativa
ggggcccacgtgggtcccatatttttaataattttctatgtgagactgacatgtgggtcccactggttttattattttttcaaattgaattgctacataagcgccacgtcaatgccacgttagattaagacccgagttaaattagctacgtgggcgccacgtcagccaaaaccgccgagagacctaatctgcactggttttgatagttgagggactcgttgtgtctggttttcaggttgagggacgaaaatcggattcgttgacaagttaagggacctcaaatgaacttattccccccttaaatactgacccattttgctttcttgtgggctggcatgatgtcatggcgtgcaggtacatgcgctcctgtggacacggagcggagcagatgggaaggcaacatccatgcgtggccttggcccactgcgttgttgttctctaaaaataaatgcgtgtggccgaacacattccgactcgattttgctatatatttgtcgacaaatttttcccccaaaatttgacagatgtaattacagtacaatcgtagtgtaattacactgtaacttgcatgtagttacactgtaactatagtgtaacttgtatgtaactttcaaaaatctctccgttacatgttatttcggtaaaatggaggt

SEQ ID NO: 60340 - DNA, 652 bp, Oryza sativa
cttcctttaaatccctaggccattatgtaacctccactcaggctgcctcactttgaaccagccaacaagtagagccgcaggctcagaagattattgtctttaacctcccaaagatagaccaatgcccatacgacgtcggagcagatctttcccatcaaatctgactgaattttgctcgatctcccaaaattggttgagggctttcaatccactcgatctactctttccgtcttccaaaatcagaggtaaaactcacgataaaaacaaccggggaagatcgcctatagtcggagattaaatctggtaaattaaaagtcgcatcaaaaggggaaatcatgtagaaaatgatgagagaagagcggggaatcgattttttaatcaattagagtagataatgcgcaatcgacatgaaggcggcatggcgctagggttcggcccgggcagcggcaggaggtgcgcggatggcgcggtggaatagatcggggaataaaacggccaaaaaaaacccagcggaaactgaaaaaaaaatggaccaaaaaaaaccagacggaaattgaaaaataaatggacaaaataaagcggtgcaatagatatcagttgggatcgggataaaaaagctgcaacaaaagaaatgatagaaaccgaaataaaa

SEQ ID NO: 60341 - DNA, 717 bp, Oryza sativa
ataaggtattgactaataccccagactgattgatcaaagcatggtgcacaacatagtcgacccggtcttagaaattattgaaaaaatcgtgtgccgcatcactattctgattaagatttcccccttgcaacccctaagcaccatcaccttgaactccatgcactccatcgccttgaactccatggatcccttgagagttgtcaccttgacttcctagagaaccgttggtagcacctttgtcactcagttgagccgagccatctagagcttgtttcctgtcttcacctttggaagaactggtcccatgatctacatttactttatacttctgaaccaatgttcccttgcggatctgcatgaatgagttcaagaactgatcccaggcttgctgcaacattgcttcaaaatccttcttctgctcaggtgtgaatttctctggatcgatgggcacgacgtttccttcattgacgtcagtcaaccccaacttctggatcttttctttaacagtgcttgggctagccgaggatggtgacagcggtggcttctcggccatgaggaagaattgcttgctgacttctaatcggtcccactaggcctgccaaaagcgtgttgatagaaaacacgaggcctgggaaatctgcttaactccaatgcaggtccaaagctcgccttcgaatgtatgagcgtgcagttgatttcatcctgtaatcaacaaga

SEQ ID NO: 60342 - DNA, 2643 bp, Oryza sativa
gaaataactaagaggtaattctcaccaagcaaaactaaattactcaaaagatatttctattataatcagagtaattaacagagcagaaagaaataagaagaggattattgataactccggaactcctccgacttcttctactctctctccctaatctaatatataataaagtacaatagagcctcttataatttagctcaagctttggtgtgtgtgaatgagggagaggagagggccgtatttataggtggagagatgccttgggaatgtggagatgctaagcatcctaagagcattttctctcttgtgttgacaagtgtcctctctatgacggtttccaccggtagaaacggtcacaaccgccaatggatgaggattgcaactgccaggtgaaaaatgggcctggatggactagctggtggtttggccgaaccctggccggctctgctagcccagcccttcctcctagagactgatatgtgggccccattgtatattcttctgaagattggctcaaatgattgcatcttattgggtttatgggctcaagactccattagcttggatatgaaagttatattctcatccttcatgtatattttctctcaactttagtaacttgtcacctgcatacgaatatataccaacactcatagaaaatggtagaaataaaccctaccactatgttggatgttttatatttatggtcttatgcaagtattgacggtgttaatttggtacttaatagccatcaacaaacccacacacttagctctttactcgtcccgagtaaatgttgaggattaatgtggaacaaaattttcaaaaatataataaaagtacccaaactattctaagccataactgtacctataaactttgcagtgtataacttaccatcttgggtaactgatgaatggaacggttgtgactcaagtccttcatgtttctcctgtcaatctcttgagttttcatatgttttcacaaagtatctatactcctcaaatgactttctctcaaatcacgcatgtggtttaatttgtggatcctcaccaaggcatattttgccgaattgtccctattctaaaaggttgtatatgtggagcttggtagggatcaatcggggcatacctgcatcacatattttgcaaagccaaaaggtcggacccaaggagatagcgagttatactctctgatcaagaatgtgcatgtgtgtgatatgtgtatgggtatgtatgtgtatgtgtatagtatatttttggatggaaaaaggaaaataaaaaacaacaactcctttggtataccgcttcctccaattttctctctttggaaatttgagagagtgcatggctatctcctttttttttcatcatgccccatactttgtatgagcagattttttttctattttctctctctcatttttttttatcaatgctccatacttatatgagcaagactttatttttccttcttgtgcatagtcatgcatctctctttcttttttctttgaaagaattttggaggaagagacataaatgacatggagtatttattttgtggataatgaatataataaatgatggatgagagatgctaacttccagtgtagaagtttagcataacgtgcgtatgaggagtgtggtgtgatcttgatcatgaaagtatgaaaagtatctcacacaggtcacaataatttgacaaagctcaatgtaatgtcaagcggcctatacacatataaggttttgcaatgagaatcatatatggccttggtaggtaataatatagtcactaaggagtattgctctaaaagaatttttaattttcacaaaataaaatcccaagtatcatgaaagttggacatgaatttctttcgttcactagcacagaacctttcatctgtgatagccactaacatgcctggaattagcgggccgtcacaaggaagtcatctcaatcgggccaaaaaagcattcgattaagatatggtcgcacagacatattagatgggcataaaactcaggctcgtcatggatgacacctatccgtgacgggccgtagtttaggcccgattgagataacattccatatctcaatcgggcctcaagttggctcccatcacagatgaccatcatccgttacgggcaccaacttagggcccgattgagataacaactaggcccgccacagatgactcatccgtaatcgattgagatgacttagtatttttttctatttttcatatggaatgtttatatttgtgagtcgacctgtagcaaaataattaactgcagtataataattcattttattagtcaaaataatttttcgagtagtaaaggatttcaaatggaaaatttgtcaacaacaaagttgtataacttatcaagatttacaacttttattttggtcatttttctgtgtaaccttttttatcagtttaaatttgaatttgaaaatatgacaactttaaaacaacattttcaaatactaaaaagtcatcaacaaaaaaaaagttgttataacttatcaagatctataacttttatttttgacatttcttaatcgacaaagtgttagtaacattgttcacaaaactcacatatctctcatctggtttcataaactataacgcaaatatgt

SEQ ID NO: 60343 - DNA, 715 bp, Oryza sativa
ttatccaatgttagtttctaggtttgtacactatataaactttacagtatatattttcgaagagttttttctaaagaacagatccgatataggacttcttcgcaaaatacccccatccttcctgcaaacagatgggacaggattgccatagctagagcaaagaggaaccacagtactaaggccatggccagcggcgatgcgggaagatggcccctcggccagcaagaggaccctcattaccggcgacacctgcggctagggtttgaatttcgttgcaaaatttctgaaatttcgttaattttgccctcccaccggcaagctcatatctcgcccgaaattttcgtttttttacaatttttttgtgaatttgtcaaattgtattcaaattcattcaaaatcagttaaacttttaaataatttcggtcaaaaaaattcgaaatttctaaaatttcagtgtcctcgacagaaatagcaatttcgaaatttaaaaccctgccgcggcatcggatactcaccccaacacacttatccccttctcgctggctagggagacctccgccgcggagccttctgttgcttctacgatcaacgcggggaattcatgcgcaggcgtgcggtggtggacgagctggcggcgctgggggcggccgtgcatacctgctccaggaacgaggccgagctgggcgagcgcctcagggagtgggagggcaggggg

SEQ ID NO: 60344 - DNA, 9398 bp, Oryza sativa
gccacgccgccgccgccgtcgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgtgaacgagctagggaacgtgaacgagcgaacgaacgaggacgaacgttaacgtgaaatgcaatatatatatatacatgtatatatatacatgtatatatatatacatgtatatatatgtatatatatatatacatatatatatatatatatatatgttacttcgcatttatcctaatacatttttttatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccaatactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctaaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagtgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgcgcgacgactaacagatgcagtggaagcctcctctcagggcacgttccgaccagacagagatagggacgagctgacactcgccctgcagactccagagcatccaggacgatctcgagggaaaggggtgattccttggaagattggtttcaaggaggacatccacacgtacaggagtcggatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttgaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcaaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctcttccggcaccttcaaagtcaagggcccccccagctccaccgcttgcccacataagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcgaacgccgaagaaagcatcttctggaaagtccaaaccagtccctcagcttggagagcaaccaaaccaggagatcgagccgttggtgaccggtaaagaaatgacgatagaacaatttattactgacaccggtctaactatggatcaattgctaggagtcgcaccaatcgaaaaggcagaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcaaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgtaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatgtatgcatatatatgtattgaaacatatatatgcatggtttatatatatatatatatatataaaccatgcagcaacaggggcatgcaaaaaaaaaaatgtcagctctatctttagtcccggttggtgttaccaaccgggactaaagatctatctttactcccggttatttcacccgggactaaagatagcgatctttagtcccggattggtactcccggtttggaaaccgggactaaaggggggttacgaaccgggactacaaagggtttctccaccagtgatggttaaggaagagcaagacaatatcacccccctcttcatgttttatcaatcattcaaactacaatggcatattcactaatcattaagcacaaattgcatattcacagatttagtactcacaaattgacaatgatattatgatagtagtctagtagacaatgagaaaactgagaataattaatgaagctatgagctagaggagtagagttgtagagatgtagaggtacctacagctacaggaaaggaaataagattacagtcggtgaccaacggcgacgggcaaccatcacagcgacctcctgagcgacgcagcgacctcctgaggaagctggcactgcggcacgacatggaaccagagctagcaagccgggggcgtcttggcttctcatgtctcgccatcttggctggcctcccgagctcccggcgccagcggctccgcggctagtggtgccgctgcgacggggagcgggagcggagatctgcgcgggtctcgagctgggactgcggacaacgacagtggtgaccagcgaggagccgaggagaggcggatagctagagccggtgacccaccatcgctggctcgctgcgagtcgccgaggagaggtgaggaacgacacccgccttgcgccttcgcagacttgatacgagcgtcagcggcgcacgaggcgaagggagttgcggctgagcggctccactcctcaaccctagcgcctgctctacttgggcctgtctctgttgggcctaggcctgaattttgggtggagggatggggttctgggccaaaaccggggtagtcccgagcccatagggactatcccctagctacgccactgcttgcaagtacgtgtcctgctttactacgaaggcatcgtgcatcagcaaccaaccggctactgcttgaaggacggcagggcacgcaagcaggactgtaggaggcagtaggcttgggttggccgccgaagaagccccaacaacccagcctttaatctcatcgctctactttgtcccaatgcagagcacccctttgcccagccactgtcgatgcccaaccgccaccactcgtgtctcaacgttacccatgtgtgtcacgcgtttgctccccatcttccagcaaacctagcaccaaactaagctcgaacccatccgctcagaagtccaggggcggagctacagtgatgcctatgtattcccaggaatacccaactttttttatcaaaaaacaactatacttcaatatatacacataacacatatacacatattagttgtccccactcctccagagtccctcgctcggctcacgcctcaccctcacgcgcaaatgcgctgctcgcccgctccccaattccccatttgattccaaaccctaggtggcggcgttcggcggcggcgcggtggcgcggcgaccggcggaagcggcaaggcgtccggcgaccggcgacgggagcagggagctagaccagcggtggcgcggcgaggcattcggcagcggcgcgacgccgtggcgaggcattcggcggcggcgcggcgaggccgcgagacggcaaccgacgggcgaccggtgacggcgggagcgaggccacgaggccgaggggcaggggcgcggcggcggccggccaacagctgcagctcagcgggacagcgcccagcggcactgcggcaggcacaatttcaggtgacaaatcaagagttcaagattcaatcagtcctaaatccactcactatgtgtccatgtctgatgtttttttaccttagtctctgagtagtttctttttcctgtacttttgtagttctgtagattgaagaactctcaaaatgaagaagaaatcgattgatttgaagactttgtgggatagacattcaaagtctaggaaggtagggttaggttctggttctggatcaacaacacagccagttagaattgacagtgaagttgctgttccttctgttcagccgattacagatgcaaatgagagtccagttcagattcagattactgcagttgaggttgtgcctgaggtagcagccagtgatgcagcaagagatgtgacagaacctgaaacagaggtagctagcaatgatccagacatagcaacagcagtgacacagcaggagcaaccttccacttggtctcctatcagagattggtctcccatcagagatggtgatgatgaagagacagagtatgactcaagtgatgaagctatttatgacattgatttactttgtcatgatcctggaaggcgaattgcaatcaaaaattatgatgtcaataaacggaattctgtgataaggggatatattgcattagggccatgccaaccacgcagccacagttttcctataaggaaaattggaggtaagcctcggcgcttccttcctagttggtatgacgaatttaaatggcttgaatatagtgtggaacaagatgctgcattctgttttatttgttacttattcaagcataaaattaataattctggtggagatgcatttgtaaataggggatttaggaattggcacatgagaaaaaggattgcaaaacatgttggtggtatgactagctttcacaatgtggcacaagataaatacaatcacttccttgcacctaaaacaaatattgttgagagctttgctgccaccaatgaacaagacaaggctagatatatggctcgtttaacctattcaatgaagtgcttgaagtttcttttaaggcaaggtttggctgcccgtggacattatgaaagtgaaaagtcacttaataaaggaaatttccttgagatgttgagtatgctagcagaaaactttgaagaagttggtaaggtggttttgaataatgctccaaagaattgtaagttgactgctcccgaaatacaaaaacagatagctaattgttgtgccaaagaaactactaagcttatcatggaagaccttggtgatgaatattttgcaatacttgccgatgaatctagtgatgtgtaccaaaaagaacagttggctctttgtttgagatatgttgataaaaaaggaagggtagttgagaggttccttggtgttgttcatgttgaaaatactacttccttgacacttaaagctgcaattgaatcattgcttatggagcattccttgagcttgtctaaggtccgtgggcaaggctatgacggtgctagtaacatgaagggtcatgctaatggactaaagaaattgattatggatgagtgcccttctgcctattatgtccattgctttgcacatcaactccaattaacacttgtggctgttgctaaggaaaacccagattgtgtgtggttctttgagcaacttagatttttgttaaatcttcttgggaattcttgtaagaagacagaaatgcttagagttgcacaagctcaaagaattgtagaagaactagatttgggtgacattgaaactggaaagggtttgaatcaagaaatgggtttgggcaggccaacagatactcgttggggatctcactataaaactgttatgcatgtcctatctttgtatccttcaattcaaaaagttcttataatggttggcaaggatcgctcttttggtgcagaatgtgcaaatgcacaaacagtgttgacaatattccaatcatttgagtttgtttttatggcacacttgatgcaaacagtacttgggttcacatctgacttgaatcatgctttgcagaagagggatcaagacattgttaatgcagtaggactgattttattgacaaagtttcaattgcagcaattacgcgaggatcctggatgggatgattttcttcaagaagtgcaatctttttgtgtgaagcataagatcaagatccctgatatggactctttctatcggccggttggaagagataggaggttctttattaaaatcaagaatatgcatcgcttccatgttgacatgtttctaagtgtcattgatagacaactacaagagcttaatgaacggtttgatgaggtaaacacagatttgctcctttgtatggctgcatttagtcctatagataactttgctagttgggacaaagataagttgattaagcttgcacggttttatcctaatgatttctcaagcacagagatgaaccatcttccatcag

SEQ ID NO: 60345 - DNA, 13326 bp, Oryza sativa
ttaattggaagccgaggctcaacaagctcacggctaagacccggcatctcatggtattcccatgcaaagcaatcaacatactctttaagtaactcgattaccttaaccttataatcggctttcatgtttttgtttacaaaagtcggccttggtttaattccatcacctatgtctacttcctctaatggatcggccgatgtaaacccttgtccaagcttctctacctcatcaaaatctctaacagtttctccaatatcgttctttgtagaccgatattcttgcaccctttttttaaccactctaaactagcctctttactcattatacaagtttatatggcttagccgtgctacactagccggctttacagagataggtacaaatttgccatcggagatactaataaaatcatagctagaaaaatccctccccgataagtattagatattcccatggcgccactcaaaagtagcatcggccatcgcaacctctgccgatgtatccgcttgcacaatttcaacatcatcgccgtcccattggattaaacattgatgcaaggtagaaggcacacaacaattggcatgaatcgaacaacgacccaaaataacattgtagttaccttgcacatcgacgatgaagaaagcggttggtagcgtcttgtttcccacggtgagctccgctgaaacgatacccctcgcctccgttggttaaccgttgaagccattgagaatcatgttagtcttcttcaactcatcatcctcgtgccccaacttcttgaataacgagtacgacatcaagttcacagcagcacctatatccaatagcatcctagagaccggcttcccatcaacatggcctttgaggtagagaagcttcatgtgacggtttgattcatcgggcttctaaaaaaccgtgtctttaggacctaatgagaattgagcaacctcggcttcatccatagcacaaaactccataggcaacatacacaccatgttgatatccatgtcttcctatggagacgattttccttcgtcaaccgattgttcttccttctcctcaacatcaatcggttttgccttctctatggacttaggcctccataccggtggtggtcgcaactcattgaactttttatccctttgttctttcgcctttttctctcttagttcttgggtccgaagacgttgcaaccttctcttttgtgtagccgttaaatctttaggcatccacctaggatttggctctgttccaggaggtaaataatgtcctctattaaccttgctcgaagacgatgaaaccctcacatcgccctttgtagccctctcatcaaaccggcgctggagcccagtcagaccggtcgtagaccaccggtcagaccggtcgtagaccaccggtcagaccggccagacgcgccggtcagaccggcctgaagcctcggtcggaccgctgtctagtcggcggtcagaccggcctgattgcccggtcagaccggctacatggccgtggtcagaccggccgactgcgatgagctggtaccggcttcggattttttgtttggggacttttcaactccatctccagaaggtataggcacatcatgggatcctattttgatagtaatcacctccgaagtcctttcctccaccttggtgcgctttccttccctcttttcttcattaacccgatttttaccataaaattggcttttgtttggtgaagataagcgctcatggattggcctccgtggtcgtccccacccttggttgaattgcattggaggcatatggttgtacattggcggcgttgccccccatgacatgaagtaaggataagaataacccggcggcggcattggataagaacccaatgacatgtcttgtggatgaaagtatggaggtgaacgcaaccgtcttagtgaatgaccaaatcgccccttaggaggtgatcttggtcttttccatttgtcgtgattcctctcaccaccttgcttctcatacttctccaaaagcatatcaaaggtcactttggttttcctaggagccttagaagtcgaagcttcacccttattctccttccaaacaccaacctccggcttctttggcaccatcatcttaggccttggctcaccaatgaccacttcctttcccttagtagattcggcttgctccggccgaatcaacaccttcttattattgaaattaattgtatttactggaaaaggatcatgatcaagcttcatcttggagccatcggtgaatttcaatcgtccttcatctatggccgattgaacctgtcgttgaaacacattgcaatcattagtagagtgagaatgagaatcatgccacttacaatatgcccgacgttttaactcttcttgtgatggtatgacatggcctttaggtaatctaatttgtttctcttgtaaaagataatcaaaaatcttatcacacttggccacatcaaaactatacttaacttcactttgccgatctttacgaggagtcggcattaaattagaacaaacaaaaggtttatttttgttggtccatgaccattcggcaacataaatatcatgatcaccctcctcttcactatcactagcatcagagtaatcaactacattaacattaggctttttgttgaatggtctagcaaattttttattatccttaacccggcattcctgagccagagccctttgcataagttgactaacatcaagaaattattggccatctagtttctctctaagaggagcaacaaaaccattaaaagcaagcccggccaaatctctatcagttatattcaaagtataacatcggtttctaacatctctaaatctcttaatataatcaacaacagatttattatatttttgtcgcgtcccaaaacgactctaaaatacatcctctaaattatgcctagaataattaaaatccgtgtgaaagcctccaacaattaaaatgtgcaaagttaaaagtcaaataaggcttggaggatttttgtatatttcctaaaagcctaaaatgcgtaaataaattttactggaattttcagagcacaaataataattattaagaaataaacaaagttaaaatgattttataaaaagaaaaaccctaaaaagtcccctttccctccccctctccctcttgggccggttcggcccagctccctccctctccctcctcctccccgcggcccatccggcctctccctgcgcgcgcgccgctgacgggcgggcccgcccaccaacctcgctgacgggtggggcccacccgtcatccccttcctcctgccgctcccgccgcctcgcccgcgccctagcgccgccgccgccgcgaatcccgccgcctcccgccgtccccgcgcgcaataaagtggggggaattattccccgggatcccatccccctttccccccatttttccctccctctctccctcggattcatttggaaacctctcccctaacctcgccggcgccattaatggcggccaggtctcccgcgcccatttccccctcctccggccgccctctctcactcccaaccctatataaaccctccccgagctccccaccgccgtttccgccactcaccgccctcttcccccgccggaatcgagctcgcgccgtcgctctctctctccgccgtcgccgccgagctccggtccaccgccgtcgtcgccccggaccacctcccacctcggcgccgcctccttcggcttcgccgcatcctcaccgacctcgtccacctctccgtttcggtcgccgaccgccggagcaccgtcgaccccgtccacccgagccgcgccgccgccttcctccgctccggtcgccgtttccatcgtcaccgtcgacccggggtgagccgtggaccgccgcttcgtttccccctttccctcccttccctcggccgccgctccgccgtgcctatggccgccgccggcgaccataggggcgcgggcgcgccacctcccgccggccgcaccgccgaggccgtcttcaggcacgcctagcggctgccgcgtggggcccggccgtcagccgcccgcgccctcgggtgcggctgacgcgtggggcccacggcgccggccggtgtgagccgggtgcacccggtccaccgtgggccgtgagactgccgcgtgggtcccactcccgtggacccggtccgcgcgccccctcccccggctgacgcaataaatccatttttaaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgcttgttatatggagtttattagagtaaaagccttttcttttccgttggtcgtgtagacgctgcagcttcggaagatccgctcttcgtggaagttgaagccgacgtttgggaaagcgagcaaggcaagtcacatcatccttgagcatattgaatcccagtttataaagttattttgatttaaattattgcattgtcgctttacttaaattcccgcattatcactgttttatttagccatgcctacttacctttgttatgaccttattattgctattgttattatttccttgttcaccctagaataaacaaaaccccaactagtggacactctactcatggtaccactagtatgattttaggtagatgcttcgctaattaattaggcaacattaggtggttttacaactctagactttgggaatattcatatcacctggacactatggaatggttggattattgtggaattggattcacacctcccactctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggacgaagtcggcggtcgatggacatctctaggacaaatgaaggctacacgagctgcggcccggtagtcgagatgtcatggcacagtaccggtgtcctgctgctaggggctcagtcctgcctacctgtcccgggggttccggccgtaggtggggttgggtcggtactcttgtctatggctaggatgggttggaaactatgtcatgtcttccgtccatatgccgtggtggtatgtggcacgtggttacacgtgaggaagacgtgtcttatgggtaaagatgtacacctctgatcagagtaaaacctattcgaatagccgcgccctcggttaggggcaagccgagcaatgtacccaagttagcgttttaattcttaaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctaggatcatgtttacaaaataactttgagcaactaagtgtcttttaatgctgtttactgcaaatcctaaccccctatattatggcttccttgtacccccttgcatttattctgcacttgtgggtgtgtcttgttgagtacagtggttgtactcagtcttgctcaatttttcccaaacccagaagaggaggccctggaagatgaaggctttggtgtctagctcgtgcctgtcgtcaagcgcctgtggtcgtcgccctagtcttccgttgtttcccgtttgtctttgtgtgtgctgggccttcgccgcccatgtaataaattaactatttacgcttccgcttgataaactctgaaatgtatcaacttttggtgtaccttgcctcctgggacaaggaataatacacgcacgtaaggaacgcccattgggttaattccggtcgtgacaatttttgcttaaccgatgttaaatcacataacctaagctcagtttctccagtatagaaataatcatgaaattgttcctctaattgagcccaagtatgaattgaatttgccggtaaagaagtaaaccatataaaagcattaccggataaagataaagaaaacaagcgcaatttaaaagtatcactattagcctcaccacattgcgctaaaaattgacctatatgctcccatgtggtcttaccatcctcaccactaaattttgtaaattcgggaactctataatttctagggaacgacacattatcataataatccggatatggttttttgtaaggcctatcacgattcctagtttcgatcccgaatttagtcctcataatatcactaatcatgttctccatgttattaggtccttgtggatttggtggtgggtttggtggcctaataggtttggtttgtggcgcaatatgattatattggccttgactagtatcgggaggatatcctctagaaacatcattgtaggcattagggatatgtgggggaatttgaggactagtggtggcagtagatacagggggatcaaatgttctaaagtggtacgaataactagcattagtcattggatcaattccctgtatcggcacaattgcgccggtctgaccggcccagggcccggtctgaccggcgtcatgttgcatggtcggaccagcctgagggccggtctgaccggtgggataatacccggtcggaccggccatctggccggtcggaccgacggcataatacccggtctgaccggccgtctggccggtctgaccgacggctgtgtcgcggtctgaccggccgtcaggcccgatcgaaccggtcacgaacgccgctccgttggttttggaccctattggatctataggaggttgatcagcagtggtataggctttatcttttaatgtgtaatcatccataaaagagcctagcctactccttaaaaacccatcaactttttccttaaacatcacatctaatctatctttaaaattagccatagatgaatctattgtatttgcaatttgttggtcgatagattgtgatacctcgtcattacttaccacgtcgggagcgagcttaggacgtggcccgggcttgatgatcacgccttgacgagtcctagtagtcaacctcatcaacgcctcccgtgtgagctcggtgatgtattcctggacatctttgcgatcctctccttcaaagtcatctaatgtgaccggtatcacatgagatggctccacctccgtcttagatgatggcttcgtcatggcgaagtcgaagttgagttgacgatgaacggatctcttccccattggagtcgccaaaaatcgtgttggcaacttttttgacaagttgacaagcacgatcgtagcaccttaagccttgcggtgattctaaagtcgccaaccacctcgatctagcaaagagctaaacctagatgggttttgataactaaaccggctagcggagccgatttctagataactacccgtctcgtgggcaaacggaaggttttcaagacaaacctacaaagagatgtcgcactctcgcagcggtagcggacggtttacggcgcaaaccgacaaagatggacaaactaagagaaaactaaaagcaatataaaaagaatgattcgattgattgatagtagattgattttaacaatgaaccagccttgtcccttatataggggttggtcttgccctctacaggcccttctccatgtccaactcggggtaaaaaccaaaggaaacccgaaacatgccttccaaagcaaggaaacctcgaaacccgacgcaacagaatcggactcgggcctgtcggtcagaccggccacataccgccggtctgaccggccttcaaccggcggtctgaccgcccaacacacggcggtcagaccggcctacctcgaaggaaaccggtagacttccaaattttggcaatatttcctattttaagcctaggtgccaaatttgggtgtaaacaaatacttccgtacgtcggttggcaaaaccatccgggcataaaactaggtgccactgccaggttcccaaacttgtaccatacaatcaaatcaattcttgacattgttatactcactggctcactggtagagagaatctttaccaccggttaaaaacccctttattttttttatttttggttgttgcagccgaaactaataaatcgtgactaaacatctcgatctaaaatacatactaaatcaaaaaaaatatatgggatatggattttgaactcaatatctctcaccttagccctcatacgtcctatctactacacacatctaatttagatggagatgctttctttctagctaaagaggtatatttagtaactgttggtgttccaacagtactaaaaatatctttagtacagattagtgttaccaaacagtactaaagatgcattttaaagatgcattttagtatagttagtaacacacaccacaaccaaagatgtttgtaggaacttgacttttataaccgatattaaagtatctctaactgatatatttgtgttttgggccctacggtaaaatatatcgtttctttggtagtgacccagctcttggggatgaaatacccaaaaggttcacgaaaagcatccatttaattacctctttgctaatcagaatgcttagcaaatcattttattaaaatgtttgctacaaagcggtgatggtttttttccggggatgtttttttttcctgtcaaccaaaaagtacttatgaaaaaattgaaaatataaattatatgcgtgggtgatatatcactttacaaatgcacgtcttttccttaaaatcacactagattaaatcaaacatattacaagcaaatgaagaagaaaattttaactgtaaatagtacaagtattagcaagagtaatttatttttttcttcgatctatggatcaaatttaacttgcatgtttgtatagtaatatatctatattaatgagaaaattaacaccatttcactcttctaaattatttcattgaagtacttagcccataaactagtttttagctcattctacaccctaaactattgaaaatgttttacatactttacacacagatgctatttcttttttttctttctatataagtcataatttacactcaacttttggtaggacgatagatgcattacaaagtacctctcgacttatttttagaattattctcactatttacataggttggaggcagatgttaaattctggattgaaattttagttctgtgttggcccacctggcagaatattctttccagcattttttttcaggtcagaagaaaacaatgtttaaattcttaaaatttatgtccgagactggagttctgtttccgccattacgcgtaatattaaggccctctttggcacaactctgaatccaaaatttctcggagctggatattcctaggttcacaaattcatggatctagatctatgattacattgataacatttagataaagtttttgtgcatattgcagatgaaacttaaatttttaaagcaactgtaattgaatgtataaacttcaagtctattatgggtctaaaatctggagtagtcccaaacaggacctaaatccctgtgaaattaatatgctgtaatttgaaatgttgtaagctaaaacatgaactcaagaacactcattccatatgattttgagaagagagatttcttcaaggaaattagttaactactaattaactagattcacttggagattgtggaataggagagttttaggaaatacagctgtgtcagaagcaactgggatcccacatattcccgcatatgatagtgatcctcatgtggtgatataatatatagttgtacaaacaattgatatttatagatcagtgcgttacttttagtccctttagtttgtttctattaggtggctagcaaaagcacagtgcatacctattactagcttagaatagcgcaaatgatttaaaatgttgatcatcatgctagcatgcactccagcatattagccttttggtgaatgaaattgtagaagcgcatgcaataacataacgatcggcagtatatttgccggaaatgttaaaaccgaaacctagctattgtgcgttttccacccaaaacgcgcatccatggcacaccatcggctagaaccggtacctttgttgagagatagggtccgctttaaataaaaaccgttacctataatatgttttaggtcctggtttttcaagaaccgataactatatttatattgtaggtttgtttttataaaaaaaatggcacttgttaagaaaaccgacagactgagtagaataagccgaatcacgacttgtttccacctatatctctcccttttgatcgcccctcactcactctttttattacccccctctctcccccttatcctctccgcctcctccctatccctctctctccaccgcaccacccggcggtagcgccctcccctcccctctcattgcttgtgttgttgatgttcttgtgttattagtgttcttgcattttcttggattaaatgtaattaaaagtgtaatcagatctggttggggtgaaggggacttattcgatgcatgcatcgagccggtctcttttttttttcattcctaggaccttaaaccggcacatttgagagaactcaaaaaggttcctgttgccaaattcggcacccatatgtggttggcaaccgacacatatccttttctgtagtagtgcctataaatccttgatggggtaccagcattgttaattaaacacacaattattcaagtggtgtacatcttgtttactgctgtccaagcactggtagcttgaaactgatatccaagcttgataagggtaccattcagacgtatagttcacgagtgacgattaaccaggaaatcaatctaacgccataaaattcagactcgaaggggtaggtaagtctcgtacgcgtgggtttacgtaattagttcatttagctttgagtactctgcatctcttgattgggtaggaaagtcttgattgtttaggttaatctctagagggctgctacaaaacgggatcccattgtaatggaatagacatattaactattctcttgcacgagtatcacaggtatcaggtcctatatatcacaaaggattccttgtggctcccgcagctattgtgactaattttccctaaactcaagaggcatctttaacctgggagaaggccaatataatgttatgtttggcatatcactcataaatattaagattatcatccctgttagtgtcaggggagaattttgagaagtttgtcaagactaatgcttagtacaaatttagtgcctatgcacatttgccgccataatttaaaaggtagcacaaaaaaattgcgtggcgtgcaaacatagtgggatggacatcacacatttcatatgcgccacttgtccatttcatatgattcttctcccattaggctacggtcattttcagagttgtaatactaagacaaagtggaccataattgacttggttcatcattccacaaatcaataagaaatatagaagactaagaggcaaactatgtaagatcctattaatcttgtcatttgatggaaaagatgaagctttactaaggggttgtagcaactccaaatttaataataataaagctcactttcctctcaaggggaaataaaattgcctctatgtcctatgtatgctactcttgaaattttcttctgtaagttctttgcaagcaatagggacatgcttaatgtcctgatttaagaaagtagttaaataagaagattaatggcattattttgggttgaatcattatgagacattgtcgaaattatggcattatttttcggccacatttctaggggagaatatacgtctcattaaggtcgagacacttcacccttagaaatttctgacatctattattacttagataaagctaaagtaaatcaagtgattcaagttcataaggtattatgcttccattacataaataataaaataagtgggagctcatcaagagctctaataagagaagattattctacctcatttatgactcatagctccattatgtggatgttataattttgtgacttgcacaattaaatatacataacatagcttgagggttttgttatggaaagacaagtcacatatggggtgcatacttaagaaatccatttgtggacttaatcaagcattgatgatgttttaaattctgctgcatcattagtgaactaagcttaaataagaatgaggacaataattattctataatgatggaagtaagacgtcattgaaattgtgtcattgtcgcttatgtcacatacctaggggagtttggaacgtctaatgagatagagatattctttcccttagattttaatggcattgtttagctttaagtgaaaatttcactaagttaagaaattagccaacaaatgattatttatggctatgtttacccataagcgacctccgatttcctttaagaaatgtaagacactaatgctaaaatcaaatgaagttatgagatctgattatggtggtaaacactaaataaagcttgttcaccttataagacattaaaaataagcattcatccaaatggttttccaaccatctaagaataaattgagatggatgaacaaaataagacattaaagtgttcatctaaatggtttttgaaccatacaagaataattgagattgatgaacaaaataaagaattttgtagaagtttctgaatgagtcaaaatactgggccatttaagtgggttaataaaattaagcctgactctaatggaaatttcgaacaattcaagtgaggtggacaagtgcatgaaaattaaaggtgggaatttcattcaccggtactctatactaatgacattttattgtcaagcaatgcatattgctgttagaaaccgacaaaatttttccctgagttattttggtctgaaggagtactggcttatatcaataagtcatatattgacataaagaaataatttgagagaatttagttatagttagtcaagctaaaattaaattataaagataatcatttatgattcagcagagagaagcttgagattagctcaaatctggatgcatacagatttggcatatatttttactgggaatcttggcagtatttaattaaatccagactagaccactggtattaagaatgttttgcattatttgcatgacaat

SEQ ID NO: 60346 - DNA, 13587 bp, Oryza sativa
ctaacactttgatatagttgtgaaagatatgtcctgggatcgaattattattaagctaagcttttgctcatggatccatactttaaaggctcataaagttaagattaattaagatatgttctggccaatacatgtataaataagagcctaactaagatcctagatgagggggacttaattttcaatcaacacccactaagttaagcttgagtttatttggatactatagtgaactgtatgtcttgttgtctcggtgacgcataatgttgttgaaaacacatcgcttggggagctattttatttgataaactcgtcagctagtctcaaaatcaaggggagaatgttggttaattttatcggctaatgccggttagttaggataaggataaaatcccaccgattttcctatcctaacaagaaataaactaagagataaatctgttttgtgtgatcggtacaaaatagattcgaattttagattgagaaaacccccgagccccaccagtgtcgcttatataaagaaagagaaggagggaggctgagtgactacttaactctctccaagcataaaccctaattcaatcgtccgatcgattagacactagaaggggttcgtgaggtatctcagtacagaagaaacaaagaagaagaaagaagagaagcaatggcttcatctcacgtcagttagatcaattaatttccgcataagcagaagatgaccatgtttaggctaagattcaattaattagttggattaaagctagggccaccatcatgccgtgcaatcaccgccgctagcttcgccaccgcgggagctacctcggccaccacttcgccctcatagaccgacagccaaatcattacctccaccgcgaaattcaatcgccgtctcttccactgtctctagctgctccccgacggcgaggcaaggctcgtccggtcgtgcttccaccgccaacggctttgccgcgctgtgcagcacctcggccgcctcctcgccttcgacatccatcgccggagtccgcttttgccgccgcctcgtgcctctccttcctcgtctaatccctccattctctttattagatcgagggcaagcccgtccgcctcttccagggcgccgcccatcaccggagcgctgctgccttccttcgccctgagctctgccagccacctccctccatctccgtgcccctcggtgagcacccatctcctttttctcggttccttccgccgctccccgtgccgccactcacagccggtgttgccgccggtggtcgtcaggctggcgccgccaccgcccagtcgggttggctagcgagccaacccacccttccgccgtgcaccgccactgtggactcggtccacggtcgactagcacctttggctccgctgactagtggggcctgccctttgtggatgtggtccacacctctccccttgctgacatcagcaatcggcttttccctttgtaaaataattattaattgcgtcataaatcgataataattccagaaatccatttaaatggctcaaaatttctaaaattcatatatagttcatatgaataacgaattgagccattcaacttgcaaaattcatctaaaattgatccctgttgacggtcgttatagaccaatttcgaccgctaatataactaaaataatagagaattggttatgctcataatgcatattttgttttgaaataatttagttccacttgtacttggagaataatttgttgcatgtactgagcaaataaaatgagaagaaatgaggaaaactcactcctaagcaagcatatggataagatgggcccacatgataggtgtaaccgtcctgaaaactgcatcaactaccataaccatcatgaggacccacctgtcagccactctactgtacttgggggcctgctgggccgacccaggttcggccgaacccctggcagctgtggctccggctggccctacacatggtcatccaggatcacttgccaatgacggttcaggggcagaaaggacattttgccttctccataaccgtcataccgaccctataaaaggaggagctcacttcacttctcaacacagtcaagcaagctcaagatttctctctacactttatttagtagtttttgtgctaactaaagtagaatagaatagttttcggagtcctcggagtcttcgaaagagttcgggtatggctctagtatcttttctatcggcttttgtaagacttccagcattaatgaaatattcttctttatatactttcggtactttgtttagtctgagtatcggctttactttacatttgtgtcgtattaattgtatggttagcttcccagagtggtatttattaatgtaaacgaggtacttagattaataagtatcattatctgggcatatatgctacggatctgtagaggtgggccgctgatgatgatagctcagtacaggtcttcctccacgatagtatatattcctaagacaaattcctccgtatttagccccggttggacggccatgacaggttgtcgtaaggaattcggcaacccagggtggtctctcgaaacaccaggagggcactattaggggatattggccacatgattgtatactagcaattgtagactaaagattgagtgtatattagaagtataggaattgagttcttttctatttctccttctacttagtttaggatcattattagagggaatctaaaagcgactacttagtttaggatcattattagagggaatctaaaagcttcgcttcgtgtcactctacccatatgctgaattaacccctactaggctttgatgaaggcaagtaatatatatgtatataatcattagcatggttctctctttcaatatcttcccttagaattaaataaatacgataccctggaatactcccgggtgaaatgctataatggtatatccgtatgcttgtggattttttctgtaaccaaccaggactaaagatctatttttgtcccggttgtttaacaaccaggaagaaaaacgtccacccacacgcgcgcaccaagtctccggcgcttctctctgcatcctgtgcatgcacagcccctctctctctccatctcccatccttatcaatttttcttctcctcccttatctccatcctgtgcatgcatcctctccatccttctccttccatactccccttgctcttctctcaccctctctccagctcccctcccctcccctccctctctccctcctcccctccactccctctccccctccacccctcccctcccctccggcaggccgcgacagaagcagaggcggccggcggcgggatggaggctgagtgtgggccggtggcagccgggcgcgagccaacggtagggaggccggccggcgggatgcaggaagagcgcgggccggcaacggccgggcgagggccagtgggatggaggccggccggcggtggcccggcgcgggccggaggcctcgccctcccctccccagatccggacggagaagaagctgcgggatgggggtgatttgatttttttgagtttttttatctttttttttatgatttgtggatgttgtgatttgtgaatgttttgaatgaatatgtgaatcgatattgtgaatgaatctgcgatgttgtgaatgagtctgtgaatcgttgttgtgaatgaatctgtgaatcaatattgtgaacgtatttgtgatgttgtgaatgaatctatgaatggatattgtgaatgaatttgtgatgtatttgtgatgaatctgtgaatcgtctgtgaatgaaaagatatgaaaggaggaaaaataaaagaaaaagccgaaggagaaaaaaaaattagtcctcccggttggtaacactaaccgggactaaagatgcaaccgtcttttgtcccggttggtgttaccaaccgggactaaggatccatctttagtaccgcttatttcaagcgggactaaagatgggcatctttagtcccggattcctcctcccggttggaaacttaggagtaaaggggttaccaactgggagtacaaatggtttctccaccagtgtgtaagtattttacgatttatttacatttggatctgtatattaatttatcattttgtaccctagctgattcctagacagggatttaatacacaaaatagtctgaaaatttaggctaaatttctggacgtaacatgaaaatagccaaattggcctcactagtcagacctcttagaaacctgtagcctgaccgaagttcattgtccacttttaccatctaaacacgtgcggtgagaccgtcttttgcctgaatgttctgaaccacttctatatttaatctaaatttgacctattgtcaaatttggatgtcagcccatacaaattgcattccttagatttgaactttgaaataaccaatggttgatagttgacagtgtctcgagatcgatttttactgtagtgcacgaatcttggtgtattcctagccatttaaaagtcaatatgtgtacattttcatgtagctgaaaactagacaatcccacagctggaaaatattttgtcagccagacgatgctcggcaggtgatgttggaagcgcgatgccgccaaaacaaggtgaggaagaagacgagagtacctacagaacagagctcaaattgaatgataaggaactcgataacacatcgggtgtaaattaaacagcatttgccatccagctgaaaccactacaagaaaacataatgttttcggcggccatacgatttcttcggtcaaaaatgggctgccaatattagtctttaaccctcgtttcctgattaagtgattatacccctatatatactcccttcggactgataatattagtcgttttgaataagggtaaagtcaaactttaaaatctttaactataaataatttttaaaatatttatcttgcaaatatgaaaactatatgtatagattagtcttaaaaagtacttcaataaaatcacatatttattgatatttcaatataaattataatagaaaatagttgtaaaagttatttttggagaccgtgctcttgtccaaaacgaaaagtattatcaacgaaaagtattatcaacccggagggagtacatctaaaactaaataataagatctggcctagacaagcatatatatttccatccatacacataaaatatcatactaatattcatttgtagtaaattcatgcgaatcaaattagcgaagtcgacggaggacgacgacgaccctaacgtatgtaatattatagtgaactttagtttcttgcattatatattatcaacaacaacaaaattagcatcacgaaaatactttcctatatgaatcaaatgatttgacaggcataatattaaataatacaatttacaagtatccacttttttaaaaataaaatgttctgttttattttggggcggagcgggggtatattgacggagatagtaacgcatgaaattgagaaaacgacggcagataaaccaagtctttggcggctgacggagatagtacctcgtgacttgctcaatgtgcctgcatgtgacggcagcgggtaaatgttgttaactaataacatgcgccaaaagctagtttcgttcaactatatatggcaacttttctgttaaatttccaaggatcccagatcgaagtcggcccaatcagctggcaacttcaagaatacatgaaaaagaaatgttgatttggcagagtgccaccaaatgtagtttcgttcaactatatatggctacttttcgctgaaaaattaaatgtccatactaattaaagctgctaatattgaatttcttcttcctcagatatatatatttcacatctatagcttgcgattatcgaagtctaagtaatgtaattgttcacgtttaaaactttgctaattacttgttttaattaactaacctttgcatccattcgaaatttcattaatcttacagaaacttttgtcccgggctcccggcacggtaattccttgtgcatacattgataacgctgcaaatacaaagtgagttacactggaaaacaaaatatcgagatggagtcctaaacaatttgctgcagttaaaaatacactagtacgaaatacgaaatatgatacgccagcatgttagtaggaaaagaactcttcaggctttttctttttgccatccctgtgatcaatgcgaaatacgccagcatgttcattgaggatccagaggatggttgtgagctcgccgccacaggcgagctgcttggcatgggaatcccttgtgcatcggaccgacgcaaacatcagaagacgcacccatgccatgaagatatgttccagcatttccgacatagagaagtcctccttgtcccattttttcagttcaggaatcaactgcttaagtcttttatacctatcgaagccaggggattcggagctgaaggttttgggcgtcgtaatgttggacttttctcctgggattttcattacccgacttagcagcgccaaggcgaagctagttccgtcagagagaattatattctggtcgaaaagagcacttgcgagttctggcctcgacttgtgggtactatatcctggcctccagttgctgatattcatcggcctcatgggtttgggctgtttctccttgtctattaggagttgggcgagattcttctttccttccacgctgttattaacagaagattgtaattggttgcccttaatttcgttcagtgctttgagggcaccttcgtacaggctgcgtagcttaaggcctggtagcatgcttgggcgcaccacgacgaggaacaccatgtaattcgacagtgccttgatcgcccgtacatgccgcaacgatgatgcatattcaccactgatcaagaggaagatgtctgtggtgatgtgcaagataaggatggtctcttggaatgcaggtgcaaagtccagagcctcttctagttcccgatgcattgctgcttgcggttccgccaacaccgccgctacttgttctggtaattccaatgcgggcaccatgggcggctgcttgtcaggaataataggcgggtacgctgacttgagacattcccatatactttcgaacataaggttcctaacatctgatgactgatagcataacatatgaaagcccaacgagttgtggtatctgtactccatccaacggtcatccagtgaaactaattccaacactgatttccacatcttcaacttccatgttatgtcacgagtgcactcgtcaaacaagttgtattgcccaatgattcctagccacctcctatagctagttgttggatgatccttggaaaagaacctcgacggatccagggagacgatggaacggcgaatcatgcgccatttccctgagcacagaagggaatggtgaagccaggagcgtggcctatcatgcaagaaggaataggtccatgtcgaggccactgctctgaggagccatttgatatccaggatgacgatgccacccagtacgatataggtgatcaaaacgtcaggctgctgcagaccttccttgctctgagaccaaaacagcaagaacattgcagatgtgatgaaatgggaggagaaacggatggcatagccaccccatgtgtggaccatggctgccttggtgtacaagatgtcatacatgagggagagctccatgtccaccacatcgtacaacatctcattctcattccaggtttcagggcggacaatctcttgtttgtcgacatcatgctcgtaagccatattgtcgatgaaggcgcccttggtgatatggagcatgtcatgagccgccagcaggatttgctcgttattgtccatcttcctgcggcctatacgccttaagtttcggatgctattgcttagttttattggcttcttctgctcggcctccttttggcttgaacttcgcatcttctctagcttggcgcgccgcagagcgaatgctctctccccatacttgacaatgcccatgatgaacatgactgatgaggacacccggacaatcgtgccgccgctactgaagaatacattcttgtacagtatatagattgttcccaacacctgcatgaaaaaccctatcatgtcgcgccatgataggatgttgtcttccaaggagtaggaggtgatgttgtccggaccaccagcatggaacatcagcaatgcggcccagatcgtcaccagctgcaccgactgggacgacggtgtgctgccgccgatggaggacagcttgccaagcgcgaacgtcggggcccaattagccaactggtacgccagccacaggaccaacgtctccatgcctgtggctttacggcggcgaacatcggcgaggaagacgaggaggagttgtgccacgaagctggagagtattgccaaccggatcatccacgcattccagaagagctgcaagccaatcatccatccaggcatcgccgaccctgctatagtgaatgggtacatgttagtccacaaggacaaaagattaacgcaaattacatgttaagagatcaaggacaacaactgatccaggatatataaaactgaatgaatatccgttacacctcccagtataatcactgatcaactacgcacctgattgatatcccagtcaagcttggaagctacaaactgctatgatagcagggagttataacaagacgtagaacttgcgcccatctaggatttatgcctctgttgcatgcgctctacatttctatattattagcccaaaggtttaatgcatgtcacagtggatgccagcgtgatcaaaccttttcaatcatccgccttattctaagttacaaggagcgcactgcatgcatgtgcttttgtagccatgtaatagaaacaaactatgggaattaagtaaaggtaacgtacactcatctataattgttttgtacaactatatctgagcaccacatgagcatcactaccattccagggacatgcactctacatttctatattattagcccaaaggtttaatgcatgtcacagtgatcaaaccttttcaatcatccgccttattctaagttacaagcatatactagctaggtacgcactgcatgcatgtgcttttgtagccatgtaatagaaacaaactatgggaattaattaaaggtaacgcactctcatatataattgttttgtacaactatatctgagcaccacatgagcatcactaccattccagggaatgggatagatccccagttgcttctgctacatctggatttgctaaaagtgctatagctcttccacatgctccaaattaatgaccagttggttttgccacagctggatttactaaaagtgctatggctcttccacatgctccaaatgaatgtaggtagttactccctccattttaggctataaaaagttttgcctttggttaaagtcaaactgtttcaagttgattaagtttatatacaaatatagtaatatttataatactaaattagtttcatcaaatcaataattgaatatattttcataataaatttgtcttaggttgaaaattttactacttttttctacaagcttgatcaaacttaaagtagtttgactttgaccaaaatcaaaacgtcttataacctaaaacagagggagtaatttccattgaaagatgccatcttcataagatgacactacaccatgtcctaaaagcaccaacagaacatctgtcggcagaggccagctttcacgtcatcttatctgtcggaaaagacctttaccgatagaaagagtgtgtccctgagtagcctgtcgttaatggaatccaccgacagacagtatgacctagatatgttagctttcccgacagacctatctatagtgagatacaacaaacagtcagacaacaatatcaatcattgcagtataattagtattttgattatttgatagcatgggcgagaaccatttgtgtacttttgtcatccccaaataactctagaaccggatgtccatcaacctgcgccccatccggtgtccactccgcctagctgccttcgcctggccgcaactccgcaccaatctgtgcggatgcaccccaccgtgcctctctgccctcgaaaggccaccgaacgccagataggagatgaggaggaggtcgccgacgagctgctgtctaacggcgcgtggaagaaagctagtgaggcggcggcggcttgaagaatcaagaggagctaggctggatctagggtccaggtgacgagcagttatataccaacagatagtgggttggaaggtctttccaacagacagtttgacacgagattaacaatcagcgacagaaagtttgcccctagaaaaccatagagttcccgacagatggtatgtcacaagcttttaccgacagacagaaggttagatgttgattctctatttttacccacacacatctgtgggcaattctttgacatggtgtagtgtgataatagcaaagaaaatacaagtataagaaaatattgttcttgatttcatatacattgttttattaattatatcgtagcattttaagttatgccatcttaattgacaccaggctgtattcagtattgaaaaaaaaattgaaaacattacaagggggtcaagaaatagaactgaattttccacgcacaaaaaaaaagaaatctgaacatattttactccctccattccaaaatataaggcacaaccacccttaacccaaagaccaagaaataattattatcatcttgtagtttgtactaaatataatgcatgcatactaatattcatttgtagtaaattcatgcgaatcaaattagcgaagtcgactgaggacgacgacgaccctaacgtatgtagtgaagtcataatttatattatttgggttaacctgccctccgtcaaagggaagtccactagatgattcgtcttcttttgcttttatagttgtgtgtagataagtactagcctataactaaggggatgcctaacgtacaattattgtctgacaagttgggataaagaaatgagtaagcatgcccgtaattgaataattaaagctagctttcgtattaaatttattagtgatctccatgaaaccaccactggtggagaaatcgtttgtagtcccggttcgtaacccccctttatatatatatatatatatatatatatgcatgtatatagaatacatatatatatatgcgtatgtatatatgtataaatacatatattacacacatatttataatttaaagcacttaacattttaacattttatgtacatatatgttaccaaaatatatattaacactaaagtaaatgtacgtacatatataaatatatatatatatatatacatgcatgtatagtacaatccatttgctcgctagctatagctacgacttcgtcgcctgcgttacgtcagaagaggaaggaccgacgttacaaattgtcgatccgtcgtagtagaattcaccatcgggattaaggacttcttcgttgatgaaccccatcagttgttcttgaacagccgtgataaaatccttgtgtgggagtttttccctcatgtgaatacgctatcattcgaaaaataatgacatatcaatatatgaaattaataaacaacttaacaaatcaatacgcaatgaaattttgaatggtttatgtatacatacatcgagctctcgtttggtgtatatttggtttgataggcagtgggcatactcgcgtacgtagtagcgcataagttagttcccttgtcctgctttgcacactacatgagaaacgatgagagatttaatatactctttatattaactgtaactagagattcaattcaatataattttggatcatgcatgtactcactggaaaatgaaacctctgtccaagtttttctttccaagtcccgcggaccaattgacggaactgatcccaagccctacatgtgcagttgcaagctatgattaattaaatattacccaacatcaacataatagcaacagagtcccgcgactttggaatagatggcattatattacctgtctatcagttggaagaccttgtcaaaaaccttctcctctttattcattgagtcgtacacagtgactctgcatgcggccaagtcaaaaaagaacaggacccagtggaaactggaatatgcgtgagataagataaatatcagaatgtatatgttatatgtatgggaatgaaatttgttcgaacgacaataaaaattcactctgtgttgtacggcaatagtatgaacgtcttgtaatgctgctgtgttaggagatggacgagattgtcctctgtatctttctcgtacttgtcgagcatttcggtgttgattttccgagggtcgatgaacccagtatcgtaaaccccccgccgtcgggccctttgaatctccattctacaacaatgaaaggaaattattattgcttacatatatgccaggagctaattatttgtaacaccctaaaattcgaccaataaaaattaaattctaaaaatgcggaccttcgaaaactttataaataaattgcatcatgccgattttgttcaatgattttattggattttgatctcggagttcatcgattacaaatagaggaaaaattaattaggaattaaccctgaaattaggttggttaaagaaataaataaattataatttaaaataaagattaggtgtggattgaaataaataaaatattaccacgaccatatttgtatcaattaaatttaaatgcgatggaataagaattaaccctaattaaaaattcaaataaattatataaataaaatatgggtaatattagtctagggtgaattcattagttaagataacacaaatattgagtaaaatccatatatgcaaaaaattaggaatggtggaatcaaatttataaaagaaatagactaaaatgagaaaaataggaaaatgcactgttcatttcactctaggtgctcgacgtggtccccctaacccagccccctcctctgccgtcgtcatcaccgtcgccgtcacgccgcgtaccgtcgtgtccccgtgcatcgcatttcctagccctagcccctcctctgccaagctgcctcgcgccccgcgcgccgcgcgctgcctcgcctcccctctgccgtcgccgacgcgtcttgccgccaccgctgcgccgcgcaccatcgccatcgccgctgccgcgccacgccgccgtcgcatcgcctcgcgccgcgcgctcaccgccccgcgccccgtgccctgtcacgcgtcgccgtgccgctgtcccgtcgccgtcgtgtcgccgtcccgcgcctcgcgccgcgagccgccgcgcgccgtcgctgcctgtcgcgtcgccgttgtcaccgtcgccgtcgacgtcccgtcgccacgcgcgcgtcccatcgccgccacgtgccccgcgccccgccacgccgctctcccgccgcgtcgccgcccgtcgcgtcgccgctgtcgccgtcgacgtccagtcgccgcgcgcgcgtcccatcgccgcctcgcgccacgcgccgccgtgccgccgtcgcgtccccgccacatctctcttccctctcccctt

SEQ ID NO: 60347 - DNA, 6453 bp, Oryza sativa
ccgtcgttgtgccgccgcgccgccgccgcaaagccaatgcgccgtgccgcgacttgcgctgccgtcgccatcgtcgccgccgccgccgctggtgagccgtcttcacccccctctcgcgtccaccgccgtcaccgcccgggtgagcaagagccgggagagagagagagatagaaagaagccgagagggaggagagaaagagaaaagaaaggaaagggagaaaaagaatagaaaggaaaaagagaaaaagaaaagaaaagaaaagaggaaaaaaaacaaaagaaagaaaaggaaaaataaaaaaaaaggaatttgaaggaggttaaggaagtttagaaaatttaaataaatagaatttaattatagattaattatagtcgtagaattgcaaaacttaatatagttatagattatatttggtaatctctataagtaatcaattcacggtagaaattcggatttaattactagtaattttagccgtgtattatatttagtcgtttagtcatagactaaattaaatcgtacaatattatataattcgaggatttcgtccgatacttagccgcgatagaaatttttaacctattacatgcatataatattcgggttgattaaattaaagacttgtgctaataaaatatttatacccacgaaatagtttaggatggataaattaagatcagattagctctattccacaaacaaaaatagataatgtaagaaaccgacttccgcactcgatgtcttcttgaatttacttggatctttatttgaattctaaccggattcaaatcgtttcctcgcacgtaattttagagcccgagggagttgcggatccgagcaaggatcaagacccgcaggactacgagcaaggcaagtcatcattattccttgaacatgttgatcccaattgcgaaattgttttgcttacaaataaaattgcatgcaatgatgaacatcctacttgcgattatgccatgccttgattattgtttaccccttattccttcgtaaacatgtttacgtatgagtccctagtcaactatgacaaatgcttagaaatgctattctagaatcatgcatactcatatttatcaaatgctatatgcttgggcaattgcctttgggaaggtaattgagatgcggcatgtggagacatgagcaccacattgccatgatattgatgacatgatttgcgaaaggagaaataaaactaaacaactgttttcgactggggcggacggaggatttgggtggtatatggaaaaggctagtaccgtccccggtcaattaagcaccgagccatgaagttaagcatgaaacgacccccgcacaaccgcacttctcgtatgggtatagacctagcggagtagatagccgagcggaggcagtatccctgcatagatggttcacccctaagcgaggcaggtgcgctatggtgggacagccgttgaggtagggccgagaggcgtgccctacatcagtgtcgccattgtttggactgccatgagtgtgtgtgagagagaacttaacttgaaccataatttaatatgtgtgtgagacttctctttcctgggagagccagaactcctctcactgctagaaacatggaggcctagagtgcgtgaggatttaggttcatggagcgggtactgccaatgcaaggttatcgaaaagctttgccgtgacgagtctcatgtgttgggacgaggctcatgtgttgggcagtcgcggagtgcaggtaaagtgtacatccactgcagtgtgagtaaaccaaatctattcgaatagccgtgctcgcggttattgagcaccgggacatgtattacacttggctagactctaaattcttaacttgtatgggatgggatattgcataatgatttctatactgatggaggcacttcctgagaggcgggaaggtggacgtcctcagaaaactatgacgattcaatggcgggaagctatccttgggatcacaatggatggtggacagaaccgtcgttgtctaatgcgaacactagtattaaaatttgatcaatgcatgctaggtcttaggcttgtgaaaagaattacaaaacttgctttgtgcaaaagaaccatagccattccttgaataccctttatcatgtgcattgttgctgtggtggcttgctgggtacggttgatactcacccttgcaacatacaaacttaatcagaggtcggagatgaagcttcagaggacccctacgcttactaccaggagggtgatgaagacgatggcactcagtaggtcttagttacggtcgttgcctgtggcaatggcgtgccgctgccttaactccgctgccctatctacttctgtttttgggatgtattccagactgctcggtccgatgatttaaaactatgcctgcgggcttatgatgtaataattcgtactagacactcgtgtatgtgtatttggtatttcagctatgaattcgtgtgtaccagactacttgatccagcgaaatggtactgtttacatgattgattcctgttataaaaacgggggtccacattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctgatcttcgctccgaacatctctctaccattggcgcttatttctatgtaccattcatggaatttgtacatttgtgtcggtagggactgcagctgctcaggcctgacaagcggtttaccgagttcaaacttgtatgccacttccgccttcgggattggtgcacctccaaccaactgagccatggttagaccggtgtccgaaatgaaatccgttatgccaaagtcttcgccggtcaccaacggctcgaccacttggtgtggttgttctccaagctgaggaactggtttggatttcctgtaataggctttcctaagtgttcggtcatagtccgattgctttaaggcctccttgtttgcggtggacattcccttgaagaaattcttcacgctcgggtcgataggtatcttcttttcaggactccgaggcttgagttgcctcttcacttctcctgccacataagcgtcaagctcctcttgactgcaaccgtacggcggctccttgtttttggtggtgtcaactttggccttcttcgttgcccttgtgctggcaggaggtggagcttggcgagaccttgtcttgggaggtgcaggcggacacggtggaggaggaggcggaggagccggaggagatggtgcaggaggaggtggcggaggagccagaggagatggtgcaggaggagatgtctaccgtcattattgctttccttccgagagtcccctttccctgtagtctcccttcatggcgtgattcaggtaccccgattgggcgaaggtcttcaataaattctacgtagaattcaatgacctcctctgttccataccccttggcgatgcttgcctctggacgagcacggttacgaacatacttcttcagaacgcccatgtacctctcgaaaggaaacatgttgtgtaggaacacaggcccgagaataccgatctcgttcactaggtgacaaagcagatgcgtcattatattgaaaaatgaaggtggaaatatcaactcaaagctgacaagacattgcaccacatcattctgaagggcttctaacctatccggatcgatgaccttctgcgaaattgcgttcatgaaagaacatagcttttttattgttgcccggacattgtctgggaggataccccttattataactggtagcagctgtgtcatcaacacgtgatagtcatgagactttaggtttgtgaatttcttctccttcatccttattattcgctttatattcgtggagtatccagacggtaccttgatgccctccaagcattgaaacatactttccttctctgccttgccaagagtgtagctggctggactcaagtaatggcttcctttctcctctggttccgggtgaaggtcgccgcgttgttccatatgcttcagattattacgtgcttccagtgtatctttcgactttccatatacacctaggaagccaagaaggtttacgcaaaggttcttagtgaggtgcatcacgtcgattgcgtggcggatgtccaagaattcccagttgggtaactcccaaaatatggagttttttttccacatcgccgcgtgaccatcttcgctttctataggctggctgccaggcccctttccaaacactactttaagatctttaaccatagcaaacactgttttcccgctgcgatgtttaggcttcgtacggtggtccaccgtatgttcaaaatgcttgcctttcttctgtaccgggtggtttgctgcaaggaattgacgatgacccatgtacacaaccttcctacagtgcataagatacgtacttgctgtttcatccatacagtgcgtgcaagctttgtaccccttgttggactgcccggataggttgctaagtgcaggccaatcgttgatggttacgaacagcaacgctcgtaggttaaacttctactgtttgtcctcgtcccacatggggacacattccgtcttccacaacaatttaaaatcttcgaccagtggtcttaggtacacatcgatgttgttaccaggttgcttggggccttgaataataatcggcatcattatgtacttcctcttcatgcatagccaaggggggaggttgtagatacacatcgtaacaggccaagtgctatggccgctgcttatctctccaaaaggattcatgccatccgtacttaaaccaaaccgtatgtttcgtgcgtcctttccaaagtctttaaattttctatcgatgtttcgccactacgaaccatctgcggggtgtctcagcatcccgtcctgttgacgttcttcagcgtgccaacgcatcattctagcattccccttattcctgaacaaacgccttagccgtggtattatagggaaataccacatcaccttagcaggaattctcttcttcgttagctgcccgtcaacctcacctggatcatctcctctaatcttgtatcgtagtgctttacaaacagggcatgcttctaggctatcgtactcctcaccgtgatataggatgcaatcatttggacatgcgtgaatcttctgaacttccagtcctagagggcagactatcttcttagcctcgtacgttgtctcgggcaatttgtttccctccggaagaatgttcttgacgagtttcaataaatcgccaatgccttgtcactaataccattttttgccttccattgcaagaactccagagtggtatccaacttgttgtgcccctgctcgcaacctgggtacaatgacgttctgtggtcctctaacatcttgtccaatttatgggcccccttttcactttcgcagtcctttttgttatcttgcaacatctgaccaagatcatccgcaacgtcgttataatcagcatctatgtcctcctcgcctgtttgatttccttcaaatccagcgtactgagcaaagtctggaatattgtcgtcttccacttcatcttcttccatttcaaccccttgctctccgtgggatgtccaacaattatagcttggcatgaaccccgactcaaacaagtgaaaatgaatagtcctggatgcagaatactccttctgattcttacacttattgcatggacaacaaataagacccttctgcttgttagcttcggccactcttaaaaaaataatgcacgccgtcaataaactctttggaccaccggtcagcgtacatctattgccgatccatctacatgaaatgaaaaaaaatcgtacacaaataatcattcgtacaataatgacagtcatacaataatgataaaataatcacaaactctttcaataatcatacaataatgacatatcattattcatacaaaaattataaaatattccaccaaataattcttatttattattttttaagttttaaattcttttaattttcaatttagtttgatttcttttatttaaaattaactttcactatattttcctactcaactattttataaaaccttatttagcaaataaacaaaatttgtatatattctttcttttccacacaaattttctctctcatcaacttacaacaaaattttggaggcaaaaaagtgtgcaaaacatagctccaaatgtaatatgaccaaaaaaaacattggaggataaagttgctaaccttttaggcacctccgatttgtatataatcaccaaagtaaattcactataaattttggcatgacctcccctcttttttgaagaaattttgaagcttgctcgggctggaggaggaagaagatatatataaaggggtgggactttagtcccggttg

SEQ ID NO: 60348 - DNA, 1920 bp, Oryza sativa
aaaaaccaacatactgctagatgtgatacattctaatacaacgaatctagatatacatatgtccagatttgttgtattagaatatatcacatctagttctagatttattttttttgacggatggagtaatgtaaaagaaaaataactgatccaatcaaatagatgtgtccaatctcggggtttttaactatttaccactcttacggagtggcatactgagatgccactcttccaaattttgttacacaaacactacatgagagaggtattttcctaattaaagtgccatatcagccagagagacttaaaataacctttttacccctagtttaagaaatatgagaaattatatacaaacatatataagaaaatattatttaggagtatatcttaaaaaaaagagttatcatgggcaaatataggtcgaacaagttcaccataatttataatagattcaacatagggtgaacttgtttaatatatatttgtccgtgataactctttttgagatataatatagtacgtacttactacgttgaatctattattaaattgtagtgaacgtgtccgacgtatattgcttgtgataactcttttttaatacaatatactgtattgaatctattattaaatttggtgaacttgatcaacgtatatttgctcgtgataaatattttttgagatataatatactatgctaaatctattattaaattgtggtgaacttgttcagcgtttatttgcccgtgatagctcttttctaagatataataaacaatattttcttatattgtttgtatatatctctcatatttctcaaattaggggtaaaaaggtcattccaagtccctcttgttgacgtggcactctagttaggaaaaatacctctcttatgtggggtttgtgtaaaaaagtttggaagagtagcatctcaatagtgccactccgtaagagtggcaaatagttaaaaagaacctcaatctccccgtgataaacccagccaaacacgacacgcagaactaaaataaaacacaaggtacaaacaaatccactcaaaagaaaaaagaaagaaaaaacagggtacaaatccgctgctaaacacacagggttttagcagagcttgtgttgtgttgctcatccgacacccaatcccagacggctctgctctgtgtctgtctcctccgctaccttttgcgttttcccccctccaactcctctctatttccttcgaagcccctcgttcccctctctctctctcctccacctcgctcccacctcctcctcctcggctttgctgatccaggacgagccaatcgagctcgccgacgggcggagccaccaccaccaccacccatccccggcgccgccatgctggcttccgcgaggtgagggtttcttgggggggatatgtcggactcctccttttgctttgctcttgaggtgttcggcgaattgcttgggtgggatgggtgattgattgattgatttgatttgattcgctggtgggggatttgtgttgcagggggttctgggggcggcaccggcggaagatactggtctcgctcggggtcgccggcgccggctacgccgcgtacaggtacttggactcgcaccggaggcagctcgtccgggtggagcagcgcgcgctggaggagcgcgccgccgaggagatcatcaagaaccagtaagatgctcgcggcctcgtcgcctccgtcttacttgctacctacttgagtggggtttaatcggggggtttcttcttcttgcattgctatcatgctgtgttcgtctttgatgggtagcctagcaacagcaaagttgggggtttgagggtaggattatagattctacggttggggtttgaggaaaaaatagaaaccttttgtggtgcgcctattgttctaattgcaggggattagt

SEQ ID NO: 60349 - DNA, 588 bp, Oryza sativa
aaaaagaaaaatagaatttcaactaggaatacaatgtataaataactaaaatttgtaataacaaagactattgaaagaagggaccatctagaacccatgatgagattaattaaaattatgaaaatttaaaaataataataagagtttaagtaggaatataatttataaataaaatacatcggaatgaaaaatatgaaattttcaaactcaacgatgataaatgacaataaagatgggagaagccataagcctgtaaagaagtaaagtgatgacggttgaaggggcatctaaaaactattaacaaaaccctaaagagaattcaatgatgattaaaaagatggatgacggacaggcagttaagaagcacgatctcggcggttggcgagacatctaaaaagtaaaaagtaaaccccaatgataatcatattcaattttaaaatcacaatggcaataaagaggggaagcaacaggcgagccgtagaggagtacagtggtaaagccgtcaccactgacggtttggcgggacttctagaaagtaaaaaatgaacacaaatgacaattatgtttgatttttgaaattccgatgac

SEQ ID NO: 60350 - DNA, 5032 bp, Oryza sativa
ctccctccctcccgtcggccggcttgcgctgcctcctctcccgccggccgccccgacgagctcgcctcctccctcgcggcgatggacaacgcatggccgacggcgcgcgaggcgcctggggcggcggcggccatctctctcttgcgcacgctcgcctagcagtccgccgcccttctccccgatgggcgccggcgggagaagagggatcgaagccacgtgcctctccccgtccctcggccgccgcggccctcctcccgtcgtcctccccctccaccgcgccctcccgttccccccccccggcgccgccgcctctacttcctcgccgccgcggccggggacggccgcgccgatgccctcccctcgtctgagctccgcaagcgccatggcggctctgctgcttctggtggtggtggtggtggtggtgaggacgagaagttccacttgctccgtcgcctcctcgcgcggcccaacgtcgccatcgacgcctacatcgtccccacgtgcctcgcgcgcgccgtcgcccgccgccggccatgcgctgtccattgtcgcgccgcctgctgccgccgtgctggacgccgcccgacgagaggagggagcagagagatggggagagccggagagaggaggaagaagatattggattcggtcaacgacatgtggggcccacgtgggcccaccatatttattttgtgtagctgacatgtgggacccaccatttttaaaatattttttggggctgacatgtgggcccatgatttttattattttaccgagatataattgccacgtcagcgccacaccagcgccacgtgggatggagaccgagtcaaaatggccaaaaatggccaagtaggcgtcacgtcagccaaaaccgctattaaaaccgccgagggatctcgtttgactgatttttgtaagttggggatgggtcgtatacggttttgcggttcaaggatgaaaattagactggcgacaaataaagggaactcaagtgaacttattccaacgttgaaattgctcagtcattgggccgtcatgagcagtgggaaacgtcatcctgcacatgcggcctgcactaccagcccactagttgttgggccatttgaggctttgaacgcagtgtgctcggagaaggaaagctgattagctgagcctttggtattattcaggcccactcgtgtacattgccttcattgttacaagaacaacttcattgttaccaagaacaacttcgaacccgagcagggaggtcagttttctgctatctgttaactagttctatctggtatgcatctgatatatgctaatgatgctatgcaggtaaactgtaactcggatgttctccttcttttgataacaggtaactgtataacagaatgcttgaaacctgatgttcagtaaaccgtcatccagcagctaatcgaactgccgtcagctaacgcattcggttttgctgcaacctcatgacttcacaagtggacttgcattctgcagttatatcttcccaagaatcttggctagcaattgctgcccaagagctttgttacttcttacggaatacggactgcagcttgcaaaacgaaaataaattatacagtacttcaggctgacctactgttacatttctcatttttcacggagggattattcaatgtactgtactagtactagtattctgctaggatttccaagatttgataattggtgactttgttcattttgcataggagtatgactgtatgacaggaccacatgacgcgatgcactgtattttgaagtgtacacggtgacagcattcacgcgttgtagctgcatggctgcatcaggttcagagaaaagcaggccgaggcaataatgaatgtaagacggcttgttagtattcttaatcacatgaatctttttttcaaactcatttgagacttgacatcctccaaaagcttatcagagtcctgttaaacactaattacacatttgatcccattattgagaaaggaagactaccatcaacctggcccctcctaacaaaaaaaaacatcaagcaggccatcttgtcaaggtctcaaggataattattcaaccatgaaatcaagaagatctcaccacttgttgaagtatgtcataggcaccaagtcctcttttgctagcctccaattaccataactagttactacttgtatactagctagtaactgaagaccccatcacctcacaactcaatgattaaaacttagattaccacttgttctaaagtgactgtttttttttctttcaatcacgtttcagtttcatccatactctgtatgagttatatgaccagagcgatgatcacagtgtgaatcgtcacctctttagaattattctgtctctaatgattgtatctgatcttatatatatacactgagtgctatcacaacgacaagagcgtagcattgacttgcagctggaaaatgtgacaaaactgactatctcgcggccgtttcagcaaacaaatggactgaatgctactctattggccatggaaacttgtggaaacgaagcactgaaacgtagacttggcctcagctgcaaaacttcaaggattgagacaaacagaattggatgagcgatcgcgttggtggaatttttctatcttggctgacatcgaaagcatttgggttccccatcaggccgtcgccgactttgtttttgggggcttgatatgattagattaagagaggagttctatccaataggtttttttattagctagtagtattcaattagcttagctgactcctttgctagaggattacaaagtcaaaatgttcagctgtaggaaacacatttgaggagatatgtacagtagcagtgtagcacatttctagaaccagttggttggtggcaatgcaaacaatactacaagatcgacaaagcgatttaattctctcctagtacacgaattaaaatctttgggtatgttttacttttaaactttatctgtagtgtataagaaaaacgaactttaaaaaggaagaaaaaactcacctagaaaattgggaaaacgccaaaacgtaacatctctgctgataaatgccatttctagcaagaaagtatttttttccattgaggtgatgtgcccttgtttcttacattttatcaaaataattataattattttaacaacatggatcaatatatgatatatcattacacaaacacaaaggttaatatttcaaacttttaaaaaatatataactataaatgatagtacatgtattatgcattagctagagtttaatttatttttaaaaaaccttctctagattgaaattaaacggctatgtatttgaagttacctatcactttctatgtcccaaaatataagaagctaaaaatgaatggaacattttctattattacgaattcagttataggtttttatattttgggacggatggagtacataataatctatattattaaattatcttaaaattatttggaaggcgtacaaaagatgatgaccattacctccatggctccatctacagtaaacaactcccgtttctaacgtgtgagttgtgaccaataattcccctcgtcagaaatgttcctttcagcgattgccaccagccgcctgcaggtaccaagattgtcaaatcacctttcagtccccgcgcggcaacgacactagtacaacagcgcaagtatagccggtcagctaggcttgcacagttgtactacattgccgcccgcctcgatcgtcaacctgcagacgcacacgcgcactagcccgtgtcgccggcgctcgcagggcccccccggagacgacatgccatcgcctctatcgctaaagccgtcgtccacctccccggccgtcgctgtcctctcctccccctgcgcgagcaaatcgatcgaaatcacggtggctcatgcgattctctcgtgtgtgaacggcgccaaccgtggcagataccctttgccgagcggaaaagggtgtcaaaatgcggtcgcattttctgcatttccaagcgacccatccaaacaaggactcgcatggagtagctagttctagccccaaaaaaaaaggggcgagatgttagttatagttagtggagggcttttgacttgcagcgtccggccgccggtgtacggaggagaacaagggaacagcctagcgagctatctgctcctacctacatcgtcgtctcgtcaaggttttgtttgttcgctggtcgatggattggaacattcgcgagacccttctttggcatgcgttgaaattgttctctcgaaatggaccgaataatgttcctcgataaaggaccgaattggagtactagcaatgaaatgtatgcacatctgagtacgagaactaattaaacaagcagaatcagaggccaggctttaagcaaattaaactctgcagcgtacaaacacagttaattaagtccatcgtctcgtgatctcgtatgatcagaagaataacacgtgacggcgacgctgctgggcagaacacagacgatacatggtacttatcctcatcttaagcgccttgatctttaatttatatgtgttaacactgattattttttgaaaaaaaggcggatttgtggaatattcagcggccggtatcgacaagcgcaagcgatagatgggtcaagtggggggttttttttttgggtacaaatatgtgaacgattgattgggaaagatcaaccgccattgatactgtcgctacgtggaaatctcaaatctataagcgtagttcgtatgtctatctgcctgcctaactcgaccatacttgcatttctttcacgactagttatagctcgaaattgatcttctacagatatggttggtctggcatgtaatggatgaaatttgccgctacctgttggtgcgtgggtcttgtgttcccaagaagatggctagttttggcgttttattaggttggctcttatctagtgtgagatcggacggtgaacaatagcgggaaacaatgtttaatttagctgaaagtgcgccgggggggggggggggggggggg

SEQ ID NO: 60351 - DNA, 6419 bp, Oryza sativa
  unsure (1)..(6419): unsure at all n locations
cttaatgatagatcagattgatccacagacactttaaaagggtcaaaatttgctggccttatctcagatgagatcttctttatccttcctacgacatcaagaaactggttccatctttcaaccttcttcctcttcatctcttctaggtatggtaatattgcaccgagctcatcccgtaatccacatgctttctgattagactgataaaacaatcaaaaacaaagaactaattactgccttactggtagatcctatttcgctacagcatacttctacctttcaagttggataactaaataatacacattaaatgagcccatctgtgactgtaatcatatactacctccgtctcaagatatagcaaccagtactagatgggatataatctagagggttgtgctccttccggctattgggtgtggcaactccgtggcatgcacaacaatataagtcattagtgcatgattaattaagaattaattattataaactcaaaaattgggtttatttgttttttagaataaatttgtatgcaaaaagtttttgcaaaacacacactgcttaccagttcggaaaatatgctaacggaaaatgatgaagttaccatgcttgaatacaggcgaaaggtagtatacgaagaacatatgaattcatagcctaataataattcgataatatcacaatacaattgtgggtagtgtttttgaatcggagaaacggctaaattctgatgcgccccaaaccattatagtaccataacacagtaaatcgtatcaaccatcaaaacataagctcttaaacgacagaaaacagaagcaaaagtgacagacctgcctgacgtggaccgtcgtctcgccaatggcggagcagatggcggcgagttcagcttcatattgagcgatcgcctgccgcagctgggcgcgggagcggttcgcctggtccaccttcctcctgtacacctccaggcactcctgctcgagctccagcagcatcctgtccctcgcggcctcgggctccccgacctcgtcccagatgacctgcaaccacgagcgatctgaatcagcgagagaccaacaaaacctgtcaccgccatcgcggcaacagcagatcagtcgacagcgaggcgcacctggagctcgtgcatgagggatccgcatatggtcttcatcgggaggaggcgctccttcggattgccgctcctcgtgaggacgataccacgcagcctgcaggggaatcaaacggggagagattgatcggcgtcagaattagggttggcacgatcaaccagcagtaacgcctacggcctcgagttcactcaccagtctcggtggctcggctcgacggagggcgatacgggaggccgaaacgagggcaccgctgcgtcgtcctcggcggcggcggcggcggcggcggcggcggcgtggatttggccggagacggccgcgcgattttgggggaaatgatgagggattgaagagaattgttcgaaacaacttgaaaatgggagggagagggggaaacgattttggatcaccggatttgggcggcacaggctgatagatatactgggccgggctagtcactcttgggccttttattttgaattgggctggagatggaaagttttactgatatgggcctaggctaaacaactcataaagctgttgcagattatgctgagtggtgagtagtgagaaccaaactagtagaagtacatagtggggcagtaaaaagagttaatgaaacaattaaaaataatttataggtaaaaattttgtatctgtattacggtttaaaagctaaggttgagaagttgactataatgaaaaatcctaaaatcaattttacaattaagcacaatcattctgattgcaaattcttccgccggagaagcgaatagccacaaccaaagcatggatatggaaataataaagaaagaattaccaactaaaaacaagaactcaatgatcctatgcttcatggatctgcattataaaggacacatgctttcgaagttccgagtacttttgtgcagcacaatacaatgtcactgcggttccttattaggggtaaaaggagaaaaggaagacaaaaaaacatcgctcatcagaagatgtcacccctgcttgtaatcacgtcctggctacagaacgggcatatagaaaccagaatccaaaaatttaacttgtacagaacttaacaatgaagagatcttatgaagccgactccttggcgatcttctcagctttagcaatgacttcctcaatgcctcccaccatatagaatgactgctcgggaaggtcatcatatttcccatccaaaacaccctgcacatcaacagaaactttagcaaagagcacacaagcaaacatgaatatacattactaataagcataatgaagttctgtaatatcgcgtgtctacaactacagatctagcaaaatgtgttactgaacaaaggattaaaaaagtgtagatggattgtactgtctggtaaaactagtgtattcttgcaggcacatactgattcatcaattataaccccaaaaattgcaaaatactgtaaccgtagtggtactgaactccaaaaactactatgcatattcaattctgacctggaaactgttgacgctctccttcagctccacgtacttcccaggagcacccgtgaaaacttcagccacatggaagggctggctcaagaaacgctggatcttccttgcgcgagcgacggtcaacttgtcatcttcactgagctcgtccatacccaaaattgcaataatatcctgaagattcttgtagttctgaagaaccttttggacaccacgagcagtgttgtagtgatcctcacccaaaacatggggggagagcattctggatgtggagtccagaggatcgacagcagggtaaataccaagctcagagatctgcacagatagcaaattcaagtcataatgaggacattattaacacgatgtattaggtcagttggacaaacctgtcgtgacaacacagtagtagcatcaagatgtgcaaaagtagtagcaggagcaggatccgtcaagtcatcagcaggcacataaatagcttggacagatgtaatggaacccttctttgtagttgtaattcgctcttgaagtcctccaagatcagtagcaagagttggttgatatcccacagcagatggaatacgtccaagaagagcagacacctcagagttcgcctgacatcaagattcaagattaatcaaaaccataacaatgggacttagtagaaacacctacgctacgtatactactagtaattcttttttatgcagagtagaaataccaaaagaagagatgtcttgcataaattacctgagtgaaacggaaaatgttgtcaatgaacaaaagcacatcttgtccttcggcatcacggaaatgttccgcaacagtcaaaccggtcaacccaacacgagcacgagcacccgggggctcattcatttgcccgtagacaagagcacacttgctttcactctgcaaccaaaattgatatataagtagcttgcacatgtgtgcgtcccacagaaaataagatatcaactaaaattacctgtttgtcacctagcttgatgacaccactttcaatcatttccctgtaaagatcannnnnnnnnnnnnnnnnnnnnnnnnnnnnnnnnnnnnnnnnnnnnnnacctggcaaacaaatcatcatcagtcaaatagaacaagtgactgaaatttgaacaatatcacacatgagactatgtatagatgcataccatgggccttagcaacattgttgatcaactccataataaggacagttttgccgactcctgcaccaccaaaaagaccgatctttccacctctttggtagggcgcaagcagatccacaacctataaaattaaaccaatgtacagcaattaggactctaaatcatggttgcaactatttaccattcaaatacttcagataaccacaggatcagagaagggtgggacaattataccttaattccagtaacaagaatttgctgttctgtggcttgctcaacaaaagcaggcgcctcacgatggatgggaaggaagtggttcgttgctacaatagaagtcagcatcaataacaaaacataaataagaactggacacacaaattcttaaataactatgaataatgaagacatggaacatatagtaacttacttatgtcacccttctcatcaattggctcaccaataacattcatgatacgtccaagcgtggccctgccaacaggaacctacaaagaagaataacttccaagtcaaaaacatagtagaacacattatatatgattagtttcaacttccaagacaatgctacagatacaaggttcagcaactctaattataatcagaatttacacgaatgcatcagcagttctctgaattcagtaatgcccattttatgctaaacaattggcaagggtattaaataaacaaaaactggaatggattcctagactatgacgacaattttcattcaagcaaacagtggaaaagttataccaaccaatgcatgttaacctcacaatacgccaatacggaaatgcaacactggtgaacataatgaattctaatagactctagatgaccaccacaaaccaaaaggcagcactttataggggaaaaaaagtcaatttcttcactagcacgaacagaccaccacaaagcagccaacagtctaccgataaaatgaacgaaatggaagggcgatcgctcgccactcagaactgtacacctagatcaaatctgacagcagtagatccacatttcgtcagatctggtcggagacaacacgaaatgaaatgtacgatcgcaaacaaggatgagaagacgggcgggggggcattacagtgattggggagccggtgttgaggacgcgctgaccgcggacaagcccctcagtcccgtccatagcgatggtgcgcaccatgttctcgccaaggtgctgcgccacctcgagcacgaggcggatgttgtggtcgagcacctcgagcgccgtgaggatgggaggcagcccctcgtcaaaccgcacgtcgacgacggcgccgatgacctggcacacctgcccgacggcgccggcgccggtgaactcgtcggtgatcttacctccacccgtggccttccccgtcgcgggcgcgggaggcgccgcctccttcgccgcggcggccgtggcgtacgcggcggcgcggttgaagaggtaccccgatggcgacggtcggtggagcggcccgcgcgggcgcggggcgggcgaggccccgcggagcctggaggcggcgcggacgagggaggagagggcccggcgagtcgccatggccgggagatcgccggagacgcggggcctggatctagggttagacttttttttttttggttgcggcggcctccgcgagaagggaggaggagaggaggggagcggagtgaggaggagagtgggtgcggtgggtgctggagatatcgacgtgtggggggattggcgggtggacccggtctacgggagcccgagaagcgtggaggagcgggggttgtgtggtgcatggtgggctcagttcatggaatggattgcaatttttttggggatccatttggtagcttgatattgcagctggaaatctggaatataatagtgttcctttttttttcttcttttttattttgggctgtcaactgtcatttggcactttttaatggcatttgatttttgctatgttttgatggtgacagaggatttcggtttttattgagtagatgatgacagcagatgattattttgaactattataagttcgaaagtcgaactaaaactttgcgtaatcttcgatcaagccgtcatgtttagctattttctagtccaaattcgtggctaactttggtaacagcatcttgttcgaggcctgtaaccttttcttttttagaaaatcgaggctcgtcactctgtcagcacacaaacgttgaaggaataagttcattttaggtccctctatttgtcgcccagtctgattttcgtccctgaactgcaaaaccggtacgacccgtccccaacttacgaaaaccggacaaacgaggtaccttgacgattttaagggtggttttggctgacgtagcgcctacgtgtccattttgactcggtcttcatttgatgtggtactgacgtggtgcttacgtggcaatccgatctagaaaaataataaaatctgtgggacccacatgtcagtcacataaaataataataaaaaagatgggacccacatgggccccacatgtcagtccaactcacctcacctcttcttcctcctctctccccatctcccatctcttcatctctctctttccaggcgacggcggccgctcctctccctcccacctgcaggcc

SEQ ID NO: 60352 - DNA, 5189 bp, Oryza sativa
tcagtaaaagggttccctaaacttgttcaggaggctgagtcacaggtactgcctgtttcccaggttcaaaataacaatgcattacaattttacatgtgaacttcctgggatttctttcaacattaaaaatgtaagttttctatcaaaaggtgtgtccttggctcctagcaatgaggtgattgtatttgtgcagaatcttgtctgcgcgaaaaatctgcagatagacaagagcatacataatgcatatgtgaaagctatcagatctgcacaacactatatctacattgaaaatcaatattttattggatcttcatactactggtcttcaaatagaagtgcaggtaacaagttgactatcagccatgctattgttttcttttcttattgctatgtgcactgcctcccatataaaacaaactttatatttgcctcacaataccttgtacactagaacatgcatttggattttgtagtaaagcatgctcctgatttccatactggaaacttggtttatttttcatatctactgtagcaattactgggcaatgagaaatgaaaaacaaacatgactatagctggaaacaggtgataaagattaaagaaagctacctcgttagtatctagcatgtgatttattccttaaatcgtggatacaaccatgaatcccgcttttgaataatcttgtatttacaggtgcagagaatttgataccgatcgaattggccataaagattgcaagaaagattaaagctagggaaagatttgcagcttacattgttataccaatgtggcccgagggtaatccaacaactgctgctatgcaggagatcctcttttggcaggtttgttccacatcattatatatcatggcttcatcttgagatattttgggaaatgcatcacacattttgattttaagatattgaatgaatcatgattgattatgcattctaccttatgttttgctgcttctgtttaatctcatctagggacaaacaatgtccatgatgtacaagattgtcgcagaagcactacagaaggaggggttagatgatacgcatccacaggattaccttaacttctactgtcttggtaagcgtgaagtctcaaatgacgtatctacaacaagccaatccaatgagaattccccacaggtagtaatattttcttctttctccgataagcatatcaagctaagcacattcgatgtgctttgctggaaaataaacaattactccctccgtttcatatcgtaagactttctagcattgtctatattcatatagatgttaatgaatctagacacatatatatgcctagattcattaacatctatatgaatgtgggcaatactagaaagtcttgcattatgaaacggagaaagtaattcctttcttttactctctagcgcctggtccaaaagttcaagcgattcatgatctacgtgcactccaaggggatgattgtcgatgatgagtatgtgctcataggatcagccaacataaatcagaggtccatggatggctcaagggacaccgagatcgctatgggcgcctaccagcctcactacagctgggcaggacgcaagaaagctccacgaggacaggcatgctactgttcattttcctcaccaattaaacctttacataatacctacaagcacctttatagtgatctctattggtagtattctactgcctgtattatcactattagtagtatgatcaccagtattagtattacccccagtattatttcttttgtcttcctcttctgttttgtttcacctccttcctatcattctagtctcggccccttttggctttatatgttcttcacccacaattaatacaatggttaaaaggtagagtctgtaacttttgcataaaaaaacaactagtagtagtgatatcaagttttgaatcattgatttattagttttactatcattagaaaaaaaatctactactaatagttgaggtggtagtggtagtactcgctccgtaccatagtataagggattttaccccttctactcgtcccacaatataagggattttggtatgctcacatccatcaactccaattcaaatttctacctattttaacctccaactacctacccacaaccaaaatcacatttaatagaatacctacccacaaccaaaatcacatttaataggggtattctagtctttttattctattcttaatcttacccaaaatggaatgatcccttatattatgggacggaaggaatatataaatagatatgatccattggattggaaatgatgcatggttttgattaattctaccaccattaaagaccatttttaaaagacttcaatatttaattacctgctgctccagcttgtaacctcgcacttcaaaactgttcatttttcaggtgtacgggtacaggatgtcgctgtgggcggagcacctgggtacagtggaggagtgcttccgttggcctcattccgtggagtgcgtccggcaggtgaatgaaatggcagaagagaactgggcgcgctacgtatcaccggagatggtgaacatgcgggggcacctcatgaggtaccccatcaatgttgaacgggatggtagggttggtccggtgcatgggtacgagtgcttcccggatgtcggtggcaaggtgctcggcacacactcttctcttccaaatgcattgacaacttgaattggctggagcatgaacgagctagatgtggcaactaccactaatactttgaaaagaatcattttggggcgtgaagctttttgtttgtacatgaaagagagactgcttgataccagttccacacattgctgttatagagtactgcagttcgactgctgcatatgcagtatgtataataggatttcaattataatcatctctggctggatgcaaatacatctgttcttgcatttagtttgttgtaaaaggcaccttccctttattcagacagtcggttagccttaaaaacaaaattcttggtggcacatgattcaagaatttattggaatgcctcagaagcattacattactttctctcaaaatgtacgagaaaaattatctcttcaaggctgtttggtattgagcaatataaccaaaccttttggcgcgatgtcatgtgaccataattttttagcacataggcaagagagttgcacatttttagtgaacacattatgaccataattgggtggcatctatctactgcaaagttctgtcgagtaactcaaaattgattttcattctagttatcccccaaacattttcagaacacattcacaaacgactgacagttgttaaaaatgacctgacaacattcttttatgagcaattttatggtccttgaggaggtaccattttttctattgtaaatttggtacctctgggtacttaggtattatgaggagtaccaagaggtaccaaattttacaccaaatttttaagtacattatggtacctactgcaactgcacctaatccgaattcaccttactaatactatgatgtatgcatatctcttaagaccatctccagtgtgagtaaaatggaactgtactctaaaagaccgaagacaacatattgcgacaatcaactgatatgtctcagagcaaaaaatcgacaaaaaatatgagtcgaacttagcgactaaaaaatggatgcatgtgattgagagaattttttttatgtgggccatacaatcgaagtgaaacattgtagctactgaaccaaacttttgttcaaccacaatagtcgaatcaagtctgcaggtaccctaaggacatagaaaaagcttcaaccggtttaattcttttacttctcaaacagtaagtaggtacaaggacaggagaaaaatcgcttattacagataagaattctaagcataatatattcatggcattccttggcctaccaaaaaaatatttgtacagttaaaaagattgagggctagtttggtttggttccaaatagccctaccaattcattggcaattttcaatagtgtttctagttgtttagattggtgccaaattttaacaacatatctctttagatagaaaatttttgaccatctaaatttggtagtgccaaaagttacccaaactttggcactactaaaattaaaattttggtatggtaccaaaccaaactggccctgattgtataatcagagtattgcataatagatgtgatatgcatagtagagatgtaagctagccatatattatgctcgctgcaacaaaacagcagcagcgccaaccacactacactgttaaaccataatagaacagggtgtagataaaaaagtcttccggccatgagaccagaaattggttcaaatgcggtcgtcgtgattgaatatcgtttgatcgaaatatagaattgttaatttgatcactgtgtacttgtttatattttttatcactgtgtagtgatataatttcgtttgatcactgtgtacttgtttatatcgttttctttttctccaacgtgtaggagagttacgcactagagaagactcgtccaagcccttcaggaccatgcatggtaaacataacaaacaaagactagaagaaaggaaaacaataacctgcgaaacaaacttatggataaaaattaagaggacctttgctccaccaaacaccataatttgtcccatccctaatattctgcataagttcattggtattaggtaaggtctcctcttgatcataaagcgggcaactgatcaacactccagcatctatctagtgaggccaaccaaacagagaaatgacaacaacgcacgtagaatttttctttcacactgaagaaacaaatatttttgttttatggaaataagaaagatggaagatcttttttttttcatttcactgtgtattctccattatccagactccagagaaacaattttttactctatttttgtttcgtggaaatggggaagatccattaggcaggaaaacatggaaaaactcgaatgcctagttgcatgcagccaagcaaaccccctacaaagaagcaaaggcagaatgcctcaaaattgcatagagccgttgtagacttgtgatataatctatagattcatatggtagcacttgggacatttaaaccagcagaacgtaaagagtggttttgtatgcatggtagacagcgtctaaccagcggacg

SEQ ID NO: 60353 - DNA, 2139 bp, Oryza sativa
  unsure (1)..(2139): unsure at all n locations
cgaatgagtttgcacgttacaaatgccactgctttctttccgtacgtacaaacgttgtacatgattgaaaacaaaattttcctaatcttcgctggaagaaaaaacatatacatgtacataaaacagacagaaaaaacatacattcaaatatgaatttctacaatataaagataaaatatattacttcccaaatataaatatatttagttaaattaagaactataagaaatatccaatcaatgttcttttaaaccatcttctaaatctatctgttatatactaaaattacattaaactttctctcaaataaattagagaaaccctagaaatctattatatactaaaattctattaaatgtcttgtaaacactactacattatcgcgtgacgctctaataaaattagagaaatcctagaaatttagagtaaaaaaagaaaaccatccaaccttgaatttttacttaaattattagacccgctattttaaacattggattagagctcttaaaattcccatgtgttgacgcgaaaaacacgcactggtctaaatctggcacattaaaattccctagtttaacatatccttaatacccctgtcacagtaaatctggcacacgcggacctctcaggttgcctcccgtgggtgactccaaggagccctcagcagccctagtcgtcgccagctgcctcaacgcctgttctgcctccgccgccgccgttggtgacgatggtggtagttttttttaccgcccaacaccacgatgaagtagatcggagagatcaacaccatgtgcgaattagcaggaagatcggtcgatcgctgttgtgaccgtgctcgccatggatgtcggaggagttgaatcggtagttagcaaggacaccccttcaccgctgatcctctcttccaaccggcaatccgctttgtntgggtcgataaacatgcaatgcggaggacatcacatcaatccgaacgtgatccaagaagggatattggtctagctgatgaagggcgcaatggcaccctcttatccggttgtgccaataagttccatactgatctgttcagcgataattttattcatgttttcggtagtccggttcgatgatggcttctttcattcgcttggtggtggcagatccagtaggctagtactttgtccttggtggctacacattggtactgcttggtctgtatagttagcaatctgatatattggttgcttggtcagcgaatgctaaaggcggttttgtggaattgtggttatgatcagattgtgagtggattgtgctaagtccatccagatgatggcacagagtactagcaatcactccagagtgaaaacctaatgattccacaacatcgctgcttgtgtgttattcctttgttgaaggtgtgatgtcaggcttcgaataacaatctagccttgtgttccaatagcagcggcagacaaaatgtcatgtatttctcgagggcgttgtttcggagtaaataactaggattaacctcttgtcttggttctatttgagtgagctgctacaagacaacatgatatgtttaggtttgtcttagtgtttttttctattttatttttctagacttttgtgcatccctagttgggtcggatttaattttatttttaacaaaactcttccccttatcttaaaaaacactaaaagctggtaacttcaaaaactcacagaaaataacatttcctcgaaatcattattctactgcactatttagagcatttgttctaagctattctgaaaattctatttataaaaataattaatttgtagacaatccatggtataatagtccgttcaaatcgggataagtccattttacacccctcaactattatatttatctaaaatacacccttaactttaaaatcgggtattagacgcccctcatctcttaaaaccatgcaatttatacccctcatccaaaccgctctggttttttcttaggaggcaatccagtcaacctaggaccacctgtcatttttcctttcttccttctctctactggagcagaacgaactacgcctcactctccggcagcttggcgcaggcgaggtcaaggttgagcggcacattcccgagcccttcctttggtatctcggcacaggtgag

SEQ ID NO: 60354 - DNA, 16011 bp, Oryza sativa
cctttctgatttctgcaataagtctgtgaaccatatttgtggcagtgtggatgatgaggctaatgtttggcactcacgtttatgtcatattaattttggcttgatgtctcagctttccagcatgtgtttaattcctaagttttccattgtcaaaggttctaagtgccatagttgtgtgcaattgaagcaacctcgcaagcctcacaaggctgccgaggagagaaacttggcaccattagaactcctacattcagatctttgtgaaatgaatggggtgttgacgaagggtggaaaacgatatttcatgacgttgattgatgatgctactagattttgctatgtgaacttgttgaaaacgaaagacgaagctctagactattttaaaatttataaggcagaagttgaaaatcaacttgacagaaagataaaaagggttaggtctgatcgtggtggagagtttttctcaaacgagtttgacttattctatgaggaacatggcatcatacatgagaggacgcctccctattctcccgagtctaatgggattactgaaaggaagaaccgcacactgactgacttggtgaatgccgtgttggacacagtgggactacctaaggcatggtggggggaggcattgttgacctcgaatcatatgctaaatagagttcctaacagaaataagaacaaaacaccatatgagatatggattgggagaaaaccatcactttcttacttgcgcacatgggggtgcttggtgaaagtcaatgtacaaataacgaagaagcgcaaacttggacctaagactgtggactgtgtctttctgggatatgctcatcacagcattgcctatagatttttaatagttaaatctgaggtacctaacatgcatgttggtacaatcatggagtctcgtgatgctaccttctttgaaagctttttcccaatgaaggatacacatagtagttctagtcaaacctctgaaataattcccaattcaatcacaccaccagaacaaactgaacatacacacgaacatgtcactgaggaggatgacagtgaagctcctcgaaggagtaaaagacaaaggacgactaagtcttttggtgatgatttcactgtgtacctcatggacgacactcctaagtcaatttcagaagcatatgcatctcctgatgcagactagtggaaggaggctgtccatagtgaaatggattccattatcgctaacggaacttgggaggtaacagaacgaccctatgggtgtaaacctgtggggtgcaaatgggtgttcaaaaagaagctgaggcctgatggtaccattgaaaagtataaggctcggcttgttgctaagggctatactcagaaagaaggcgaaaatttttttgacacttactcacctgttgctagattgaccacaagtcgtgtgctactttccctagcagcctcacatggtcttctcgttcatcaaatggacgttaagacagcttttcttaatggagagctggatgaggagatctatatggatcagcctgatgggtttgtagttgaaggtcaagaaggcaaggtgtgcaaattgttgaagtctttgtatggtctgaaacaaactcctaagaaatggcatgagaaatttgacaaaacattgacatctgcaggctttgcagtcaatgaggcaaataaatgtgtgtactatcgccatggtgggggtgagggagttattctgtgcttgtatgttgatgacatactgatatttgggacaaaccttgaggtgataaatgaggttaaatcattcttgtctcaaaattttgatatgaaggatttgggagtagctgatgttatcctaaacattaagctaattagaggtgagaatgggattactctcttgcagtcccattatgtggagaagatcttgaatcgctttggctacattgatagtaagccttctccaacaccttatgatcctagcttgttgcttcgcaagaacaagagaattgctaggaatcaactggaatactcctaaatcattggctcgttgatgtacctggctagtgtaactaggcctgatatctcctttgctgtgagcaagttgagccggtttacctctaatccgggagatgatcactggcgtgcgcttgagcgagtaatgcgctatctgaaaggtactatggaattggggcttcactattctaggtatcctgcagtaatggaaggatatagtgattctaactggatctctgatgtggatgagatcaaagccactagtggatatgtcttcacactaggtggtggtgctgtctcatggaggtcttgcaaacagaccattttgacgaggtcaaccatggaagcagagttgacggcactggatactgctaatgttgaggcagaatggctgcgtgatctattaatggatctccctattgttgaaaaaccagtgccggctatccttatgaacagtgacaatcaaacggtaattgtcaaagtgaatagttctaaggataatatgaaatcgtctagacatgtgaaaagacgattgaagtctgtcaggaaattgagaaactccggagttataacattgggttacatccaaacagctagaaacctggcagatcccttcacgaagggactatcatgaaatgtgatagacaatgcatcgaaggagatgggtttgacacccatgtgaattatactatggtggtaacccagtctatgtgatcgaagatcccgtgaattagaacctgggaagaacaaactattagtaaactataagagagtaccgagatataccctctctaagtgaagatgcatgtactctcgtgagctgcaaggcaggttggctatgccttaatgagttctgttggctttaattagcgaagatgctgtcctgcagagcattcttgaaagaactcacctttgtgagcttgactgttggtcgcagtctatggagattttgggtgaatcttctaggaagcttactaaagacctaagagtatgacttatatgctccacccgaggggtagtctacagacggtctagtaccagataagactctgagtgaaacttgcttgcacaagacttgcaattcaaggcgtagtccattgttcaagttgtgagtaagtgtagcttggagttctaggtggatgttcaaccttaatcggtctccatcaaaccgctggtatataaacagtacattggaaaaggcaaatctcagtgggattttgagatttggtgggggattgttggaattaataaatgggctaaggcccattcgaagattaactctttggaaaatcacaaaagcccaccacatgggatggcatgcatgtgaagtttagtaccaccttacttattctaggagagggggacctccttaaaagggagatgccctcctagccacttgaagcatgtgtggtggagagaagggggaaaacacgcgcgcgcgctcactcgcctcgcctggcctagcagggcagggctggcggcgcgcgtgcacgacgtacacgtcgaatgatccgcaaaattggctcctcacccttgcgcagatgcagcttccttttgcagttttgttttgctacaggaaaattcggatttgttttgttttggaaacattccgaaaaatccggtgcgtgaaaacggcgtgaagtccggataagttacgcgcgacttatccggttcggttacgcggagtggagatcgtgcgggcgccctgatcaagcgacctatctctatataaaccgagccgccgccttcacgcaacacacacgaaatcaatctagggtttgcctcctcctctgttctgcgccgttgctcgtagactactccatcccgctcgcaggcgtgcacctgcaatcgggagagcaggtctccgaaacctctgccttcgacgtcctgcaccgagaaaaggcggcaataaggtttttgggaagcgcttggcgcgactgctccctgttcgtccgcgacggctcgtcttcctcttcgctcgcgtgctgcgcgccgtcgtcgacacccacaaccgcgagtagttcctgccgagcaatcggtttttccgccacctcggtacgtgttcgacatgttgcgcatatttgatctgttcatgttttactgcttagtttagatgtatagatctaatgatgcgttcaatctagtttacatatgcaatgtcatgatttatttatagaaattaaatcattatgtgcttataatttcaacaatctatgcgtccccaaaaagtctatttgggataggatatgatctatcctaagataggaatgccctgtttggtttagggactaaattttaatccctatcacatcgaatgtttgacactaattagaagtactaaacgtagactaatgccaaaacccattccataaccttggactaatttgcgagataaatctattaagcctaattaatccataattaacatatgtgatgctatagtaaacatgttctaatcatagattaattaggcttaaaaaatttgtctcgcgaattagctcttatttaatcaattagttttattattattctacgttcaatagttctaactagtgtccaaacatccgaagtgacaaagactaaaatttagtccttagatccaaacaccacctaagacaggaatctagatatctagattcgttgttctatgataggccacgtcatatcctagattatttctttttggaacggagggagtaagtatactatcgatcataatggcgacgtgaccaataatatacgtgtacaattaccaactgtgtactccctctgtcctataatataagggattttttagggaggtctagacaggctccttatctagattcgtcaaactatgatgtgccatatacttttaaaatcctttatattatgtgacgaagggagtaatacagatttatatgtgtgatatgacatgtagatatcttttgtgggttctcaaaccacggtatactaatatgactgcgatatgtttacgtaacctttatagcgaggtagatttattttcagataagtggaatcgactttgtacatagtaaactctaaataattagtatgtatgcactcatgaaatcggatcaatgatcttaattattaagccttgattttgcatataacgtgcgcacatgatcaattcaagtatcttatctatctacttcctccgtttcagattataagacgttttgactttgatcaaagtcatattgtttcaagattgactaagtttatagacaaatatagtaatatttataatactaaattagttttatcaaatcaataattaaatatatttttataataagtttatcttgggttgaaaatgttactactttttttataaacttggtcaaatttaaagcagtttcactactacaggaaagattttcttggataccggacccttttatttctaggcggactgtaaatggaactgcaaaggaaatggggcggggggggggggggtacatgcgccagaccatcgcccgcataggaaaatcaattttcgtgtgcgggtcactatatagtccaccctacacgaaaatagtccaccctacatcgagcgctcgatatcctttcgcgcccctcgcccctccgcccactgccccactacctccctctctcccacctcactctctccctctctcccactccactcctctcctcccactcagcggagacagcaggcagcggtgggtgatatagcggcagcgcttggcccctccctccctctccctctgctgtgggtgggaagaggggcagtgacagcggtggcggcgggcgaccacggcggcgtgcggcccctcccctccctgcccttgcatatccggtggaggggaaacatgggggcctggtggatccggcaaagctgcgaaaggcgacgtgcgggggcgggaaggaggaagcccccccccctcggtggcgggaggcagttggacaaagtcggcctgcgtccctcggcggtgttaggtggtgggacaaaggcggcccgcgccggatctggaggtgtggcagtgtcaacggctggtgtggaggtgtgactatcggcaggaggtgcgacagtggcatcagcgatcgatgtgagttgatgcccctcccctcccctcccctccccttgcagatctagcggaggggaggagcgtcttcagctggcgactatggatccgacaccagcgacgggagcgggtggtagatctgtagccggcgaccgcgggggcaacggtggcgggcctcggctagggcaggggagattaggattagggttttgtttttattttttttgtttcgatattttattatctcgtgcgggcagcttaagcgcccgcacgcgaaaatccgattttcgcgtgcgggtgaggcacctgcatgtgaaaatcacgattttcccagacccctgggtgcgagcgggccgaccatccgcgcagaaaaattattttcgaccgcacgcaaaaatctttattgtagtagtgtttgactttgactaaagtcaaaacgtcttataactgaaatggagggagtagaaaacaatattttccctttagtaaactcatgaaaccatccggctttgcaatttcaatagacactaaaatttctgttgttgccaaaattttgaaaatttcatgaatttcgatgttttctaaccggaaatattttaagttttaacatatttttgaccaaatttacaaatatttaaaaaaattagaaaaattttgggggagatttgtgcttgccggtggagcaaaatttgtttttttgaacgactcgcacaagacggtgcgaagttttattgatagagcagaaaaaaattacaagattaaccaagaaaaaggaaaaaatataccaccacccacacaccgacagcgccaacacatgggtccgggagaaggctagcaccggacaggccgtcactaagcgtgaccaaccgccactaggccaacaaaggaacacagaagagaacgcccaaaaaacgcccttacaaccaacacaaagcccaactccatctagattgtgcttgcaccaatcgttcgagtggtttcggcaaggggatgcctaaacgacgtctccaacgagagaagcgacggaaaaccgtcgccaccatccgtcagggactcaaaagagccaagattgggctttcgcctggcaaacacctttgagggatgagacggcacgacaacgccctcaggagggggaatgaaccatcgttgtcggtccagtcaagaccaagctgggttttcacccaccgctcatcacctgcaaatccacggctgacgcaccgatgctccaccacagctcaacctctgccgatgtgtgggaccactgcaccccgtccccgccggctagccttcgtgcgccgaagaccgcgccacaccctcaatctattatcagtcatatgtatgagagcaaccacggtatatcgaaaggtaaccttatggcaatgattacatttataaagtggaacacatacattgtgagaaatagctttagcttagagtgcatcttatacttaaggtctaccacaagcataaagaaaatattctctctctcatttatgtcatgaacaagagctgaaaagcaggtttttctatctcataagggccccatattattgttaaatttcagcaagggattagctaaaaaactgttgcaggttttttgagtaaaaaactttcaaatctaactatagtacataattttactagaactacactataataattatataacttgtatagatgtattaaaataatatatgcaactttatatctaatttgatagagataataatgtagttactgtaactagggtataactggagtataagtaacatgtaacttgctaattttttaaaaaacttgcaagctggtgggatcgaggtcctgggttcgaaccccatgcagcgcacaaattatgtttctcacacgggatttttttccatgaacgcgccagcacgaatcttgagatgaatctgacggtcaaaaattcgaaagaatttacccccgttttctgtcgatagaaaactagcaaatccgtttcagcaatagcattatgggaattgctttaacaacaatcaaactattcatgggccacttctaagatcacactagacccatatacattgagattgccctgatatatccatctaattcatggacattttcctagtcttggggggatataatataataggagctagaggggggcatgggtagtgaagtccagccagcgcagaagatccttggggggatctggttgcaatggggatggccaatgaggagtcgccaaattatcaggtgaaaaaaggcggccggattcctccacgtaaggaccaaatccatccacagatcgccccgctctcctcgatcgatcataatatgatctcgcaatggcccccctacctttccctcatccccaacttgccctgtcttcttcttcttcttcttcttgtacctatattattacaagtcatcgatctcgctgatcgatcagtgatcacaagcatttcacaaccctagctagctgagctgatcgagctcaagtgacctcacctgctatagctaacttactagctagctctagctagttgttgtttgtagctcgatcgagtttgatttatccgttcatgtcgatgggaccagcagccggagaaggatgtggcctgtgcggcgccgacggtggcggctgttgctcccgccatcgccacgatgatgatggattccccttcgtcttcccgccgagtgcgtgccaggggatcggcgccccggcgccaccggtgcacgagttccagttcttcggcaacgacggcggcggcgacgacggcgagagcgtggcctggctgttcgatgactacccgccgccgtcgcccgttgctgccgccgccgggatgcatcatcggcagccgccgtacgacggcgtcgtggcgccgccgtcgctgttcaggaggaacaccggcgccggcgggctcacgttcgacgtctccctcggcgaacggcccgacctggacgccgggctcggcctcggcggcggcggcggccggcacgccgaggccgcggccagcgccaccatcgtgagtatcaatccaataatcctgatccggccggcatgatcggctcgattgagccgtgtcgattattaatttccatcttatatattattaattgatgaattcttgattgattcatcgatcctcctcgtcttttcttggcttctttgtttttgttatttagtcaaaaacaactcttcatttctgctgcctatatgccgtacaacttcaaactatcaaaggtcaaataatcgatcaatatataccaagtttgaattaatttggagcttaattaattaattactggcttgcagcagctggtttatagtattgtttctagctatatatgtgagggccgtgtgtgggatgtgatttgcatctttcgatggcgacttaattaattcgatgatatatttcattgcatatgcatacggatccagcctctgtctatactgtacgattccacatacgtatatgtacggttaagtcagtatatatacttttagatagtcgcgtgtgcttttcgagttcggtagctatattttagattgtaaaaacaagtcagaggctaattttataatctagaaatacttatttccccatatataagcgtatgttaaatattgatggtgtaatctacttatatgtcaggaaacatcattgcttgctttctggcgctttcttctacatatcagtagaggaaaatggaaaaaaaaagatgaattttgatgttgtagtttgctatattcagcatatataccatcagttatacatatgcagatcttgctaaaaccaaaataaaaatagaactgtaaggagatattgtgcttctcggtctatttacttacagtttgttgagaagtaatacgagcaagcaaatgtatatatatatttctttagaactgcaaggagatgcatatacatgtgtgattcaaacacacgtactgcacattcaaactataaaaacaacttgattgccgtagaagttaaaagggagacatatccatgggtttcggattctaaatcaatctatgtgtaaatgaaactttagtatagtaggaaataggttttcaaaaaaaaaagtatagtaggaaatagtatgtgtatatgcctttttaacccttaattacaagttgttataattcagtgttaacaaagtcacggactcacagagtgtgcccttacacaatttcagactaatttgtaaatgcatcgatcgtcacattttatgtggttcaattatctgacacagttaattaatggtggccgatcgatgtatgctcttctagctttccagctatatgcgtatgtaataaatgaataaaacgtgtaggatgaaatgtgaatacgcatcattgtaattaatttgattaatgctagtaaaaaatctgcaaatttgtctttttgaaattaaaatatgccttataaaattaatggacccaggcccctagggcaaaatatattggggcacaaaatcatgtccatatatacattcttatttgaaagtagactctgaaacaaaatatgcccatataaatcaagggaggttacaactaactgcatttgcttatgcgtacatctggattgtaacttctatgttttgtacatacgatgattaattgtattcgagcttcttaattgtacatctattaactaactagttttgcagatgtcatattgtgggagcacgttcactgacgcagcgagctcgatgcccaaggagatggtggccgccatggccgatgatggggagagcttgaacccaaacacggtggttggcgcaatggtggagagggaggccaagctgatgaggtacaaggagaagaggaagaagaggtgctacgagaagcaaatccggtacgcgtccagaaaagcctatgccgagatgaggccccgagtgagaggtcgcttcgccaaagaacctgatcaggaagctgtcgcaccgccatccacctatgtcgatcctagtaggcttgagcttggacaatggttcagatagataattacagtgcgtatataccactgactatatatgactgatcatcatgcatcacatatatatatatatatatatgcattattagaccatacatacatatatatatatatatatatatatatatatatatatatatatatatatatatatgtgcttgcatataacctatatatttaggcatgcaattcggtaatatatatatatatatatatatatatatatatatatatatatatatataattagtgatcgatggcccattcagaaaacttgattgcatgcatatacattagcttgctgaataagaaggttgatctgcatgaagataagaaggttgatcatggaaatgtatgattcaaacatatatttgttcaagaatcaagaggttccttagatgctttatcactctttatattctttaaaccagctaatatttcttttgccaaaattgaatcccgcatgcagtagctctgatcaggaagcacaattaatggtgctgggatacataggataattatttggattcaagtgctagtctttcagattttgtccaaattgactaggttacaagaaaaatccctaattcaaagttccacgtatcctctatatatactttcgctaaagatcgataaccatgttggcacaccaaaataaatgtctaaagaaaacagggtccttaattaattcttccatgcatacatcacacacaatataatagtggaacataagataagatgatagagaaatattattgtgcatgcatgtatatatatttgtgccatgagagagcatacatgtatcatgcacaatatccaactaaaaattggttcctttttaatagcacacagccactaaaacttgggaaataaatctagctaacttctgttccgttcacctttagttatgaaattacttggaaagaaattattggccggaaactagtttctgatatgatattgaatgaatttcatgtttgacaagttaaaataatttgtaatacatattcaactaagctctagttcaatttccataagaacaatctggctccattataactgatcataatgttatctaaccggtggtagcgatcaatcgagttagttgatggaattataacaacttgtaattaaggctatctatcggggcaatatatcctatgcacacgagcttaccgtgcacacttcgtgcacaccaactaacaatgtcataaaaaattttataaaaaaattgacatttactcctaatagtactacacatatctacaaagtctcgtattgaaattcattatattgtagccgtaacaaaaaagttaaaaatcttacagttttaagggtaaaaaactgtcagaattttgtcttttttgctacggctaaaatataatgaatttaaagataagatttcacatgtagttgtaatactattggaagtatgtgtcatatttgttttagaattttctgcgatatttgctagttggtatgtatggagtgtgtacgggaagtttgtgtgcataggatatgttcccatttatcaatggtaaagagtattggctactcagttgatccagcagtttgcagttggactttctaccatgaaattatagagaaattcttataatcgatactatagaaaacactatcattgccggttcataattggcaccagcgacagttttttaactagtggtaacaaattaagtggcaaagatatttggggagtataaaaggagttatatagaaactggccattttgatagtaggatcttaattacgtttgaattttgcaacccccaaaatataaggccaagtagtatgacatggtttttcatacaaatatatatgtgtgcatgcggacaaatggagtaaaacaggcgacctctatctgtcatgcaaaggctctttaccatctcaccaataagatagatgctttaatttgacccttcttttccaaaacttattgacgaatatttgggcatctaaataaaatggaaaaggtttcacctatatgaaagttgtacatctctcgtgcatagagagctacagcattgattttttttcttcatccgtattagtatgaaaaaattatgaattttctaagttataggttgctataccattatttttcactcctggaacacaatattgtttggctcagccttgtcactatgtgttataaaggtggcctatattaatgtttgtataatggcaaacattcaactggaacctggaagttaattaggattgataagaaaaaaaatacctcttctgatttatgttctcctattaactatatctttgttgtcttcttattttctcctcctaaagcggtgaaagtatggcactttagtgaggtcatggatttgccacatgattcctccaagtgtgaataaaaggaacgcactcatggaagtatatgtccatgcatcttctatataatctgaaaaaaaagagaacatcttacaccactttttctcacttgactttgtggaagatgcccgattgaatgatctccattggccgggttgggttctaccatatatgttctcatacctgatctcattcagtagtatattcttttttcctagcccatatctgtttctactaattaatatagagaaagtcttcgatcccttgagagaaataaaaagtaacaataaaagatacatagcactgcatgtgagttgttaattaaaagtcgaaaatagttttttttattgaagtttgttagcacataaatttccaaattaagcagcacccacttacacacactagaacgggattgcttatctgtgacgggctgaaagcctcatcactatcgggtaaggtccccgttactgggcaaaggtcactgatgtgagaaaatatctcaatccggcaaaagctcgtcacggatggatgttatctcaatcgggccgaaaacaaagcccgtcacagatgagtatgaccagtcaaaccagcgtagttaggagcccgtcacggatgactaatctcaatcgggcacacaactaaacccgtcacggatgagctgtcatctcaatcgggcatttagataaagcccgtcaccaataggtttgaccccacgtgtggagtcaaactagtcccggttcggatgacttatctctaacgggcttgaccctacagcccgtcacggatgacatatctcttttgggcattactaaaatgcccgtcaaggatgagtttggaaccaaaaaaaaatttataatttggctagcctcaggcctttgctagccatgcccgctgcaaaaattgacagaagcacatttatatagttgttgacaaaaaacacgaggcctcggagatctgcttaactccagtgcaggtccaaagctcgccttcgaatgtatgagcatgccagttgatttgatcctgtaatcaacaagaaatagagacaaagaattcgtggttaaatctataaatgatagccgatcggctaggtgccgatgacatatcatttatctttgagccgatgtcatatatgaatcgatcggcggttataaatagacagtaaggaactaaatctattcgatcggccgtagatattaacgatatatagttcttatattaatatatacttaaatcaagtaattgggatagatcggtcaccatgccgagacagtataaatcacttagaccgaaatatatattaataacaggattatatatgtttatagcatagccgattagatagatctagcatgtatcggctaatactccgatactactctatacaaacatatcaagacaagtataatataccaaacaaaggcttaatatacttaaatgcactaagatcttgacataaagggcggatttaacatgtcactgaggcacatagatcgaatatggttaaatcagatatgattggctgaaactccgatactaccctaatcagcaaccagaggataggctagagattgatattctaagcacgacttaatagatcaaactcaactgatgcatcattaagtatgaaaagaagaacaatatctagacaatcaagccgctggatgtttcataaagtggtaaatatcttatataatctaggacaacgtcgctatttaacctaatcggctgccttctattaatagatgttagccgattgtaggttagatgacgatattgccaaagattatgtaagatatatgataactcgacgaattatataggcaagattagagtgtcataaagatggaagcactaatcttgagaacacaagtcgtcataacaagttttacctcttgttgaagatcgaaactgatgcagctcaacccgcaagcaagaactcgttgaaacaaaactaaagcgaaagggtggcgatgcgccgaaattgtattgaacgtgtgtgttaaaaattacatagggctcggggtctatttatacccgagaattacaagatatgtccataccggacacgaccactatctctaacaaactctctaagataccataaatctttgcggcagacttttacccaaacatatctctaaggaagttacataaaacatcctaattaatagatacaattgccttctcaggactctatccatgtgcggcaatcatcttgaagcacctcaattcaacccgatgtcatacaccaaattatactgtcggaatcggctgcatcggcttacctagtccgacctagacccagccgatcctaatcgtagccgatctggacttctgccgattcttgctctgttctcgaatcaatctccgccttcgactccacctggatctagtctcctcttccgatgctgatattaccaaatttggttgttaacacatgccccccaagtccgggatatttgataatgttccggatttgccgtgtaccgactccgagcaagtttcgcactctgctatttttcgaccgttattctatcgctttaaataccaaccgttgccctcgagaaatctcacgccgtgacttccgttttcaccgctcaagcgaaacattgtccttt

SEQ ID NO: 60355 - DNA, 691 bp, Oryza sativa
tgaggaattccacccaaaattgtcattgaccctaacaattccaatatatgctatgtaataccgacacagttatctaatgttaacatgaaccgcaagtgattatttactcgaacaaatcgttttcccagcgaaatcatatggggggataggatagtgaaattacttggagaggatttgggcatcgagatccttgcggatgttgaaagcggatccgtagatggcttccgccccgaacctcttcttatccgcccagaacttggcctcctgcgcgcgggcaagccccaccaccaatcacccggattcagcgcgttagggttttcgagggggcgaggagaggggaagcagcgacgggtaccttgtggacggtggcctggatcgggtgctgcggcgcgaggtcgcccttgacgctgttgttgaagccgaagcggagcacgtcgtggttctcgccgacctccttcttcacgatgctgccgctcgccatcgtcgccaagctcttcctcttcttgtgcttctttggggagaagaaaggggcgcgattgacttgtggtgggccaaataaaaacaaaacgaaaatcaaaggaccgaacctaaatatcggttttttttcttcggtgttcgattcggtttatcttggacccctttttattagcctagttgtacaatgcaccagggatttaccaatcttttcact

SEQ ID NO: 60356 - DNA, 18424 bp, Oryza sativa
ctatagttgtgattaaaagattatggccagcttgtttgcaaccaattttatgattataattagggtttttccgttgttttaagttacttggtacttttctaatgctaagaatagacgtgcaagtatcaacataaattattttctattgcatcggttacatatcttcagcttataaagccatagcttaaaaagatagcttccattcagccttgcatcaacatcgaaaagacataatctctctctcccagaatataagaagttttagggttggacacggttattaagaaagtaggtagaaatgggtggtgaagggttatgattggatgagtagtggaagtaggtgggaaaagtgaatggtggagggttataattggttgggaagagaatgatggtggagaagttgttatattttgggacaaatcctgggaagtagtaaaatactttgtggcatgtgtttactgggtactccctccatctcaaaaaaaaaactcaacctaagcggcgatgtgacaacaatttagataagtggcgatgtgataacgaatttgtttagattcgttatattgggagctcttataggttgagtctttttagagggaggaaatacattattgctgatcggtgaaactcttgtggattcgacaaactaaaggaaacaatccccaaaattgtggtagccttgcaccttcttgcaccttattgcgtcctaggctcctactcctacactaccactctactacttgtactagagaaatggaattggtataacagaagcaggggcagtacagggtgcaggtaagccaatttattgaagcagatgctacctacctcttgttggatttggcccaaggtgcatggagggagggtagtagctcagcagcatctcatctcattcattgacacacctttattattacaccaccattgctgctgctgctgcctgctgcctgctgcatctcttctcttccctttccttctcttggcttcccttcccttcctaggaatgccccatgagtacaccaggtctacatccacagctccatacacctgtgtgacaatagacaatagttaagttgctgaaatttcaaaaagtaatataattctagcaatgtttcacttcaaaaaaaatatataattctagcaatgtgacatcttgcaaacaccaaattaatagcatagaaaagaacaacattttgcctaccgtttggcctccgactgttagatccatggtgtgacactctgcgactgttgaacaattgcacttagattgatacaagggacccggccacccgcaattcagagacattagccaaggaggcaataacacagcctatttagtgcaagtactggcaccaactacatgttactatcttcattttgcaatgttgttccatagactaaaaatatatacaagaaaaaataatgagaaaagacaatgtataccacctacagaaacatactccgtataatataatcgccaacctcttacaaagcatttggttacgggtaaagagcaaaataaattgcaacaataatatattggcattggtcttctcagtagacaaatattgagatggataatccaataccataaacaacaaatattgtgaaacaggagagcagtaacatctgatgttgtagtgcatgaggaccgggtccatgcacagttccatggagggaaaagagggtgccattactgatgaggaggtcctgcctcctactagtactcaactgtggtggcctggtgtttgtagggggctggctggtctggtgactcgcgaattaatccaggtcacagaatgggttttattaatagtctacgtctaatatttataattattatccaaacatccgatgtgatagggactaaaaagttttagtcccatttaaacagagttaattaggcttaaaaaatttgtcacgcaaattaactcttatttatgtaattagttttataagtagtctatgtttaatactctaaattcatccgatatgatgcaaattagcactggaattggattggattggatggtgtaggaggaggagagcatgagtggttgttgatgggtgcatttaagacttcctggccttgacaaagataccagatctctgtactatggggactggccactcagctgcctgcacccaacaaggaggagaaaactaacctaacctctgggagttatttccaccaatcaattccctagctacccacttttccatgctccacatgcaaagccgaaggccaggagcctcagggcacccgtaatagtaaagtaaggtgttttttataaaatatgtatatctcagcaatagactagattaatagtaaaccaactcaatagtatgtctgcatgggtatctatagttctctaatccattgcctcgtttttctctatagactatctctaagttagtagatagctttgctctctctctctcttcatttaatctattccaaatagtaaaatatgctgacatggatctcttgtagagagcctatagataatcattacgggtgccctcacctcctctccaatctccatcaatttgccttgcctcctcttcttctcatcagtagatctgcatcatgttttggagcatttcttatctgcaccacaaatgaagaaacatggctgaatgtgacacatatatagtatagggtgacgtgtttacatcaacgcataagcagttttcatgctaaatagctaaatccttgcatgccagagcaaatgacagaaactctgaaagcacctgctatgaaaacaatctttcaggattgttattgtctcaattgatcgctttggataccatgcttgtagtactagttctctttttgatggagcagataagcacttttaactgtagtagatctggtggtattatctttggactcatgcaacagaaagaatgcaaagagtgaggtttcatggcaccaaaaggggggcagctgactggaccggagtaccacgaaaaatattctttagcactgtaatcaatgtcaccaccaaaccccgaatgagtttacaattcttaaggatacatcgttggagattaaaccattaaaatatttcttttgtttgaacatgaacagctgagcttactctactaggattacctgtattttgtcctctcaagactcaagactccaggatgtcctcatggaaatggaaacagtccaaccttcctctatattcgggttttttttttaaaaaaaaggaaccttcctctttagaattcaaatattgcagcaagactagttcgaacagtcctgccaccatcatgaccatttcactatacaaacttaaccaaacaacaaacaaaatagccataaaattgacgtaatacactcgtgatgatactgttgtcgcaacagctggatgtgtgaattccgatgcagcaagcatgagtacatggaatactcggcctaccctaaccttacaacatgtacaccaaccaagaataaagtaacgggttaaacaagtgcacaacttcctccatatcaagagggaggggaattaggagcgggaaggaaggagggggtagctcaccaaattgatcagattctcccctttcttgcttcaccctttccctttctttgctttctttcttgcacaatcacacacacaaagacatgctgctgggttttctagaatctcagaaaggagggggagctagcgtggggtgctagaaaaatgtcggtgggtgagcctgaaaaaaagaggaaagattacgggattgtagtagtagaaattaaaaataagatgagaagcaacgtagtctgagtcagagtgagggaataaacactttctatacccattaagcatcgccatgtgctgctgatgtgtgccccaaaaaatctactaacgtggaagtgggtgttgagccattgaagtttgtttccaactcagactttttcttccatcaagcaacagcaatcccttggaccaattgaaaaccttgggctagctcgtgtcccctcctgtccaatagaaggcatgcatgatagaatcaggtttaactcattgaataacaaaggaacgaaaacatagtacatgttgtatattatataaagtacatatagacgaacaacacactaaaaataaacaatactgatcgatttatgtgaacggcatgcatgcatcatcatcgtcctactagcaaaactaacaaataccttattcatatatcaatacacaattatacaacaccgtagatgctgtaataaaaaactttttttttgctgttaccacatacgtatttcagaaagatgtaccatcaaggacacccaccaaatcggaggcgaagaaaaacccctacctatgcgcgcccaactcacgcatctggtacactcaccgggtacaaccaacaatcccatttccaaaaacaaatcgaactgaaaaaaaaataaaagatgaaacaataaacaaaaccagacacagaaaaaaggaaagggaataggacgaggagcactgggagtgaagtatacctacctaccaaatccagccccgtgggggggagggcctttgcaaatggcagccactcaaccaacctccgctcctcctctcgtctcatcgcaccaactcggtcaaatggcccagagggatccgggtcaatggggccctcccctcctctccctctccctcgtataaaaccaaccaaccaccaccctcctctctctccttgctcacgaaaaagctcccacaaagcatcacctgcaaccagcccccgctcatctccatcttcctcctccctccctcgctcctgtgcttcttctcttcatcaacaagagagctttccctcgatctgtgtgtgtatatatatagagagagagggactgatctgggtgtagcgagctaggtagcctagctagcatggggaggtccccatgctgcgagaaggcgcacacgaacaagggagcctggacgaaggaggaggaccagcggctcatcgcctacatcaaggccaacggcgagggatgctggaggtcgctccccaaggccgcaggtatatacaacgtcgtacaaaatcatgctactccggccatggcgtgcatggcggcggcgatcatggtcagaggtcgacggtgactgactgagtgttacctgtgtgtagggttgctgcggtgcgggaaaagctgccggctgcgatggatcaactacctgagaccggacctcaagcgaggtaatttcaccgaggaggaggacgagttcatcatcaagctccatgagcttctaggcaacaagtaagcctccatgccggccatcctgcaaagaagataaatattgtattagctatataagagatagaatcatgatccgatcatgacaacatggcgatggatgaatcgacaagcatattactgatcactgatcgatcgatgtgtgtataataacatatatctatatggtgtatatgcaggtggtcactgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctccttaccagccgcaggatcagaccagcgagccgatgaagcaggaggaggacgacgaagcgtcagcgacggcgaacggcgccggcaatgcagcgatgacgacgacggcgacgacggcggcggtgtgcctgtgcttgaaccgcctcgggctccacggcggcgaggtgtgcagctgcggacgcggcggcgccccctccatgcaggccagcacacacatgtttagattcatcacgccgctaggaggaagccaccacaacagtagtagcacaacaatgacataattaattaagttgagggaggagatatatatacactacttaattcgcaattaaaacccagccacacatgcttagctctttgtaatattcatcaggaaatgtgatctctttctcttttttttttatttcccctcatttgcagcctcggccagagtgatcatcatgcttcatcgatcatcattcatcagggtgacatggttcatgagttagttttagttgttatttctttcttgtcttcctctagtttcttttaacccatatagatagttttttttagggcaagacatgggttgttgatgatctaccattagatctaaacatgcccttttggagacctcataagaatgcatcactcaacacatagctttccaaacactttatttccctcatgcatgctagtagcccttttgcaacttgtttttatgtctccttttatatggagatgctcttgattggccaaagatgagggaggtaaggagtgagtggtacatactgatgaaagtgaaggagggtgcatgctgtggttgtggtgctgctggtggttatgggaagttaggtttcttgatgaatgtttgcaatcacatgagcagccagtgagaaaaggaggcacagtttttaaagaaaaaaaataaagaaaaggtttgtcttgtagatagagaggagggagatcagggggccaggggggagagaatggagagcatgtgagatgctctctcttttttgggggggttaggttggtaggttggtagaagggatgggagaggtgttaatgaaggggataaagtgccatctaggagggggcatggattgaggagcttttggttagttaatgacttaatagtcggagcttggctcgtggtttgtccttagtccttgggtggatgctggtaacaggtggaggtaattagtattttaatcatggatcagtgctatagttagcacttaactaagctagcttcaggcttttctgaagaggagtgggggcccaggaaggatgatcttcagagttaagaggattaagcacaagcagaatgtcagtggtctccctcactgatcactctagtctcatcctacctatgtacactggtggagaaaccatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcaaatgctgtcaggacctgtcaggcccccccgggatctttagtcccggttggtagcaccaaccgggactaaagatcttaactttagtcccggttggactaaagatcccggtgatctttagccccggttggtgctaccaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaagactgcgaaagtgaaaaggaggcccataaattggacaagatgttggaggaccacagaaattcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttaacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttgagagatgagcagtggccatagcacttggcccgttacgatgtgtatctacaacctccccccctggctatgcatgaagaggaagtatataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacaattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccatgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcaattgatgcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactacggaattggtgcgactcctaggaattgactattgtagtcttaattagacttagcatatacgcacgaaatacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttagtattagcatgtaatattatttgagttttaatataagattattttatttgtaattagacttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtccaagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaactttgacacattcccaaagctaagggatcactgggacgagttcgttgcatataagacaggtgaacaagggaaggcgatgatggaaagaaacaaagaaaatgccgccaagaagaagtaccatcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacccagctgatggctcactggtcttcggctatcagatacaagaggctgtgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggagtcggatcaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccctggaggagacggtgagacgcatctacgagacacatgccatgccattattctatggcgcaggcggtacatcatcctccctgggcgacaagcggcgtctcgtgcaccatctcctccggctccgccatctcctcctcaggatcctgcaccgtctcctcctcatgctccgccagcaccgtctccacctcaggctccagcatcgactcctcaggatcctgcaccgactcctcctcgtgctcctacacctactcccccgcaagctcctgttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccccagtgtcaggaacttcttcaggggtatgtctgcatctgtcaaggaggccatcaagctatcggactatgagcaaacgctgaagaaagcatcttctggaaagtccaaaccagtccctcagcttggagagcaaccaaaccaggagatcgagccgttggtgaccggtaaagaaatgacgatagaacaatttattactgacaccggtctaactacggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagagcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacattcatatagtttattcgcatgagggataacctgaccacacacaaggaatttatcgcggcggttcaagaacaactcatgggattcatcaacgaagaaatccttgatcccaagggtgaattctactacgacggaaacacaattcaccggtccttagcttctgagctagcagcgagtactactacgtcgaaatcgtagctagctaggacatataatggattgtaattaatacatgactacatatgtttctatatgcatgtgtacacattttctataatgtaaatatattttgttcatatatatatctatatacatatgcatttgcataacatatatatgtataaatacatatatatatatgtatgcatatatatgtattgaaacatatatatgcatggtttatatatatatatatatatataaaccatgcagcaacagaggcatgcaaaaaaaaaaaggtcagctctatctttagtcccgggtgaaataaccgggagtaaagatagcgatctttagtcccggattggtactcccggtttggaaaccgggactaaaggggggttacgaaccgggactacaaagggtttctccaccagtggtatcttccatattgctagatttgacgcttgcatattcctccatgggcgcataattccttgagcaacttttgttttagctatattcaggagcaatctgaaactatacatgggagcatgcatacgttttaacctagaatataacaaagcccagtccttaatattgtccaacagtcagctgtataaaccagaggcaatagctaggtaggatgtgctttctacactttgacaacaatcaggtaccacagggagaagctcaaagttgacaaagatggtcatgatatagggtgtgtttagtttctgaaaaaaattgaaagtttgaagaaagttggaagtttatgtgtgtaggaaagtttttgatgtaaaatgatgtgatggaaagttgggaatagagggaaactaaacacggccatagaagagaactagaaaccatttcaacacatatagttgatatatgtgtccgccaaagtaaatacgcactgattgatacatagaagatgtaaccaccggaggaatgttcatttagaactatgttcagaaatttcatactttttttccggtttcgcgagaaaaatgctatgaaacaagctaaaacaactgttctacaggtgctacttcttaaccaccgtatagcagctttctcaaaatattttttaacacaagattgtcggttaattttcatttatgaaaagggtttgctgcataagcgtagtgtaaaagagtgcctcgttttgttggagagcaaggcataatattggtagtccttttataaaaggagttgaaatgtgatagtgcatcgttctaatcaatcatgataaaatcgtaatagtaaagattttattcttaagccccatattttggggcaaaaggtagattaacgttattcctaaattgcatatgctatctaaaagtaacaatgcatggaattgccaagatccaatatttttcctttatatattccgtaatgcttcacttaaaacaaaagcaaagcacctaataaaatgctgttagttattcatttgtttccatatgtcatgatgtcctagccatatttaataggattcatcctttttccctagttttggtttgcattcaaaatgtgtgatgaaaatatgagcagctacaaactttatataccataatatagaatctacctgttgtaaagactagtcagatatcagaaggctgtacttcagatcttcgattgtgttcactattagtaacaactcgcactaacccagatcattagctagatctaataaaagtcggatatacactagtatataatactaagctgaggttgttagatagcctacctcatttgtttccaggtgtagtgtaagcctctctatgcagacgtaagatgatagaggaactgagctgaaaaagaaaagtcaatataaaaacaataagtcgtcatctcgaactaaatagaaattatgtagaagtcagtatcaacggcaaacacatctcatcagatctttgcaaagcatgcatgtgacacctgcacttataggaaaggaccaacacctcaccctacgctgtagttccttaggtaaaaaatgtttatactcgagatctcaacaatttttgccctggaaatttaatcacgtgaggtagaaaatattcccaagatcctatcaatcggatctaagatgtctatagaaaactaatataaaatagggatgcttaatcgactagttcttgctgcaacacagatttgctttttttttctcgtaaacaaaaagaaaatataaagacatgctcatttcaaagaactgccaaagctaaacgtttgcttaaccaaagaacgtcagtggaaagagtaggtttgtcttgtttagtctaagcgtgtgcgcttatggcccacaagagctggcccaacagcaacctgcggcaataataattaagaaatctaattgtcaaaaaagggatcacctatacatttatcgacaaattttctactaaaaatttgacagatgtaattatagtacaattgtagtgtaattacactgtaacttatatataattacactgtaacttctatgtaactacagtttaacttgtatgtaagttcacg

SEQ ID NO: 60357 - DNA, 964 bp, Oryza sativa
cccattattttttttaagagaacttatgtgaaaaaaaaagaggatcaagttgacttatagtataatcgcacctgtcttttaactgtcgagtgacgtctgaccagcgtaattctttcataaatttgttggccatgactttaattccgtattaaccagccacccaagattaccatttctctgtgtgccatgccatatttattctcattttactagtccttcactgaaagccattagtacggttttgtcaagctgtccatattaaaagttcatttaggcatagacgcatagtagccttggagtatgtcggtatattactccatctcgcaactttagtactcgtgtcatcgcgtggtagcatccaccgcaagtctgcaacaatgagaacatattccactgtcagttctgggttcatgaaggcatgaactgccacggcaaatggtcaaagttggtcagcgtcggcgacttaaggctgaggtcgttgcttgggttaggtattcatccctagttcatgcaaaatgacataactcattaacgtatgattaattaagttttagtttttttaaaaaaataaaattaatatgaatataaaatttaaattaactttcatatagatttcatatagatttttgttaaaaaaaacaccgttcagtaattaaaaaaatgtgcatgtgaaaatcgagtgagttaagttgggaccttcaaacaaaaaaaaactttcatcgttcattggcgattgttgctgtcgatgataaacaacacagatgtgctgaccaactttagcattcccagcaaaaaagaaatatatcgctgagtgaaaagacactgatcaggtggctgaccttactacaagtgtgtgaatggaaattagtgctcactttgacattgtctggagatgatgcctcctttttcgccggactcaagctaggtgtctgaaaccactgaattacgagggtcaccggtaata

SEQ ID NO: 60358 - DNA, 69446 bp, Oryza sativa
caaaaggtttgtcgaagtatccaaccttgttaaggtcaacagttgtcatcccactgtcatcaatcattacgcatccaccagtcaacctaacccattggcgcgggaacagaggaaccttgagagggccatagtcaagttcccatatgtcctcgatggcaccgtaatacgtggcagttgttccatcgtgtcccatggcatcgacacgaacagcgctgttttggttcgtgctcttcatgtcttgggctctcgtgtagaatgtgtacccattgatctcatatccctggaatgtcgcgatcgacccagacggtcccctcgccaggaaggcaagttgttggttgatcgactcgttacccatgagatgttgtcgtagccacgcggggaaagtatcaatgtgatgccgtgtaatccatgcatcggacttaccgatgttcctggcgcgaactagagccaagtgctcctcgatgtaaggagctaccaatgaagagtgttgcagaacagtgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgcctctggacgagcacggttacgaacatacttcttcagaacgcccatgtacctctcgaaaggaaacatgttgtgtaggtacataggcccgagaatacggatctctttcacaaggtgacaaagcagatgcgtcattatattgaaaaatgaaggtggaaatatcaactcaaaactgacgagacattgcaccacttcattctgaagggcttctaatctatccggatcgatgaccttctgcgaaattgcgttcatgaatgcacatagctttgttattgttgcccggacattgtctggaaggataccccttattacaactggtagcagttgtgtcatcaacacgtgacagtcatgagactttaggtttgtgaacttcttctccttcgtgcttattattcgcttgatattcgtggagtatccagacggtacctttatgctctccaagcattcaaacatactttccttctctgccttgctaagagtgtagctggctggactcaagtaatggcttcctttctcctttggttccgggtgaaggtcaccgcgttgttccatatgcttcagatcattacgtgcttccagtgtatctttcgactttccgtatacacctaggaagccaagaaggtttacgcaaaggttcttagtgaggtgcatcacgtcgattgcgtggcgtacgtccaagaattcccaatatggtaactcccaaaatatagagttctttttccacatcgccgcatgaccatcttcgctctcaatatgctggcttccaggcccctttccgaacactactttaagatctttaaccatagcaaacactgttttcccgctgcgatgtttaggcttcgtacagtggtcggccttatgttcgaagtgcttgcctttcttccgtaccgggtggtttgctgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcgttaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgaagctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactctagagtggtatccaactttttgtgcccctgctcgcaacctgggtacaacgaagttctgtggtcctccaacatcttgtccaatttatgggcctccttttcactttcgcagtcttccctggcgtcctgcaacatctgaccaagatcatccgcaacgtcgttaccatcagcagctatttcctcctcgctcgtttgatttccttcaaatccaacatactgagcaaagtccggaatattgtcgtcttccacttcatcttcttccatttcaacaccttgctctacgtgggatgtccaacaattatagcttggcatgaaccccgactcaaacaagtggaaatgaatagtcctggatgcagaatactccttctgattcttacacttattgcatggacaacaaataaaacccctttgcctggtagcttcgggcactctcaaaaaatagtgcacgccgtcaataaactctttggaccgccggtcagcgtacatccattgccgatccatctacatgagtcaaaaaaaccgcacataaataattattcttacaataatgacagtcatacaataattataagatatctttattcatacaaaaatcataaaatattacaccaaataattcttaaaaactatttgtaaagttttaaactaattttaatgtgttttacttcttttaatttttattttagtttgttttctattatttaatattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaaacattggaggatgaagttgcaaaccttttaggcacctccgatttgtatgtaatcacaaaaataaattcaatagaaattttggcatgacctcccctcttttttgaagaaattttgaagcttgctcgggcagctggaggaggaagaagacatatatataggggtgggactttagtcccggttggtagcaccaaccgggggtaaagatcaccgggatcattagtcccggttggtattaccaaccgggactaaagttaagatctttagtcccggttggtgctaccaaaccgggactaaagattccgggggggtctgacaggttctgacagcattctaaccgggactaaagatgatctttagtcccggttggtaacacaaaccgggactaaagatcaaatatgcccgttacccttttgaaccgggactaaagatcatctttagccccggtttttattgcatccgggactattgtggaaatcggccgaccgacgaaagatggtttctccaccagtgcatgaatctaggtgattgttgatgttacgagagcactagtcgaattccagtctgttgcaacgaattaagtctttgttcaaaatattttaatcggttgaaataagacctttcatcttaaattagtgtcttctttttaatagtagtatagattattgctatatttttaattttcgattgccttttcgctaatttgaacttgtatattagatttacggtgtttaaaaagtttagtatatgatgtaaatttgtgaagtaggactacccaatgaaaatttcctagctacgccactgcttgcaagggacgcgaggccgacacggcgggctgctcggccggttggcggtggcgagtggcgacaccgctgttcttggcgcgtcgtgcgttggttgaacgacggtgcggtgggtgtgctccaagacggtgagagaatgaatggctgaagccatttgaggtgtttagcttttgtaaagtacaaatttgttctcattagttggctgcaggctaggtgttccaagtgcttgctggattttagctgctaactgtgttgagaaggcattaactgaaagctatttcagaatcttattccaaaagcctccatctagatcatgataggattggagtaatattggtggttcatatatgtagttcaagtaattcctctcctgtttgaggcccacaaattaagggttagcactaaacaagtagattttaatatgatcaaattattgctcgataatttttttcccgttgcaatacacggacattttttctaatctatatctatctttaaccctacttaaaaaatacgcaagacttccggaatttttttcgttcgcgccagtctgcatgatcaattatgtttccatctattagcaagaaaaaaggggaaaaaattgtatggcaccccatgccacaaagcttgcatggcacctctatcgagatcttgccacctggcgtgcacaaatcttggagcacatctaccttcaaaaccgtatgaaactaattacttcctccgtttcatattataagactttctagcattgcccatattcatatatatgttaatgaatctaaatatatatgtgtgtctagattcattaacacctatatgaatgtgggcaatgctagctagaaaatcttataacctgaaacggaggtagtaactggctatcgctaatctcgcacgcggaaggatgccggcagtcgcgagccgcgactcacacacgcaggtggagacgaacacatcacaggaaatagagacggcggcagccgcagacggccgacgacggcagatcgacgtaacgtattactagcacgcacgcaccaacacggcaaaaaagcggcattgcacagcagcacggccgacggcggcggcagcagcaaagtgcacacaaattgaaacacggcagcgacatcgactcaatcgatcgataaatttaatagtttggaattaacacatgagagcagaactaacataaatattatttttgatatagtttgtacataaagcagagtattaatgaaatattgtgataaaaggaattgttgaatcacaaactgaatcattttcttcattcatgcaatcttcaaagtacatcaatcaaaattatctcacacactaatcattttcttcattcatgcaatcttcaagattctcatcatctgaactgaactgaactgatgatgtgcagtggcttggtctttcatggcatcgtcagcgaagtttgacctcgagtcatgatcgatcaacccgcgcacctctgccacgcgatcaatctgggcagcgctagctccgtcgatttccgccgtgttgctgcatgcttccgcgtcgccgttgccggcagcggccgccctttctggcacacacgtcgtcgtgtcgtcgccgccgccgtccgtttcctgcccgtgcgtcgccgtcacgcgcatcgccgccgccatccttccgcgcgcgcgagattagcgatagcccgttaattagtttttgccctagtatggttttgaaggtagatcagtgctccaagatttgtgtacgccaggtggtaagatcttgataggggtgccacgcatgctttgtggcatggggtgccatacaattttttttcccaaaaaggggcgtgtgaatcatgaattcatgatcaacatccattaatttggctgtttgtccttcctcatacggcctggattggcctgtttttttaaatgggctgctactacaatttttcagagtaattgggctgtttctgtccctcctcatacgggctggattggcatattttgtaacaggctgctataatttttcagagctgagggtgtcctaaatggagtatgttcacttgtaatccctcaacttcacatcgagtctatataacatccctaattcccaatacttaaaatatcgacccctaaagtgttccaaaccgttcaaaataagtcccttggcagtatagaccatattttctcgatttttgctaatgtggcatcggaatccacttcgcagtgacccttacctttcttcacgagtcaccccttcacctctctctctccccctccactttgtgcccatctcattaggcagcggccagtggcgggcggtgtggaagggcaactggcagtgaccgctgaggaggacggcaccggtaacagtggcagctctggctccctcggtcgcttgcgaactcatcgccctccaccaccacccggcctgcacatcccaaccaaacctcgccctgccatcgatgcctcatgccgcctcgagcaccatggcctcccgcccgtatttcacgagctagagtgggatctcatcatggatgccagtgtcggcagggtggatgacgggaccgccagcggctgcggtggcgtactggcttgacgagctcctccctcgcttccgcctggccccgcactcgcgtcttgttggtgattggggactctgcaacggcgaggtcggcatccacaaggagctcgcctccggatcctccgctggcggattctccggcggcgcgattggcctcaacaacttcatcgccgagaaaccgccttccccaaaccggcccagaagaatgggctcgctagcagcggaatgaggtagtcgagtgtggtgcggtgcgacggccgccgtgtggacgttcgccgccgcctccgccgagaatacgtgggtggggttagctgcagcttcggtggacactcgaggtagcgtcggtggcggcggcggtgctcggccaggctcttcggccgcctctaccccctctgttgtcgtcggcctcctaggctggctgaagaaatgagaagaaaagaagagaagacgctcgaggcggtgttggtggtggcggtggagcttggacggactcaccagccgcctccccctcctacccaggctcaccgggcgcttctgccccctctgccgctagcactctccttgctcgctgaagaaatgagaagaaaggaagagaagaaagaaaagaaaagagaagaagaaaaatataataaagaagatgcggatcccacattttttcttctcacttacatgtgggtctcatgttttttcgctgactagaatgccacgtcagtaaaacctatgggactaaaattgcacggttttatatagtataggggtgaagatttttgttattggagataagggttatgaaacaaattcgacacaaaaattagggacgattggtgaacttattccgtcctaaattaattaatcattccgggccaaggtatgattgattccttgaaagttggaaccgtatgagcccattatggtttgggttaattaacctgtaaatgccataataaattgaaacattgtataaatacactacactgaaataataattagccataaatacaaacatccatactaaatacttgaacccaggtggataaggttcaccaccatgaacttaccagctgagctatatcgaggcgggaaactacctggactcggtggcggactatgccattgtaatatgctaaaaaaaaaagttttgaattgagaaccatgtacatgtggcatctgacaattaccacatataatcgatttttgctttgaaagttttgagctaatcatctaaaacactccttatataaccaactgcaaccttcttaacctatatattgtgtatcaatttttttggttttcgcttgtacaataattttaattttgatcccgtaacgaagtacgggcattttgctagtacatacaataaatgtggttaaatttcataactatgtacaaaataccgtcaaacatgaactaatggagatagatgtattcgtctgatcccatggtctgccttgcatgaattgttgcattacatttttgcattgtaaattctgtcttatggctgaaatgaaaattcataagttaagtgattcagtcaccctaaagtctaaactcaagtagttgcatcgaatgtcttgatttcttctctcacagtgatcattagcttcctgtgctgtgtgccctcaaacctcactgttcactgttcattgctataagtagctagctagctggagataagttgctaggtgctaaagcaaataaagagtaaacaaattcattctcatctttcctcccatttcttccctaaagaatcctgtcagtgtccagccatctcctcattgtgtttggttcacaatgtacaaccgtcctagtgtcgcgtggtctaacgatagtaaatttacaaggaaagtatgtgggtaaaaaatattaatattttctccagtgtcatgaactcacgatatatttttaacaaacagacgatgagtgttgttatttcgtaaatggttcacgagattcctcagctcagactctatttgatttgaattcctggttggtaactgaagaacaatgtaccaatcatgtgttcttcagccagtagccttgttcttataatttctgaagcagccacttatagccatatgtttgtgaactgaataattccaaagcaaaattacattgtctggcagaacaaaacgtatttacttaaggtctgataatgtggcctgttcattctgaaattgaggggacatccttgcccatcatctctaatttcactctaaaatggaatgaagaacctatattacaacaccggttgcaagttgtgtcattcaacattgttaatgttggtgtagaacttaaggattttgaagattaaccactgcgaagtgttaggaaacgataagcgaacaaacgataaaaaacaatagatcaatcacagaatacacgagatttaacgtgaaaaccctcccaaaacaggagagaaaaaaccacgggcgccagccagcaaaatatcttcactatatctggggtaaggttacatcgccgcacggtggcttacaagaggtatatatatggtagaaccctaaaaaggatgacgatccatttcgctccggcccaagcctcccggcgacgggcctccgctccactacggcagaagctggcctttattaagtgcaaatgaatttggatcacaactcaacacgaagaacaatttaatgatcagtgactcagtgttgcaacgaaccaaatgctagggtcaaatctacttgctaaacttatggcaaaggtgtggctctgaaccaaactcccccttaatgccttttccctgacagaatctgttcacttttgtttttgttctatgcattcctttttatgtaacctatgcactttaagcagatactatcatatcttaatatcttaaaagttttaagatattaagatatgatagtatctgcttatgtaacctatgtaaaagttttaagatattaagatatgataatatctatgcattcctttttatgtaacctatgctctacaagttgctgaattttttgagtttgtcaagagaatgaaggaagcttcatgaaatggaaacatcaatgacaggaaatccaacaatcagcaaatcttgcttccttgcccagggggcctgtcgttccttcctgacaggggtcgcttatctgaatttaggctgaaatcacttactgtttagcaccaaatagctggaggcactaggcagtctaatattccgcagttagtatcgtcctttatttacaagaaaacagtaggagcctctcctactgtgttagtatcgtcgttgtaaaagcagctcatatcctccaaacattcatagatactgacttcaactgtatatcagctcagttcatttcttcatatttatgagattatctgagttgaagatcatattgaaatattttccaaaactattatcttaatttgtaataatctaaattatcatcaagatggatgggtgccagaggtaggatttacttcatcctttaattatccgtaggttgttttgatggttgtagcattgcactaaaattgcatctgattcttggtgatccacctcgtatgttctgaactttttgaaaggcatctacagactgtgcagtccaatcttcacatgaatacaagaaacaaagtactactaggctttgtagtcaaggtatcaagtcaggttcatgaaagatgccaacaagtaaactacaggcttctcagtttgcttccaaatttccaataggtagtgtacctggttattgagtgataattttcaggtcttcaattactgcacatggaaaataaacaggaagatgggaaagtcctttcttactttgtaatttttttaaaaataacattgtaattctttctaaaataaaatacagatctcttctgatgacttctggtattttttttttcactgcaggtagccaaaattctctggttggcattacttctcaagaaaaatggggaactggttgcccttactgcacacttcgacacatgtgagagcactctttataacaaagtacttattcaccaaataaacaaatttactctttaattaccagacgttctcttgttgatgcacacttgcagggatgtgatggattggaaagaacaaagctggataagaacatgcatgaaactatgaaagtgcaaagctggccacacgtcggaatcacaaaaatgcctccttgccatctcacacagtgccaaatgcaagcacaagcccagatctctgacaatgtacgtatctctacgacccatcactgtactatccttctagtactgtacatatatcctgcatggctatctacctgacctatcatctcatttggccctttctctaatcctatcctgacaaaaaaaagagttgcacaattgcatttgcctgcatcaccccattccaatccttccttgccattttgcaggtcgcttttgagtaaagattcttcagcatggatctgccggcctgtccctacacacttttgttgcttcctgttatcagtggtcagtgccattgataagtgcattgggtgcctaattaaaaactttggcaggagggagagacactccaggacaggcagatgcaactcatcagcgactagtagctgggcaaaaaaaataatcttgcatctctccatgaatgatttgtttctgcatatgcatttgctgcatggcctacatgcttttcaccagattcatacaaaatttaagccaatgcagagtcacatcgccattgtcttcttgtgtaccttgatggtgatgaacaagttaggtatgtggtgcagcgatgacaacgaagctgccaaccatgcatgtttgggggcaggagggagatgtggagccgcaggtagaagctggcagctagcaaggctgtgctggcaatttttttctattaattactctaaatcggctatttaaattactccatacattctaaaatatagcaacttctaatatttaatatttaattttttttaagaatataacaacttcttcactttgctcactcaccatataacaacttcttcctatgctcactcgccttaatcaatcacaaccattttctcaccctcctttttatcttaatcaatatgaaaagaaatagttcaaaacggtagtagaaatcaatataaaccgttcatcttttctaattcaatagaccatatctatttacactgtcatctcaattgttagtagataaagatacttctacaaaaaaattttagaaatgcttatattttgacaaaaagttggtgcatactttgcaagtgctttttactggaagttctactcaaggacaatataattaacttaattgtattataattttaaatttttaaattatagttatgaatatattatttgccttaatacttttcaattttaacttaataattctagaatttacagttaataaatataaataagttgtaattgttgccatgtatgtagtcttagttttagtcttttctagattaaatagctccattgaaaataacaaatacaaaatcgtgtttgatttaattccttatagtatgttgataaataattaatcaagtcctggtcttaacttgatttggggtcttaattatgttgtttttattattcaataactctgaaatttgaataataaggactccctcctttcaaaaatataaccaacttctaaaactcaaattttattccaaatatagcaatcaaatacttgtaaaagtttacttttactactaaactacgtatactaccccccactatcatttagctttattataccctcaactactctgagcctattcctcacccatcccgagtaggcaaccaattctttttatcctgctacttaatatatacccatacccaaggctaaaacttgctatattttgggatggggaaatatcaagttgtatttgacttaaagtattaatttagtgattttggaaattcaaaattgataattgcaagtcgtatatgatataagatcttattttgatttgagctctcacctatatggatggcttgatttatttattgcttcttattaatgtgggaatttgcttgaagtaccatatagtactatagattatatatatatatatatatatatatatatatatatatattactaaattatttttttttgaaaataaacatctctcctatcaatatatatttgtgtgcataagagcaggtacaatagcaggctataaaccagctgcaaacatattttaaggagataaataaggagagagaagagcagcgggctacagatttgtagccagctgtagtacggactccaagacacaatgtgtgtatgataagtgggaccaggtattaatagtgtactatgtaactattgtatgaatgagctattagattgactatagataaagagaaaatcccttatatacccctgaaattttacctaatcccttctatacccttgaattttgcttacttccttgtgtacccccaaaatttgattttgatcccttgcatacccctcccgtcagttgactgttagttgactgtgtattttctataaaaatgaccattttacccttggatgaacaaagaaattcatgaattacattattaaaaatataaaagcttctcgcatgagactattatagttatgagtttgttgtgcgatgtattatttattccaaaaaatatttttagataatgaaataaaaaaatacgtatttatttttttaaaagaagtcataaaaatgaggagcattcatataaagataggactacccatgttcacaacattttttttatgaatgctcccgataaaaaaatccattgtcttattaaaatttcaaataaaaatttaatttattacatttattttatttttaaaatttatgtcaaaattttctgcactaattatttagtctcattagttttataaaatacacatactgtgcactcaaataaaattttcaattgtttttggagcttatatttaaacctaaagcatcaagggtaaaaatgacatttgcaaccaaacgtaacagtgaaatgatggaaaatgtaacggtgggggcatacaaggaatcaaattgaaatttcaggagtatagaagggatcgggtaaatttcaggggtatgaaagggattgagtgaactttcaggggtacacagtaaatttactcatagatgaattggagctagtagttggctatactattaaacttgctctaagatgcgtaccttttagactcatagagtgcttttcagttggaatataatgacattaacttcttgattgcttttcagttggaatgacattaactttttgattgagcagttacccatgacgttttgaactatttatggaggaaactaactagctagctagtgcaagatcggtatatgctgcgtagaattgatcatttgactgtcttcatactcttttggaggaatattctgcaataaggtgagatgctgaagctaataaccatttcagacaaggctaatgcatatggtaatgtggggcccagatgttgtaatggcggcagagatcaggcgctaaccactgcatcaaaaatctgaaaattaattaagcatcggtagcttacgcaacagtgaacagaaaacctgacactcttatatatatatgatttgccaatgtccactttatgcaaacgttgactgtcatattttttatggcactatgttattctacaaatttttgcagttcacatcatgtcgtcgtccctgttaattattagaaaatcaaacaactcatgtttagtactgaagataaaatacacaaagcatgtgattgaagacattagatggatatgttcatgaacaactggatctagcaaatatacaattagtgtgtcgacattctgacttgtttgcactggtgttgcgtgatccatgcatctcacaattaattgtaactgatggtgggtgtcagcggtataattctctgacccggttgatagaagatgatgaataataatacgtggagtaattaattaaattaaaacaacgacgactagcttaataaacatataattgacgaactaattaagttgtattttcttgtgaataccatatgtgataaggatgttgctgatctatatctacaggtactgtaatttcttaaacacatgggtagcttgtgtacaagtatatactagtacattactaatactaatgggtagcttctttttggcacttgttgtgccggttcacagtgccaacgggaactatctaggaccaatattgatatgtttggaaagcagaaaaataaaacagggaaaaatagaaatataaaacaaaggaatgtacgtgtaaaatagagaagtagagaaaacaaatgaatttagttcgctggggggttgtggatggttacaaatgattcggtgtttgaaaacatactcgtgaattatccttttgcaggccatttaatttataaatctaaatcctttgcatagaaatggagcatcctgctaggggaagaagatcaagtgcttttggaagattggtgtaaggttatccaggagaagttccagcaagtgagaccacgggttctagctagtttcccttcgctccattcctataatccaaactgtatgctatagtaaaatttactgtagtttcctctaggttccttccccctcccctccatttatatccttcaatccaaacagcaagatgcagcagatgagtgataataatgtgagaaattgcatatatatgcagttccaatgacaatgagtaatagtagtaaaaactgttgtctccagaatgtctgggatttagcaggcagcacgagtatctcgtggtagggtgtaattttggcaatgcattgttgcgctccatgtgccaaacccaaaaaacttacagagatctctctggcatacatcgatgttgacaaaaggtaatgatcaattgggcttataaaaattttacttggaatatgaattaatattcctaaatataagttttagcaaaccctagctaattggtgctaatcaattaacactagcaatcttgcacactgcctaaaaaaggaaatcttgcacactatctaacgtattgagatacagaaagtaattaaattgggcatatgtatatatagaaaatacagagatgtatatgtgccatctattttgtagctggctgattttgaatcagctattcgatttagctactaactaatttttcatgaacatatttcccgaatggatgttttacgaaaaaacatttaacatagaaatttgtaatagttaacatgcactcaatttatcgtgcactatataagctgcctaggagagatattagctggtactcccctattcctcgaatcctagttgagacgagtagtacgtgttgttcttgctatataacaattttgtttagagacattatacaaatacaagtactcacagtgtgcgcgcactcatcttatttctatgaacacacatacatacaccctacctctatgagcatctcgaaaaaactaagctgacaaatcttgcgattgacaaagtcagtatggacaccttgttatcaatggatacagtctaccactgaaaaaataattagccgtaaatgtgagcacctgtatctaaaaattagaacttgaacccgggtgtgttgattccaccacaagaaacctaatgaattgagttacactcacttcgttgctacataacaatttgttcgtctatccaaatacttaattatatttattttatctaaggctatgggaaaaggcaaggttcgtttgcgcgcatttaaaaaagttacaatatgttctctcttaaaaaataaacactgccacataaaccttcattaatgtttgttgagaagattaatcagtgttggttttctaacaagcactacttttcggttccccaaagagctctactctttggcattgatgagtgggtagcatttgtggtcggttataaaagagttcagatcgggagaatcggctcatttgagccaatgcttcaagcgcctccccgatatccacatacgcatccataccccctaatcaatccttatatagggcttgttcgtttaatccctaagagatcattggaggggattgatgggaaataattccacaccataacatatatggaataaatcccctaaaaatcctcctcaatcccttagtgggagggattagccgaataaggtctcaaagatcaatacaaacatgttcattacatcacatataacattacattgattcagtactaatcatcattccccattatcaagaacaatatttacaatatcgtaccgccttctccccctcctcttccctcctcccctcagtcatcgccttcttctcctatagctcctacggtcactacacaccagatcctaaatgtaagcttgagcaggccgcactggctagatccgctcgcactgagagtggggatgggagccaagtcacttgcctgtcaagccaatatagtcgatctcaccattcccgtaaagccgctcgatctcccttgccagcctgccactccttcatttcgctcggtctagattgagagagaaaaaaagacaaatggcacatgtggagggctgagagaagagaagagggagccagcctagcggtgacgatagtgaggaggacgcgcgatagttccatagagagaacgagaggatttagtgagatagacagagagatcaaccaggaaaggatttttgttggccttcaaataatcgatcgtccggctagctcaatcggctcagctcagtgcaatacccatctataccgatcaatttaaaaaccgacagaagtctcacagtgtcggtgtttttaatgtatagagttggatttttttaatgaaccaacactgatgtgatgcatgtatcggtgcctgttcttccttgtagagggtgtgagccgtatgggtggatagaacacccttatcagtgcttttctcaactaaaattaatagatggtacgagcgaagcgagcgtagctccactggttaagtttcttgtggttgaacgagtccacccgggttcaaattctagatttgatacgggtgctcgtatttacggctgattattcattcagtggtagacgacgtaccgatcgacaacgagacacatgtggtgacttggtcagtatcaataaatgccggctcagtcttgcggaggtgctcataatgatagggtgtgtcataggggtgactgtacgcgtgttgtggacatctgtgtttatacagtgttttagaaaaaataggacggtacgatttaacagttgtgtagtagtggaaaagagggttaatttatcagtggagttacctcatcactgttattttttcttttgcggtgactctcatactgacagtaatgtgcaacttgtgcaacgcgtgagcgaagggcggcgtttgaaaagaaagatatcgtcacgtacgatgtgtatcaaaacgtaggtctacagtaccacatgatcgtaagaacattatcgctaagaaaagataatatgagtaaaagtctaaaagattgcaaatttgcataatacactcggaaattgataatatgcatatccaatccaccaacttgcactaattattaattattgacagagatcaaactactgctccgaagtctatacagtacactaccgtacgtgtctctagtttctggaaaaaaaggtacagctatagtactactcttccaatactaatatattaatctaattgcttaattaattaattaattaatagtagttgattcatcacagaaaattgaaggacgttggctctgccctgaattatgataaatcatatcgtacatataaattacaaggatacatgagccacctcccctcaaatgcttatatattaattgcacacccttgtcgatcgatcgatctgcgagcgatctggaccgcacaaatataaacgaacggctccgacgcacgcacgtggcatccatagaggatgcacatatacgtacgtaagtacgtatattcacaatgtacgcgtatatacgtacgtatacatacgctataccatacgtatgcatgtcgatcttcttcttctctaccttgggagcgggatgtcggccaggtcgtcgcggtacggcaagggctcgtcgtcgtcgacggcgaggtcgccggcgtcggccttctcggcgtcgacgacggcggcgagggaggagtcggcgacgaaggtgacgacggagtccttcctgatggtgaggtagacgacggcgacgatgtagacgagcatgaacgggaagacggcggcgccgacgagcacgttggcgtacttggggaggtcgttgtggatgagccagccgacgaagctcgtgctcaggaagtacatgttgatgccgatgatgagcagacccaggaaccacgagaacactattatctgcattcaattcaattcaatttattttttgacatacatgacgctaattaattcattgatagcgtcactaaataaccagtcatctttgacgggtggtaacttatatatctttttaacgggtatcgactgatgagcatgcgcaatttttataggtagtatatatatatatatatacatatatatatatatatatatatacacatatatatatatacacatatatatatatatacacacacatatatatatatatatatagccatgtgtgtaataataagaaataaatttacatttgttcaattttgttgtagatcagtttatttatggtccttaaaaaagaattacattttctaatgttgacttgtatgtgtctagaaatgtttaagtagagatacaacgacatacgtaatgatctatgttaaattatatttacattttacttccatgcaagaaaaaatatatatagtgtactgaagaacttggctcttcgatgtctgtaaagatcaagcaagtacgttactgcatgattttgacacatcatgccgacgacgcaatacatgattaatctctggtactactgcaagacagaaaaatgatgcaggacgtacatcttggtcgtcgttttcatatgtacgacgatcctctatatgcatggctggaccatatatatacctgtcctgcattggcccctgctgtgctataatactattgcatgagctaggtagctaatgattcaattcaattcactgcacatctcgatctatattatgcacacactgacctatagaacatggtgtcctgtaggggttgcatgcatgcagggtgaaggaccagctagctagccaactatcatcattaatttatattctttaccaacaattattgaaactctaatttcatgcatggacagatagatgcatatatttatgttacttgtacatttgctgccaattgagattaagaaacaaactataattaagcaatgcatatatatagtgtacgatcttacatagatagagttcttgtggggccccatcttgctcttactgctgctgaacttgagaagagggatgagagcaaacggcagctcgaaggacagtatcatctgcatgcacacaacacgtacggattaggaacaattaatcatatatatgtaattaagcaaacaagaactagcaatgatcagatcactactttgatttgatttaattatatataattagtccttacttattgagttggaagctagtctagctagatggtacactgtattatatatatgcatggtgctattttagatcagattgcaaaaaaagaaaagatacctagctagtcagtgacattttgctaatcagatcactactttgatttggcaataatctaaaaaaagaagaaaaagtgcttttgctctaatgacatatatatatgctcttagtactatgtcactaggtacctagtggataccccactactacctagctagctacataaatccgcacgatcgactgcacacacgtgactgtttgggcatgtgcaaaattaaaaatttaaacgcattaaattttaatcgatcggcgacacgacggccggccggttgctcgccggcgggcgccgccgtatggcgcacgcagtttgctatagtaaaatagtaataatagtaaagatttgctatagtaaatagtaataataaaaatgctgaccgaagcgatgatgatgaggcggccggcgcccctggagccgccgatgatggagacgatgaggctcggcgcgatggcgatggttcttgtcatcaggttccgaagccacttcctcatcctgatgtccaagaaaccctgcacatacatggatcatatcatatatatcaacgcgacatgatgatgatttatcatatactccttccgtcattaaatatttgacgccgttgatttttctaaacatgtttaaccattcatcttattcaataaatttaagtagttattaattcttttcttatcatttgattcattgttgtatatactactactactctagttttttaaataatattcataaaagtttttgcataagacgaacggtcaaacatatttataaaaagtcaacgacgtcaaatatttagagacggagtgagtatatcctgaagatcagtcctttggagtgaaaaaataaatatatattttcgggtccgatttatcccgtaactgaaatacgcttcatatcataaatagattattaagaggaatgagactcgaactagatcggttagcccgccaggtagattaggaaaactagttgttctctttctcaacgttcacttcagaaagaaaattttacggtgcgatgggatatcctattttttttaatataatttatagagtttcgttagcatatttttattaatcaattggttttctaagtatatgtaaacagtaaaatcgctggttattgatgagactgcaccgtgaaatggactagaccaaaagagcggagaaatatggacgaaagtggtaagtagtggcagcaaggtagcgtcttaattcgatctgactttaacaaaaacatatggtgaaatccgacgaggatcgccagattacctaattaataaaggaatattatatcactaaatattcgtgatgtaaacaggattaggtgtgcacccctacaattcgtcagttaacctccataattgaacggattaacaaattaattatgtggcagctagccgtttaattaattatagttcaatcatttaattacgcgctaagctagctggtgatgtacaggtacaggtacagttaagttaattaatttaattaattacctgcatgatgtactgtccagcgtatgtgccggtaatagtggagctctgcccagatgccaacagtgccacgccgtacacgatcgcactcgacttgcccagcacgttctgaaccacataaaaaaattgacgtcacaatttgaccataaattagttactcctcctattcaaaaatataaacatatctaataaagttattatattttaggacggagaaatcgtgtagactaattcggtattattgtggttaattaaatattgattaaattgaacacatacaagctagtactacgaatctgaatagatttctatctgtagtactaggatacgtctaatccatttaaaaatttttaatattaaggagtaggaagtaataatgaatgaatgaccttgagaaggaaggaggaggtgtcgaggctgaggttggcgcacttgtcggcgtcctcttgggagaggttggcggaggagcaggcggtgccggagacggagacgacggcgatgtttatcagcagcgccacgaacagcgcgaacccgctctcgtacaggaagaacctgcacccgtcctacgtggcaattcacacaccatatagtacatattaattattagcctggatctttgttcggtttctttccatgcatgaaaaaattctaagctgaatccagtggtactggagcccgaaattatagaagattagtgctaaaataaaacttagctaataaagtattggttttctatgaaatttacatgttaatttaataaaatttaaacaagatttaagagacaggactagatcgagttcatgtcctagctaccctatacctatctcgatctgcccaggctgaatatagctaccttgattcctctgactgatgccggtgtcttcctcgatagcaccaaggcagaatgcaagaacagattgtggctgcatatatataaatgcatgcagtagttaattaactgattagttgtatgaattaattgattgattgttgcgtatgtatgtatgtatgtaaaagcgtacggcatgacaagagctccgaggagggcaatggcgtcggcggtggcgccgtcgccgttgagcctggggatgaagagccccttcatcacctccttcgccggcggcttcacgatgctcagctccccgaagaagcacgccgccatcacgaacaccagcatcgatatcagaaactccagcttcctcacctgttttttttcaaaaaaaattcatcaatcaattttcatgcagttccacagtcagagaaaaaaaactgaataatgtacatataatatgccatttgagtacttgacaatcgatccaactagctaatttcatatactattccatttttataatcgtttctttgagtgcatcctacgctaatgcttgtgatactaaacaaaaacaacttacaaaaaataatttataccccgtatttttggaggccaagaagcagtagagtgctggtgccggtgatgaggacgccgacccacaccggaatatggaacaatatgttgaaagcaaaggccgtccctataactgcatccaccaaaattaacaacatcaaacgacatgtaattaattaattaattataatcacatcgatctgtacctttctatctgttgatcgatctatctatctatctatatatcacctttgctatcatcatgtgaggtatcttccataactagtttaatttttttaaaaaagaacttgcatgcatgatcaattaaaaaggcaatttacaacggttgaggttaactaatcccgatcagcaaagcttcgcgcagctccgttttgcaactgctacaccactgatctctcttccatgttgctagatagatagatatttagatattgttgttattgtttaaacacacatggatgtatacaggacaggacaaatgtgaaatgacaagagggtgacaaaatagttgtttactaatctgcgtaagatgatgaacgtactcacccagtgtttaaaatctaatcttgatgtgcatcattgacacttttatgggaagctactgtggacgtggtcactcctctaaacagctaaaacgcgcatttgcttatgtttgaaacagattattcaacagatatattattggtacatattatctaccttattatatggatgaattaaatatttttttaaaaaatggcttagaacttgtattctatgcaatatcgcagaatatattttttttagaaaaacatatttactagctagagacatgaaagaaataatatgtgagaataatctggtgagtagctgagaagaacgtggcttgatggtgattggtgagatattaatttgcctatgtttgtggattaggaattccagtatgtaggcccgtacggttggagctacatatgctagccagatcaacttgttttcttctactgtcagagagcttaaactgaattaattaattagctcaaagtcaaagatggtgacactgttaaacacaagtagtttaataaattaattattcaggctggaccgtgtcaagttgttactaataagtatataccttctgggatatctgcagcgatgacggccaactctgccagcagccataggaaaatcttgacgaacttggggtactcactcttgcagatctcagccagatgcctccctaggatgtaaattaatgccggccatatattagcactttatcaagttggtaattacagtttaattgcgtgtcatttagtcacctgtaaccactccaagattagctgctagcgactgtatgataagtgcgaagatgagtccaatcagaatcacccagagcagctgcaaattgaaacaacacaatggacagaaaagcacatagaaatcaattaatggtgcagattattcacttttctcttttctctagatgatgtgagagtgagatacatatgcactggggattaaaagtggttctgaaaagtttgtcaatttggagaatttgatggagctagcagatgaattaatggagtgtgagtctgcgagggacaaggaaagggacgaacacctagaaagcatgaaagttactcatgctttcagtcattcagtgcgtaaacagtaaaataaagtcgactgtacgtacctcatatctgtggttggctccggcttgcagatcggtttccactgtttcattttgtgacaaaattaacagttacaatccagagtttgtcaaaataaaagtttcagttgagagagagagagagagagagagagagagagagagagagagagagagagagagagattctcacaattgccaggatccaagtaggctaaagacaccatgaatccaggaccaacatgggcaaggaaccttttccatgcaggctcctgtacacaatttaccaaaactgagaaactaacaaaaagaaacacagacataattgaggatccaatgttccatcagtccttaattaccacatacacacacacacatgaacattcatgagcaatgaatgccatgccaggaagtactctcaagatctatctacattaagctctgctcttgcttctgcagttacagtgaacaactgtccatggtgacagtggagtgcttacaagaagacaactttgtgataattaaggtagcaactgaccttcattagcagctgatcatctgcgtcgagcttcttggcatcttgatcatgtgccgcactagctctccagctgatgctccctctctcactgctctctctctcaatctccattgttgcttcctctcttagcttcttcaggctaagctagagctaagctagagctcaggctagctggaagtagacgaagaagagaatggtggtagtgacgaactctcaagccacaccctcctgtcctacttatacacaaaccatgcaagtatgcagccaaattaacttggtgtatgcatgcgtcaaatataattttttaagacatgaataaaaaaaggaggaaattaaaagagaaaaaaaatgtgggggcctccatgtacgtacggcgtacgtagagaaagcagaattaagagaggggagaaagctccatttggcatctccatgggcaccaaacagcttcctttcattgagggcatgtcttaatcttttattatccaaatgtgtcacactcgctaaatattcatctgggctgtacctaggggagccacagcttgttttgtcccaaagcatggctagctttaagcatttagttaattaattaatatgattagcttttgtgttttgtgtgtgtcatcactgattagaaagcaggagggttatggtgccagggccactattaatttggtgtggatttaatttggtggtttaatattaattaggtgcaagatcagtgtcattggttgggaaaatagggattttggtctagctagctggctaggttcctatacgatttactactttaatgagtgtgttatgccctgtgtgcaaaacctcttgtgttctagaggggaattgaatgagagccatatgtcgtgcaaaaagcttggtgccattgttagttcatttctagaagagcaagaattaactagtaaactagaaacttacatccaacaaacagagtaattaattttaagatatgcagtttacttgtacactcagagagcaacaaagagctaaggtagaagtcaatactatagttatgacttatcatgcatggatatgtatgctataactaactttgcaatcaatcattagacctgaccatttctatgggtaccctattcatataatatgttagcttgccgataatgaataaggccaacaagaacccaggcaaagattgtgttagttagaacactgtaattgacaatcctgcctgctcattacttaatgatgggtggtaagaatgcagaaaacagtggagttaacctcatcaatttgccaccaagcatttactccatcccaaattacaagctgcggtttgactcgagacagtgctcttcaacaacaaaactttgaagtgtattattatcaataatgaaaccaacatcatattaaagtacatctaggtactagtctaacaataccatatttatatcactaaaccttatattgttagactaaatgttagtcaaaactaatgaagtttaaattttaaaatatatgcgcgccttatatataatttagtacgaagaggagtttatactgttttttgtaaataaacagctgtgaatttttctttcatctagaaaaggctgaggcagaaattaataaaaggaaagggagagatgggagatgaagatgaccaagattacaaagaaccaaagaagtgctatagcgatgtgattatatatatggaggatatataaggaaaacaaagcgcgccacacaagagctagcggtgatggaccatcatccaacattgcaagggacgatggctcatgttctgcagtatctgaagtttcaacgtcttagtggagtactgactttgagggttcagtggtacttcagacacaggaaagcccaacaggatggatagatagcagccggccgtgctagtatcatatccagggtctctaccgatggagatgtgaataatatgtccactgttttgagggctatggaggctatagcggctgctatctgatcgtttgagcaacggctgataaaccttggaaaaattattgaaacatgaaaatggatgaaaaaacttaaaaacaactttaaaattaagttttagaatttaaattttagttatgtaccactgataaactaataagtagatgataagagtttctaggaggaggagaggactgttgggacaacggcccagtagttgtgggagttgcgttcgtgatggctataaaagtaattaggtgattccccgcactttactgcgggaattactaaccaattctaaatatatatttttcaacaatcaactaggagtaaaaagaaaaaaaataataaaacatcagggattatcagtacttatcatgaaacaacaaatgatacatgcgcttaaatgtggaacatattaataagtatatgttaaattttataaaaatgatggatagatttattaaaatattgtgcaaatgatgtgactggtgataattggatatgcttgcatattgatttgtagaattaaataaattatagatgatgttttatatttgcatggggttaaatatataattgttgttagtgggtgatgatgtgacatggttgaatgttgaactttagatttataactttacagcatagatatggcggaatcaaactcaccaagtgtatattgagttacatgtaccgactaattcatttcaaaagaggtaatgagaaatgataattctctaacagtattctcacgtggcatataatttacttagttacatcttacatgcaccaacaaccacggatcaacccaaaaaacaatcacttacttctgcggtcacgactaataagctaggaaagacaaacaattgtgcagcatgaccaccatgaccatgacgggtgagatggacctgtgtccacgacattgtgcagcagccccggtcgtccacgggcacggtggtcatgccaatgtctacgaccggcctctctacacccccttggatgtatgcggtcaatagtggaatgtacatagtcaatggttgtgatctcttgcatttctggggcaaccctagcagccctggcctgctagctcgattgcgtctgtcggtgatatgggcccagggtacccgtgctgaagggaaaaatcatttcccccagccatgtggccgtgcgtcccggatcccccgtcggggggtcaggcgtgcgggcaaaaaatggacaatagatgcctaggggcctcggggtatcccgtcgcacccctcgggcctccactccgaggccctcgttcggctaccacgtggcggccgagtggacggaggtaggggcgctaccaggcgcatttatgggcggcgccccaaccgccccccgtcgtgtttaatgcggcgtggctggtcgtgcgccgcccagcagttagacgtgcatcagtcgccttgaccgggctatgaccggatgggataggtggcagcgcacccacgtcttgccctgtgtcagacagcgtgggggcgggtatgccccgtcccatcaatggcaggggatcgatgttcgaccggtacatcccatgcgcttgagcccacaaaagtctccaggaatttatgagggaatgacaagggatgtccccagtgtcaggcgaaggatggcgctagggcccacctgaggacgagcggccgctttgcttttagcctaaggcatgggtggcagctcgacccaggttgatgtgggcccctctccaggaccgagatgtgtagaggcggtgtatgtggtatccccttgaactataaaagcaggaccttgcccaccgagcaaaaggaggactctggggagtttgaaccttaggagaagactagccaaccgtctctttggggttttaggtctcttgtaacagcataaatagaaatccacacatgagttgggtattacgcttcctaacggcccgaatctggataatccctcgtctacctcttgattgtcatccaccgcactagcttgatgcacggtcaagatacgctctcgatcatcgcgccctatcccctggccgaactcacaaagaggggtctcacgtcctcccgctagagaggatctctcctcgacagcgtctctcccgtgtggctgccacgtgcaacaaccaacatgttttaggctccattcgagatcgagctgaaatgatgagcttatatatggcacataaaacaagcttaagtcaatccagaacgagcagtggagaggtcgttgagggcatcaggactcaggcgagtggacagccgtgacgatggcggctgagcatggtcccatggtgtgacttgtaggtggtgccaaccagcaacgaggaggactaacgtggcaggaacgtggcaggcaaaggcacagccccagaggagagagaaacatcggtagtgagctccgatcgtaaactggtgagcgcgtcaatctatgtttcgggacaagggggttccatttttcctagaatttattgaccgatgtggagcggaggtaggctaacaatgatgttatgaatctagagaaaaggcggccatggcggtcatgcatggcaaagaagaggaaggaaaagttgagagcgaatcctcaccaaggcaatgtggtactactggcacaatggagcagcgagagaagcctagtgttgtaggagatgcacaagccatggtgcgggagtgtcccaatgctcgatgatgacatttcagaacttaaaggcttacatgtgggccccatgtacaaaagagagatagagatagagagatgagaaacctaacatgtgggtctaagctagggtatttcaaaactttcatatggtttctcaatcatattcaaccataaattaatatacaataggaacggtgacgagctgattttcgcgtttacaaagtgctttcctctaaaagttaattcatgcgatgttttataaagctaaaaccacgaagtcacgatgctcggtaataaaattatctatgatctttggaggtcacacaacaatagcccgtgacagatgatttatcatgcatgcataagtatgcttagttgctagctaacttttaacttgaataagaaggcggcaacaagtatccacaaattatggatgttatctaattagctgttctgctcatgatttagggtggtgctaatgggcgggtgatcgcccacaacgatcacccccacccccctaaatacactcctctcccccttcctcctccccttcttctcttcctactacaccataaattttaaaaaaaataaaaaaacaaaagttagaaaaatttatgtatagaaatactatctataaaaaatatttgaattcacattcaaattcaaatttaaatcggatatataaacttttgacttataaactttgggtctataaactttaggtgtataaactttagatgtatagaaatactatatataaaaactatttgaattcaaattcaaatttgaataggatatataaacttttgacttgtaaactttgagtctctaaacttttggtgtataaaatttagatgtatagaaatactatatataaaaaatatttaaattcgaattcaaatttgaattggatatataaacttttgacttataaactttgggtctctaaactttatgtgtataaactttagatgtgtaaacttgaggtgtataaatttactaaaatagaaaagtaatgcggtgctaaaatagaaaaccacgtggaagaggggatgatctatgtggggaggggaccgatcgtgcccagcgatcgatcgccggttaggactttcgcatcatttaatttgccgcagagcatgcgcacatgccacatgttaattctaccatcttcccgttttctgaattccgacgacgatgtgcttgcatatatatgctacaacgataacttccaaattaggccaattgatctgttcaattaattatatgcacgcactgagttaattaactgtatggacagtagtcgatcaatggaatgttcttggtagctaagctaggttagatgagacaattgtaatgcccccttcgaatgcctaagttaattaattagagatatgaataatgtaattaatgtcaacacgcatgtttgtttatttgtactagctccttgaactttgaaagatatgaattgtatagcctttttgccaacaattaatataggcatgtacttgatgaggctgtgtaaaatgtcatgggattgacatatagggtgtgtttagttccttaaaaaaattggaagttcgaaaaaagatagaagtttagaaaaaaaaagttagaagtttacgtgtgtaggaaagtttttatgtgatatgatgtgatggaaagttgggaataggaggaaaactaaacacggccatagtatattcctatagacaaatggtagagtagtccaagtgttcgtagtactaagggctacgagggccctcagccctaagtactcttaccatttgtcacgtagcacggtgtacggtataccatatggtctaaagatacacgtacaacagcttcatgctgtcgtcgaatgggagaaatgacatgcttggtgctttcgatctcctgctcatcgagggcaaatgctttctgtattgagattttgaactaattataacttaagagctatagtttgatttgtttgcagttcacaaccactcctcaatcaccatatatatatatttgataactctattctacatctcctctccccttacctcctagcgcagcccaacccatcatttccccttcgtccctccaccccctctctatccctttcttcctatacagtagaaacccactacaacaattattgctataaagcgtataaagcgtgcaccacattttagcatatcattatttattccgagccatcgttgaattgttctgcatgtctccaaatcaacaatatcgcaaagttgggttggctgccatcaaattttttagccccgcctagatcacgcacgcttctactgtgagggaaaaaaacccaaagcgcatctgcatcagcgatgcctgcacgggagaaattcgcggtgaaccaggatgactgcggcatggagagtggtgacacgtgcgcggctgttgccctatcacctctctcactttccctctcgttagcccgattggatgccgctccaccatgtcgtgcctcagtttatgtctcttctttgtttccttagaaaccgccatcaaaattcatcggaagtaatagcagccaccttttcctcttcccctcttattttattgttctcctcctcgataacgcccatgtccaatggttgttgacatcttggaggtctcctagctacatgccttgctactattttcttgcctgcatgactggatctgtgcgctagataactaatttggtgattgcccaagtttttctttttctactgccactggccagttggggtatgggatcagctcaactttgctttggtcatctcagcgcttattctttcctccatcttcacagataattatcagatagtacgttattcggagtattaatttaatattttgtcactttttaagatgtggcaattaagaatttgtcactcacagtctatgatatgtgggtcctcatgtgtttatgacatgtggacccagtggcaaattcttagttgccacttgtaagagtgacagatagttaattattccacgttattcttgcacgttactcctacatactccatatgtgtattttaggtacaccttcctaatttggtacctctaagtttctatctttttccatatgataaatttaatttattttctttaatagaaagcaaatttagaaattcctaggttgcaaaccttctttttcatatatttcctactgtatagcagattgttttgcaaggaggattattgattcacgctatggtcaatcacgtcaagtaacttgcatgtttttattatctccctttgcagacatttcactagccactagccattagccaatatctatctaatatctgcatcaggtaatgcaacagtctatagttaagagcaaacgttattagtcagatcggttagcttcattgtaagtgtgcacatgtcatttcgatgctatctctctatttgtctgtccaagtatcaactatctattatattggtatttcttcaagtttacggtatagatatgaagtcacgcagcaacgcacagagaatcaattagtctatactagaatagagggagtacatatgcatctttactcacacagagaaaaagttaagtccataacttaaacaagtcaatgcacaaatttcaaacatggtacttaacttaattaatagttgcaagtacatatacctgttaatttatcccacttcaaattgttgtttaatattttctagcttcacacatgttccatacttacatgtgcacattgactcgagttaccagcatttgatgggttttaataagtactgaggctgataaatgggcaagtagtaactactatatgtatctagagtttaattaattaatttggttaggcccacatgccaatactggtttaagagattaaaaataatttctaggaattgtcaagcacatatgaaagctccaagaatacatgcatgaatattatctgttctcatcatttcagatctaagcttctctagtactagaatataattgtgtattcattaaatttggctgacatgagctatgagttactcctaaggagtacaaattaattactgccaaaagtcaaaaaagcatttgcatcccagcttgatggccgcaacatcatgtgttctgtagtctacgtgtatatccgtacgtataaaattgtagagacaaagcaagtagcttacaaattcatcattttcatgaagcaacttgccagaatgaaattaaactgacccatatgaacgggagatgatgcatgtgccaagcgtgaatctcgatggaatttaagtgtacagtgctgactggtaagcagtcatgttcgcctcaaaataaaggaaacaacaaaaggaggagggggggggggggggagaattgttattgggacgatgcgatctaagtactccctgtgcagaagtcctaaaacaattactgtgaacaaggtgaaataaattaaaatgcatataaatcttcctggcaacttgacttataccactaaacttatatagattttgggaagataaatagttaggtaacttggcttttaaagctaagtttccttccttatataccattatccgaaggaaatgttcttcaattgttagtgttatgagttctgttcctcttaatgtgtcttttaggagagttctgttccacatcagaattttatttcttggcatgatttgtgtgcttctattgtacatatccagttgaatcgctcatctgattgttttaaatggaactttaatcggaatggtcagttcatggtaaggtcaatgtatcttgctttaattaatagtggctatattaagagaaataagataatttggaagctcaagatgccgcttaatattaagatctttatgtggtatttgcttaaaggtgtcgtgttaactaaagacaatttggcaagacggaattagaatggtagtttgagatgttctgcatgaaaaatgaatctatccaacatccttttatagattgccattatgcaaagtttatatggagagcagtccagttctcttttagtttatacattcctactagcataacacatattttttatggttggcttttaggggtggacaagaaaaggagcaagtttgtacttgtaggagcttctacgatatatgttgggctctgtggttgagcaggaatgatttgatttttgataaatcatcatccatctcatatatgcaggtaattttcagcgcaacatattggctttgatattgggcgtaactacaaaagtatgaagaagacggagagtttataaaagttgcatatcgtaagcttgagacgacagttatgcaactttttgtcaattatggttggagattcacaaatagacttcaataatgtgttttccttattttagtttcgttacttattttgttcattgggtgttttcaatgttttgttgaactacactcttgattgagtgctactctgtaataattggctgtaactctcttgagcaaagaccgggatgttatattccattatctaaaaaaaaatcttcctggtgaaaatggattgggatcctctaacgtgaagttagagggacgtggtgactgacatgtgggccccaccactcacgggccacctgtcagtgaccacgtcagggagcagttcacattagaggatccggttcctttgaaaatataactgcgtcctagctaaggccatgattgttttaaattattgggtaaattattgctacagattatcgatttgatcataggtataaatcaaatattttaataaataaacttaacaaataacttaaacaagtggtataagcaatgcaatagttttttttataaaaaaagtgttgtttccaaagaatatcaaataggaaatactccctccatcttaatttgataactctctaaagtaaatgacatcaaaaccaacaacattaaaacatccatcattgtaaaaataatccttatcgatcaagctccgtcgcttcgtcttaacaaaattaattcacacattaaatgttgcatatataggttaaatgaactgataaaaattaatctttattggttgcatgcatgcagtacatttcacgatacacatttactctttgcacaaataaataaagagacactttgttagataatgatcatttcggaaaaatctcaaaaatcttatgtgataattaaattgggatggagagagtaatacatttcaataatccagtgatttactgaaaagaaataagtgccacatgaaaatttctaccgcctatactatcagtttatttttttattataggatataatccattcgatagaaagcaactgatggcctattatcctagggtaccgtagaaaagggaaaaatagcacaaattaaacatacatggtgggatcctattagattatattaactgttttaaatatgtttatcatattatattgctcatacaaatacttaattagcatccataaatatatacggacaattgctcgtttaaccgtattttgatgcttaactactaacataatcctactttttaaagtttgctattgaccccgcttttcaaaattgtagctaccttctgaccttgttttcactccaccatttgtgttacatttatgaaaaagaaaaaaaaatactagcccgaactaaccaaaatgtccttgattccgcataaccgtatcccccaaccttaacaaatccatgacccccggcctgacccaagtcaatttggcgacgcagctggcctagcactaggttttcactgatacggagggctgggatagagggagcggtggcgcggttgccacaaccgggcacagagggaggtataggccggtagagggagagcagcggcgtggagcgagacccggagcgaggtcaaggagctaggtccggcgcacggttgctggcatgtggcgcggaggtgggtgaggggatgaagagggtaaggtcactactgccatgcatggaggcatgcgcgggtgaagggagagcagctgcgtggagcaagagacccactgcacgcaggggaggcgtgccacccaggggctcactggcatgcgcacggagttggatgagggggagggtgcgggagctcaccggggacaagtgtcaaggaaggcccaagagagcacgctgtcgccatggctgcccgcccacattcagtagccgcttccccctccatgccagctttcatgagactctagacaatgagttgagccgcccccaacctcgtcgagccatccatagcctcgtcgccgaccaccgtcgttcccacgttgctttgctcggcggctgcgcgctgcttgaacgagagagaaaccgaggggaatgagaaagaggaagaggaaagaatgaaagtctgacatgtgggtccatccatctgttagtgatgcaagtaatttttcgtaagaaaataattcagaaaaagaaataaagtcccaacagtacagatttggttgaaaaaaaaacgagaaagcatgtcaaatgagtaagggtataaatccttgagttaacatcgttaggttgctttgtgaaatgggttaattggatctgtgccattatacattttctgatttagaaaaatgctactccatccatctactttagattggcatatttcaatccaaccatctttcttcttaatgactttctcggatttaatgcgtgactcttcattcttccacataagattggctacatgggcatgggaaatataaatattaatgaatcgcttgtttacgagaaatactccctcagtaaaaaaacccaaccctggatttgaatgtccagattcaaatctaggattgagttttttttgggatggagggagtaactaatagcatgtttaaatatatgataagtagatttacttatatatcctcggtcattgtgccatgatattcatatttgcacaatgaccaatgatatttatgatattagcatgctatcaccatcacattttccatgttctttctttttcttttcttttcttcttctccctgtcagcatgctctggggacgtggcagcgtgcgggcggcgcaacagtaatgtcggtgtcctgattggggcggactggagcacgtcgagcatggttgacgttcggacctcaagcggatcgaggcagtgcagtacggcgacgggcttctaccttctttgacattggttggggcaacgatatatgtccaggacaggggaggtccaggacggtagtacggtacggatcggaggctggtgtggccaatgaagctctgggcttcgtctactgtcttttttcaatggccgccgtcggtaggagctccatgccaggggtggggtgatggggtaggcaggaagcactgggggatggcgttcttggctccggcgatggcctttgatgggggaggatgctcgtcgcctacctcttttttattgatggagaggggcttgccaactagcctcctcgcagcgagaggatggaagaaaagaaagaagaaaatagaaaatgttatggcgatggtatgttttcaaatttgcaaattttcagtggcacttagcggatatcgcaaataatagtggtacttttttcgaatttgccaatttgaagtggtatgaattcaattaacccttatgaaatagggtcaaccatgatcttcgtttaaaaaaaaggtttaaataagaaaacataaaacgggggcgttaatattagggaaggacctaatatcaaataattaaaaaggatgagactttcaattcagatcgtctatcccaccatctttgtacctagccagaagaccgctgggtgtttctcgagaaaacttaaaatagcaggatctaattggacattataacagggtcaaatgcacaatcaccccaaatatatatatatatgtaccattattgttcgcgaataattcatatgcaacgtagtacaactaatttctgacagatagttggccaggcatttaagtttttgccggcagataaatggttttacaacgtgatacaatcattgttttcgtcccctctcggagcgcacacaaaagaatcattgtgaatttgtgatattttattacagtgaaattatgttatgtctaaattgaacaaatgtgcgttcagttctctgggtcttttaaagcatatggacacacatctgaagtattaaacgtagactaataataaaacaaattacagatttcacatgtaaactgcgagacgaatttattaagcctaattaatctatcattagcaaatgtttactatagcattacattatcaaatcattaggctcaaaagatttatctagcaatttacatgcaaactgtgcaattggttttttatccctatatttaatattctatgtatatgtccaaccatttgatgtgacgtttttagccaaaatttttttatgtaaacaaggacaaagaattccaacatgcatggctagtattgtaactctgtaagtcatgggtgacttcatcactgtctctttcgcttattacaaatggaggttcattaactgttttcaattatagggcatgcagcacagatcatgcttgtccgatcatttatataaattgaagaacataattattttaggactcttcaagaacacttcatcagtgtaactaagtgatcgatgactccatcctccaacgttatgatgaatatatgttaattgaagtcaacttatctaaaatatcttgagagggctacatatgtctcgctgtatgtacttgtttgaacaactgtgtacggagacttattttgtaagatatattggccccatcgtttcgctttttttctaataagccaaaacggcttattaggaaatacaaataaatttgtaggtacgtttcaaaaaaaaattgtaggtaaaacttttttacatgtgttcttgatgacttaaaagccaatgctgaaaagaaactacgttgaaaatatctcacaatcaatctcaaaatttaaaaatttaaaatttggctttttcgttagcttaatgggccatccgatgggagcctatatatgtattaattaagccattagtagacagatgtttatcactgaattgctttcaacattgatgcaacctgtgaacactagcacaaaaggctcacagaggtcagcgttataggtgccgaaagtgttaaaagtggcacctatataacttttccctcctccatgagctgaaaacacaagaaagacacatttaaaaaattataggtgtcgattctatagaaaaaccggtacttataatatagatgttggtttttattataaaaaaacaacaactttaatttattataaggccctgtttggcacagcttcaactcctaactccaacttacctggagccaaagctgtgccatacagttcagatcctctgtttttgggagtggagttaacagagctactccttaaaaatgaactacgggggtggggttgggtttttgctgctccacagctccactccaccctaaaagactcactaccctttaatttttaatatatttacacaaaatatgccactgaactaccccttcgtaccccatctcctcccattctctcccctccccatattcctccctacagcagcgacgggcggcagcgagcggtggtggcacggcgcggcgtgcgagagccacgagcggcggcggcatcggcaggtgcactggtggtgttggcacacgggcggcagtggcccgccggtggcggcaggcggcgcacgggaggcacgcgggccatgcgccgcctaccacggtggggcacgggaggcagtggcctgctggcgtccctccggcggcgcacgggcggcaacgggcgagcggtggcagccgcagccacggcagggtgatgcgtgttcggcggtggtggcagtggcccgcgggctgaccggcggcggcggcgacgatgcacgggctgagcggtgacggccgtggcagggcgacgtcaaccaggtgttcgacgaaatgcctacaagggacgtggtggagtggagctaactaatctaggcaaacactttcgtacccacttcaattgctgtaggagttagctctcgctagagttggagttgggagctgggagttgaagtttggagccctaccaaacagggcctaagtgttggttaattagaaaaccaacacctatatacactaaaaaaccagcactcctctctctctcgtcccggtggccacagcggcggcgttctcccctccaccagatctggagggagaggaggcggtggtaggcggttgcacccgaggggaagcggcgggcatcggtggtgccctccccaaggggaggaggcagcaggcagcggtgccctccccttcgccagatccagcaggaagggagatgactacgacgcgctccccgcccccttcctttgctatgctcccctccacgtactgctgctttaggttcttcgatttttatgggcatttttacagcagcggtggtgtcaagcggcggtggtgggtcgagcagcagcagcggcggctctatgtcttatctatctgttcttgatgtgtattttgtgattttgtttttcatggagattattagcttcgatagtaccccggtggctgggaagctgatgttcttgatgttcaggttcatatgttcttggatttttttttgttctaggcgaggtgaaggggagctgatcgatgcatcagctcaaaccgaggcgatacattgagtcgccttttttttaagattcctggaacctcaaaggtgccagttctaaaaccgatacatttaatttctctcatctgtaccgctttctaggtgacggttgaaaaatccagcacctatgccggatttccaaccggcacctccaggtttctatggtactatggtagtggaagctcccgagcaccaaaaaaaacctccagggaatacacaaaagccattcgggagactggttccctaagggcaactcttgtggaactagcagttgggaacttccctccctttgcgtattgcgacatgaagcatctgtacacgttgataggtttaaagaaagcgaaaatgttataattaggttaattctctgtccgaattttatagatataacccagctaatatatatttggaagtaaatgcagttttgaactccatacatgttaagattataggtactgtatacccacacgaacagcttatctaagtgtagataggaggtatagacaatatattaaaaaaataagaaaaaagtatactcaatagtcctcttaactatttcgttgtaccacaaccgagcacagcttttccccaaaaaagaaacaaattatacttatactaagtacactatactacctccatgcgaaacgagagtgtgtaagtccacctcggtaagtcttagatttgatacgggtgcttgtacttatggtaaatatgctttcagcggtaaccggtaagtcctagatttaagcgatgtacccatcgatcgataccgatacacccgtgatgatttcatcattctccagatatactggcctagtttttcgaagagaatcatagaaataaggtgtgcgtgtgtgggtttatcgggttgagtgcgcacgtattgtgagtgtacaaatttgtaatgtatttctagaaaaattatatatattgcctccaaattgtatgaagcattaaagtaatctcattttttttaatgtgagatatatatttatgttgctagctatattatatactagtataatgcccgttcgttgcaatgaaaaaaaattactatggcttgttcgttagttgtgggttgggaacccatctccccgcacagaaaatggaatagtccattagcgcgtgattagttaagtactctctccatctatttttgatagtcatatttccaaatctgaaaaatttatttttgatagacatatttcaatgcaacaacctatccctttaatgattttctcggatttaatgcatgactctccattcttccacacaagattggttgggcatcgagaaatgtaaatattaatgaatcgtttgtttacgatgaatgactagtagcatgtttaaatggatgataagtagaattacttatccttggtctatgtatcaagatgaaatatgactatcaaaagtagatggaaggagtattagctaatttttttcaaaaatggattaatttaattttttaagcaacttttgtatagagacttttataaaaaatacaccgtttagcagtttgaaaagcgtgacacggaaaacgaggtagagatgttgggaacttggaacttttgtatataaacattagatgattacgcttttaatcttcatgatcttagctaattaacattatatatttttttatgaaaccttatatatattatatatgtttcatattgtgcgttagagtggacatggtggtaagtggtaactaattttcccaggaaaatgaccagtaaaaaaatagaccagtttaataaaatatttgttaatcgagccagttcattcagagttctatagaaatgaaagaaaaataaagcacttaatctcaagccggcggctccgccgcaagctgattggtccattttttacccattaacttactgctacgtgtcccttaagcatcttgtactgctgtctttatgccggagcaacgaaaacaacagtggcttctgggatgtctcgcgtctcatgcggtctgtgggccaaacactcccgtccagctccacattgacccatggaccatgcaagtgtgtgccctgtgctggccttagcccagctgtatgctgagttcccgcaggcggataaagtccactttgactcccttaaaaaataggccgaatctaattagtacctctcaaccagaaaaccagataagacgactcccccaagtattgaaaccagtgtaatttgatttcctcagcgattttgaagtgtggttttgctgaagtgctactaacgtgacagtgttacctggtattcgtctcatgtgatgtttaggtggcgttagaataaaaaaatattatatgtgagacctatttggaatttacacaagtataatatgggacccactaccatgtaggacccgcatgtcattcttttctctgtctaacccttcttcctcctctctctcccttatctctatcttttctttccccttcggccctagcggcggcggcagggcctccgcgaggggcacgcacggcctccgcgagcggcgttgccatcaacgacggcagcggcgagtcgcggcacaccgggcaagtggcgctcacctgtagccaccacaaccaccgcatcccgagcccgcgccagagctcccgacgatgtagttgccgctcccagccatgaattgcaccgcggatgagaatcgttggggaggaaatgatagaaacgaaattcaactggaagaacgaaataaaaaaaaaactgttatttatctacaacgatgattgggaagaaaaaaaggccaagattgcccaacgggtgccatagcatgggccaacggcagaggatgtgaacccagtgataaccatcaaacaccacgctgatgcagacctgagtgagctctctgaatattcagacccaacaggaataaactcttacagtctccacataatttacataaacaaactgcatatatactactacaaaagaagaaaaaccacataggtagtattatcagcataagacataacacaatagcaagtgcaatgcatcccgtttagaattaacatttccatattttgattacaagcatccctctctgtcatacaataacaaaacataccaactctggttgataacacattatacattacttttttttagatagacaaaaaaagagggatatgcctcggaatacttgggacctcctaaatgtctccttagcattcacgcaccgtgagcactgacgagataaatgtcatgttcacgaataaaaagatataggaacataaacctctttctgaagagacgctgcgaagacaaaaaaaaaatgatgagatcataaactttttaaagatgtaaatttacatgcagctaatctttgatatgcaaatatgcaatgcaggtacccagatccacaaaaaaagaggtgtacgattcttacaaaggatcagtgttcttggtggatgtggatgaaaaaggtctcttggctccattaatagaatccgaaaatggcggcttcatgggattgtttttcattaaggccatgccagttcttgctgcttgcgttagacaatatcacaagttagaagacaataagcccctggttattgggaatagccgtactagctaggatggatagctctagtggaaacatgatggagtgctctaatgccaaattcctgaaaggcagcaggtatgaaattaagaagataaaaaattgcttggaaacaaatagaaaattcagctgctgtcggaaacatggattaattaattgctgctcataacctcaggatggtggaagagaggggatcaagagagataagagtttagtgtgggcatacagcagcagcgcctgcgcaggtgacagaggaagaagacgcatgagcggcaaggaacaggggcgtcaatctcttgcacaggacacgcgcggcggccatctcagctagtggacgatcgaagtaatccgatccgttcgaaagaacagggtttggccagttggcctcgaccggtgctgcatataaaaaggaggaaggaaagggctcaatcccgaaccagaaacagtcgactcaatcagacgcggaataatatcggaaaacacaacatccgatacggtacagcggcccacaccgttttgaaaccgaatcaagaggggaataagttcactttgactcccttagaagtgacccaaatctaattgatgaccctgaaccgcaaaaccagatatcttaactcctaaacggttaaaaccggtgtaatttaactccctcggcggttttggagaacggttttactgacatggcacctatgtggcgatattgactaagtcttcgttccacgtggcgttcacatggcacttgtgtggcattagaattaaaaaatatgcataggactcattagtcattcacacgaaaagaaatgtggacccactgacttgtggggctcacatgcctcgactgcccttccccttccccgcccttttgctactactgccactcccaccgacaccaatcccaccgcattatccaggtctcatctttctcttatttcattctattgcaattgcaaacgacttcaaggaagattattatcgatttggtttttggtgcagatacggcgttcttcctaccacgacgtggtgcgggcgacggaggtggaggacgtcctcgacatctccggcgtccaaaccagccacacggcgccggcgccgccgcctccccatataactgtcagatctgcgtgactgcgccctcgacctcctcgacccattccgcttctgctccctcggttgcaacttgcaaggttttcatccttttctttactttcacctcaatttccacttctttatttcttctccactatatacaatgccgatgcagtttgttctgctcatctttctcaatctcatctactacaagtggagtactacattttgttttccattttcttctttttgtttgtgtgttatgttgggtcacgcttaagcctgtgtttgcaaccccttgtttccaatccctctctctcgtttttcgcatgtacttaagcctgcctgcagctggtggacagacaccaagacgagggtgcccgcggggccaccgtgcaagctggtaaggtgaccaatgatgatgccgccgccagcggaagcagcaagaacttcggtggcgccctagctcgccttcgccgccctagcttgcctgccgccacgcgcgccaccggccgaaggggaagaagaaggggagagaaagagagagaagcgagagagcgaggaggaagaaggaaggagacagggagggcccatggccccacatgtcagtgggcccacatttctttttgtgtgaatgactaatgggtcccacatatatatattttaattctaaagccacttaagcgccacgtcaacgccacgtgtaaagaagactcgatcaataccaccacgtaggagccacgtcagcaaaaccgcccttcaaaaccgcctagagagttaaattgccctggtttcaatagttcgggggtcgagatatccggttttacggtttagggtcatggattagattcgtgtcacttttaagggagtcaaactgaacttattccatcaagaggctacaaaagtactactagtagatggaccaggataaagggcccatccaaacaatccgggccgttccggcctcaggacataaggccatcgaaaaagcaagttttggcatgggataagtttacttgaggtcccttatgttgaggtggagtttgaattacgtgctcgaaccgcagtattcaaatataacgtgtctcctgtaacttgtaaaactggagattccagacaatatggtgctgctagggtctagctaatgtgacgagtcatgcatgtcctgactatttcttcttcctccgaacttttcactcactcactctctctctctctccatctcacgctcctcgtcgttgcccgagttcaatgtgtggcctagggaacaccgagttgaagataccgttcgaggacgtgtacaccgagctagaacgatgacggcgagagcgtactgtgctgtgcatggttggcgacgccgccaaccagtgggagcaaaggagagttacgacgcgtgcatgctgcacaacccatttatagccccggtttgtaatagtccccggtagcaaacaggacttcaaatccaggactaattaaatatcgttatctttagttaaaaacccgagactaaagatcaccaactaggaataaagatggcggagatttgggttgttaggcagtgggtatcactactagagaaatcatctttcgtcggtcgtccaaagtccctggtcaaaaaagttaccagatctagttaggccccaattaactttagtctcggttggtataaacaaccgggactaaagatatctttagtcccggttctttaccctaaccgggactaaaaatcctcccgagccgcatgcccgccaagtctgagacttatcgatcccctccccttcctctctccctctttaatatcggccttatccttctcatctcgatccaacaaccaggcacatgcacttcccctctcctctcctcttcctcccctttcctctctccttcccctccccaccaagtcctctactcttgctctctgggtcggcggtggcagccgggcgggagcggcggtggccgggagggcgtggcggccgccgggctggggaggcgcgtgcggcggcctcgcgatccccttcgctagatccggcggcggcggtggagcggaggggatggcggctgtggcggccggtggccaacagcgccctctcctgccggtgcgcgcatatgcatgcatggaggacggccgggcatcccctctgccggagatttgtccttctttttatttagactttgtgattcattgtattgattgagatgaagaatttgtaattcattcgatggattgagatgtataatttctttttggagaatctataatccattgcatggatctaagatgtataatctgtgatatattttatttgagatgtatttgatttgtggtacttgggaatttagtttgatttggcgatttggggtttgatttggggatatgcattccactggatttgggagaaaatcactagcaaaaaaacaatgaaaaaaaatagaaactaaccgggattgccgctgcccctctttagtcccggttggtaacaccaaccgggactaaagatctaattttagtcccggttatttcatctttagtcccagattcgttgtctcggttggaaaactaggactaaaaaggattcccaaacgggactataaaaggattctccagtagtgtatactcgcaaacgttgtagccgcacaagttattcccctggtcctactttgcacactaaaggagaaacgacaagatatttaatatacaattctattttagagcaaattaatgatttaatataattttggagcatgtactcactggaatattaaacctccggccaagtttttctttccaagaccctttgtccaaagcacggaaccgagcctaagccctacgtacagttacaagctaagattaattattatccgagatccacatagtagcaatagcaaaattcataatgacagtggaatagatgacattacttgtctatcacttcaaaaattttgtcaaaagtagactcctctttatccattgaatcatagacatggactctgtatgagtccatgtctttgaggaaaaggacccagtggaatccgtaaattgcgtgagatggattttatttgaagatatcattactggaaatggatacaaatatatattcgaacatatctattatatactaaaagtctattaatctccctacaaacgctcctaagccgccatgtggtgttcctataaacgctcctaaattgccacatggcaattttcaatctaaccgttgagtttcacttaaattggtggacccattattttacaccattagattagatctacttgaaaagtcattgctacacccataccgtataagctttatacatgagaaagttttacgagaaaaattaaagtatattccgatcggatataaacccatactactgctcgcttaaaaaaaatcaaacaaacatacgtgcagctataaagccaaaaaaagtactacattgtacattgaagccgtatataccggaaaatcatgtccatacgagtgaaaccgcttataccgaaaaatctacgtatgtacgcacaattaaaaaaaacagaaactttaggtactgtttatttaaaaataaacgaacgtacatacgcgtagacaaaaccaagaaaaaaaatgtacgtatgcgtagacaaaaaaacagatggttttttaaaatagtattttctatagtagaaaaacaaaacttattacttcacaaatatggtaaaaaaacgtacaataaaaaatatatgatttgaaaatatatgttttcagctacgcgggcattctttaaaaagttgatctagcaatatatacagtgactgactttatttatacatgcaagtgaagtggtactgaaagaaataatatatagtcacttttcttttataatttttcatatatgtttgaatgacgtgcataggatagtaaatggaacatggaagaatatacatacataggatagtaaatagaacatggaagaatatacattttatgaatgaagtagatacttacgtatgaattctaattgtgatttttatcataaataacacaatggtccaaatagataaaaaaatgaaggtatgatttaaaagttaaaaattataatgagttaaaatatattgttacaaataaatatataattaagaaggttgtggttatttaaaaattattgttgcaaatattttcataaagagaaagggagaaaatgtaatcaagaggataaacttcctacaaacacttctaatccggacatagtaccctataaatgctcatagaccagcatgtggcactctaataaatcatagaaattttataaaataagaaaaaatcccgaccaatcggttttcatttaatttggtggacccattattttcaactattagatctatcttaaaactacaaaataaatttatttgtaaaaaggcccatgtcgtattggcacgaccggcaaaaatacatgcatgtaggtatgtaggtattccttcttaagaaaagtacgtacctacgtagagtatgtacacagctattcctatgaacagtgcgtatacacaccgcgtcccacatccttatttttttttcttctcatcatttggattagatagaaaaccaaactaataatttaaactaatatcaactatgctttgagttgtaaaaatatatgctatttcgagttgtattcaaattaggcgtatgtcatcgaaacacccataaaaaatataaataaattgaaagtatagattatgtgatagttaaattagacttacattttccaaaataaaaacaacttcaagtgtgtgtagaatttcaaaaattactcactctctctctctctcttgtaaaaaatactgatatggaaaaatgatgttataaatttatcagaaatatttttttatgtattatgtgtttactctattcatatattattagaaaattgaagatcaaatatattcatttgacaccacgtcaatatgttttttctcctacttagcctttgttcgatctagctcattgacttagcgtatccagggcacatgaaaagtcacaagtcattagcacaagattaatcaagtattaaatattaaaatcttgaaaatggatttatttgtatttttagaaaacttctataataaaaaatattttgtaaaatatgcaccgtttaataattcggtaaacatggtcatgataaataatgaagtagccactccgataagcactttagaacttaaccataaatttattacttatgcactaaaactaaatatgtagtgtataatatactttgtgaatctagaatagtataatatatcaatcgtatgtccccgataaattctatgtaataagttctatatacaaaccagtgtcaacaatcgtcaagttatattgtttatgatacatccatgcacaatgcaattaataattagttgacatccaatatgcacgtgcgtcatcaagcaccgaagatatatgatgatacttagtgggaacccataaaaaaatgatagataagtagaggatgacacaaaatcacaacaaacaatagttgactacaagtagactatgagtttaagcaatagtgttcctatacttctacaaacacttgtgagatgtcatgtgatgctctaataaataggaggaaatttaagaaaaaatataaggagaaaacaaaacatctacccatcgatttgcacttaaaccgatgaatccattattttcaaccattaaattagatttattcaggtaagcccttacttctataaactagctaatccctctctatgcacgtacatatacaagagatgacaaaaataaaaaaaagaagtgcgtgtatatatgcacgtacatatacgagatgtcaaaaataaaaaagaagtgtgtgtatatggtccaccacgtctggtagttttcaatttctttctttgtagccctaaggttctcctcaaattatacatatatgtagcgaccactctttgcgaggttgtcgaagaagccacgctgccatggcgccgcttcatgtcaccctcgccaattttcttgaaaatatttttttgactaacgatataaaacgcaatcataggcagttgtttaaacatgtgcacagccaccctatgaatatacatacgcacaccctacctcctatgagagagaaatatttgtcaaaaaaaacatgaaaaagaacgaacatacgagagactaccattcgggaaaaaaaaacttacgtacatacgtacaataaaaaatgtcatatggaatcatattttatcccttttaattatgccgttctcatataaattgtgttaacaattagtacaaataattttgacaatatagagtatttctttgtacattacccatgaacatgcgtaagtgaattagatgtataataaaagaaaaaaaacatcaaaactcatattatgtttgcaaaggatgatgataggtaagtttacatataaccaaaacaaagtgattttttgtttgaatatgatagacactatcatttaccttatcaaattcacggtataaatatttccttcttttatggaaaggttacgaggtaatctactgttcttatagttaatatgatgatatatgactttttttcagattttttttatataaacataaaataaattgcccgcgcatctgcgcgggctaccttcctagttaagggaaaagacaatcatttacctggcctgctctctcgtttacccttgttgcaggcatgaagaaatccatgaattacaatggagtagaattcttcacttttggagaagataacaagctcaaagtatttccaccaaatacctataaattcaagcaaaaaaactcacataatattagacgaactccaggaatgcatattaggcaattttcggtaccaataaaatagtaagagggaagaaaaacgttacatgctgtctatactaaacagtcttgctgaatatttccatttactaaatgacctaatgccagcctcagaaaataatgaaataatacagcaaaagcctatatatgtagtctttgatggaaagctccccggagtttatatatcctttgaagaaataatagcctaaaaaatagatgcaaaaataatgggcggcctatcgtggaaaaaaatatatcgtggaaaaaaatatatagatgttgatgaagctttaagtcaagccatgaaaattttgggaataaactattatatggagccagctgcaaaggaatatatacaaaaatgcaaaagagccaaaaataagaaagctccagaaaccccatactatacgaatataaaagttgaaggatcttctaaaaaaccttcatataaagaatgcttaactaaagggatgtatcccttagatggtgaatacattgactgaaaaataattgaaaaatttgaagaagcctcctcaattgaaaaaagagttaaaagaagaaatacttaaagaattaaaaatgattgacaaatttgaagaaataaaaaagttttatgatgaggaattcgatgtatctttttctgatgttgataccgtagatatgggcggccatgggcagccagaccaataagcaatatagccaaatataagaaattgataataaattatcaaatttttgggcatggtaagcctaataataatatataattttgaatcaatccaaaaatgcttttcggtgaatgacaatgaatgacgtttcactgctaaaaacactgtggagaatataacttttgaaaaaggaagagacacaggtgcaaggtatctccactccagccaaacaaaggacgaagtgaagcaaaaggaagtgccactacatggtgcgagccatcccgtgaaaccacagtgataagcatagagcactgacgagcttccttctccagcccctataaaaggaggagcctggcagctgaaggggaacaacaaagacaccactccagagcaaagctaccagcgcactctcatcctccactatacccctccttgtagtaatctctctagtcttccttgcaaactatattgaagcaaggtgtgtataagtgtaaggtaagaagaaagcttgtatgcaagtttatctgttcagtatgaagtaacttttcttaagtaaccctgtttgttcgttctagtcaagtgtttatgctagggacccgataggagaaacctcttcggttgttctcatttctagcctgcatcttgcataggcgtctggagaatctgtatctgcagagaagtgttcccttcgggtggaactgcctgaggagatgataaactcttagctagatcgttcatgactagggttatctaatttaagttgcttctaaaaagacgataggtgaggcatatggtgagtaccgagtaggtttttaaaacttctgtttcaaagcgctagctgtgttggattcgctaccatgcaaagatcctgaatatttaggttgaatttttcgagtgaacagtgttttcacccctgtgaacagtgtttccagcactaggaatatagtggtaaatagtaattaaagcactaggaatagtgttaccagttgaattgtgtaagcaaatttaccttttttatttaagccagtaaattttaattctataagtgtactaaatttgccttttagttcaagtggcaatagttcttctatatgcatcttaaattcttctatatgctttggatttgcttcaattgggctagtcttaataatatactctgtatttattatattaattttacactcgattgcatttttctcccaatatttcataggaatttctcctataatttggatatcctctaatctttggacgatcttttctatatcctttttagatttaatatccctataccaatttggcgtgaatgcttgtagtcctatgcattctatattgcaatttgatgtataatagttgtctatattttcactgagctcatattcattaattctttcttcagactctttacactgtggaactatattacaacaaaggaactatattgcactccagagcaaacataccagcgcgcgctctcattctatattggaatttgtaatattcttttatctaataaggttattaaaactttagctcctaatttcttacttgtcattcctttgattcctattatatacattccttggtgaatatacttatagcctgaatattttaacccattttcaaacactttagctactatttttaattctactggtttggttaatacacttaattctatttctctagatattctatataacccattcttattctcgaagaatcccatgttataaacttgttgaggtcttattgccctcaaagtatcccgttgatattttcacttctggcgcgaatgcttgtagtcctatgcattctatattggaatttgatatataatagttgtctatattttcactgagctcatattcattaattctttcttcagactccaaattgggtgtttcaagattatcgaggtaagtctaatatgatctttgcaggttggcgaatccaacacagccggcgctttcaaacagaagttttaaaatcctactcggtactcaccatacgcctcacctatctgtctttttagaagcaacttaaattagataaccctagtcatgaacgatctaggtaagagtttatcatctccccaggcccttccacccgaagggaacacttctctatggatacagattctccagacgcctatgcaagatgcaggctagaaatgagaacaagcgaagaggtttctcctatagggtccctagcataaacacttgactagaacggacagacatggttacttaagaaaagttacttcatactgaacagataaacttacatacaagctttcttcttaccttacacttatattacacaccttgcttcaatatactttgcaaggaagactagagagattactacaaggaggggtatagtggaggatgagagtgcgctggtgttgacgtgaaaacacgaggcttgagagatctgcttaactctagtgcaggtccaaaacttacctttgggtgtgtgtgcgtgccagttgatttgatcctgcaatcaacaagaaacaaatacaaagaaaccgcggttaaatccataaacgatagccgatcggctaattgctgatgacatatcatttatcttcgagccgatgttatatatgcatcaatcggcagtcattaataagtaagaaagaactaaatctacttgatcggctgtagatattaacaatatataatccttatatcgatatatactaaaatcaagtgattgggatagatcggtcgccatgccgagacagtataaatcacttagatcgaaatatatactaataataagactatatatgttgatagcatagccgatcagatagatctagcatgtatcggctaatactccgataccactctatattaagatattaaagcaaatagaatataccaaacagaaagcctaatatacttaaatgcaacaagatcttaatataaatgacagatttagcatgtcaataaagcatataagataaaagctaaatcaggaaagatcggctgaaaccccgatgctaccctaatcggcaaccaaaggcaggctagagattgagattctaatcatgactcataagatcaaactcaactaatgcagctataagtatgaaaagaagaacaatatctagataatcaagtcgttggatgtgtcatagagtggtggatatcctatataatctaaatcaacatcggtatttaacctaatcggctgccttctactgacagatgttagcgaattgtaggttagataacgatattgccggagatcatgcaagatatatgataactcgacgaattacataaacaagattagagtgtcatgaagatggaagcactaatcccgagaacgcaagccgccataacaagttttacctcttgttgaagattgaaatcgatgcagtcaactcgaaagcaagaacttgtcgaaacaaaacgaaagtaaaaagggtgccgatgcaccgagattgtattgaacgtgtgttagttttattacatggggctcggggcctatttatacccgagaattacaaaatatgtccatatcggacacgactcttatctctaacaaactctaagataccgtctcgattcttccttcacatccgatccttggattaccaaatttggtcgttaatagctggtagctttgctctggagtggtgtctttgttgtttctcttcagctgccaggctcctccttttataggggctggagaaggaagctcgtcagtgctctatgtttatcactgtggtttcacgggatggctcgcaccatgtagtggcacttccttttgcttcagttcgtcctttgtttggctggagtggagataccttgcacctgtgtctcttcctttttcaaaagttatattctccacagtatttttagcagtgaaacgtcattcactgtcattcaccgaaaagcatttttggattgattcaaaattatattgatttaaaattatatattattattaggcttaccatgcccaaaaatttgataatttattatcaatttcttatatttggctatattgcttattggtctggctgcccatatccacggtatcaacatcagaaaaaatacatcaaattcctcatcataagccttttttatttcttcaaatttgtcattcatttctttctttaattctttaagtatttcttcttttaactcttttttcaattgaggggaggcatcttcaaaattttcaattattttccagtcaatgtattcaccatctaagggatccatccctttagttaagcattctttatatgtaggttttttagaagatccttcaacttttgtattcatataatatggggtttctagagctttcttatttttggctcttttgcatttttgtatatattcctttgcagctggctccatataatagtttattcccaaaattttcctggcttgacttaaagcttcatcaacatctatatttttttttccacaataggccgcccattatttttgcatatattttttgggctattatttcttcaaaggatatataaactccgaggagctttccatcaaagactacatatataggcttttgttgtattatttcattattttttgaggctggcattaggtaatttagtaaatggaaatattcagcaagactgttttgtatagacagcatgtacccttttcttccctcttattattatattggtaccaaaaattgcctaatatgcattcctggacttcgtctaatattatgtgggattttggcttgaatttataggtatttggtggaaatactttgagcttgttatcttctccaaaagtgaagaattcaactccattgtaattcatggatttcttcatgcctgcaacagggtaaacaagagagcaggtcaggtaaatgattgtcttttcccttaatatgttcgaatatatctttgtatccatttccagtaatgatatcttcaaataaaatccatttcctagtagaactctttttcctattaagttgattataatatccacatattgcttcactgtggtgaccccgaaatcctcgctggtccggaggccacagtacaatacctgtgtaacatgtaccagtcccaggatacacaagctagtacacaaagaacatcggtgatccaaagcagtctaataatattacattagtcggatagtccttacataagttgccatcgtggacagaccccagatggacaacgatacgacacaacaaacaataacaacaatgacaacaacagagcggaagcgaacagcggaagacgacttaacgactaagttctaggctaggcacctaagggactaacttattccacaggcatggtttgggaactaggcccgaaactctaaaagtcttcatagttggcgtgctcctgaagatactcttcggcggttggattatatcctccttctttatcttcaaagcctaatataattatatgtagagcaagggtgagtacttttgtacttagcaagccataggaaagatgacatgtgcggctaccaaatgaggcaaagggttttatttgtgaaaactagctgttgctcaaaaggtgtctttttgcaaagctctagtgtgtcaagttttagttattggaaagaggctcacacctcaatccattccacaagttgctttgcaacaacttgtcacaagtaattagtgaatatatgttcttctaccaacaccttagatcttctcttgcttctccaactcttgcacttgtttccacttcacttctccacgagctgtctcatctcagagcacaacgagccatctcagctcagaacaccacgaaccatctcagctcagaacacctctcgaccaaacaatccaactcctagtcacactatgatgccaatcgacatcccagatcacacagacctgttccaaaccactcaggtttgtcgtctgccacacaggctaactctggaaatgattcccatcccacaaaccaatttcacaaacatatacaaacaacactacgctaagagaatcacctcacattcgcccttaaccgtgggcacgactgttcaaacagtttaattaaactctgcagaggtcatacgctttacccacatgacacaaaactgacaccggttgcccgtcggcaccagaagtttgttgcaaggcctttccaaagctagtccataaaaatcccataccacgtagtaggccgagtctcacgacaagcatcaggcagtctcagccctcgtctactcagggtacactagggatgctcctccaccttatcggtaccgtatcgccacaatagaggcggggccactcttggccaaagatctcatcaaatacacgcaacttcgtctcctcatccccagtgtcccactactactggcatacaagatagtcatggactaacaaagtacttttcaaggggtatgccataatacccgtgtggtcgcactataagatgcttggatggaattcccaaaggaatcggtccttaacgacaatacatagctagctacacaggctcagcctacataccatcagggttcgcaaactagttttacttcgcaaacacaccgatagggagcatcgggttttgaatagttgattggaaatccaggtttcccacacgacaatacaatcgtggcaggtccaagcaaaactacctcgatgttcatacccgtagggaaagatgtcggtgcataatatgtggagctataaaggacaggtcgtccaatatcctacagaatataagtgcgactaataggtagatccatcggatgcgttcgcaacacgaggcaaaacagtttaacgtgtaacctaagcatgcacatttgcaaacaacataattttgcacatataggaagcaatatggtcaaaggtggctttccttggtcctgcggaggttcttccttgacgagaacagcttccggttcatccgcgggatcggcaactatacacaaaaagagcaaaatcaacacaagagctaataaagtagctcaaacagtaagatattatactgccattagatagatctcatttttagaaaaattatggaagtggaacgaagtcaattggagtcacggtttaggagatatgaattttcgaagattgaaggaatttctattcaaaggagaaagagtttctttatgggaaaaaggaatatttcgggataaaccccttgcggggcccgctgttagtggcacgggaggagccggcgcaaggtagaccacgtccacggagggcgccacacagagaggtggtggaccgggctcgtggtccaccggtcggtgcgtgtggggcccagccatcataggctcggcgcacatggacctggtgtacacacgggcacaccgcaagggaatggatagggtgggacccgcatgtcattagcacaaggattaagaagggattaaaacaaagattaagcacagtgggcccacatgtcattgagacaaaagaggaggattaaggaggtaattacggtgcaaggattaattaggaatagtggggtacacgggtcccacatgacagtgtctcacatccttcccttttcttctctcttctcctcttctcgttatctcctctcgttcccctctactgctcagggttccccatatcgttttgacagaggttaccgcacccccacggtaggacgattaccgcgataatcgtgcgataatcgtgaaaaatcgaacaaaaatcatatccaaacatttgaattcaaatcctcggcggtttcgcagctttgacgtgattatctcgtggtttatggcgataatcgcgatatttgtctgattatcgcggacagtgaagagggaaagttggaaatgaaattcaaattgaaaaaaacatagaaaatacagttaaatgtatgtctatcttggatataattataagaatatgtaggatacatagaaaatctaacatttgagtgtaaaattcgaaaattcggcatgacctattctatattatggacatcgaagcaattcaacatttaatagcataataaatcaacaacaacaattgaacaacctcacatttcaaagcctaatgaagtccacacaaagtagaaacaatagagtccacgattacaaatatggtagttcatatgacaagcaacacaaacatagaaagttgtagtttggaacgaaggatataaagaaggacatagctaggtgttccactgattgtaagccatgttgtactcttctgttgacatgagcatcaagccatgagagtgtagcaatcccaccttgtattcctgccaagtttgttctgtccatgatgctgttgattgccattgagcgtacaattgagcataccactggggctcttgtcattcatacacccatgtctgagcaggataatcagatgcttggggacggttttacacataggtttgatagccactttcaatgctagaggcactgaaagagctgtagctatcctggggcgtgtcaaactgttgttgttgttggcggcctatcggattaatagtagttctttgtgaggttggagcaccatcatcctggtcttgagtagcgtgagtaaagtcggcctcacctgcaagtgaaatattagcaagaacattaatgagtcatgaattgcaaggtgatagttgtagtagcaagtaaagtatatcgtaccagtgaattgaataaggctgtggtgttctgactgaggtgtgtgacccctagaaggcacatcagtggtgccttggcctccttggcctccttgaccaccgtcatctccatcatctgtatccatctggagctactgtcatcggactcttggtattccgggcttccttcagcgtcggcatcactatcgacactcctcaaccgtgtagttgtagctttgccctttgtttttttggctgcaggtgcttttggccgctgtcgagtcttcctcttcccaatatgattgtcgcctacgttcttttcagcccactcagcaacactagaagccccagtggccctgcagatgtctgtcaagtccactaggtcggctactagtggactaggcacaggggcgtcactctcggtcgagtcttcatcaagttcagggcaagcattagaccaagcattgtccatccagtctttaatttgattgttcatgtcataaaatgaaagatccgctagcctctgaaggggatcgtcatcttccttcctaatttgtgcatttgcttgttgtatgcgaagctgaaggttgtagttgacatacacaagcttgttgagtttcttgtgtgtaagtttattacggagctttgtatgtatgaatgcaaacgtgctccaattacgttcacatccatttgaggagcaacattgtccaaccaaatgtaacgcaagcttcttcaagttcggtgtgtctgaggcgaacatagaccaccattgtgctgcaaatgccaaacaatatgtcatttcactattatgaacacatagagcattgcattatgaaatttttttgctacattagcaaaaaaaataccaagggaagttttcccatccatggccatctttcttgctagtggcttcccaaattcgccactcttacactgatacatctcaacctccagcaaagcggcagctgccgtgtcaatgtccgtcatccactcgaaagcttaacgaaggtcttggaagacggtggaactacaagtgtaagcgtagtgcgtcctcgggttcaataccgcagctacaaaacatagcctaaattagttcaagagttatgggtttaggaattgaacattatgtaaagccgcaactttacttgcattgatgagtgttttagtggtgaggtcgtgcatccttctgtccacaatatccatataagcgttgtacttatccctttcacaagcgaacagactatcatactccattctcaacagttgatatctcaaaagaacctcactcaaattggggttcttgtcctcgtcggcaaaccaaagaaaggagtacatcggttgcactgaattcactaccgcctccaagttttcccaccaactcatgctagataggcaggcatgtgcatatctaccctctgttgtgccattgaacttactttgcatgaatgtagaggaagccatccactgcatgaactgatatcgcttcctttaggaaactctgaaggaacatgcaattggtgccaaaccgcgtagcattccacttaaccaattcaccacctatcgctgagaccatcatagaatgcagcttcgaatgattgtatagccatctgcaaatttttctaccactagcaatcaccatatcatggtctgccatctttccaacctccttaagcatcaagttaattgtgtgagctacgcaaggttgccacataatagctcggtactcttgcataagcagtttgcaggccttcttatagttggacccattattagtgataatttgcatgacatgttgatggcctactttgcataccaccttcctgatctcctgcattaataaatcacagaatacacgtaagtccatcacctatacttcatgataacatgtgaggctaatttgttggatccagtgtgttaccttaagtacaaattgagcatcctggctttggcctgtcgcatcaatggacttatgaaagaacattattccattacagtatatcaaaaagttgatgatggccataccggtcggtctagtccacgaatcacacatcaaagtaacaccataatcatcccagtcgtgcttgaacctctcaaattgtttcttcacgtccttctccgtagaatcaaggtatttaccatctatctccctacttgatggagaaggtatgttttcacctacaattcacataagaaatattagtgtctaaaatgtttatgaaaatataagttgatattagttgcatacgtaccccacttctgtgtctctctcacgacgctgacaaagtaaggattatcgacatttcttgcagcaattccggaggtatgttttcacctacaattcacataagaaatattagtgtctaaaatgtttatgaaaatataagttgatattagttgcatacgtaccccacttctgtgtctctctcacgacgctgacaaagtaaggattatcggcatttcttgcagcaattccggaggtgaagaaaaaccttgcccgtgactcaccaatggcctccctagcctgctttcccttctttgtgaagaaccctgtctcaatgcgtgtctgcacaggggccttggcaactgctagattgtaatctctcaaaaaaggtgactccctctgagatgtagcccttcgtagcaaattggcaattgggttacttttacctctccttgcctcaggctgagcggatccacttccatcgccatgctcatatgtgccacctcgctcctccacatcccttctaaagtcttgctctcgccgtgatgcttccatggcctgttccatttgttcctcctcgtcggcatcacctgtgaggtcatgatagatgacccttgccgcttcaaccctggttgacttttcactcttacgcctagcaccggcagcttttatcctgtccaactcgcgcttgaacaagtcacggacatctggaggcactgaattgcaatatgttgtcccctttccctttccagccaaatgaattttaagtctagttgccctaccaccgctcttttgctgatggcaatatttacaatgaaatccatttcctatgctctccccgtgctcccacacagggtccctattatcagccatctccaccctgaatcatatggaaaaattatatcactaaaagaattaaccaaattacacattaacaacaaatgacccattatcgttaaaagtacatttacatcaataaacatgaaaatgtctactcacccaacaaataacgtactgtacataaccactgtccacatccctaccataattcagaaatcttcatatctcaaataacatcaaacattttacaatgtatatttgacataaaccaacatacaactaaggctactacttgcacaacagtgaaaaattcatacaactaaggctactacttgcacaacagtgaaaaattcatgcacaatgtcgacatcggcactgtggctggggcttccagggcaaggaaggcgcgtccgggaagcggcacacgcggcgcggcacacacggcgctgtgcgagcggctcgacgcggggtggcgcacggcgctgtgcaagcggtgcggaatggctcggtgcatcacttgcctagctcagcattttgtcgagcaggtggtgcgcggtgtggctgctgggtagggaggaagaagaggggagatagatgggccaagctgggccaccttgggccagccgaaagtgagggagggagacagtaacaagggaaacccaaaggaataggaacttctttcctttttctggtaattggaaatttggaatttgatgcaaaggttgtaaatggactgtaaaagggaccgtggactttgataattctaggagtttatttgtggacatggaatgagagatttgagatttttaatggcataggtaaaaattcaaatgagaaccaaattttgaaaatagttttgtatttaaaataggtttttaaaagaaacgaaaaatcaggatgttacattcacaatctgtcctgaccgtaaattctttgaatcccagatataacctaaaagcatttatcgcattgattattgctaagatttctcgatctgtattgtttacaatttttactttataacttccagaagcatacctacatatattttcttctcatttggtagagtatttagtaggtctttgctttagtattgcaccccaaccttattgtgatgcatctgtttcaataataaagtaattctcttctaatggtagttctagaggttttagctcttttaccctttcttttattatatgtactaatttaatgtctttagagttaaagtatttctgaccatttttccttaatttagcatacaagggtcctgctagcgttgccaaattatcaatgtgatttctagcataatttacaattcctaagaattgttgtaatttatttttatcattcataacatcaggaaattgtaaaattttcttagcaatatgttcctgcaaatgaattttgccttctcctatttcatgaccaagaaagttaattttttttctttgcatatttccatttttttctttgataggattaatccattctgctcaacttttctaaaaaataactctaaaatgagcggattgaaacattataactctaaacgacaatgttgacatacagatccacgtcttacaaatattataaaagtcttacacaaatgcagcggaaattaaaaggataacagtagctaagccttgacttggatagcagcgggagacaccattccactggcatccttgacggcatggacgaagcctactcctctgagaagccaccatcggacgcatactcgaactcttgggttgggagatagagcaagactaagtactacccactgtactaagcaagtcataccggaacgaagggtatgatgcaggatacaaccaaagagagctaaaggagtttatttgcataaagctagcatttatgaacagtagttgaaagcggtaaaatagttaaataattatccatcatttaacccaatcactgcttaacgctacaccatgttaagacaggcccaaaaccaccacctgaactaatcagttccattaagctaagctaggggtgagactaatcacagtgaatctggttgaccgcccataaccgcgggcacggctattcgaatagttttactttgatcagaggtgtacaactgtacccacaagacacagccccacgacacgttcccgtgcgccggcatgccactacaatatactggaaagaggccgtgataggacccttcgcatagccccctctaaccaagcacaccacacctcaggtttcacccccactcctcaaaaggtagcgggcagtcccctctcgtgcctaggtgaatccggaagcgacaaaggccgttgcagggcccatcctgctccatcacacccacccttgcctagatgcgtcggctagagaaaagctacattacaagcccagctattgcccacgctggcttatggtaagtacgataagttcttccagggcatcccacgaaccggtccttaattgccatgggcacgaccatcaaaaccatacacccacagcccaccaattaatgtgttctaattaactaacactattgcggtggcactaatccaaagttatactataatccaaagtttatgcgttaatgtgatttccccttcgtgtactagttgaactaagcatggctaagcaattcctaatccgacatctagttatgttacaacccaagctaacaatggattaagatgaacaaatagtatatctgaggcagtaggtaaacatcccataataacattataaaaacaatgcataatttaaaggaaacaatagagcatttgcaatatgggatcaatatgttcaagtgacaagcatgacttgccttgctctgtggctggagggacctcggcaactatctcaaagtacaccggagcgtcgggagagccggaatctatgcgacatacaaggcaaacaatgcaaacaagctataagactactgaacagagaacaaaaccttttgtaatggattgtttgcatttttcttgatttactgagacttgaatgggcttaaacggagcatggacgaattagttatgatttttagaagattatatgtgtttattactataacagaaaatccttaattgatttattgcgtaaataatacccctggcgacatcatcagagagagtggcagcgccgacatgtgggccccacatgtcataggctcggggtgcgccggtccacgggatcggtgaggggtgcaccacgtggcggcgacgtgggctgccacgcgggcagcagcgaacggccccgatctactcgagggtagatcggatggcgagggcggctcgcggcctggcacgcatgggcggcttaagccggcccagcggccatggcgctcggcggcgcggtgcggcgcggcagcggcgcaaggcggcgatcggcggcgagcggccagcagcggagagcggcggcgctactagagggagagggagagggataggggatgtcggtcgtcatcgaagggttcagccggcacggaggaaggcgacggcgaacgacgacgacgggcgatggaatgacgatggcgacgagcagccgagcttcggggaaacctagggaatgcaatgggggaaattagagagggagagggagagcagagagggtggaggcgccggccgaaggcggtggccatggtggtgctcaccagcgcgaggaggaaggcgtgctccggcggcggaatcggccgggcggacggcggacgggatggcgcttgggacggcgaacgcgacgggcgtcgacggcgcggatcggcacggcggctagcggcggctggagcggtggcggcgacggcggagaggagggtgacggcgctagggcagtggagtgcacgggagggctcgacgagaacgggaaaaaggtggaggaggatgcaggggt

SEQ ID NO: 60359 - DNA, 1918 bp, Oryza sativa
caacctcgctcgctcgccagcgcggccagccatgcaacctcgccgtttcccgccctcgcgtgcgagtcaccgctctggccgccgccttgcctccgctcgccgccaggcgccaagctaccatgcctgcctttaccgtcacagccggcgtctcaccatggccccgccgctagtgtccaaggcgtcgacgccggtcagtccgccttgccagtcgcgccaccagaagcagtcaagcagagggaggcctcgctttttcgcctcgcgcttttcctttttcctccttgcctctaccttgtcctctagctcggggagacgcggaggcaggcacgccgatgacgtcgccgctctgacgcgctcgccccaccttgaccacgccagctctgttagaataggtgtcgaatatactagtcctatttggttatagttggacttggagttgtaataggtgttaggggtggagttagagtcggactctgtaacccggcaactatcttaaatagagaggggggcaccacgatgtaaccatgacgactacaatgtagcgtagacacgcagtgagaggatggcggcgtggccatggactcgtagcggctaggtgctatgttggttggggaggagcgtccataatcagagccccggggatgtaggcttcggctgaacctcgttaacaaatatcgtgtgttcctgtgtcgtcatctggcatgtcttgggtgatcaacgactgaagcgatcgggaaggttagtcgtcgttccgctatatcgactaaattttataacaagctcggcacacaccgctggctcggtctcctccagaccgatagctctatgaactatgaaagccgccccagggctctctttctccctcctagcttccactccttcaccatccctaaagctcgccgatcgcttccaccactccggtcttgttcaccgcgtggctcgcccggagtgccggtgcttcctggcgactggggcgaggcagctttccttaccccgacctttattggttcgcgccgaagtctgaaaaatacttacgctctgctggcatttcttcactacgcgcccttcggtctcggagtctcccaatcctttttccctagctcatacaccttccaaaggctactagctagctagcttaccgctgtgtcttgtgctcgccatatttccccacactcgtgttcacctggttccgccgctaattcgccgttggccacctagatgcgccgcgccatgccatgaggatgcttgaaatggtatcatgaaccctacaggatgccctagccgcgagcccgtgacgaatcggtcttgcgtttgctccggtgaaactttcccctttggcttgccggcgggatgcgccgccgccgaccacgggttcaattcattctgggctgctgggtgtgcatgcgaactggaacgtcgaccattgtagttgtatacatttaacaaactgtacttctagaaagtcccttatggaaaaaaaaaaaacattagcttctcttaaagaaagtttctcttatagtaacaattctagttgtaaatgagattttacatgtagtactattccatatataattttttttggagataccaagaatatagaaaaatacacacattaattgtcttcactttatccaaatacaacttcacaagctacctgtcacaccctgaagttctttcccaagcctaaattgaatttataatccaccagagaaaatatcgtgtaaaagcaagagaaaaccctaatgaattgatgccaataataatcggatttggcatgtggaatttttcttgagttctacattgtcgaaatacgcttacaagatttttagtggaattttcagagctctaaaaataattttaccaattaaaattgagcacaagcaatatttaatccctggaaattcttttcctttttcctttt

SEQ ID NO: 60360 - DNA, 1981 bp, Oryza sativa
aacgacgcccaaagcatcgccattgtctgccacaagactgggctagacttttgccttccacccaccccggttgttctacagctactgctcaaagccccgataccaagtagcgactatcaacgtgtagacaccgctgtaccaacgtccccctcccccgttagccagcccctacatgccttcatgtgccaatgctgcaactataactgtatcacgctatcatcgttgcaagcctccaccttagggcgtcatcattgccggtcaccatccccgagcatctagacctcagggggcctggaacttccgacattctttgacagcacaccagaaaaacggtcataactctttgctccggagtccgttttcaacaaagttgggctctgcggaaggcttattgagagggttattgtcgacgggggatacccgtaggccggatatagagggtactggggtacgctggtacgaagatttacgtaatacaacatcaagcagacagaaaacaaagattatactggttcaggccccttgataggtaatagccctaatccagttgatatgggattatatgatggaaaccacagattacagagagaaaagcagaactcgatgataccgatgagatcgtaatcgaacaggttcgattagatctcctggcgacttggctcctgtaggcttcaactccgtaggatgtggtggatgtgctgactatgagattcgatgccttaggtcctcccggggggtcccttttatatcgcaggtcaactagtctccaagtaggactcggagacatcggacccggcacgatacaatgacgacccagttctgtccgagtaggactccttccatctgtgaactccatgatgaatttccttaacgtatgctgaaaacgtccttatacgcgcaagtataccatatcgatatgtgacgtatatcgaagggtagagggtataccttacccgtaaccctgacagttatccaacccaaccaagctctgaaccactcataggttagtttaaggctctggtttctctcaaggtaacacttgcatgggtcactttgagtaccgagagataaacaaacacatcaacaatgcatcactcttaatagtacggaattcgtatactcaaatgcaaataggaaatctataccactaggaatgttttcttgtcatcttcttgctttaccttgacagttgccaacaccaacgccatctcactactaggactattctcacctataactcattaagcacattaatccaaaattgactatatatttgtcttgatcaatgaccactttggcttttggcttgatgttcatcaacgaattacatcctattgatcttcggcattccatcttgcgctcttcaaataatttatgtggattactcatggcttcaaatggcctcgcacgatccatcgtgacaaagtctttgctcgcccttcaccaccagattgagtccatcggcgccaagcctcttgctttcccttcacctcctcatgatccattgtagccgagtcttgattgcccttcacgatcttgccatatatagccactcataccccgtgtccccgtatcgtcaatatctttacttgctcctcatcaagctgtaatgtccatcttctaccttcaatctttcagcttgatgtcggaactcaacctatatcttccaacatgtgttgtcataaatcaccaaaataatcaccacactcttagggtaatagatcttccaatctcctcttacaaaggcaattctagggaatagatctttcaggctgcaccccctcctctatagccgcatcttgccgcctcgcctccatatggaccaagccgagtcacgacgcatccaagctctcgttgttatgttgtagtttgctctcctcaacctctgtggaatccactatcggggtgtcagatctagccacattgatatcggatatggcaacctactattgttgtcattgtcggccaccttgcgccacct

SEQ ID NO: 60361 - DNA, 606 bp, Oryza sativa
cctccttccttcccaccccttgccgccgctggagctggctgccggaaaccgtgtggcggcgggcctcctttccttgggctctcgcacggacgatggatggcagctagatctaagcgtgacgttggttgctacggcagcggtgggacggctttggatggtagccaaagccggcagcgctaggagaggctgcaacagtggctggcaccggttaggcaggatgcggggcttctgggttggatccgccggaacgctgtggtgattgctcgagtgcagtcggcagagcagctgcatgggcgtttggcggtcgtcctagtcgcaaaagtgggccgcgtgggcggtggttgaggctgtgttcctggctattcaagttggcatcaacggcgaccgcagccctgccgcggtgagcgactggatctggtgcgtcctcgctaggggtagggatccgagccacggggcgtgctagcatccgagcagcgagaggactcctcccaaccgcttggacgttttggagctccttgtggtgcatggatggtggcaacagggtggaggtgcgaggtacgacaacgaccaaagctgggcatctgcgatgatcaagaagcagctggg

SEQ ID NO: 60362 - DNA, 895 bp, Oryza sativa
tttaaataaaacgaatgatcaaacgttggtcgaaaagtcaacggtgtcatacattaaaatacggaggagcactacttactagattgagttttgacgtcatatgtccatattgctcattcgggcttccgtcattctcagccgccaaccatctcccccaaaccagaataattgctacctctgatatgggttgacatgttcccagcccagtttcacaaacccaacatgaaatcgaaaaagtctaatttagttccctttgtaaatgtcagatctaattcatatctttcaaccacaaacctggttatatcgatttttccaactattaaaaccgtgcaaaatgactctctcaactattttgaacgtgacgtccacatagtatcccaatcatcggagaaataaaaaatagacatgagccccacatgtaagtggtgagtgaaagaaatatgaaaattatggggtccacattgccacatgttagcactcaacacccactcattctttcttcgctgtttcgcacggacaggtgcaagaactacagtaggcaagccggcgcaggtccgctcaacactgcttccactgaggaagcggttttgtagttgagggataaaaaaataaaaatcatatccaacctatatttttgagggtgttaaattagactttattcggtatgcaattgtttgcttcaaatgggcctcactttgaaccttgtttgattttaatggcccatgattggcactgcttatgggctcagaatctgcccaatcaaaaattcataaggcttattcctgatgcattccctgagcaatacagcaaaaactagcaacaaaacaaactggatccttcgttggcagtaggaccgtaggacggtaggagtagtagaagtagttggcagttggta

SEQ ID NO: 60363 - DNA, 35114 bp, Oryza sativa
  unsure (1)..(35114): unsure at all n locations
atgccagttccaaccaacattgtaattctactccaggtatgaaacttttggtcattttaaggcttacaatttcaaaaattggacctaaaggttgaacaaatttacaattagaagtgatacctgccagcgtcttcagggctgaactcgacatcagggcagcctaggctgcgggcgtaggccaccatttccttggcaatggccaccacctgctcgggcgtcttccttagcttgtgctgcatatggatctcgctggtggcaatgaaggtgtggatgcgcggccgccgcgcgtgccgcacggcctcccaggcagcatcaatgtctcgcttattgcatctcgagaggccacagatgaccggcacgtggccgtcctccccgacgggcgtgttcccgacctcgatggcgatggagcgcacggcgtcgaggtcgtcgggggaggaggccgggaacccggcctcgatgatgtcgacgccgaggcgggcgagctggcgcgcgacgacgagcttctcggcgctggtcatggtggccccgggggactgctccccgtcgcggagggtggtgtcgaagatgcggacgtagttggggtcgtcgatgcggttggggacgtactccgggcgccgcggctgcgccatggacgcccggacggggcgggcgaaggcgcggtggtagcagcggcgggaggcgctagggtttgcggcggcggcggcggtggcgaggccatgggagaagcgtggggcggcggcgcggaagggggagagagtttgggcgcgtgggcgtggagtggaggtggggtttgcggaggagaaggaggagggttttggggaggagaggagggaggaggccatggtggtcgccggggtttgtggcgtcgacgactcgggggtttaggggaatcgaatcaaatggtgggagagggagatgcacttgctctgcttctcggtgatgtgtgtgtgagtcagagggggagctcttatctggacatgacaacgggggtttcgtgggatgcacgaatgctgtgatggcggcgtggtttttgcggcgaagaagacaagtcggacttgcacacaaggctcgggggagaaatggagcatgcgagagtggtgatgctggtgacttggggagtgaccacatgacatgagcaattggcaagcttgtgtaaaacaaccaaaccaaccaacttctttttgaagctctgaagtctgaagatggatgacaggagtagcctagcttgccaaggtaaggttgtttgtcacatacgcatatcaaaggcagaatttgggagaaaggatgttgttcacagcacagtagtgtgaggcttttgctgtgtttcttttggttcacattgtgatcttatacaatacaaataaacaaatccacttttgatcgctcaaatatggccttttaatctgattttggctttatcttttgttcgacggttttaagacttgagggccaaaggtaaatttttttcttaaaatcagtcaggctcgagttcttcacaaaataattacacgcaatggaaattgtgcttatgctaagtttaagtagcataaaaaattcaaaaggaaatcaacacaatctacgtcataattcatattttgattagttaaagaaaaaaagagcaatcaaaactttacgatacaaaccagactcaatatcttatcgaataggtgaaaaaaaaactcataaacaacctaacattactgcacaatacatagctttctaattagaaatatagagttgttcaggtggttttttattcataccattgtaatcttaagtctcgttgctggtaatgatgatagacattagctttttcaataaaaattggcaaccattattttgaacactcactaaatgctagatctattattttgttacatatgcttcatatcataacaccacgcttgtatactattatcttcactacctttataacttatgcattctctctctatgtattaaactatatacgataaagcccaagaaaaggtgacaaaacagatcctatccagaggttcccatccttttcttcaacttcgctaatagacttgaacaacttcctgacatcaccatgaacactcattgcttctatggtcttcccatcctcactcaacctcaaagctatcacttgacgaccaaatcctgtcaagaacgatgtgatgcgttgaatgcgttgagctggtagcttaaagattagtttccttagccaaggataagaaattgaccactcagcgatcttccctctcttggcatgaagaccaacccaaaaccctcctctaggactcatcttaatgttgtctggaaacccaggtagttgcgcaacttcttcaatagttgatgcttttggtgttttaatccaatatcttaggatcttacccgttgtggtttccgcaagtagcaaataagaaccatcgatgctcatagccaaaccattaggaaaacgtaggccatcaactaagacttcaaccttgttttcttttggatcgtatttcaacaatcttccagtgttgtcacccgttataactatgtttagaaactccctacaaataatttgaatgaaaaattatatatatatatatatatatattacatgaattgtcattaaaaaataacaaactgatgagtgataataataaatntatnntatttattggtccagtaccttctctgaaaccttgtactggtctcggtgaagtagattactccagtttcatggtcaatctcaacgccgttggagaagctgaatgggcttcctgtcctcttaggaacaagcggcctagacacgttctcacccggactgaccactctcagcccaaggtacgcatctgcgacgtacagctcactcagtcttgctattgaacttgaagcccagtggacgcccacacttctgctcccgtttcgtgtccttggatcctctgcgatctatccaaccttgcacagttcaggtcaacgaccaatcaatcgataaatgccgttccaacaattcaggacggaatctgccatactataaatattatttggaccatagcataaatgatagtcaaaaaggagtagtgaaaatgaaatgaactgaacaataacattgttgatgatatgaactctgaagttgaattataccaagaacttttcagttgttttctatatgtacagatgtaactcacagcctcacaggccatattaagctcacaattaatcatcaattaattggggatttggacagtgcaactgtatttgtccggtccctggacctggatcgtaaactaaccaaccaactactactaaccaaatcatgagaacaacagagaactatactaggcagctagcaacacgggtgaatactgaatagtttccaaaagtggaaaaagacttacagctccggcacggagcaggagtgctcgacccaccggcgctccggcggcggcagccacttgaggatcctcccgtcagacacgctcgtgtacggcccatcgccggcgtcgccgaacactatgctctccggccccgcggcgccgtcgagcagagggatcagctcgacgtcgccgtcccttatctccagctgcctcacgtcgctccgcgagtccagcgacaagatcgccgccgccgcgaagacggcgagcgccaagagcttggccgtggtgttcatcgtagctaagtaagctaggcttttggtgagctacccacaaatgggagtgttcccccactaggcagagtatgggttggttttatgctacctgcaaaccgatcctaacttcctaggtgttgatttattgatcatggtaggatagtaaatgcattgccatctccatatctacaaccattaaaattttaatggtgaaagagaaagaaagatccaagaccagtgtacggtccaatagttgccactgtgtccatgctgacaggcgtgttcctgtctcacggttgcaactcgcaactactacctgaaatacgagtatgtttcacatttttttagagtttcttattactcattctctgcaattttacatgaagagcagcaggctaatcttaggtacaacatcaactattcctgaaagatgcttctctattcagcgttaaatagtgatgactactactactttgtaatgtacgtcgattgaataagacgttcttttaagagaacagatagtgtatgaaaagtggacatctatctctgaactttgaaaaaagaagatcgacattgtgtattttaagttcggtgccccataaccatcccatgatcccatcgtgtacaaacgacaaccgttgttgacctaaaacaacattttttttcagaagaaactaaaaaatgcataaaaaaggaaccaatctcaacataggctgtgtttagttcacacaaaaattggaagtttggttgaaattggaacgatgtaacggaaattggaagtttatgtgtgtagaaaagttttgatgtgatggaaaagtttgaagtttggaaaaaaaaactttggtactaaacacggcgataacttatttgaacttaccctacctagttcagatttcagaacgttagtcttacagaatgatgcgccaatatgttggcatggtcccaaaagagcttccaattatatccattaaaagtaaacagcataaggtagatgagaccataagtgagttttcagtagattggcaaagcaaatgtaagactaccatgtgcccatgaagataacatgtcgttagagttgcagtacatgtatgatgtatcaagatactttgcgcttggttggttagctaatcaagctgccataggtgtgttggaaaaggaaagaaagctacaggcgacggccggtgaccgtccatgaagacagagaagatggatagtgtagtatttgggtggatgcgggttgagcatcgtggtattgttttcagtgaatatgattattactatgagatttcagctaccagcatcgtgcaatcttatcgaagaagaatcatatgcaatggaagtgtgccgaaagccattgcaaatcaatgatgcggcagctctgctacataaattgatttactttctgtaggacaggggaataatagacttaagtacacatgccaagaattatcattgctgagaggagttgcaactgtacttagatctgagtagcatcacacgcaagtaaatgcatgcagaacgagggaacagtactatgggatgaatcgcaggatcaaccagcattcattcaacagaaacagatagagattaaagcttacagttgtggctcgatgacggcggacgagtgttcgacccagcggcgctccaggggaagccacttgagcaccctcccgtccgacacgcccgtgtacgggccctcgccgtcgccgtcgaacgccacgctctccggcccgaccgcgccgccggcgtccacggtgatcagctcgacgtcgcgctcccgtatctccagcactggcacgtcgtcgctccgggggtccagggacaccaacaacgccgccgccgccgccacggcggccgcgagcaccacgagactggctttcatcggaaccagaagtccagaacctatgtgaataactgcgattaatgaaattgcaacgcgtgaacggctccggatttgtttatgtagagtagagatatggttgattgccttgtcacatttgctccttgacatgatactccaccaaaacgtataccatgttgtctgaagagagggacatcctagtacgaagctcaaaggaccgtgttcggtacgtgtatgactctgtctgccagttgggatttgaaacggccggtgaggcggtgaccaacaccgctgagagcaagtttaatagtatagcccactacaagcttcaatttatctatatccgatttaatagccaattcatacaatagttgcttactatactgctccctctgttttttaatagatgacgccgttgattttttctcaaatgtttgaccattcgtcttatttaaaaattttatgcaaatgtataagatataaatcacacttaaagtactatgagtgataaaacaattcataacaaaataaattataattacgtaaatttttgaataagacgaatggtcaaacatgtgataaaaagtcaacggcgtcatctattaaaaaacggaggtagtattataatatatggccccacctgtcatacacatattgtgtcttagagtccgtgctacagctggctataaatttgtagcccactcctctttttttttatcttttatcttattaaaatatatttataactggtagtctagtattgtacctgctcttagcgcctcggctcaatctggttgcggcgcgcacgctattttgtccccgaaaagcggtctaaaaccgcacgaaatcctggtgtttgcgcgagttccaggttggtgggtagcggtcggacacgggctgatccagcaaggacgggagcactcgttccgcatacggggcctgcggttttctgcgtgtgggctgggctggagcccgcggttgcagcggccgttagctttcccctcttctgggcctcgcaccactggagcgcgtgcgctgcgaagcctggaaccaggccgtccgttcgatctggctacctgcaaagcccaatacttaggcagagtggtgttggctcgaccaggcgcttctttcgagtgagacaggaacaaagcaacacgtttcgtgcgagggagacacggggttttcaggctagaaatccagtcgctgaaaaccagcaccaaagtccaaaggctatttgtgtcatgcatgccgggggttagctactcggctcatgctcagctagctgaacaaacatcccaaggccttgtttgcagcttgtttgctgaagaaagcctagaagaaaaggtagtaggagtacatcgatcatcagtgcagtcgatcgagagactctgaccacgcaccggtgcaaatgtgagaggtgcgacacaaaaaggaaaggaggcagctagctgcaaacgcaaagcaatcaagtgcagagaaaaagtcatgggcctcctgtcttgacgtgacacctcctcctcctgagtccagactcctctgtcctgggcggcttctgcctctgctgtgcgtgccatcagcaaggcctgcctgcagctatctgcggccgctgcagcatattattggttcgttaatcttacagcaatgcgagtttagcagcttttcagtagcccggccatcaacgcatgcgttttctcgtcagtcaagagtgaacgaagagtgggtttccatgcgacaccctaccctagcgctggatcctaaaacaatactttatccctttaattgacctatataaacactggagtgctactgtttaattactgcttgagttgagtacttggggattttcttttcatgtgaaatggcaaaattagagcatgtacaatagcagactattagtcagctacaaatatattttaataagataaaaaatgagagagaaaaatagcgggctacagatatgtagccagctgtagcacggacttaagacacaatgtgtgtatgacaggtgagaccgtatattaatagtatagtaagcaactattgtatgaattgactattaaattggctataaatgaatttgagctagtagtggactgtactattaaacttgctcttatacattaggtcaaggggatgttggaattaatgaatgggccttagcccactcgaagattaattctttgaaaaatcacaaaagcccacctcatgagatggcatgcatgtggagtttagtaccaccttgcttattctaggagagggggacctccttaaaatggaggatgccctcctagtcgcttgaagcatgtgtggtggagagaagaggggaaacacacgcgcgcgctcgctcgccgggccgggccgggggcgcgcgtgcacgacgtacgcgtcgaatggtccgaaaaattggctcctcacccttgcgcagatgcagcttctttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacctgccgtcttcacgcaacatacaaaaaaatcaatctagggtttgcttcctactctatactgcgccgtcgctcgtagactactccatcccgctcgccggcgtgcaccggcgatcgggagagcaggtctccggaacctctgccttcgacgttctgcaccgggagaaggctgcaaatgtaaggtttttgggaagcgcttcgcgtgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaagaagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactataaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaatgggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggtaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcaacatgtcccttctatcgacaggaatcttgttagtggctcccgtctgactagagacggatttaagttggtttttgagtctaataaagtagtcgtgtctaaacatggatattttattggtaaaggttatgagtacggaggcctgttccgcttttccctttctgatttctgcaataagtctgtgaaccatatttgtggtactgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttaaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggtgaaagtcaatgtaccaataacgaagaagcgcaaacttggacctaagactgtggactgtgtttttctgggatatgctcatcatagcattgcctacagatttttaatagttaaatccgaggtaccggacatgcatgttggtacaattatggagtctcgtgatgctaccttctttgagagctttttcccaatgaaggatacaaatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaaccttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttctgttggctttaattagcaaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccaccttgcttattctaggagagggggacctccttaaaatggaggatgccctcctagtcgcttgaagcatgtgtggtggagagaagaggggaaacacacgcgcgcgctcgctcgcctcgcctggccgggccgggccgggccgggccgggccgggcagggggcgcgcgtgcacgacgtacgcgtcgaatggtccgaaaaattggctcctcacccttgcgcagatgcagcttctttttgcagttttgttttgctgcaaattcggattcgtttttgttttggaaacgttccgaaaaatccggtgcgtgcaaacggcgtggagtccggataagttacgcgcgacttatccggttcggttacgcgcagtagagatcgtgtgggcgccctgatcaagcgacccttctctatataaaccgacctgccgtcttcacgcaacatacaaaaaaatcaatctagggtttgcttcctactctgtactgcgccgtcgctcgtagactactccatcccgctcgccggcgtgcaccggcgatcgggagagcaggtctccggaacctctgccttcgacgttctgcaccgggagaaggcggcaataaggtttttgggaagcgcttcgcgcgactgctccctgttcgttcgcgacggctcgccttcctcttcgctcgcgtgtttcgtgccttcgtagacacttgcgaaaagtttcgaccaagcagccggtctttccgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaggggaagtatgaaatatagtacaccgtctatttctttatcaatagctgaatacccgtattttgctatgggtaaaataaaattttcatgaagtgtgctttgctatgaaaaatatattgatcttgttttaattttatatgtagctatctatttagatttgattttttatattaagaagtttaaggcttgatttgcaaaatttataattagaggtggctgagttcactgccaccatcagtaatatgattgacaataaaccgacggtaatatgctggtagggattgcacaattgttctagtgcttgtcataatgaaatgaaatacgccttgtctttttcaaaagagggagtatatttctgatgagacatgcatgaaaggtctgttttataaagtttgcatacgctaaattaatagtatggtctaaacctccaatttttagttagtatgggctaaattaatacatcaataatttttaattagtgcaaacatgattaataatatatatactactagctcacataaacagtaactcacaagtacatcttgcccttttgcatctgcatgctggaactcaattgggttttcatgggatactaccctggacatttatcagatggtgcaggatcagagacatggttttcgaaattcctgttttatggaaatctttctggtagcctgctggttgatctggaaacaaagaaatgatctcatttttaacaacatcagtgtttccatttctcgctggaaggggaacttgaggaaagagttaagcctacatttaactaggtttaaagtagctaacagatcttcttttcaatcatggattgatgctttgtaattcttcttcttctgtacagattcttttttttcctctatataaatgaaaattaaccgtgggggcttcccccactgtttcccggtcaaaaaaaaaaattagctcaattttttttttgctagatccattgagcttgtactagtagtatattctagcagagaatgtgcatgatgccaaacggagaattcgatagatcgcagtgatatgatatgacgcactgcagcgtgcttggtggtccttctttgtgtgtgttctcccattggcatggaaatatgtatacacacttggcgatatgatatgcacgcacgcatgtttattgttcttttccctttcctgttctctcgatcttctctaatagctaggcgccaccatcaggcacagtcagctcaggtcaaaagctttaaaacactactaccaaatgatcagctggagatagagctagcactattccagcatggcacaaagtgttgagctatattattccttttcctgcttgaacaaaaaaaaagggcatctattcatgccatgcctccctgtttcccaaactctctgaacatgagtaataaaagagatggatcagcattagatgtactgttcatcaccatctttgggtctatttgggagagcttccagccgctgcaacttctccgagaatcagaagctcccccaatcagtacagctttgggtccagattctgagaagctgtaattgtagaattcataaaatgaactagaagctaaaagctgggaaacccagcttttccagattctcataggctgactacgaaccagctgcttcttagaatcttaacctctcgcaaacatacccttttatctcattcgttctccaagataaaatatatatggagctcatcgtcagacaggccggatggagctaagcttaggtaacaccattcaattgatgggacgttggatcactgtaaagattctcagcatggaaacagcatgtactactactataagcaaacaggcaaccaaaagaaagaagaggaagaagaacagtgccacatgtttgcgtgcacggacaattagctggaaacaaaaggaattatcggggctcgatctgacgctaattaaatccccagctcttgctaatcgatgaacaaaacatgaactcgatcgccgtattgcagcagttgatagacgatcaatagatccaggcagtggtaccaaaagtctagcagaaaacaggtgaagcgagcgagagagagtacgacaaagaaaggatcgatatcgatggagataattggattcgtcacgacataattaagattcatggatcatggccacactagctaatcaatttgacaaatcaagaactgtatatacagcatgaaatgaaggcgctgtagggccggccatgagagcgaacagctaagctcagctagctctcatccatggtgtcattggcgtttgtgtgtgtatgcgatgaaggaaagagagattaataatcaattaatattggcaatatgatgagaggggagcatgcataagaggacaggggcaggcaaacagtggaaatccaagccgggaacagttgggggaggaacccaccatgggagacaacgcttttattgcgagatgtttttaacagttgcagtgactgatgagagcatggtaccgtgggcctctcctctacagtattctatacagcgaagacgagcgagaagtacgtaccagccggtacgtacgtatacgtagctaatagccattgttaactgttacctatagcagtagctgtaatgcatgtcatgtctatgatctccactgctgctggtcatatgcatatggatggacagtaattaattaaccgcgcgcgcagttttactggtgttgagtcacagatactcactctgctatctaatacaagagattttaacattttatttacacgatttgaccaatcattttattcaaaaaaattagtgcaaatataaaaaataaaaagttgtgcttaaagtattttgataataaagtaagtcaaaataataataataatttcaattttgttaataagacgaatgataaaaaatacaaataaaatatcaaaatcccttacattatggaccgaagggagtaaaaattaaagacatcatgcatgcatgtcgatctctcttcaaggaatctactgcgcagttgtcctcatgcacacatatctgcaggaacaattgaagggatcgatataattggagagaaaaaggcaaggggtagctggatatattcatccatatgctcaatcgtcatgcacgtatatatactccctctcatttttaatgtataatgccgttcggcttttaagatacatttgaacatttatcttattaaaaaattatataatttatttattttattgtgacttgatttatcataaaacattctttaagcatgatttaaatatttttatttttttataaaaattttgaataaaacgaatagccaaactttgataaaaagttaacatcgcactgacatgagcaatgtacaaagtgaattgtgtgcagtacgatactgcatgcatataaagtgtagtttatctttatttatatattgagtacaactaacattgggatgtagacttgcagtagaataaatctctgtactagatttttttttgattttttctaaaaaaatttcaaggataaactccctgaatttgaacttttctgccatattattttaattagtgtgacagaacaacgacactatcatgctgataaaaaaaaatcaaggcgtgttactctatactagccacaccattgttcatggtgtcatggtgtggtagagtatgggggtgtttggatcagggtgtaaagttttggcgtgtcacattggatattatatagggtgtcgcatggggtgtttgggcacgtcattagcaaatgtttacggtagcaccatattgtcaaatcatggagcaatctatctggagtatctattatatactaaaagtctattaaacttcctacaaacgctcttaaaccgccacgtgggactcctaaaaacgctcctaaatcgccacatggcattctaatatattagaaatatctagcctttaattttcacttaaataggtgggtccattattttagaccattagattagcttagattaaaaaaagtcaattagtcctcccctcatctcacgagcgcatatgtacgccccaatggcacgcatgtaacatacgtgaaagtgtgccccacctttttttttactcccccccaaacttttacaatatatttatatcacctcatttttatgccattggtatttttgagcgtatatttgctgaaaccacaaaatatttcagcaggttgttacatagacagtcccaaaataaatcattcgatcctcgattttcatgttaaatcagatggacaagttattttatacattagattagatctataaaaaaaataccatccaaaccaaaaagaatatcctatgtattatatagcactattcacgtgaaaaaagccaaaaagaatcttcctgtgtacgtatacttactccattatattattcaccgaataaaaatatttttattatatgagatataaattggtgagtccattattttagatttagattaaattaaaagaagagttagtccctccctctcatctcacccgcgtgtacgtacacctgcttcatcccgtttgtacccaggtaaggtatgtgccctcatttctttccctccccccatttaccccttttttaccctacaacctctacttttttagatgttttaaatagtgggctaagccataaatagtgggctaagccatttagcggttagttctcaaacagatatagcggcagctatagcgggctaaatagagctatagtggctaaattgtacatgagagcaaatagctaaacccttttcaaacaactatagcgggagatttaaaaccctacttttttatgctattgacattgtttgagtgagtgtatatttgatcattcatcttcgtattaaaattatgtaattataataggagattctagaaattccgaccttcgatttttatttaaattggtgaaccagttattttatagcattagatcacatctattaaaaatatttcatatgtacatatgttgtacatatgaatacatagtactgacaagaaaaaaagccaaaaagaatatcttgtgtatatatgttaccctccttaaaaaaaattgcatggatttcaaagaaaatgaatggcctatattagagggcacctaacccctaaacttcctacaaactctctcaagccgacacgtgggactcctaagagcatgtacaatgtaaatgctctaaaaacgctcctaagttgtcacatggcgttataataaattagaaaagtttattgattttccattaaatcggtgaacacattaattttaaccattagatctctctaaaattcaaaattccggtagccagcacgtactccctcctagccaccctccaactcttcccttctctcttatttttagctaactttttctattatttagctaacatagatctatcttaagattttgaaattacgctcatctggaaaaaagaatcacgtgtagaaaaagtcctctatctctccatggacgtgcacgtacatatgtacctaccctctttgttttctttcctctttttttcccttcaggttagatgagatagaaaatcaaaattcgtattaaatatattttaagttgtaaaaatacactctaataaattagaaaaacatctagaaaatgtgagaaaaaaaacctaaaatatctagccatcaatttttatttaaattgatggatctgttatctccgaccattagattaaatcctattaataatctctctcctaatctccctcagcgcactgacgagagaaatgtacgtacgtacgacttgtaaaaaagccgaaaatacatatacaattgtaacatacatttaaaaatataaagtggaaaaacataaaaatataattatgtcattaaaaacgtgcatttgcttccttcttcttccttctcttctacatgtatagacgaaattgtaattattaggagtggtaataaatttgaagaaattataacttcataaacatagattatatatatcatctatatatgtctaaattagctccacaaatttttgaaaataaattttataaaactatattattttaccctttatattaacaatataatatattttttacttaaaccgatgtatctattatatcaaatcattattttatatcaaaattttaaaaacatgttgttcaatataaatgttacgcaataatattctctaccagtaaattgccaatttatgatctatattaactaatattttacattaattactgagcccactattttatattatttttaataaaaatattttgacatcggttttcagttaaactgatggacctattaactagacctattaaggacctattaacaaccattccatatctatcttttataaaagtaaaatgaaacttctaaagacctcgcacatgtgcatgtttgctttctgcacgtatgacgaagcatcgtacctaaggcagctaaggtgatccgataaacactattcataccaattaaatttatataatttttctcttatttcaaacaaatatttttccaaagaaaacaaacaaacatgagaaaaagaaataaaaagaaaagcttcaaacaattgctgatattttgcactatccaaccaagcaattctgcaaatgatttgtgtcctaacaaaaattctttaaaactttagaaaagaatatgaaaattttgaacttctacgaagggaaaaacaatctaaccgttaatctatccttaatttggttgtcactaaatcacgcatcttcatgagacgattcgatcacaataactttgagtccttgctatcgcaatttttacttgtagcaatattgtatggtatgtgttcaaatagtatacatgatatttacttttcgcaaacgcgtatacatgatatttacttttcgcaaacgcatatacatgatatttactcactcagtcaaaagtaaattcaaatgtcatatgatcttgatctatcttctaagtcaatgaatatggttttcagatatatccaacctatgatttgcccttataagatataatttctaaagaaattataatattacgttatgatagtacggatgcccgcgcatcgcgtgggccaccttcctagttatatactaaaagtccgtccatgaaacttcctacaaacgctctcaagccgccacgtggcctcctaaaagcgctcctaaactgccatgtggcattctaattaaccggtggacccactattttagatttttatatattagatttacacttatatggtggacccggcattatatgtcattagatctatttttcaaaaaaaagaaaatcacatcctcaccgataccacttatgtacgtgtccgtgtacgtgatcttcttccatgtacgctctcccctctgttccttttctctcctattttcgtgctattttagtttgatggaaatcacaaatatttataatattttttagaaaataaaactaattcactgtcctatacacttacgtagaaacgtacgtatgccctcctcccccatgttctaaggccggtgtgcaccctccttctttttgatattatttaaattcaaattagaccaaatatttttaaccattaaattattagttttcaccattagatcttatctttgagaaaagaaatatattgatggaccctgagttccactcgacactcaagactgttgttggcccgatctttcggtgagttgagataactacgatttgggagaaatgttgacgacccgactacaaccgtacgagacgttgtgttgcgccttagcgatcgatacagctctccgtgagttgttgatcttgccggtgcagatcaaccctattcctgcaagcaaatcgaagaaacaagtaagaacaagataaaagcaatctgatattgcaaataagaatttaatacaaatgataagttggggttccgaagaacaagcagacggacggtctagccgacacgcgcgctgcaagcaagtagcaatggctaaactttaatctatcaaaaacccaagaaactgtaaaggggtacctaactatttaaggaggtgggaggacgacctaaggggatcctagggtcgtgctccacctggttggggcgcaccccacatgggccccacttgggccagggtcccagacgaagttacaagcccataggcccattataggtgacgcaacaccttgttgcttcaattgcggctcaataagatggaatttcgcaatgaggctggatccattggaaagaggactccaagagctttccatcaagtactcacggtccgaaaacggaggtcgtatgcagattcggcggccgtttgaagtcagcagtgtagtaggtggccgaatcggattccagtacttgtaagacttgatcttgatatcttcttgttcatccatgatgtgagcaatggttgcatccgtggtagccatggtcacatcatatatatgtttcctttccctgtgcatgagaaaagaaatatgtatgtttccctctccctgtgcatgtatataagtttcagaaagaaaaaaaaatcatcccatccatctgaagagggatcccatctcccttctgtctctcctatttctcttcttctttttagctatcaaccaaatatataaaaaataataattatatagataaataatcataactcctgagtatatatatatatatatatatatatccaatttttaatttgtttaaactaatatttatttaaatgttatcatatgtttctgtaaaaaaatataatacgccacctagatatggcgaacccaagaaaagaattatcagggaatcactttcatatatacctttctttcagtggtgaatgtagcaaaaaattatcagggtactacacatataaattatgtaattgttgattgatatatactccctccgtcccataatataagtgattttgactttttgtgaccactcgtcttattcaaaaaaattgtgcaaatataaaaaacgaaaagttgtgtttaaagtactttggataataaagtaagtcacaaataaaataaataataattctaattttttttgaataagacgaatggtcaaacagtgtaagcaaaatatcaaaattccttatattatgggacggagggagtattgattaatatgacatgaatatagctagaatcgaattcgaataatctacccaggaaggtgaatgtagttaggccatgtatcttttgcatatcaatcaaacaacaataagatattataaaaatgtacatatattttgttatcttaaaccatttaacaaacatacaccggaataaattttcatataaaagaataatttatctagcgggcacaatgaaacaataaatataaaataaatatgtattatgtgatcttaagttattccacaaaactgcatagctatattagatcgacggtgttaaaataaaaattataaatgcaaccatgaaaataaatttatgcataaatttaatttatgtagggaccacactcctacactttgaatgtcatccaaattgtcatacaaaattgtaaaataatttaacaacatatattgcatgatcatacattactttgcaagcatggatagaaaaattagatatataatatgtaagtgaaaagaacaaatttaactatgaataacataacaattataaaaaaaagattttacctttagttggatgcaacaatagctaattaattatgtcttttgaaatatgctcaactgacgagataaattaaataggttgatttgtacataagcgttctaaaatatagtatacattatcatttaatggacttagaggtaaaagaaacaaatgaatattactatgacttccatatcttgtagatacaaagataaatttgtctattttatatgcgtagaccattaaaaatgtgaatactcctgtatatgaatattaataggctacgagcatgttcattgttcgtacgcatgcataactaactttaaaatccatttatatttctcttatgcaagctcccctcctcctgtatagaaaatatattttgtgataatataaatcatatagctaatattttacgtacatcattagattatttactacaaaatttataattcaagacccaaaccattggatctatctcaaaggaaacaaaactcctcccctcctcatgctgtacgtacatgtgcatgtctcccggaagaaaaatcaggatttatctactctatctttattgatccatatgtaaaaatatataacaaattaattacgttaatatgaaccaattaaaaggagggctagcttgatggtacattattaacaataatattttttgagatttattaaaaaaatccccaaaacattcaattaaaaagaaaaaaaaacacattacttttaatttgaacttaatttgttacacatgatttctaaacgaaccaagtctacctccattttaaatggtgaaaaagaaaataataattacggatgcattaaatatttcatagtataaacatatttctgaagtttggcaagtatggttaatattcatccctggtaagtttctcaaatatagcctatggtatacatgcccgcgcggatacgcgggctaccatcctagttaggcttaaaagatttgtctcacaaattagtcgcaatctatgcaattagttatttttttagcctatatttaatccttcatgcaagtgttcaaatgttcgatatgacagggtgtaaaatttttgtgtgagaactaaacaaggcttaccataccactacatcaaatggcgtggtcaaaaagtttatttacataatagcctagatggtttattttttaagtagtttttagatcgataaaagttcaaacaataaataattcatgaaatttctgcttttcagagggattggtatcccatctatcgtatctgatcatggaaagatatatatacatgatcctctaaaagtctcaatgcataaatgaagagaaggccagagaagcttgatttttttcaagttaagtttatatatatgagaataaaaactagagaaggaatatttttgtgaagaaaattacagataaaagctaggtttgtgcatgtgattggtacacatgtactgtttgatgacataattgtatgagtagtacttactgtgtgtacagggtacatgtcatctcagcagaattaggcagcgagcattcaaatacgacacgattgagacagaaaagttgcaacagcaaaatgaaaataggaatatgcctttacactattcatgaaaattcaaataaagttgtgaattttataatttccgatagtggaagctatatgtattacttaaataatttgacgattactgatgttgtgtatagttttattattttttacgctatcaataggggagcaaaatagatgagttaaggaatattttgattgtacgcaattattttgacttttttgttttgaaaaacagaaagagaaataaatttaggaataacgtgggtgtaccaaaatgaaccaagtgaaacaccagtccctatcattttaatatttcattcgctatatgcgtctagatcataataagatgaaatatcctatttttcttgtcaaggtggcaattaatggaggtggtggtggtagccggttggccaacttgggatcaacgatggcaaccgtggacgtacaatggttagattgtagggaagacggtgggttgttagcggtgtcggtggtgattgaggtgaattgattccacctaattaccatatccaatttactttttgtttgctaggcgggtatagcaaggagcaacatcaacatgacaaaggaaggctagctggcattgttggcgatggattgatagggggtgcgacgctggatctaggacccaaatgctgttcagtctggggtgtctatgcttgtatctatttgtgtagcggcaaatgtgggttacgttggaggggttcttctcttcgaaggcactagatgctgggagtcgctaaatttggatcgattggatccatccagtgatagggatatggtgcaaaggagctggtcaaaggtggatgtaaaacaaataagggtgtaagagttcagactgcacataagatcgactcagtgtggtttttggtgtggcaggcttgttagggagaagaaaactgaagcttagtcttctagtatttttgttttattttcttgtttctcaattatgagacctaaaatataagtatttttataacctttggctatttatattcgcttgtggatagataggccaaatttccttcttacgcctcaattttcaccttttggaatgtgcatccttaattataagagaaaatatgattatacaatgtactcccaatgtgttgcacaaattattttttgaggatatatatgtcgtacttaattactaaagttaaataaaaaaatgcacgctttatgaatcaacagtaggaacctaattcggtttgagaaaatatgtgccgtgctgtaaactgaattataaaaacatgctaagttcaaaattaatatattcctttaataattggtggctaacttgggtcgtataaatagagtgagttccctaatagaattagttcacttaatgtaccttttttttatattcatttcttcagatgggaaaagccatctgaaatgtataccaccacatgcatatatacaaatgtaatgaatgtatcggtacatttttggtttactacggatgatctgtaaagagagaaataaataaaactagtaatgcaaataatatccttgccacgcctaattatagaaaattaattaaaatggtactaattttattattaataatatatatattttggatactagtatatgaaggtatacatttagctaaccctagagtctcatcaaacaatgggcccatgcactaatcagtgaccggtccctacatggatatataggagtatatatatgaggccacggtcgtcaaattttcttttttgaggactactctaaaggtttaattaatcaagaaataatattaataatgacacaatgaattagcaggagctaggatatcgtctttatacatctattaacttaataaagtaatagaaaaaggagctatcatgttcgctctcaagatctaaaaattaccacgttaatcgaagaaaataagaaaacgttcgctctcaaggtatagaaattaccacgttaatcgaagaaaataagaaaaataaaaaaggcaagcggagaaggatatgttaatcggatgaaaatatgaaaagaaatagtaaagcaatcggacacggattcatggaaactgtcaaagtgtcaaacatcaatcagaaacaaacttattgtggaaatggaaatacaactatacaagtgtaaaaacagactctggtcacaatgcattagtatcgtttagagtccaaaagtaaaaaaaaacaaaactatttaaaatatctgaaattcaaaatataactaactattgcaagaagaaactatgcataaatacaatttagactaatctgaaattacatttttttagaaaatctaatattgagaccatagttgtatagaatttacttaaaaaagagtcaatataaaaatataatttaaaaatatctaaaatccctaattaaaaaaagaaatattcgaagagaagactagactccatacatgtatgcaatgtagaactaattaaaatttggaactaaagttagagtccataaagaaataaaatttaaaaataactaatattcgaaattaaaaaatattgaaaaaatagtttagagtcattatagaaatacaatttacaaacaacagaaattcagaactaataaaaatatatattggaagaggagtctagagatcaaataggaataaaatttaaaaataattgaaattcagaattaaaaataagaaatacttattgaaagaaaggtttagagcccatatggaaataaaatttataaataacagaacattgaattagaaaagaaataaatattagaagatgagtctagagtccatatagaaatccaatttagaaatatcaaaaatttaaaatttaaaaatagttaataactatcacgtatatacaatacaatatgaatattacatattggttggtgcggttaagttagtacaaaatttaaaactatgttgctattttaatatattttaattatattatgtgaaaatatatatgctactatgtgaaaaaaaaaatataacgttactagccacgtatgtaatttgcgcgagccaccatactagttttaataaaaatgaaaaacacacacatatatacacatgctttgactaacagagtctgtcgatcatatagatatgcaaaagttcatggtgttctaacaggaggtttgtaatttgtcgcctcatgttagacaaaaatcacgtactgccggtactaattgtacaagatcagtacaggatcgagagcatgcatgccatcaaaaagccattcttaaagagacacagagaaaaacgaccttaccagtagatattacttcatccatgcaaaaggatcgatctgggccgtccaatcctccaggatatatactgtggcgaatttttatatatatatatatatatatcccagagaaaatgtcgtcacacaggagaaatgcatgtgcaaacccagtgtcattcaattgcttgcacacttagattcgccttgtcgaacgccactcgatccccattccttcacatgatcttgcaccccgctttcctatcgtccaaagcctactacagttatcaaaagctgcactgcataaagacattgtaaaaacaccaacagctaaaatcctcttcttcaggccatcaacactagtagctgcagctggatcgagcatgctcatctcctggtggatcgatcacattggagactacagctccaatattacaagatgaacattgcttgatggtttgaaactttttgaacaaattagctagcatgcaacagtttgctgcgcgcgcaagcgaatcaatcatgcgaaagatcgaacaatccacatcaaataccactaaattgttgcccattatcctagctatatagtagctagctacaccatttgctgctcatcttgtcaaccatgcataaccccacaaatctcaacacggctagtagaagagaaggatagggaataatattacttatgcgaagccattggggaagtacatggcgggcggcgggctccctcggccgttattgcttttcctcccctcgccggcggccacggccgccgccatttcctggccctggtacatgagcgtcgagttcatcgtcaggctcaccaagctgtcgtcggcgtcgctcctcgggaagttgccgccgtcgcttccgccggcctcggcgccgccggtgacaggcgcgccgtcgtcacgcgtggtcaccatcaccgccgactgcacgagctcgaggcagagcctgagcttgttgggctcgatgtgcgtcagccccggcacggcgcccttgaagaggaactcggaggtgaggctgcggagcacgtcgagcggcgtgacgccgtcgagcgtcctggagttcgggtcggcgtggtggtcgagcagcacggacaccatgtccggggagaccatctccgccgccaggtgcagggcggttttgcctgtcgggccggcgcgggagttgacgtcggcggcgccgagctcgagcagcgccttgacgacgtcgcggttgcagtgctgcacggcgtagtggacggcgagcgcgtcgtcgaggtccaggccctcgcccatgaccatcagtttgacgagctcgatgtcggcggcgtcgagggcgcgccgcatgcgccggatcttgttgtcgcggtccgccgcggaggacgccgggttcatggggaggtagtggtgcgtcaggaacggcgagcgcggcgcggccaccgcggcgagcggcgacttggcgcggatctcctcgatcttggcgaccacatcgatggggaggtgcttggcgaggagatcggcggagaggccggagcgcgcgacgaggtgggagcaagtcgcccacagctcctgcatctcgaacttgcgcgacgccatcagcaccttcatcacgtcgtccaccgacgcctccttcaccatgctctccagctgcttctgcattaacacattgcattgtgcaactcgccattagttcaattaagatgcttaattaatcaccctcaaatgcacgacagctaattagcagcatgaaatgttgttcttagcatgtagtagtagtactttcttcagttctgttcagagagatatgcaaaaatgtatgatgagcttaactgtactttgcttagaacacagcatgcatgctgtacactaagaattatttttggaaatgatgctagttaggatcgaagtggccaccccgggttggatctccaagaaaccctagcaatggaaatgccgaaatgatgcgaattaagaaatcaggaaagcaagcatggggatggatgtgatgtaaggaagggacagacacaacaagagcttgaaaagacccttcctagtaaagatgagttagaagctccatgacaagtgatgacagaagcagcaagggcgaagcagcagaaaagcaatcgagactagagacgactcagtcctattagtacactataccccatctatctcactcccgaaaaaaaaaagaacacaagaaaaaatgttaaaaaattgcgatgaatgaagtgagggcatgcactagattctgctgcagctactgcgcatggatcagatgccacagttgagagcagtagtgcatgaatcgtgcagctcagctcgctcagtaatcggaaaaaaaggcaaagggggcatgcaacctagggatctaggcaagcatgcagcaggatcagctcagacttgaacattgcttctgctgactccttaatgtcaccaaaaagatgctccaatcatgccagcctaactaccatcatgtactcttaatcaatacccagtgttagcagcagatcccaagatcgaattgcaagcacatggaagaggaatttcaaattatttgcagctgcaggatgcatgacgcgtatatactacgtcgtgttcctgaattttccgcgcagtacctgaaccagcagggcgagctgctcgacgccgaaggagcgcgcagcggcgagcgtgtcgagggcgaggtcgacggcggcgccgcaccgcgtgtgccagcaaccccgggcgccgcaccccgggagcggcccgctcttgggcgccgccaccgacgcctgcccgctgtacaggaactgcagcacgagcacgagcacctcgtaccggatcgagctgacggggatgacaagctccagcgtggcatgcgctcctccaccaccaccggggccgncacgcccttcaccaccagagccgccgccgcctcccccggccatcggccagtttaacggcggcggtggcggcggcggctggtgattcggatcgagcccgcagaacaacttcctgaagaacaagctccgcgccgccagcacgcagcggtgggcgtgcacgaggcggccctcgacgctgaaggcgacgtcgctgaaggcctggccattgatgagcaggctgaggtagtcaagcgacaaggatttgagcgagtcctcggagctcatgatctcatgtgcagcttatcaccaccagataaaagcgccggattggccccaacttttcaggcgcaggaaggtgaggaggagggatttggatagagattttgaggaagcaaaccaagcaagagaggtggaggggaaagggagggagcaacacaaggtagaagcaactgttgcaagaggaaaaagaaaaggttagggtgaaggagaggtgtgtgtgaggagagaaatggaggagaggggagcatgcggatgctatcaatcccctttgtgctacagctacagtgagcaatggtaccgtacccgtcgtctcttttgtggcaagcttgtgggtggggacgcatacagctgatggccatactgttctggctacagtatcaatggtccatggatgatcgatgcattgttgcagctcactgtgcgttttgatcgtcactgacagaaagggcactgctcttggtagaccccatctgccaatgacactataggcactagtaactggtttgcactttgtatatactgtgcgcaactttcatgaacattagattttttatgtggtaaaaaagcgaggaagtgaatgggcagagcttgtgattggttagtttttaggttcgtagagattcagacgttaaatgattccgacctacttatttatactccctttatttgttaatactcctatatgatactatattatatactgatttaaacaatacatttgatgatttatctcatttaataattacgtaaatatgaaaaatataaaacatgtttaaagtacttcaatgataaaataaattataagaaaataaacgataagtgcaacttataaataatacaaatgatcaaacgcaaggtcatatattaaaaaaatgaatggagtatttttttaaaaaaaatatttaaattcggtgacatcccagctaatgtatgcatatgtatgtgtgtatgtgtggcagatatgcacgcatgtcacacagtgtttcatcccgagccactgtatttgcgtgtggatattagcctttttcccgatggctagttgattatgccagcagggtttagttcgacttcagtcaattcatgaagcgcaaaatacatctcaattaactgattttctgtcgctcttcacataaattattgggtattgacctcgcaccaattcaccatattgccgacctgtttagaaagcgctatttttagagttgcgtatagaccgtatttgattgtgaggttagttgttatattgtagattattctaattttatgataactttaatattaaaagttagaaatggatttatttgatttttaaagaaacttttatatagataccagtatttttttaaaaaaagtacaccgtttagcggtatgagagatgtgtccgtgataatctagtagccagtagttgaatcaaacaagaccttcaagctgatatattacatatggctgaaattaattttaaggtaagacttttagggtccaaaagttaaggctaaaaatagaaatccacaaagaaaaccctaaataaattctaaatttaaattctaatgtttaaatttggttgcagccatctcaaagcatcttccccattaatccgaccactgcacactttcatttcatcagatatcattgcccattgccgtgcctcgaaaaccttcaaatttaaagcacaatttaggttagtatatatacattctaggtatgactactagtagcaattttaattgcaaagtttgaaactccgagctgtaaggtttagtatgtactagttccaattgtaattaatctgtcatattatttaagtctagttgaaatttatctggtgagaaatgcgcgcgcacacacatggattatccaaaccaaaagaaaacataaatgattaacatcgccattttttgttctctggaataatgtcgtgtgccattttcctttattccatcaaaatgttactatcatcaatttattgcacgaataaatatgacgcgcagattttattgaacactgttcgtttatattaggtactcgtacttgtcacctttgattaatactgcacaaatcacaaacatataataggattatgttttataaacccaaaaagttattatatcatgttaatattttttacaacaaatttatccctatgaattgtcattttcatgtatccaattgcaacttaatatttaaaaacatattcttaattaactaatatatctttctttaatatacaacgttgataactttttgagatacttttggccatttatcttattcaaaaaatatatgtaaatatcatttattttgttaggacttgatttatcatcaaaagttctttgagcatggcttatattttttatgtttgcacaattttttttaataaaacgaatgatcaaacttatgtctaaaagttaacagcatcacatattaaaaaccggagagagtataaaccgtgttgaaacgcatgtgcatttggaaatgaagggagagttctgttttaaacattaatttattcagaaaaataattattattcgtggtttgcagatcgatcgtgtcgctccaactatatataattaaatgtgggaacaatcatgtttggaagattaattgatagtgtatggtttcgccagcatatttatttgacttcctatataggaaaacaggacaacatattgaagcaatcatctactctctctctctctctcctcgttcttttcctcttttctgctttataatcctgccatctctagctttgagcaaacagtcaccggtaaagaaaccatcttcgatcggtcagccaagatccacaatagtctcgattgcaataaaaacctttagtcccggttcaaaaggttagagctacttttttatctttagtcccggttggtgttctcaaccggaactaaagatatatttttaaaaaagatccctatctatttctagtctcggttggtagcctaaactggaacaaaatatcggcatgcgcgcatgcgtggcggagaggacaaggcgtgcgtgagattgaggaattaataaattctattctttatctcttcctcctcccatctcttcctcttcctcctctccccattctattcctcccctctcttccgtcagcagtcgggcggaggcggaggcggcctcgcgccgcggcggcggggccctcgtgcggcggggcggaggcggcctcgcgccgcagcagccgggcgaaggcggatcaggaggggaggcggccggctgccgccggatctgaagggggaggcggccgggcggcggcccgagcggagggctgcgcccggcggcggtcggtgcagcggcaggcggtggaggccggcgttgccgtggatttttttttctttttttcctttaatgtgcgattcaatctgtgtgttgattgatacgttctgtgttgaatgtgtgatttgatctgtgttattgttgtgaatgatttggggatgaactattgctgtgaattaatgatttggatgaactatgttgctgtgtgttgtgactgtttgatct

SEQ ID NO: 60364 - DNA, 642 bp, Oryza sativa
gtggttcgatccgccgctcgccgctgtcgtcaacagtccgttccggccggcgtagtagtttacctcccgccggcccgagtggcagctacgtaggcgccacgtcggcgccagttcggccaagaccgggtcgagccgaccccggtcagtccctccccgtgcgcgtgttccaccgcgagccgtgaggatgcgcgtgggcccgccgcatccgtgtccaccgcgaacagcgcgcgtacaccgcgtccctcccccgcccgtgcgcgtgcgccgcgtgctcgctccgcacggtgaaccgtgtcaccgacaagcgggtcccacccgggaccgcgcgaggtgagcccggtccaccggccctctctctcctcccctcccgcgcgcgcacgcttgggccgccttgggccggccggcccatttagctcggccggaacgctccgtttctctcgggccgcgccctagccgcccgaggaaaagtctatttcccctccctcttttctttcttttcttttatttttcaaaaaggatttaattcaatccttttcctttagaccaaaaatccaataatcttagaaattcaatatcttcccaaccgcaaatccgtttgactccgttcaacttccaaaattcctcaaatctcgagatctatct

SEQ ID NO: 60365 - DNA, 719 bp, Oryza sativa
atctttgttctgattcctgtgcatgaattgcttatggtagcctctagacaaatttcattaggatgtgtcaattttgactgctacttcttcagatatcatcagttagaaaagaggattgatcttgcacatttcattactagtgcttaccttccatcaacttctcaatgatgaaacccgcaaataaagaaaaacttgacattccgaggaattagccaaatgctggtgtacatggttagaaggacaaattgttgtaatatgcccttttttttctatgatattttgcaacatgcgaaatattttcatagaaattagcactgaaatattgaaatgcccatcacagcacaagtaaaagaaagaccatgtttaattgaataccatcacaagacagaatcaagaagtgccagtaactattatctatccaatagaaacaataagagaaatccatgttcaatgatcagttttgtcagctatgatatgtccatactccataccagcagtgtattacaagtttacaattggaataagccattccacgaaaaaaacaacagcagtgctatttgtattcagtattcctgaagaaattgggtgacacaaggaagttgcttctagattaacattgtgatttgttgcagggattcacactacacaaaagcctatttcaagattaaaggatctctgaatgtaaatctaagcatgcaagtcaagcattggagctttta

SEQ ID NO: 60366 - DNA, 1082 bp, Oryza sativa
tgtttctagcgaaatgtacgttctcttgaaaaatttctgaccaaaatatatgaccttgtttttcctctataaatcaaacaatttcacatgaaaattctatgcattttttcacataaattaagctctctatctctctgttatgagataggagtaatgttttttttaagaatctgtttgctcatataaactctactggcttgattctaaacttgggtgggtggtttccgttaccacatcctgttgataagcccgttaccgtgataactgacctttagggagaccttgtttcaactatcactctggttatggaattgtgtttttttaaaaatcggtttgctatgaagttaatgaatttcatgcaaactctactagcatgattctaaacttggataggcggttaccgttatcgcacctcattgataagcctggttaccgcggtaactgatgttaagggagaccttgatttaaactctctcttattacgcaattatgctttttaagaatctatgtgcttatataagcttgtgaattccatgcaaactttactagcatgattctaaacttggtccatacgttacacggtttccgttaccgtatcccgttgataagtccggttaccgcgataaccgacaataatgaagacctttgacttggatttgagctaatgagacaagcattagtagcttccaatccagatgatatccttccatgtttgtaccaacattgaccaatgatggctaccaagtgtactaatgtactgacattttcttagggccccaacaacataaaattgaccggagtagaccacctcatcagtgtgggcccagcggcgcagccaccacaaaatcccctgcgtgtcttccgagttttaaaaccgaacagccaaaaagaagaccaaagggaaaaaaaatctgaccatttcttgatttcttcttctcccttctctctctccatcactccatggaccaagagaagcatcaagccatggccggcgctgccgacgccgccgccggcggtggctctgttgcgaaggacacgggcgacgattttgagttctgtgtactgtcgtccggtgggctcgt

SEQ ID NO: 60367 - DNA, 1402 bp, Oryza sativa
acaaaagtgatcttatccttctgcctaacaattgtaacatcacagtcgcatgcccatgatgatcatccccttaagatcttgtccccttgcccatgtatctaagtgggtgtattgtgtacagacctggttatgtaggagtgttggagtcttcagaaaatgtacgaagcatggtgcatgcctgggggtatggaaaggaagtatcaccacatgcgtgcaagcatatataacctacaaaaaaacatatgcaatacatgtgtaagaatactctgcaagttactgtgccattgtccagtctgcctcagctctttttcaaggtgacttacaggatgattatttgagaaaaaagtatctaccttgcaggagcatctgaaggtgctcgtccaagtaccataaactttccaaagtcatggtctttgacaaatctattgattaccattcctttaattttgatgtaccttgaaaaaggaaaccacagggactacaagacgcgcaaacaccaggtcatagtaacctgcatatcaaggcacgtccaaaaaaatgctaagattgagacatcaatacatcataaaaatcttttgttctatttccccccaagtcaaataaaggaagaactatgtgaacttaattagtttgttgagtaatgaaaacagcaattgcttgcatggttactagaaaccccatcctaatctatcagcatggatccaatatcattactgtcaaaacttttttgttctgggagtactaaatcatcgatccattgcatccttagtgttaaaccttttcgtgaatttagtgttaaaccttttgagttgggagttcataagatcaggatatataacacacgtcaaaattttaaattgtgcaaatggtatatggtatgtaactatgtatatgtaatgtatgcaaagtttgaccactaataagacttgtctggtttagtttctgtcaaatcaagcttgtgtactgctaagtatccaaaggggccaccgccagacatacaagaagtaacattcacaggaaacaccttacactatgggaaagtacagcaatacatacgctaatcaacaatttcattgttccacattccaagcccaacagatacagcgagcaactttttttttcaaaaacattgagacggtagttactattaagtagtagcaaaatatggcaagaacaaaataatcctttttttaagagacgaagcaagaacaggatagcacattagacatatatgtacaagaaaaaaagattagagtattctgaaggcatgcatgtgtactccattatagagcactagaacaactgatgagattctccctaccaacaaggcgaaatgcccagctggtttgactgcatgccaaattgctctcactcttttccaacatgctgcatacatgacatg

SEQ ID NO: 60368 - DNA, 1459 bp, Oryza sativa
actcttgcgaagaaagtgcttgaatctcttgacaataaaagccatttcttcatcttgactttcttcaccacttgactcttcttcttgttttgccttcaaagcaacttcttgattcttgatcatggcggcattcttcaccatttgtctcacttcacgagcttcctcttcttgcatctcatgagacacaattcttccaacaatgtcacttggggtgagcctcttgaagtctttcctttcccgtatcattgatacaagagtgggatttcttggaccaaaagtacggagaagtcttttgacaacaaagtgatttgtcatgtcctcactcccaagtcctttaatcttgttgacaaggatcatcatcctatcatacatctcttgtggtgtctccttgtcatccatcacaaatcttcctagccttccttccaatagttcaatcttggcatcacaaatggcgggtgatccctcatgagccaattgcaaagtatcccatatctccttggcctcctctagtccatcaaccttgttgaactcctccggactcaaggcggagagaattgcattggaagcttgagcattgcggtggatgagttgttcttgctccgaagtgagctccatgtcctcatgaggtacgtcaatacctgtacacacaattttccaaatacttggatgcaaagagattagatgcaacttcatcttgtgcttccaagcggcgtaatatgtcccatcaaattgaggagcacgcccggaaggcacggagacgaagttgtgagagggaatggtaagtttgttgtaatcaaaaggtatagtggctccccttgggtgatggagttcccttgttgctcgctccatcttcatttccaatttccccgtcctttccccctaagtccgacatcgtggatcactcaaagcggtgaagcttgaatcaagagcaccttgatctgataccaattgaacgcacagagatgtagcctagagggggggtgaataggctttcctgaaattttctcaacaatcgcagcggttaaattaacagggcccggaacctcctggtgaagaacaccggaacttcctggcagagatgagcagcccggaacttccggagttcttgagctaggaaattccgggcaacagagaaaatcaaaatttggggaagcaaaacaagtcctagctagagacaatcaggcacaaggttgcacaagatgtaaatcacaagataccagcagattcaaacacaaatcatgcacaagagagacaggcgattttttcccgaagttcggatcacacggatcctactctccgttgaggtgctcaaagagccgggtctcgattaaccccttgcctcacttatgcaaagatcccagaagaagtccacagccttcaactcaacacttctaggtcattttctagaattgagtgaccaccaagatccaactcacaattccttctagaaaagaccaca

SEQ ID NO: 60369 - DNA, 7637 bp, Oryza sativa
atatgcccctttagacacaaccttattgatttgaaacggtccttcccaatttggtgaccacttgccgaacttgttatcccgagttccaatcggcaaaatcaacttccatacaagttcaccttccgaaaaaatcttaggcactactttcttgttataatgcctagcaactcgttccttatctttggtaaccttagcaagggctcgtaaacacgattgaacaaaatcctccctctcatcggccataaggttataatactcatcggctgtcaaaccgtcttgcaattctatccttctagagccgattctaccttcccatggcaaaacagcttcatatccataaacaagcttataaggaggaacttgaattgatccatgacaagccatccgataagaccacaatgcttcggccaaccgggtatgccattgccgaggataatcagaaatcttccacttaattaatttgatcaagctcttgttagatgcctcggcctgcccattagcttgtgcataatatggtgaagaattcaacaatttgatacacacactctcggcaaactaaacaaacttatcggacatgaagatcgaaccttgatcagttgtaatagtttgaggaataccaaatcggtagattatatgttcttgaacaaattaaattgcatccccagaatcaactttcttcaaaggaatggcctccacccagttggtgaaataatcagtcgccaccaatataaacttatgccctttacttgatggtgggtttatcataccgatcatatcaattcccaaacctttgaatggccacggtttaataataggattcatagccgacgccggcgctcgttgaattgccccaaacttctggcaatcttgacaccccttataatatctgaagcaatcctccagcattgtcggccaaaaataccctgcacaccgaagtaaccacttcatcttatgggccgattggtgagtgccacaaattccttcatgaacttcgccgattgcaactttagcctgatcggcactcaaacacttaagtaacactccattaatcgttcgataataaagctcatcatccaatagagtgtacttcaacgccttatatcttaatttcctagaagccgattgagatggattatgtaaatattgatgcacatcatacctccaatcatcggctgttattgctgcaatttaaaccttaacatctttgatcatcagtttataccccgatgccccttgggccaaatcattagcttcaatattttgttctcgagatacatgctttaaagtaaccagccgaaattccttcatcagttcttggcacttctcattataaaccattaatatatcattcttgcactcatactcccctgccaattgactgattaccagcaaagaatcccccatgatttcaatagcatcggcttcaacttccttgagcaactgcaaccctttaagcactgcttcatactcagcttgattattagtcgcataaggtttaatagcataagcaaactcgaaacatgcccccataggggaaattataactaggctgataccacaaccatgagtacacaccgatccatcaaagaataaagtccatggcaccatttcaaccgagccgattgaatcatcacgatgttccacaataaaatcggctatagcttgtcccttaatcgccttcagtgactcataccgaagatcaaactcagttaaggaaaatatccactttccaaccattcctttcaatattggagccgataacatgtatctaacaacgtcggccttgcatataatagttcattcattggacagtaaataatgccttaacctcgtgcatgaaaaatataaacataagcataacttccccataggagaatatctagtctctgcatccaagagccaacgactgagataaaatacaactcgttctttttcattcaactcctgaatcaagactgagccgattgacttctcaccggctaacagatacaatctaaaaggtatccctttctgtggaggaatcaaaacaggaggggaactcaggtatcctttaatattatccaaagccttttgctgctctgctccccaagaaaactgctaatcagccttcaatctcaacaatgatgtaaaagggtctaattttccagacaaattagaaataaaccttcgaaaaaaattaatcttgccgatcatctcctgcaattcggtcttgttttccgggggcttaatcttttttatcgcattgatacttctctaagttatctcaattcccctctcatggacaagaaatcctaagaactggccagccgatacaccaaaagtacattttgtcggattcatcttcaagccatatttccaagtcctctcgaaaacttttattaaatcggctatgtggtcttttatttccttagatttaacaaccacatcatcaatatagacctcaaccagccagccgattagatcatgataaatataattcatggcccattgatatgtagctccagcactcttcaagccgaaagtcataacaacccattcaaataagccgattgcaccaggtcatctaaaagctgtcttatggatatctacttcagcaattaaaatttgattataccctgcgtttccatccataaaactcaaaattttgttccctgacgcagcatcaaccagctgatcggctactggcattggatattcatcttttggtgtagatttattcagatctctaaaatcaatgcataccctcaccttgccgttcttcttgatgacaggaactatgctagaaacccactcagcatatcggcaaggacgaataaaaccagcatcatataaactcttaatctcagccttgacaggttcaagcatatcggctttgcatctcctcggaggctgctggtgtggcctaacccctagtttgataggtagccaatgttctacaattgatcggctgagtccaggcatctcataatactcccaagcgaagcaatctctaaactcttttaagagctctatcagcttggttctaaattctggagacaaattcatactaataaatgtcggccttggccgatcgcttggacctatatctatttcttccaaatcatcagccgacataaaaccttgaccttgcttgccaagaattggacacttttagaaaatctccatcccaaacttttccagataaacaatcaaggccatccatctcccaaagagctaaatcggcactggcaacattaactgacctgtcggctggcacgatctctattttgtcgccttgccactgaatcaagcattgatgcatagttgaaggaatacaacaattggcgtgaatccaatcccttccaagcaacaagctgtaagaacacttcccatcgatgacaaaaaacgtggtaggaatagtcttactgccgaccatcagctccacatttagaacacctttgtttttcgatggattgccaccaaagtccttgagcaccatatttgtcttgatgagatcctcggcatttctacccaacttcctgaatgtagcataaggcatcaaatttaacatggccccaccatcaaccataattttagacatcggcttcccattgacatagtcatttatatacaatggtttaaaatgccgattctctgtcccctcaggcttcttgaacaccgcctgttctggtgatagaaccaacttagtcgattcctcttccacctcatcgacatcgccttaatcgatcccgaattcggctggcaaggtaaaaaccatgttaactggtgccgtcacaacactctttccttttgccaacctctttgcctcatcggctgcaacatcatcggctacaggagcctgattcttaacacgccactcctgcctcggttttgctttcttcagccgatgattaatttctttctcgacctcctggaagcgttctctactcctcaatctttgaacccttcttttctgattcttcataaaaataccagaaggacaccattgagtcttcctattttcgttgtcttccaaatcaccacgttggttcactgggcccaatctttgatgaacaggtactcttgtctgttttggccgattgcctccatcgtacaatcggcttgaaccccctgcaacatcactgcatccaggacaatcctcgatagatggtagcctcataccttcattccaatagaacctgaagaactcacagccccaatgaggatcaaagccaccattatcttcttcatgatgcctttcctgttgcttgccgtatttcctttgatatttgtttataattctagccaaacttacttgataacccctcatgcaccccgtatcagctattcggtcagctatgtgtaccatgttaacaggaaatgggttaccatcgaccctcatcggctttttgtaatcatcaaacttaatcttgcctccctcaatggccacctgaatctgttgtctaaaaaccttgcaatcgttagtagaatgggatccgaaattatgccatttgcaatatctctttttgcctaattcctcagccgatggaatcgtatgaccagcagggagttgaatttgcttccctcggagtagcagatcaaaaatcttgtcagctttagtaatatcaaaaacatacctctcttcctttccagaactctttacccattggcacggtatgacctttttactcctcacccattcggctgcagctatttcagaatcatcctcatcgtcatccgacccatacatgtaaggacaaacatgattaaccttcttagagcttttcctagcctccgcagacctatgctcgtgcaaggtcaccttttgtatcagatgtgacaagctatcatagtcttcggacgagaatttctccctaatcggagcaatcatgccctgaaaggctagatcggctaactgagcgtcagttaaactcaagctaaagcatttgttcctcatctccctgaatctctgaatatattcgtgcacaggttcatcatgccgctgcttaatcacagtcaagtcagataacttcatcttatgaaccccactgtagaaatagctgtgaaattgcttcttcaaatcggcccaactattgatcgacccatacggtagagaagaaaaccaagtaaaagccgatccagacaaatataaccagaacaacctatccctcagagcgtccacagccgatgcttcactacactgagctaaaaattggctaatgtgctcataagttgacacaccatcctgtcataagtccggaactttgaaccgattggagagaggaactctctcaaaccactcagggtaaggctgccgatacaagcctccagtctcttttggtttaagcccaaactgttccctcattacatcagcaatcacatcggcccacggtagttgctgagctgctccctgtgactgttgttgcatgggctcgaactgaccgtactgagacacaaactaaggttgagccagtccccctggctgatattgggcttccggggaaggaggctgatattgataattcaagttgccccctggtaattatgaaggttcggctgaatattacgtgccaaatgctcgggaacaacttgaggcattactgtgccatccggctgtacgtggtgaaccaagtgttctgggacgacttgatttaaaaattgttgtacaggctgtcctccaggcgtcacaaacctgaccgatgtgctcattgagccttggtgctaaatcggctgaacgatttgctgtcttaacggcgcctactgaattggccgcggaggctgttgccttggtggcgtttgctgaactagttgcacaacttgttgctggattggttgtacaacctgctgaatcaggagtgtctgttgaatcggctgctgctgtattggatcaacagcatattgaggcggcagaaacgtggcagcaacctgatcctgcatcagccgattcgcaacctgcccactatgctgtggctgctctctcattaacaaccctcaccagctggcctggtgccaatgctgacggagcaggtaagggagtcgatgccagcgccgtcggctgagctgatggtgcgatggggggaactgcctgaatagatggctgggcatcagtgatcaaaggccgataatttggaaagacacctccttgcaaataaactgggcctgcagcctgatgctcagctattaatccatcggctattgacttcatcatgtttgataaggtattgactaataccccagactgattgatcaaagcatggtgcacaacatagtcgacccggtcttagaaattattgaaaaaatcgtgtgccgcatcactattctgattaagatttcccccttgcaacccctaagcaccatcaccttgaactccatgcactccatcgccttgaactccatggatcccttgagagttgtcaccttgacttcctagagaaccgttggtagcacctttgtcactcagttgagccgagccatctagagcttgtttcctgtcttcacctttggaagaactggtcccatgatctacatttactttatacttctgaaccaatgttcccttgcggatctgcatgaatgagttcaagaactgatcccaggcttgctgcaacattgcttcaaaatccttcttctgctcaggtgtgaatttctctggatcgatgggcacgacgtttccttcattgacgtcagtcaaccccaacttctggatcttttctttaacagtgcttgggctagccgaggatggtgacagcggtggcttctcggccatgaggaagaattgcttgctgacttctaatcggtcccactaggcctgccaaaagcgtgttgatagaaaacacgaggcctgggaaatctgcttaactccaatgcaggtccaaagctcgccttcgaatgtatgagcgtgcagttgatttcatcctgtaatcaacaagaaatagagacaaagaattcgtggttaaatctataaatgatagccgatcggctaggtgccgatgacatatcatttatctttgagccgatgtcatatatgaatcgatcggtggttataaatagacagtaaggaactaaatctattcgatcggctgtagatattaacgatatatagttcttatattaatatatacttaaatcaagtaattgggatagatcggccaccatgccgagacagtataaatcacttagaccgaaatatatattaataacaggattatatatgtttatagcatagccgatcagatagatctagcatgtatcggctaattctccgatactactctatataaagatatcaagacaagtataatataccaaacaaaagcttaatatacttaaatgcagtaagatcttgacataaagggcggatttaacatgtcactgaggcacatagatcgaatatggttaaatcagataagatcggctgaaactctgatactaccctaatcggcaaccagaggacaggctagagattgatattctaagcacaacttaatagatcaaactcaactgatgcatcattaagtatgaaaagaagaacaatatctagacaatcaagccgctggatgtttcataaagtggtaaatatcttatataatctaggacaacgtcgctatttaacctaatcggctgccttctattaatagatgttagccgattgtaggtta

SEQ ID NO: 60370 - DNA, 10541 bp, Oryza sativa
taactcctattttcagcagactgtcaaaaaaataacaagtagaaaatcttaattgttacattactgttgttccactttcaagcaatagcaactaattaatatagtgattcatgtccctctcatgataggcaagagcaatgtaaatattatcaatatgtacgaaatgatatgacctgcacaaaggtgactaagcttgtatggcattattaaaaggaaatgtctatccaaaggttcaggttaggccttttagacaagttatttaaaggagtttccatggtagagcaaaattgtctatgaaataaatgtttgttgcagcagaagcctatttagatgtggttgactttaaatgcataaagcaaaagtgatcagctgctgaaaaatgtaccttgctaggacaatatttctcaaatatttgatgaagataaatactgtacagcagaagcaggaaactcagattctgggagaggttgtgttttctaaagaggtgtgtccaaaagatgctaactgctcaggtcatcctacaaacagacatgagatgataaacctcagagacagaatacccatgacacaagctaaaaatattttgctgcacatggttgaacagttggagcaattgaccagatgttcaaaataagaacttctggatgggctggccaattcatgaaaagaacatagacatggggtccaattcttgttcaagcatttagaagaaagcaagaattaacaaggccagtcatgggccttgggcctgaattccagaccatcatttaagtcacactacaaaaattatgccctccaagaaaatcatgccctagttttcaaggaagacagacaagatggaggaaaagatattgtgatttacagatttccatatttacaccgcttcttgaatctttgtcgttgcatcaccagcttgaggattattacttcacaaatatgattagttccttacttcctttggatgttgttgataatgaccgtgctttgatgctcaaatcatgggttggaaacttatgctttttcctttgaagtatttgggagcccaccttcattttaaatagacttagaaaaaaaagataaccagcctaatgttgataaagttgtgaagagtggctggctggagggtcagaattctatcctatggtgggcaattggttctgattaaatttcttgtttatctacttttctgttcttaaattcattgtttggtctgtgaaggctataatagatttctgatcagaatgggtctgggtaaatgaaaacactcagatgatggttcttgttgattctgctctgaaaatgaatctgtaccaaaaaaaaaatactgcaatgttgctaaaatcctttggacagagatgtcgaacatgttatctcgccaggccggcagaagccggccgaagtttattaagggaagtcagacatgctatctgttttggtaatagtttaaactttgaatgtgttgctataagtggaaacaagatttaacatccttgtggaatatgagaaatgacctactttttttttctgtgttacattgaagaagtatgaagattgtgcagcacaggatgatgctgacattgaggaactggagtctggggaatgttgtgcctagacagctattatggctgatggaccagaatatgtaaagagtgaagaaggggctggtacagaagagattgaagattgagctgtggagcaaggggcagagcttgaagtggaggaactctaccctatgtatgagaagtaatcagaaagcatgtcaggttgtttagatttgtgtgccaaaagcatgcgttgctgtctacaaatctttgtactctgggttagtgtgccgtgaagtcatccatgtgtggaattttgggcctgtactgcttcttcagcttggaactctgtaaatatgttggtctcgttctaatgaagtccagaactgatgcttagccctttggttctaagaattattaggattatccttgtttccttagtgacttacctccctgtattcccttattaacagcatcatgccattgggccaggtatgttttagtatgctcctgagctccataaaaaaaccttaaagttctagtcaaggtcaagtacaatggaaacaagaacagtatcatatccactgggcaatcatctgatctgtgcatgaccatagataaaccactccattatttaagatcgaagtttcaatgcaagcagaaaatttaatggagtgtgccaagaaatagaagattagcatgtaagcttattttcttcttgtgttttatatagactaggcatatccgcatatatcaggattgtcaacatacctgaaccagagtgccttaccactatcgtatcacacagatgcatttgctccagccaacagtaatctcttttatatatgtacttctaatctatctgtggtacgcattgatgcttcatttgagcagtgctgatgtatatccctgcagaactgaaaagcccactgaaaaaaaggaaattttctgcataattagtatttgtattggacaaactaaaatgcataaccattcccttaatcctgaactcaagatacagtgcaactttctagtgacagagcatcagaccataaaatgtgggaagattgtaataatattggtcgttagttatgaactgctaaagtgctaagacaaaccactacctgggtataaatataaatagctattttgttcaagacaaaccactacctgcgtataaatataaatagctattttattcttttcttttacaataaatagccattgtgttgattgttgaccactataaaagacatggcggaaaacttgtattgtcaactaagtatttacaggataaagcaaggatcaacattcacatttcaattggtgaacatcgaccaaatgctcaaccgtgcgaaaccgtatcagcttactatggttgagaccaatatgcaagtcatgttgtctgctacgcaacaatttaggtctgtacctgaggtcatgctatgctctaggcagaaatttacagattcctataataagaacctgaaagccaatttttcagtcacactgaccacccaattgcaaccattgatttcaaattggcaaattggttgcaattgggtggtcagtgtgtgtttgataaattattttactaaaattcatcgaataaatatttcaagtaatatcggtcacatgaagcagaactgtatgatacgtgggcccaaaattatcaaataataaacatgtctaaatatatccaatattggacttgttctgttgcgtattccgaataaaaaaatagtggtgcaaacagatttcaaatttgatgcacagtctaaagttttgaggtattcaaaataaaaagagattgactagtactacgtgtaaattacatttgatctgttggtggcaactacattaaaggtgggacccactgtcattagtagagataatttcctgattatctccagacttcagtaccacgtcgatgggttagctcatctctgcgctctggcttggcttatcacggagattaacgcgtggcgctgaaagtgcattaatccccctagtgggttttggtgattaatgacaaatgtggttaagggactaatgagttcattaagtgactttcaggtgcattagtccaaagtgtggaagatggatgcttggagaccccaaaaagtacaaaatcaaagcggaccggaactcgagaagtgcataggatagtttatcttttgaaatcgagtttttaggaaaaaccgtactattaaaaggggttccaggtgatgctctgagatatatcaagtgctcttagtgtgaaccaagtgtcaagtttccctaggagtcatttttgcaaatactccatttgtccaaaaatgcaagtccggaacttactgtcttccaggtccggaagttccggtcttgtgaaaaagattttcctaagtgtagtccggaagttccggtcttccaggtccggaacttcctgtctagtttccagttcaaatttgtgagtaacggctagatgacgtcacctagccgttatacatatacagctcgtttccagctcgttccttggccattccactttcatttttcaaacctagagctattgctagcctctcccaagtgtttctggccttctccactcaatctagagcctaattcttgtgagaaagagagattgagagggagagaagaagatttggagatgtgtgaagactagatcttgggtgagcacttggaatatctcgtgggctgtcatctcggtgcttattactcttggagatgatctcctagacggttaggtgtcgcccgcgagaatccgttgcatattgtggatgtcccgggtaagtttgtgaaggatttcctctcctccgaaagggaacgaggtaagttagtgaagttcttgtgctgagattctagaggctttccaagtagagcaacccacacttgtggtggatttctagaagtaggttgagttggatcttggtggtcactcaattctagaaatttgcctaggggtgtttggggttgaaggctgtggattttctctggggtttttgcacaagtgaggcaaggggttaatcgagacccagctctttggagctcctcaacggagagtaggatcgcaagatccgaacttcgggaaaaaatcgctcttgtctctttctgtgatgtttctgtggatgattctgtgatatatcctctgcttagaatacctgtgcaccatcttgtgaagattagcttagtctcttgtttcgaaatttgaatttcatctctgttctgttacccggaagttcctgtcttagaacaccggaagttccgggcctgggaggccggaagttccggagttccttaccaggaagctccgggtctgtttgaattttaccgcttcgatttgtttttaagttttcagggacagcctattcaccccccccccctctatgcttcatcaacgcgttcaggcgctagaaattcggaggcaatttccattgcctctgcctatataagacgtgaaccactaggtgtcgcgggagaggggaggagaccggagaaaattagaaggagaagaagagaagcagggagaggcgcacaaaaacaactcacattgatctatttgctggtggtgttccgaggagattagaaacttctcggtgactcgcctgcagttcgtgagcaagcgcgccacagtgagattaaatatctctcatcgtcgagccgatgtcgcaagtggagatgatggtggtagatggtaagtatgataaataatcctctccaaccctgttggtaaaccagtcgttctaatggattatcggagtacctccttctcatcaattggagcgctttggaaatcaaatcgcctccattttcttgaagcataaacttggatttgtctaatctgcggattggattatcctcgtattttttataatcaacactcttatttttatggtgcgcatgccgggagcgagccctaaattataaacaaaggaggagtggagataaaaaaaaaaagatatatgctatgttcatgaccgacgaggccaagcaatgcattggctaaagctgaaaaatgctatggctgttatatatgtctatttataggcgaaaccatggccgagtgctgacaaggccaggtcactatactattaacacgtctagtctaaaatgaacgggagccggatacaccgttgctgggcactgacgaggcaaaagcaaccacaaaaaatccatgtttgatgaaggccgagatacatgactgggcaccgatgaggcaaaagtcacccgcttcaccaaatttcctctacacgccgacgtgatggtagtgtactgtgaccgggttttggtgaaacaaagccacccgttacacattcactatattcaccgtaaaatctgcaccaacctcaaccttcagcgagcaaataatttttgagacggcgatcacaaagcgcagcttaatcggaggtattccataggctcgtcctgtggatgtaattaactggtagcctcattgctaggcgccgggaatcagcgaactgcacgcaatctccagtcagcataccttttcattaagcatttctcgcgaaggcaaaaggcgaactcctgcgggagccctcatgtatttgtaaatattcattaaatacagggtttccctattttctgtgtgttcattgttttgttttcatcaaacagtgtgaatcgctgcagctgatcaaaatcccaaaggactaacactgaaaccaccccttcttggtgaatattacatttttgctgttgtcgccgtgcaaatgctcccccccccccccccccacacagacaagagacgatgcaattgtggctgcggcgtatgccaaactgccaagacggtgctgatcaccgatcagccaaaccaccgagcaggtcgcgggcgtggggaggcaggcaaccaacaacccaacgtaccagagctgacacgacgagaatcaacgacgccgccaatggcgaaccaaaatcgcaatcccggcgccgaatctcctctactctgtggaatgacgcgaacagcagagcagagacaacacccgatggaaactaccacatcatctgcaacggattgctcccccccccccccttcccccatccgcttaaccccacggattgctcccccgatcccgcggcaaaacccctcaaacctcacatcacacgcagcaacaagcaaacaaaccctagatggagtagaaaagctggagagaactaactgtagatgcgttcgcgggagctcaccgattgcggccggcgacggctggtcccgaggaatcctccggtggcacgggtcgctcccgcggtggcggcggtgagctccattgccccccgagagattttgaaatgggagtaaaaatcaagagatcaaatcaaaatgtcctcgaaatttcgaattcttttttttttttttgttgagagatggtgttgtgcacttgtgcgttagcgggaatgcggcggacgacggcgttttggcgctgtgacactggtgcgtggggcccacttgggaagctttcgcatttgcaagggatcgtctcttctttgctaggcccaccactggttttatcgaaatcattaacaggtccttccaggacttggattgaaaaggcgtgaagataagcttgtgatttttaactcttacatatgggttttgcgcttgtgtaattgtgttgcctctagcacctggccacctgctacgagaaaatggccctgctccttttataatttttctcaagatttttaccacggattatttgctcctcacttcttaaaaaatatgatttcttaaaaaaaaaaactttctctccactacagtgattagacaacctattctaaactatttttaagtttagtcttcaaaatattaatcattatattaatcaaataaacaatccgtgacaataatccaagcaaatgtatatgcatctcatgttggtgtcatgattggggatgcgtcacttagatttgtgttgtgttgatagcatgttttagattgttgggttagtagtatattagatcgccaaaagcttggatgtgacataagagttattgcctgtataaactatgcatattagcatgctcataattttggatttcctctcttgtatgtctagcaataagttgttcccttttatttttagtgccccattgctaccaaaagattagttacgctaggtttaattaaaaaaacataaccaatttactaatgaaaggtcattgagatttaaggtaagtgttatatttgctgtgataattcaagtcttgtcctaattttatcaaatggaatcacagtttcacatgcaaattaaaacatgaaagatttgatgaagtcaaaatagcttgtcatgttccgctatagacaaatacatgttttatacttgtcaaaggaaggtcattgacccctttgacaatgacagatgcggcttcatcagagaaaaggcacaaaaagtgacagaaactactgaacgtggaggccactagaggtgacgtggaccattggaagtataaaagaccaccagcggatagtaaagacctttgagagagtttataccacttagatccaacagagtaggcttgtcctatgaggccaagccccacaacaaggcccgtaggacctagaagttggaggcttgcaaaaagacatgtatgcccttgtacatacctatttgtaaggggttgggatataaaattacctatgtaccataccctagccctatacaatactgggtttcaagggaaatgcaatgaacatattttttaagaattaagaagattagggtttgagcgtacatcacatcaagggcattggaacttctctaaggctgtatttggaaccctaagttcccaacccctctacctcgtattccacgtgcacattcaaactgctaaatggtgcatttttttgcaaaaggtttctaaatgaaagttgcttaaaaaaatcattttgatccattttttttaaaaaaactaatacttaattaatcacacaccaatggaccactccgttttccgtgcacactgtgcgtgttgggaacatatgcttccgaatacagcctaagttcttgccctaacaaattgttgcctttgataacactacctttttatttgttatacataggatgatataaattcgtcaatcatacagtaattagcatttacttccccctctcaaatatatgactagcctaaaattgcaccaaaagaaacacaaacaataattaaaaggctagcatatctatcttctccatttctcatactcaaaactagttggtggtctaccctaagccttagattttgttacctagactctcgttgtaatatacagatttatgtctagatgaaaaaacaggtcttttatcctagtatgagaaagttttttttttcttattttctttttcaaaaatatattgtagggtcataaccggatttagttactcgtgatcaatctccacaaaactatatttgttgaaatgagctacataaacacgacatgtttttcacatgcaaaatttagacacttcttagataattcgttcgtgagcataatagcctttgcccacgatttcttgaaataaacacccacttaacacaaactaaacatcttccctagctaaggctaacttatgccttttatcattttgttggtcatgatgtctctataacaagctataattggcctcgaaactaaaccttggtgaggtcagcttttaagcaaatgacccccataggatcatagtctctcatgctatgtactgtagatgacagcaacaaattatatgagcgtgtgctttcaatagaattttagcaaaggttaaggagctgctgctagtctccatctatttgaccttatgttcgggcacatattcccggagcgcgagtatagtgatatatgtgccttcactcttatcttgaaaaaaaaagagacaaaatttaagactttatttaaaaaggatggtcatttataaaatttgaaaagtataaaaaaactacttctgccttactttcactacacgaaacaaatgaaggatcatgctgcatgaaataccacattccacaggcacctcccgcaaaaacaccgaaggtccccgtatgaggaggcagctcgtgctcgggcggcgagactgagacgagacgcgagaccaaaccctcccctccccgaccgcgccccgcccagatctcgccgccgacgagatgcatcgccgcggcggccaccacctccacctcctcctcgccgccgccgtcgtcctcctcctcaccgtcgcggggctgcccctcgcttccgcctccgagtccgaccacaaggtgcgttgtcgcccgctcccccaccccctctctctctctctctctctctctctctctctctctcttccttccttcctttcttccttcccttaaccctagatccgaacccccgacgtgttcctcacgctggatccgccgagtcgccgcgctggatctaggagcggcggcgcggtttcggtagctttgggttccgtggcctctttgctttgggcgagtgctgcgtggttcgaggtgcaaggttgatcttagcaatatgataggaagggctggacagctaggaatacggaagctatgggctggaggattggttcgaaggctgttctaaaggcttgctacttgatgatcttgtttgccatgagagtgaagaaaaaaatcattagtggaaacacatttggtagaaaaaacgtttttggtgctgtagtgcttcgattagcttgttatttgagcagacaagccactgcaattgtattgctgttcaaataatctgtatcatgctaggcctttgaataagattatgacagcagacttttcctgccttagcttcacatcatcaaaattttgaccttttggtggcgcatcaaaatgctgagatgcgaagcatttcatgcttgggatacatgaagcgcacactgttgtgggcttgttacagttgatttattatcctttggcgccttgacggggcagttatccttgtccttgctgcgtcttgaatgttttcattaattcttttttcctattttg

SEQ ID NO: 60371 - DNA, 6278 bp, Oryza sativa
aactataacgcaaatatgtaacattgttcacaaaatttacatatctgcgttatagtttatgaaaccagatgagagatatgtgagttttgtgaacaatgctactatcactttgtcggatgaagaaatgaccaaaataaaagttatagatcttgatgagttatacaactttgttgttgatgactttttcagttgaaatcatttagtatttgaaaatgttgtttgaagttgccatatgtttaaattcaaattcaaactgttcaaaaaatgttatatagaaaaatgaccaaaataaaagttatagatcttaatgagttatacaactttgttgttgatgactttttcagttgaaatcatttagtattctaaaatgttgtttgaagttatcatattttcgaattcaaatttaaactgttcagaaaatgttatatagaaaaataaccaaaataaaagttatagatcttgatgagttatacaactttgttattgacaattttgccatttgaaatcatttactacccgaaaaattatttgaatttcttatattttaaaattcaaattttatatagttcaatcaaacccagatggagaaatgaccaaaataaaattagtagatctcaatgagggatgctggggtgtggcatcttggcccaggacttaataggattaatagaatactcataccaacaagttaccacttcttatttctaaagaactctgaggttaagcgtgcttggcctggagcaatttagggatgagtgacttgcacaagcctggagcaagcacatgagtgaggacaaagtgtacaacaaaaaagacttgcctggcctaggagaggcgggacgttacatgggatttcttttttttttttgtggattatactcatccgtgacgtgctaatgagagtcatccgtgacgggcttttttgttggcccgattgaaatgtgtgtcatccgtgacggtcgaatgccccattgagatatttcaccacatcagtgacctttgcttgacggggcccctacccgatagagatggggcttgccgcccattacaaatgactgaacccgtgctagtggtcataaccatatcataaatatcaattacttagatgagcatggttccctatgatagatggttgttcacaagtgacaagtggtagcaaagaataaaaggtatacacgattaatcataggaagattctatttgttgagagttaatgttttcaattttcattttgagtcaaactaaattatatttaaactttcgatgcaggtttgacttacaaacaggggaggataagggaggagacgcgcaaacctgaccacacggcgaaagggtgacagagccaggctaggcaagggtcgggtgaacacttggtttggccaacccagccaggaattggttctggctgctgaattttgtgcacagccgtgggccagcgttcatcataccatcatgtcaagttgatcttgttgcgcgtcgggagttccgaaaagactcccccacatttgtcttgtaccttttctttattcaacaaaaacataaaaaacaaaatgggcttccatcgggatgaaacaccggccaaccaaactttattcaataatcctaggcgcatgaagttcctaaatttattttttttatctttatcttgataatttttttcatggcaacaatgagcatggtgggtatcttagcagggtggagatatgatgcacaaggtggttgagattcttaccggatagttcttaccaagcttagaactaaatcgaatgcaacaaagttttgcatttgttctgcttggttccatgtgcatctttgttttctcggagaccaaggagcgtggtatgagtgttgtagttattttacactgctccttagttgtctttttatttactgcaaaaggttagtggacaacaaatacccgagggattacaaagaattggaaagattttatcataccctcaagatcagttgttcacatccatgctaaaaaggaattgaattcaaaacttcagaagtgtggatctcacaaatttgccataattttattttgtcatcatttttttcgagagacactttattttattcttgaaaacaaatatatatatttttcatttttttattgttcaccaaattttcatttaagcaaaactcttgcagggctgaggtaaatttgcctgaacaaggtaaaggagcattcaacaatatacgcactgtgcaccttgagaggtgatctatttctcttttgcatgttagcaattgctttattcctggccctgtcctacctctagtgtgactcgtgcatgagaactcacctcggttgacggaactcgtcatgaaaagcttgtagacctccccccacacacacacttggacttttgtgtcataagacgtcaaaaaccaagtgtgagatgttggggtctcttgtgttgcatcgccaaggatcaccaacgtgctcggttgatgtagctcttgcattcttaggcatcgtatgaccctcgttcttaatctcaacctgtgattgttagtgaccaagaatacccgaatgtgcatactattctaaaactggtccttgccttcattggaaaaaaaaacttgccatgataatccggggtaactcctggcagtgctttgtttatggtcacaagctcagccatagagacatcttgctgcaaagttagtgccacaaacacatacgagatttgcaatagttatgataaatataagcatccacaaccacacttctaatcatgttagaaatgatggccaaaaggcggttgtggtcctcgcacaagaaagcgatactaaactaataggaccctggggattccttatgtgagcatgaatcttggggaattttgaaagagaagctttcatgctcaaagtgccgttctcatcctccagagttgatgtctcaagcttatccataacccaaaggttctccttctcaagagatgcatcgtgcaagaacgaggttgtttcttgacaactgtcaagaacaacatattgagggccagagagataaggttttggctcgattggaggtcatgatggtggttttatggaatgtaattcaaagatctcaaccgactcttctttttcttggataaaatccagagcgtcttgtttagaagatgatttgagcagctaaaatggaagaacaaccattatgtcctccacgatatcttcttcaggaagggtatcagtcaaggcttttcttgactgcgagaatggaacaaagaaattgaccctcctaaagagaatttgaggctacctaatcgaggagtattgatgagaagtttctcgattggatgtcttattagaacatcaaaatcttggatttcaaaaacatgaataatccaagattgcctccttgccatcatgaatgacaggcacgtcttgtacaatacctaattcttcaataagactcccgttagggtgctcgaagaatttgtttgtcggtgtaattgccttgtcactcagaatagtgaatacaaaggattttgagacaatattggcacagactgatggactgtaaaggataccaacattattcccttctaagtgatagggaatggttcgaggagcgatatttattagaattacttcggaagaaagctctgcctcctttagccattcgtcactcatgattgatgtcagctcccgaactgtttcctttagatatccatattctattggatcgagagttggctagagaataggtggccgtaatattcgagaagatcgtccctgaatttgggagcacatcccggatcatgaatttcttcaatatctggagatagttcccgggaggattcctcattagatctgatgatgttgacggttcaggttcctccgtacctgacacagatgcctctggagggggttcaaatcactgcccgaaggtatttttggatattctatcgagaatttcctttccttcgacgggggttttgtgcatgaatgacctccagcagttatgttgaggtaaagtgcagactccttatccaaacccgtatggaaatgttgcagtaatgcaaaatcgggtatggcaaggttgggactagactgtaccagagtaacaaatctggcccaagctgcacctattgatttcttattattctaccgaaagctgaggacttcgatccggaggaaagtaatacgactaacaggaaagaatgtgaggcacaaaatctgtctcgcaattcattccagctaccactcacactcccaacggtgtaaatgtaccattgttttgctctctcttgaagagagaacggaaacaatttccatttaatagtctcccgtggcatgccttggatcaagaggcacgaacacagatgctcaaactctcgcaggtgatgataggagatttcctggtctagactagagaaagatttctccctaaccgtaatgatgaattcgggacgaatttcatagccaggtgttaaataggctccgatgaaggaggtggctcgtaaaatttgccccgtggagcagatagttgaaagatatattgtggctccatgggcgagaagagttttacaagaacatttctctgggtagcaggggtgaaggtagaagaaagaaaagtaaaaaggatatgaggatgaacaaggtgcagagataaacaacaaccgttctccggcaacggctctagaaatgcttgttggtatttcttaacgtcgcagatagaatttgcaagcgcacggaagataccgatgtagcacttgacccgagagtattccaaggtatcgatttctgcagggaacgtgtgtgttaactctttaccaggttcatctaaggacacgaagcaaagataggcaaagggtagagaggatttactagtgggagacaatgtctatggaaagcttaatttaatcctaacgcgatacttcgggtactggccagctcgctactcccagatatcgctctactacgtacccggacaggaaggactttagtgatcttgagggctgtcaccacctctacacccactgcacacctactgtgggatacagagcaaacactggaaatcaactacctagacaccatgtctaagcaattaatagctattctagtgtttagaactcactaaagcaatcactattttactgtattatagtgaacgatgatctagcacgctgattaggaaataactaagaggtaattctcaccaagcaaaactaaattactcaaaagatatttctattataatcagagtaattaacagagcagaaagaaataagaagaggattattgataactccggaactcctccgacttcttctactctctctccctaatctaatatataataaagtacaatagagcctcttataatttagctcaagctttggtgtgtgtgaatgagggagaggagagggccgtatttataggtggagagatgccttgggaatgtggagatgctaagcatcctaagagcattttctctcttgtgttgacaagtgtcctctctatgacggtttccaccggtagaaacggtcacaaccgccaatggatgaggattgcaactgccaggtgaaaaatgggcctggatggactagctggtggtttggccgaaccctggccggctctgctagcccagcccttcctcctagagactgatatgtgggccccattgtatattcttctgaagattggctcaaatgattgcatcttattgggtttatgggctcaagactccattagcttggatatgaaagttatattctcatccttcatgtatattttctctcaactttagtaacttgtcacctgcatacaaatatataccaacactcgtggaaattgttagaaataaaccctaccactatgttggatgttttacatttatggttttatgcaggtattgacggcattaatttggtacttaacagccgtcaacaaatccccacacttagctctttactcgtcccaagaaaaggttaaggattaatgtggaataaaatttccgaaaatatgtacaatataagtacacaaattattttaagccatacctgtacctatgaatttttgcactgtctaacttaccatcttgggcaattgatgaatggaacggatgtgactcaagtccttcttgttcctctcgtcaatctcttgggttttcatatattttcacaaagcagatatactcctcaaagggctttctctcaaatcactcatgtggtttgatttgtggatcctcaccaaggcatattatgccgaattgtccctattctaaaaggctgtatatgtggagctctgtagggatcaatcgg

SEQ ID NO: 60372 - DNA, 8275 bp, Oryza sativa
tctgactagacgcagtacataccgttctgtttaagaagattggcagcaactcaaaacaggtggcaattcgactttgaattagtgcagctatgcctgtgtttagtcaagcgtaaagttagattttggttgaaattggagatgatgtgactgaaaagttatgtgtatgacaggttgatgtgatagaaaaagactgaaatttggatccaaactttggatctaaacacagcctatacatgatgtaacgtgagaaagtttattcgtctctcaaggaaacactcctttatttttttatacggtttgaaaaatcacaaaaatattaataaaaagtagatcaataatacaatatataaataaaatacaagctcaaattcagctagaaatgaaaataataaattgactccgaataaaatgtgtcattcatagttaaatttattttttaattatatatatcaaattgaaattacataattgtcgagtgacacccccacatatttaattaatcttaatattttttattaaaattattaatgattttttaaaatggcatacaccgacatacacaagtaaagaaacgtagcctcgaacaacaaaagtccatcttacaatcatatactatttggacaacggaaagcctgtttcgtcttctactcttcttcccgtggcttttctgttccatgcgttttctgctctgctcctagaggtaagaccgccagcctctctacttgatcgccacggaaacggaagggaatccacatcagctagttgcgagcatcacgtgccccattcactctctttatttattgctgattcccgatcgatcgatcgatcagcaggcaatatataggcgtagttaatcgatctcaacaactacccatcagttattcaatacaatacagccattcagacagagccaaggtctatcgagtcagagagatcgacacagcgagcgagattggtgaattgatgggcgaccatggacgccggcggcaggcggaggcggcggctccgctgctggagaagaagggcagcaccggcaccggcgagggcgatgggtcctgcattgaggggtgccccgggtgcgtcgtcgaccggcggaaggccgcgagctccggcatcccatacgggagcttcctcttcgtctggatcgtcacactctgcacaggtaattaaccacccttcatttactctctcatccacccaccacatgcatcatcaatcgcgctctcatctcatcgatctgcacctgattctgttcctcttctcagttgatctccatatttatcgagtcttatcataatgagtctgtttaattagtttctcctatatatacatatattctccattgatcatgcagccacattggagtgccaatatatacatacagtcccttcaattaatcaaaatcattaaattgataattactaattttatgatttgttttaagatttgtgcacctcaaccaaccgttgaattttagcaatggcttatttgaggtgtttctgaatagctgtaggttcttctgataattagaagctctccaagcggtttaacttttcgttcatattctaataagttatagttgttgaattcacaaaataaaatagaagtagaaagccagaaaaccaattttttagctctaagaaataactacccaggctgtgtgtttagttaccttcacatcaaatgtttaaacacatgcatggagcattaaatatggaagaaaaaaaccaattgtacagtttgcatgtaaattgtgagacgaatattttgagcctaattacgccatgatttaacaatgtggtgctatagtaaatatttactaataacatattaattaggcttaatagattcgtctcgcagtttacagacggaatctgtaatttgtttttgttattagtgtatacttaaaaaaattttggacgggaaactaaacacggcccaaattagctgattattactactctgtcccaaaatataaattttggttgtccagatttataactaaaaaatacatatattttgggacggagggtacaattttaagcttttttttgcagtccatagattagatttttagaggttgaaacttgaaactgccaatggccgggtgcgtgtgcatgtgtagcagacggtcgcacactcgcacatgacctgacctgctgagattaaattcgtgagcttaatggttcattcattgcttttgtactacctatattctcgtttcttgattagcacaagccaaccattgctccatgcatgattagcgcttactcagacttcacttcatccacgttaccttctgtaaatttgttttttactttattaacctggccgtatggtttttcataatgtctcccatattttgaaagaaaaacaagatagcggctcatacgatatttcaatttgtattatactcgtataagtagctaacggtaatagagacagtagcggtggagttcacgcggccgcccaacccgttcgggaagtgcctccgccgttggctgcatgtgtgcaacaataaaatgagttgtttaataaacttgctatatattaagggaattgtatactagtttatataaccgtctcatgctcgaattgagaacaaaaacatatccagtggagttaaaatttttaagtagaccattaagttttaagtgaagtctaccgtaagatgatatctctgctacttaaaaagcgaacccgttcgtttgtactctttccgtacgtccttacatgtgtataagcaccatctctttaagaaaaacccactaacatgtgatttctcactgcctacaccctgaagccctgttcgcccataatttcaatcatgttctatgataaaggtgcactttccgatcagttaaacaccatgacttttacaaaagtctcctatatagaaattccgtgatatactttctataatttgttttatcactttttaacatctaattattggtttgtgcccttaaataattattttcacttttcgtggtatactgtgagtttatagcattgcatgctaattccaaatatgcatggagctatatgtgacgtggagctccaaccacccaagtcggatagagtttttgtcactctgtccaactgttggtagctcatgtgaactttggcgtgtatcacgtacaatatacgaacccatatgtacatgcatgcatgtgttaagttcgctttcatcaaatatttaatattactcgatctctgaatattctgagtcttgaaatccacagaaaatatttgaagatgaatgtgacagtactgtttgtacatgtctgggagacgtaaggatctgaatgtgttcgtgaaaaagttgaaggaaaataaaagaattcaagtctaaaatatatgttcaaaattcgaacatacaatagaacatatacagatttgagtatagtgtgcatatataggcataagtagtacaaactgaaacacaaaaatgtcaagtccagaaaaaaaattaaatttgaatatttagaaagtttcagaacgagtataaagttcggaatactagatatcttaaacgtgctagtatatatgaaaatgcacaaattccacatagaagccaggaagtcccacacaaatttgagcagtgcaaaaattggaagtttctatgacggccacataaaaaaatgccaggtaggcagaaaggtagtgaccgtaggccgccgtctattgtgtgtgtgaggttgcaaatcttttgttttctttgtgctgatgtgctagtaatcctaaatttcgcctactaataaatgacttccactaccacccacctccatggagctaaacatatgatggtatattctacccattcttgtttgtggcaatgcgcggggtggaatgttaaagcgacgaccacggctcgctcactccgttttggcttcctcttcctcgtcttcttgtcgttgttggctttccttgttgggaattccacgtacggaacggagcttggatttggagaggagaggagactgcctctgcctggctctccctcgccgccggcgcacgccattctgggcctctcctctttgccgattgataagaggagaagccgaggagcctccctgtttcaattcgttccggcgggtcgctgcaatccggcagcgaagttgaggtacaggtacgcgcgtgccgtgtagcagtcgattgattcatctcctctcctcgccggagatctctcgggcgcattgcccatttgccttgcctggcggcggtgggagggatggaagaggaggcgggggcggaggtgccgttgctcaagatcaagggggactaccaccaaggttgccctggctgtgcctatgaccgcaagaaggaggtctacaggggattgccttacaaggagttcctctatctctggatgatctgcctcaccgccggtatgcatggaacattccctccctttttcgcaaccttttgactagctctggagattcattctggggtaaagttcttcaactttttaacccatggtgctctaggaatttcccttttctagtgtagtacgaatgaatatctccaacaaagagaatcttggtaccacgtaggaacatgacaacatagggaatcttggtacctgcaggaacatgtcttctttcttgcaaatgctacatgttactgcaatgtccatgtgcagttccatatgggtttggtcggtgttcagtcatgtcgatgattcctgttcctgtggggaaatcgctgattctctataatagattaacaggaccaagttagttaagccaattgcctcaacaagatttccataatgggggggggggggggatgttgacatgctgttgctgtttttaccacgcacttctccatatttgctttcagtgctgcttacaaccgttaattacaatgtgatgtgatgctccgactcatactacacacgacgaccgtttacaccggtcataacgttgtccatggtgttacagttgcaaacttgcaatgccacgtcctggttcatgtgatgtgggttagctggggggtctattatgttaactagaaaatttattgtttgagggacatcactgtgcgaacaatattagatgcacaattaattcctgttatgtcatagtgccagtcatccaaaccttattgggcacataattaattcctgtaatctttcatcgcaccaatagtccaacccaacttcattgataggatatccaataatgggactgtaggtgatgctgattcagaccttgcagatctttaggttcttcattgtgtttgtgatcttttttacctacctcggttgctgaaatttttacaacactacatggcatctatgtcaacagtcagcagaagcatacactaaaatgtcctactccgtgttagattagatagcatacagtctgcaatgcaatattgatttgcgaaaatgcctttaactgattttccttaatgatgttttttaacatatttttttataccgctccaaatcgtgataaaggtcattgtgtaaactgtaaacttggaactgatgcatgacttgtttcccacgtgtcctatataagcatatgtaattgtgcatattttttaggggtgaagttccatgtgctgttctggtgttctgcataagctccatcatggtttttagatgaaaagctccatcatggttgcattgaacagtagtctttctcttttacaatagtggaacatgaaattaatttttctacttgaacatcgtttcctatctgctgttgaggatattgagtgctatcttgtttccttcagagtattgcttaaaaaaatgtgcgtggaacagtcaaaatctgagaagcatctagcacttcaaattttcttcatttcaagtacaactagccataataccttgttttattatccctgttctcaccagcatcatttagttgtttgtagagaagttctcaagtagtcccctgatatcaccatctaagtaataatataataaatattgttatcaccacttgcatctacaaaagttttaaatgtatttatcgtaaccacatatcccatctattctttttttacataaattttcagtgcatactcaagatttctaattctgtccctgcccttttcagctttaccaatatcatcattgttccccttcttgtacttcatggtatgtctatcttcaggggcttttaactatttgccactcttacgagtggtgcttaacgatttgccactaggcccatatgtcatagacacatgagggcccacatgtcatagacacggtgtggcaaatcgttaattgccatgtcacaagagtggcaaatagttaaatttcccctatcttcatgtcttcttttgatggctaaaactagatttttttttcttgttggtagtttatctccttttttgacaactatctttactctagcaattaagtcttcaagacgtgtcttattacacagataagagacttgcatgttgcaaaaaggacagaagatattgggttctatgccggctttgtgggtaaatttctcatgaattgcttgttcaaatttaagattaactctggctctcaccttgactgattccttatttacctgccttataggtgcttcgtttatgttcggtcgatgtttgacttcaactatttggggaatagcagcagatcgtattgggaggaaaccagttgttgtgtttggcattttcgcggtgttagtgatatttttcctcctctatatgaaataatagttgatatctggcacaacctagtttactccggtatagcagttccttttctttttattggtgtttgtctaactaagttcttggtataatggtaccagggtcatatttaatacgctatttgggcttagtttcacctattggatggcaatagctacaagattccttcttggtgctttaaatggtttacttgggccaataaaggtacaataaagttgaaactttcctttgttgtacttgtacctggtcatgtttttttttcctccaatgcttgtacctggtcatgttgatcttgatcaatttatatttgtcctttcaggcctatgctattgaagtttgccgacctgaacatgaagctcttgcattgtcacttgtaaatacatgccatactgttctgttattaatttttttctgtttaaattgtgttgattttgattttttttaatattaggttagtacggcatggggaataggtcttataattggtccagctattggaggctacctttcacaggtatgtcacagagaattgaacagtgttagggatttttttttaacaatgtggctacatttaatacgatttcttttatggcagcctgcagagaaatttcccaatgtcttttcccctgactcactgtttgcaaggtattctatcttgtgtaccaacgcccaacaaaatgttttttatgattcatctacagaatacttacttttgttggaaaattttcaggttcccatatttcttaccctgcttgtgcatatcagtctttgctgctgttgttctcataggctgcatatggatgccggtaagtcagattccataattgctagcttcacaaaatatgcaatcagtgtaatttgacatatatttagttgtatttgatatatttgcactgtggaagatcttatgacatggatctgaaaaaagaaatcaaaagttttgctgcatgcttagcaaccaaaatcagttactagtaattataacggagataatatgcattttatcctaatgtggttgttccatttcatcaggaattaatagtctcttttgttacttttttaagtcaaatttatatttcctttctcttaaaaacttgtgcattagcagaaatatcaatatttagcatgactcatagtgagaaaggataattctttggtactttgtattaattctttttgtatggttgtaaagtatcttgaaatgtattttaggagacattacacaagcataaagctgatgcaaatagatctcaaactgttgaagctttggagagccatttgattgatccagaagaaaaggctgaccaaaatggtagtttggactgcaagaagagcttattgagcaattggcccttgatgtcctccataattctttattgtgtcttctcctttcatgatatggcttatacagaggtattgttcttgctattgtctacggatggtttgctactgctttgcatataaattgttagctcatgtggtttacactcagttaatcactagaaataatatgcatttcagcagacaacgtgtgatattcagcatgattttatattgaaatatatgccaaaatata

SEQ ID NO: 60373 - DNA, 963 bp, Oryza sativa
gacgaggagatctcatcgcatcattctttgtggcgtcttaattctttcttgggtgctttgctgcttctttcactcaacaaaagcttcaggatcttgttctctctatggggcccagctgaggttgaatgacaactagttggggtataagttgctgctgctgtcaggaaggcgcgaatattgtgatcatttggatattcgtgcacgggcaaaacaaatgccttccggattcgctgacatatgggaccggacatgatcatatatatgcaaacatagaatcgataatgacatcatacaaccctcttttttttcttttccgaaaatcttgctagaggaaatcatcgtttcgcggttttggttttagttataagacaaagtacggagtgatggcgctctgttaacgtgaaaattgactcatggacaccgtgcccattagaatattcgccgctagttaaataagagagaaaccatgtgaaaatactaaaatagcccaggacctacatatcaggtccaccatctctctatctctctctacatgaatattaacatggggaggagtggcacggtggtgtcgtcctcgttgctgggcttgcacaaccacttggaggcagccttgtcggcggtcttcatagcatacgccttcatcttgcagcagcaagaccgggtgttttctgtcgcagcagccatggcggcagtggcggcgaggggttggagtcgccgaagccctcgatggcttgggcatgggctacgtggacaagaatgtggtcgagggtgacgtggagccccaccgcaatggtcacgttgctccgtgtgaacctacaccacgcctggctctcggccatcacttgtcggagccgctccgctagcttggccgcgcgacgccgagcgacttccaacttctcctcctcctcccgccgcgtccactaacgtcgggcatactagcgcctggcactgttgttttcgcgc

SEQ ID NO: 60374 - DNA, 856 bp, Oryza sativa
acagcaagcatcctacggttccaatcatacggaggtatccacggcaatcgaatcattcagattggacagctatatatatcaaaggggtcaacgatcatggggctcactctcaagatcttggatgatgtcccagggagcttgtacttaaatttaagtatgtattagtggtatggaccactcaaattgagcgtaatccgcactggcaagaaatccaaatcttttgccagtgtagaagacaagaaccaacttaggagaagatgatgaagatggctgtagctagctgtggacggacagggagaggataagcagagggcttgggaatggatggctggatgcaaacactgggcggtggtagttggtggttggtagcccacatgacatcagcccaaaaagacagcagcccgtgtcttcttcttcttttcacaaattcctggcctgtgcttttggcaattgctctagtcccccaccgcatctcatctctcgcacctccctttcagacgtcattctcggctggctcgggtgagttttttatggcttttgggtgaagtgttggtttttttgtggtggggtcaccttctagaagcacaagtgatccaatgtcttccccacaaatggtcagtggatgcagcgtccgtttgcaactatccttgtcaatgatctactagcggctcaggcactgtttagatcctccaaaatagtaaaagttttatcattttaaagcactttttaccattttggatctaaacactagcaaaagttagcaatttgccatttgccatttgctagtccatagtagcaaattgtgccaaaaaaatgctttggatcactctctctctccaccaaaaagtgctagaat

SEQ ID NO: 60375 - DNA, 752 bp, Oryza sativa
ggctccgcgtctccccggccggtcggggagcgcgcgggccgtcggatcgggatcggcaggctcggggttcgcacgcgagcctcgggtggtgcgcctcgcgttcgccccgtccgtcctgctggcttcttggggctgggcgatcgagtgtttttcgccgctgctttttggggggtttgcgggatgcgtggatccgcacattgggacgcgctgcgcgtggaatggatggatggatggagggaaccttgtgtgggggccactttgctgcggttgcgggtggctgcggctgggtagtcggtgcggtgcggagcgatggatggacggggcgcggaaattcaccgtgccaccgtatcagcttgctggtatgtgtaacgtacgtaagcatctcggctttcgtgtttacaagtctactacgcgaggtaaggtttgtaaatgaagagcttacccgacatgcaatctgcggtcaatactcatttcacaggaaacccacgtagtcttcttattactccctccgggttgataatattaggcgttttggaaaacctggtcttcaaaaagtaactttgacaactaatttctattataaaatatatagaaatttcaacaaatatatgattttattgaagtactttctaagactaatctacacattggttttcatatttttaagataaatattttagaaattattcgtagtcaaagattttaaagtttgactttacccttgttcaaaacgactaatattatcagcctgg

SEQ ID NO: 60376 - DNA, 1409 bp, Oryza sativa
tcagtgaagcacacaagctcaaccccatattttttgctattaatcgtcttcaaacacctgaaagtaggtaagtgattcaaatacatataactgaatattgaccgccaaaataaaatcactacttgacaaaatttagatataaatcaaatactttgaaaacagatacagtattgaaagaaaaaaaatacaagcactagaataggtaagcccttgcccttcagaataaaatgtatgtagtactgcagtacagtaaaacaggagctgaaattgttgtacaaaaaaaatcaagactgagtgactgacaactaaatgcaaaaagggcaattactaccttctttgatttttataaggcttattctaattttaaagagtcctcaagattaaattttgaccgttgttttctcataaaatatattctaggtatccataaaaaatattgagcaaaagagctttgaaatgtgtctatattggcttttacactaaatgtacttgtaacttgataaatccttgatcaaaatcaacaaacttgagttttgaaataaaaatacaccttataaaaatcaacagaggggatgaaagtaagagctgttcaaactgtttacacatggagacacaaaaaagaacattgagattaattgtttatactcacacagcattttgaatgtcatataggcgaattgattcatcatcacatgctgtcacgaggtaatttgtagccttgctgtggaaatccatagaactgattcttccattctgaaatacaaataagccccataagaagaatgaaatggccagtgcaagaatattttaactaagtcagtagatactaggcaacattctaatgtaaagtgaaatatgtacaaatggttcatcaaagaatatgtactgaatatacattaattttcagagtacacattgagattgctaattgacatcccgaccaacatacccgcaaggaattattgaagaaagagcagccaagaaactgacaggtgtgattgtacatgatgggtgaaaggcccgaattaaacaacagtagcatgctctacagttagactagatgaatttctttgttcttcacattctctgtttagtttcactcacactttatgaattgctaatatctcacgatatgaaatgtaaatatattaagtacaccaagagataaactgatatcttttcgattggttaacattgtttacaggacttattacatgcaaaaaaagtttccagtccaagctaccacttagctgtcagggttgatctacttagccctctgactgcgaaagtgtctagataaccccatgaactatctaataccatctaaataaacccgataaggttttacacatgccttttgccaccatagcagctaatgtgtcaatgcttcaacaaatctatactccatt

SEQ ID NO: 60377 - DNA, 3302 bp, Oryza sativa
attcctgcagcccatatacgtgcaaacacaaacttttcatatgtgtataaaatttttttatacatgatgtatttttcaattttttttgactttttaatacgaactgtcgacgaaatgggaatgggtgtacccatttcaccgtcaaaacaataaagcaccttttaacgagggaactaatagaaggacatggtcgtgggccccaactatagggtttgagaatgcggctcgaggttagccgcggatcgggccatacccgagaccccgatctaagaatggccaaatggctagccaagttaaattttaacaagtataaagaaaaaatgcccttcaatagcctctccatcatgttagctaagccatccagatggccaaatctcacccctcaatggccaaacttggagagtcaccctgcctggctattcgtggcccccaccactccctctcccacccccatctctctctcggtctctccctagcaagaaggcagcgccgcagaaccacacgacaacgacggtagggaggagagaggcgccggagccagccacgaccgccgccgtcctctgcgtcgtcatcgtcgccagccgcgcccgccgccggccgccgtcagcgatgtccccgtccgcgcttgccgccgccgccgccgtcagcgccgtccccggccgcgcctgccgccgccgccgccgtccgccccatccgtgccagccgcctctgtcagcgccgtccccagccacgcttgccgccgtagccgtccgcctccgtcagcgccgtccccagccacgcctgccgccacagccgtccgcgccagccaccgccgtcagcgccgtccccagccgcgcgcccgctgccgccgccgccttccgcgccgtctccagccgcgcccgccgccgccgtccgcaccgtcgtcggaagtgctaatgcgaagaggtagagggagaggaaaagggggagaaagatgggggagaagcggtatagaggctgacgcatagatcccgctgtcatagactcaaaatagagaggatggatggagagattgttggagtaaacaaccaatttgacttaacaaatgaaatggagagttggccaaatagacatttggagagttgaatttagagagcatgttggagatgctctaaccaagctccttgccgaagcccgcgcccttcggctggaagggaagagcgctcaacaaggagcgttcctagcgtaggagccgaggaagcgcccggacctaggtacgggctgaacctacccaggcgagtctctctttcccactctcccgctctcgtcagattacgtaacaaaggctaccacggtctcggcatgcccggggcccaggctgactttgccctcggtagggatcgtttctccttctctacgaaggaagtgcatgaaagcttattagggaagtaactcagagatatccgtccggttgtatcttcctcgagaagctcgactagaaatatcctaactaccgccttaaagacgcaaggggcacggtcagctgtaaggcactgcaccccccttatgatgaaaccaaagcttacagaagatttatcccactgacaatggaaagacttcgacaagacttctgcagcgaatcattagggtcggtggtgccccagacacgtgtcgcacatgcccgttgttgacgatcgttatcgatcagtttcgccagtcaatattactaaaataaaggagaactagttatgtttgcaatgcatatttgtgttagaataagttattttccactagcactaggattataaccccttgcagaaaataagtacaaaatggaggagaatcgacagcaaaatagacgatccatcaatcggacgctgtcgagatccagacttatggataaatgggacaagaacaaaaaattgccacgatccaataggcccaaaattcactgttctggataagggaggagataaggaggccgccagccgaaattggggtggtttggcccagcccatggttcagccaaaccatgggtttggccgaacccccacctgcaccattggatgcagggtttggcgtggacgtccaggattgcatcccaatgacagttggagggcatttctgaccattccaaccatcacaaccgtcattgggaggctataaagggagctctcatcctccactccatcacacactcaagcaagagcttctcatattctctcaagtttagtttagtgctctagagctagtggagtaggaatagaatagtttcttcaatcctcggagtcttcagaagagttcattcttttgtaagacttgtactatttatagaatattactttacttcattctgatcccttgagtaccgacttttcgatatattatttgagatataattgtctagctagcttacctgggggatgcattggtgtgggcataatgttcatttatatgattgctctaagtcatgatgatgattgtagagtagtatttagtagcataagcgaggtgcttaggctattgaatattattatttggggttatatgctacaggacagtagaggtgggccattgatggtgacagctcagtacgggtattcctctacgttagtatataatcctaagttactttcctggagagggtatttgtcacactctgaagttcttcccaagcctaaattcaatttggaatttgtctcaagaaattagttgtttaaagtcaagagagaaaccctaaagtagtgaatgcaaataataattggaaatagcatgtggaatttttcttgggttattcatgtcaaaatatgctaacaggatttttagtggaattttcagagctctagaaataattttaatcaattaaaaatgagcacaagcaattatttcatccctggaaattgttttcttttcttttttccctttttccttcctttttcctttgattgggccatcagcccgttctcttctcctccccgcgcgctagctgggccggctcgaggccgaggcccagtaggccggccgtgcgcccctcctccctcccgagtcaccgacaggtggggcccacctatcgggcccgtccccaacctccggccgccgccgccgcccacgctgcaaccgccgcctccccgcctctcccgcgcctcccgtgcacgtcgcccgcctttcgtgccctctcccgcatgtccgcgaccgccgccccactttccccgcacgcccgtaccgagaaacggccgggattcgaatttcgaatcccaccggcctctctctctccacctcccccacttcgccagccacttcccacctctcggccatgtccgacctccccggccctatataaacta

SEQ ID NO: 60378 - DNA, 31653 bp, Oryza sativa
tctcctctagaagtaagcaactcgtcactggtcaaacgaacataaatggttttttttctcagtgatataattacaaatgtgattatgtgagtttatgacatatgagatactgctggcaagatttttacattgttaaaaactgccaatgattaacgatgtggagtatgtggataatattaggcaatctacgccctaagcccctaatatagtcacattatggatatataaaatagttgactggctatcttctactccacttggtatatatggttgttgctttgacttaatatcttaattggtattcgtaaccggtagcgttcatacccattttgatacctattcgtcccgtatttatgcccgctgtgtttgtattcatattcgacactatccatatccgacccgattctaattatcaatcacctatcaagacaaatcggacgctacgatgagacatgaaaacacccgatcctattctgacctcgatatatatgtggaatcgttttgcgccatatgtattgaaattgcacgggagacacggtcaaagccaaggttaagataaggctaacaaaatataggttagaatatgagaaatgcgagatctgaccgaaactaatccgatttcatccctatgagggagtagtagttgtttggtttttttgattgtgtagaattggatttttgtaaaagattgtataaaaacgaaaaaaccccttgtcgtcttctccattgcgacactgaaactcaggcggcgccaccagccagagtcccacgacgttgctctgctagggttttgctccaccttcctcccacctcgcgccatcggattccaccttcccaggtctcccctcccctcccgtcgccatgcctcacctcgtccgcgagcgcctcttcttcggcgacatcaacgacgccatcgccgcgctcaccaccaccgccgcggacaccggcggcttcacccacctcctctccgtcgtcagctccgcatccatctccttcatcaccgactgccgcccgggcctctccatccccaccgaggaggtccgccgcgtggtcgccggggaggagggcgcgccgccggtctccgccgtggcccccgggcggctgttgcgggtggtggagcgcgctggggtcgggctgcgggtcacgcggatggccgtgccgctgcgggacaccgaggaggagaacctgctcgatcacctcgagccgtgtcttgatttcatcgatgagggcaggaaggaggggaacgtccttgtccattgctttgctggggtctcaaggaggtacgattaatatttaccaacactaatgttccgagtaatttgtgcttttctgtcatctttagtgtcgtgtgctaatcaaagtgaagttcatctttagtgtcgtgtgctaatcaaagtgaagttcatcagatatttttagttctggaatgttacatatatctgttaggcatacttccgttttagccaaatggacattgtgaattttgttccaagaatttatcaattaatcataagcatatgatggaatgtgaatccctgtatcatgctctgttttgacaagttggatatttttgcctgtcctgatgcattggttataacaaatatattggttaacagcgatgtatctcctgttcactgttgttcatttgtaacaaataaattaatacttgtatatttatttgtatcttgttgcagtgctaccatcatcgttgcttatcttatgagaacagaacaaaaatctctggaaggttcgactattccaacaaaatgggtgatttttcagtcgttgctttggttattactccagatgaatacctgagttgtctttttgatacacgctggtgacatgccatgctttttgtcttgtttcagaagcactagagtctcttaaggaagtcaatgagtcagcctgcccaaatgacggttttcttgagcaggtaatcctttgtgatctgtttgcaccctattgctcttagatttcttttatttatttgttgaatgtgttgtaaattgcagttgaaactgtttgaagaaatgggcttcaaagttgatacttcaagtcctctatacaagcgtttccgtttaaaattgctaggttagtcataattcatcttggattctttgttactgttggacaggttgtgtggttattatgtcagggaaactgtgaagattctggccactggttagcatttatttaaaaaatggaaatgtaaattctttgttttagtaaatttcaacattgcatgtctgtgaatcatgatatatttgatgttttcctgcttttttttaattatccatgactaagagtgctattcatgcagtcctgttgaaaataaagcagtcatacacttctcaatattgcttacttttgtttcttacttatgaaaaatctttgacaaatggtcagatttgggtactttactgtttcacctttgtcctttctcttatgcatagtctcttactttgccacttttcactaaatctgtcaattttttttttacttctcgcaggccaatcctacaaaattggagagaaaataggaagctatgtatttgaagatgatcctggtctttctggacagcctaattcttctactcaggatttaccaaacaaacaaacccaacaaacagcataccgctgcaaaaaatgcaggagaattgttgctgtgcagggcaatgttgtgagccatactcctggtgagggtgaatcttgctttcagtggcaaaacaaaagaaagggagagcgatcatatagcaaagaacaagattgctcatcgttgtttgttgagcctctgaagtggatgactccaggtaattcaccctcgtaattcagccctttgcagttacctacggtcacaaatgacttttcatgttgatctcctattgatgtggttcatagcaaacctgtgtttactactgagtgctcgtccaatctgtcatgtgattctgtaattggtcggccaacctttggctgacccggcaaaaaaaaaagaaaaagaaaaaagattctgtttgttttatcatttctaattggtgcttttgttaatgatggaacagtggaagacggtgctttggaggggaagctatcgtgtatccactgcggagcacggctaggatatttcaactggtcaggaatccagtgcaactgtggcagctggatcaccccagccttccaaatttccaagagcaaagttgatattagtacgacttagatagttttttttttgtggggtgtacgacttagatagttgtcggaggctagcagattatttcaggaccatgtgagctggtgtaaataccgttttatcagaaggatttacgaactcgaaggatctcgaccgaagattttcagatccattgtgcactagatagatatcatgaagcattagcctcagaaacctccactgtattactacttggtgttagaagactatgccatcagttgcaattgttggttctgatgatctgagaggctatcaacacgaatttcattttgttttttgtttttttgtattaaatgcatctgtctgcaaatttgtaatgcagttttgttgtacctgagtccatccattgaaaacattgaaacatactgtgttctaagcaatggcatgtcatattttcgtgacatatgccgctgaggtggcggggtcggagttttcgctcccgagccagctaggctctgctctaagatgggcttgctcaccgaggggtgggctggacgtctgcttacgggccatgtattcggcctcagccacgtacgtgggctttatattgggccgcatgttgaggcccatgtacaccatcacgtcaggaggagggagaaaacccttccacgccgcacactctgtcacacgccggcgcgccggccagcggcggaactcgcgacacccgccggcgaaggagcagcagcacaggaggtggacggcgcgccagcgaggtcgcccagccaacctctgcgtttagttgtcgactaatcgggaagaaggcgaggaggagaggagaggagaggagaggaaaggaggaggggaggatgccgcaccgcgcgcggccgatgacggggctgctgctgttcacgggagtcaacctggtgctcctcaacaccatcacccccgtctacgacttcgtctgcttccacccctactgggaacgcagggtacgccgcctccctcttttcttcttcacccaccttcatcccccactccgatctcccaagccaacgctttgatcctcttgccctactacagcttggtcaagcctttgcccgcaccgtttgatccgtgcatctgttgattgtttcttgtctcgagcatgcgcgccagctgtttgtggaaatgcctcgcggctgtgctgcaactttcttctattttatgattagcaccatatgccattgccgggcttaaggactactaattcagtagttcgtgttcgctgcattgacccaacaattttcacttttgaatattagtttgggggaacatcgtatctgccatgtaattatcatgtcatatcaactactctgcctagggctgttcaattttggttgattaaacccgtttaagaaccggagatcagcatgcttagtacaatcattatcttacgtgccgccggtgcggttaacagaaaaaaaaaagactacctccatagatttcgggaacaaaccatccctaactcttcctttcgacagacaatttggtgaagaaattccatattccctacccacaaatttttacaataaagagtgcccttctaggaccatctttgtgctattatgatgttcttcctttctataccatgttcttgatatattacatacaatttgaagttttcttgatgtgtaatctcgtggccaatttagagagaacgtcgtcaaaaggagcgtgaagcactacaagccaatggttctctacaaactgctaaatgattttattcctaggtatgtgcgtgacactccttgagaaaaatctgtttgatggaagtgttcatttttataaccagtttaggagtagcttcacaatttggtggatgtgaaaggaaggtgagaatccccaatttatctggtaaaaaacttgagatatatttttgttcaccctagtgatagtgaacttgcttttggtatgctttatttatgcatgcatttgtttaactttgaattgacattgtatattttaaattttcagttgttttattacttggttagttcgatgaaaccctggattcttcattgatatggagtgaagaaaattttataggcaggtaatattgtgatgctcttcagatatgagtagatctccgcactccaggtcttgcttcataatgctactcaactgcatcatcacatccttgtaaaattaccgaggaaactagatctgatgaatattgtttcttgaaactacctttatgtatctcttatcgtctcatactcatctggctataacatagtaaatgaaaaccactgtttggctcaagccatttattctgatcaggatcctattaacttagttatttcctggggtggaaggaacatatgtttaacaactgatcctgcagagtgcttcattacgtgtttgaaagttctgaaaacctccaaccattttactgttcttccctcaatggtttatctgtcaacaagcagtagaggcatgctttctctgttcttgttgaatgtaccagtaatcttttgggctttctaatcaggtaggattcaatcatgtagtgtacaagatgactgaacagaaagaaggaacaaatccatcttcccaacaactagccaggacaatgtgcaagaccaaacatgaacctgagcccaacctgaaatgcaaatatgcaattggaaagaaaattccattgtatacattacactcgtggtaaatgcacatcatgtttgaaattgtgcacaaaccagccactatacacactaccctgtttcgctatagaactagatctcgcctcttcttctttgggtttgttgcttctgcacagcctgatcctttcctcatcatggccacaaactctgaataatctatccgcccatcctacatgtgaaaaatgcattcagcgtctcttgataggacaaatattttcagctttatcgatttcatctgttttgcatgaacacaatttaaagagcatttcttccttacattattagagtctgcatctgtgatgacatccttgatctcgttggcgtcgtataacccttgttccttcaaggcttgctcgagctcttcctttgtgatgtacctgcaagagggatggcataaatgtgtacaaatccctgaagttcagaattcagttatatcagtttttgctatccttaacttacccactattatccttgtcaaagtactggaatgccgtgtaaaggtgctcttctcgatccattttgttcatgtgcactgtcgcggtgacgaactcctcatagtcgataattccattgccatcagcatcagcctgaaagttgaaaggaatttccaggagtcctgtcagttttagcatttcatctcgaactgaactaagtttgtagcttcactatgaggactcactgcttccatcagttgctcaatttcgttgtctgaaaacttggtgccctgctttgctaacccatttttgagctcctcaagcgtaatggtcccactattgtccttgtcgatgttcttgaacatctccttcagccccttgatctcctcctctgacaggcatccggctataatctacagaagattcaaaacaacaattaagatgcatatatctaccctgatgatgtgattaagagtaatatttaccctcagtgcagctttcttgaactggttcatggccctgaactgcttgagcctgttgagaacaacattgtcaagtggtacatcaggagcatccccatcttctttgatccacgggtgatctgcaaatccaaattgatccaaatgaatccaaatttaattctgacaccaataaagggaaaattaatccaaactgtacctctatatgaaaaaaaaaggagcagatttgagtaattaatctgtaacaaataaacttactgagcacttggaatgctgtaagcctctccttggggttgatgttgagcatcttcctgacgaggtccttggctccagaggagatcttcggccatggctcactggcgaggtcgatctgtccgcgaaggatggcggtgaagatggcgttctccgactcggcccagaagggcggcacgccggcgaggaagatgtagagcatgacgccgatgctccagatgtcggcctcggggccgtacttcctcttgagcacctccggcgcgatgtagtaggcgctgccgacgatgtcgcggaacacctcgccttccttgaagaagacggagaggccgaagtcggtggccttgagcggcgcgtcgtcccccttgctcagcagcaggaagttctccggcttgaggtcccggtggatcacccccatggagtggcaggtgtgcacgatcccgacgatggcgcggaggagcgccgccgcggcgcgctccgtgtagtggccccgcgcgatgatgcggtcgaagagctcgccgccggcgcagagctccatcacgaggtggacgttgtgcttgtcctcgtaggcgccgcggaggtcgacgatgtttggctggccggagaggtggtgcatgatctgcacctcgcggcggacgtcgtcgacgtcctccttgtttcgccagcttccgcttcgcgatcgtcttgcacgccagcttctcgccggtggccttgtgggtgcacaggtgggtcacgccgaactgcccgcgcccgagctccttgccgatggagtacgtcgtgcgaacctcctccatcggccgctccagcacctcgccgatggggcctgccggcttcttggaggaagacgccgccgccgccgcttcggtcgccgccgccttggccgccggcgagcacggactgctgcttggcggacccatttttggaggaggtgccgcggctcggcggcgccgccttggaggtccccggctctgcctcgtcgccggcgacggccttcccgccacccgtgcagcactggcccatggcgtcggtgggattcgcgcgtgcctgctccggcgacggagaggcacggatcggagagagaatttttggtagaaggaagaaatgggtgtgtgagtttgatgggttgagaggaaatggcgggaagaagtgagcggtagttgtttccgtttggattttcagcgtctcgtaggtttggtcgcgggctattcttggctgctaataattgtttctggttagattttcctgtgaccaatcatcaattggctgctaatagtttttttgattagatttttccagtgaacaatcatcaatctgcctttacaattgcctaaaaaaatgggcctttgcaaacactaccaaactagtcaaagcttacaatatcaagtgtcttctctgttatgaaaaaaaaaaacaggccctaacccctaagctctcatttctgcagaagcaccgagagcaaatacaaggatacttttcctaattttggtgtgctatgtatatattttaactttcaggatacactcacaatttgttgattttagtcctgcattaatatgtcaccgcaaaattcaagaagaccatttaatcatgtaactgtataagttgttccactgtcaatagagtgaaagcttcttctggaatttctattgccgtatgcaattctccctcctgaataaccacatcagataatgttctcctgaagctgtcaatagcatcctctggatgccctttcgcaatggatgcctgcaatggtgttgataatcgtaagcaaataacctatcacaagaccaaaactagaagtacaagagccaaagtttaggcactgtagatgttgtgaaaaaattcagacataccaaatgcttttcatcaatcttgaaaagccaaaacctccatttcctatcctcttctccatcaatacggagagaaatattagtccaattcatatggtggaattccaaacgttgcaacccaaatccaacgccagcacctgtagctttgacaaatgcttctttaagacaccaatacctacaaaaacagacaatcgttaaatcttaagtaactccacaaattttggcttgtaaacatgatcagcaccctgcagttgttctgaaaataaaaaaaattgaacaagaacaaattcatatacctgtagaactcagttagcataccatcatggctgcctgcagtaacaatgcagttccactcatgatcagtgagataggaagtgaaattgttgatgaactccagggcagtttctcgttgaggcttggagatgcacacaatgtccaggccaacgaggcagagaggctcagatgctatgccaacgtactccccctgatgcgacgtgttgaagttgaagccaggaaagttggcatttttattctgctgcaacagcagacgtgatcagttgcaatttgggcttcagaaactgacagactgtaaacgtgaaactgaaagagatggatttgggatgcagagcagacatgaactaattgatgggaatatctactactactaccaggtagggcttcccttcaagcgtgcggttgatgcgaatttggtggaatgggattccaagagcatggtgcacgagcgagtattggagaaggcgactgacgagcgcccgtttcctgtcatcttctctgacgaacctgcagcggtgaggtcgtgactcgtgaggaggaggagaaaaatctagaggctgaattgaatttcagtagtgagtgggtggaatcaatgtgggggaagaggaattggttggaaaaacctgtggatggcggggcggtcgtgcggcgggaggagggcggcggcggcttggaactcagcgggggaggggcgccaccggccgacgtcgacgagccacctacaccgccacctccccacgctgctctgcttctcttcttcctccaccatcaacaactcgagttacggcagagaaagccataggccatggccggccgccaaggaaaggaaaggaaaggaaaggaagacgatgacaacagagaggggatgttaggatgggcctttctcacgaggcctgtaaacttttgaagctaaactaggcccaaattgcatatgtgcatcttgccatggtgccatggcagagacatcagcaaattaaacagcaacagagacataaccatagccatcagtccatcaccatctgctaatctctcacattcaaaaacagtcgccattgatacgctgtgtgctgtgcactacatttatttttcgtcggactcgcggtggagatggagattaattgagctcgagtgtgagactaacagcaatgccacgcaggctcaagatcgcaatagtaattaatggcgaatcgagccaacgtcagttcgctatcgaccgacataataaatcagtttggttgtgaaccaagacatctcatcatcccaccctggagtcaggagctcaggaacagcaagcaagaggagaggaagaagctgagatggctgcaggcgacgctgcgacgccattgctggtgctggagacggcgtaccaataccatgagggctgccccgcctgcgccgtggagcgcaacaaggcggtcaacccgggcatcccctacatgcgcttcttccacatctggatcatcatcctcgtctcatgtacgtacgcgcctcctatcgatcactgcttcatttatactcctacgtgttcatgcatgcttcgcttcctgcttgactgcctctccaatctccttattattcatgttatattcgaaaaagctaatggacgagcgctcgcgttcacccacccccacgcgatcagtttactctgaccaatcccatgccacgcgaagtataggtggccaaatggaccgcccggctcggcacggcccaagcacggccgtacctcggccgaggtcagtcgggcaagcacggcccaacctatatgttaggccgtgtcgtgccagctcacgggctgcacacacgtcccaggcacaaccctataagactcgggccatgccggtccagccggaaggcacgacaaaccatcgtgtttcttcatagaataagtctatttttcatccctcaactctttgggttgtcttatatgactagaaataagtctattttgtattacacctctcttttggcattgccttatattgttgattaagtctattttggatccctatactattttcttctatcgtgccgtgccgggccggcccaccgtgccaaggcatcggcctaggcatggcccaactatcgggccatgccgacacggacttgacaccagtcaggccatgccgtgcttaggcccagcaaaatggccgtgtcttcggccaggccatcgggccccgggccatatggccatctataacgtgaagcgtgatattctctttggctctaatacgaatatagccacttcttccattttaggctagtccttttccttttaggctttactctttcccatttaattttatttgaccaagttgaattttaggtgagaccaaccagttaggcctcacaacccgcatgcatgatttttctttttttattctatgaattcatttaaatttgtatatatgatacaaactttatacgtatgaagtttctatacataaagtttctatgtataaaatttactacatattattttttgggacagattaacatgtcgttgaattcagttgaaatctatgtttataaaaaattacatgcacaaatttctatataaaaaatttctctttctatatatgtatatatattttagacatgtaaagtctatatataaatatattttctttactgggccatgttgcttttgttgggctgaattctagaaaagagagaaaaagatgcacgtggaagcctacgagcgtggaaacatgaccgagaaatctgagtcgtcgcgctcgcgccttagcaaatccatcttaggtgtgtaaacgtgatcgtgcacaccgtggacccatggttgctcaagtattagacggaccctattatgtttgcatatccattttttttcatttcctccagcattgcaaaatgtgaatgctttatcagtcatttctagttcacctgaatttatcttatagaggattattttgtactacctctatttttttctttttatatagatgactcagttggcttttggcataatgtttaatcattcgtcttattcaagaatttagtataaatatgaaaaaaatatgagtcatataaattttattaataagagaaatggtcaaatgtcacgttaaaagttaaaaaaataaagggagtattagtgtctaaaattaagggggctaaaaggaaagttctagcttgtaaccgttggtcgaactattgaagcaaaattctaaattgttgtttcttgcatctcttttgcatctttatttatcttgtcattagcttagctcgttccattgatgcgggcttgtgagcctttcatggtagatttttaacctttcatccttacaatattttttttattgaatttcatccttataattgaatttcaggtttgccaatatcatcgttatttcccttcttatacttcatggtatgtatttatgattgtaaaatttacaatagcaccaaaagatgctctacattgtataagtttcagtgtaaattagctgtttctatttctcattagcggaatttgtaccttgcataattttatcatttggtttcgtgaaatgatattcatcattcatgtagcaattcaaatttctctagtttccatttatattaactagtttttgtagtcttggaaacggaaataacagtaaagttaccacctaattcctaattcttcaagctatgtatagtcatatatatgttgctatgtatactcatactcatatgttttggctaatcattgtttgaataaaaggtaagctcatagtttaattctcttcttcacaataggtaagagattataacatttatttttattgtatatttctcttgtccacaacagataagagacttgcatgttgcaaaaagagtagaggacattggattctatgcaggttttgtaggtaagcgattataatgtctgtaataccaaaggtcatgcttttacttagtagtgacaaatgtttttttacacccatttatctatcgcaaacatgacatattataattctcaacatattaggtgcgtcatatatgtttggtagagctttaacttccactgcttgggggatggtagcagatcgtattgggaggaagcctgttatcatttttggaattttttcagcttaagtaccttttagttcagttccgattgaaccaagttagtaattacttgtattaccttatttatatccacctatgattactttaccttgtgttgtgaaatcagatttgtattcaatactctctttggactaagtacacactattggatggcgataactacacgatttcttataggttcattgaatggcttacttggaccaataagagtacggtgattaaattatctaaattcatatttgctattcactattgaaatactataactatctagcatactacaaccgggctttacaggcttatgccgttgaagtttgtcgaccagagcatcaatccattggattgtcattggtatactacaaagttctataatattttttactatagttatattgcactttacattatgacactctttttttatgattaggttagcacatcatgggcaataggtctcattgttgggccagctatcggtggatatcttgcacaggtatcctactaaattttaataccatatgagttgggtgcatgcttaaacaatgcattgacgctattatgatgcttttatttcatttgacagccatcagaaaaatatccaattctatttccagcaaactcattatttggaaggtatcgttgttataggaaatataattgttctagatggtataactccttaaatgactgattcttgaaaatctttccttaggttcccatattttctaccttgtttatgtatatcgatcttctgcttcgttattctcataagttgcatttggctcccggtatgtgcacaactagctaattttattcttattgatattaatttgggcacacataattcttgtttttatgcttctcttagctaaaatttatcttaactactaaaatacaaaagttaattaatattttgctaatactttcaggaaaataatgtgttttcatttcaaaataatgtgtttcataaaatttcaggaaacactacataaacatgcaacagaaagaaatggagattgtaaaattggatctttgagtacacatttggttgactccgaagagtttgtcaagcaacacactggaccagctaaagataagagcttatttaaaaattggccattaatgtcatctattgttctcttctgcattgtctcctttgatgacatggcttacacagaggtatgtaccaactatgtctagactaatggtgtagtatttcctagctaaatgagtccagatgtttgaataattgaggaaaagttgccatgttttgggaaatatcgattaaacacttcacccaattacaaaactagggtatagtgttatcactataaataatgcttctatgtttatgtaagagagacttaatttacttcgaaagggccacatgattatttaatcattataaaataatgtttgaaatatcataaatatttaattgaaatatctatttctcaccatgcatcaactagatcctaatacatttttattatttatacaatcatttttgtgttatatagacttatatgttgaacaagtaataatttaattttgtagatgttgtcaaaaaaattgttgatgagacacatcccatcttcatccccagccatgtgtataacaagataataacatttagttgaaggacacacacttattagttcatggaaaacaatgaagcacatacaagttttattataacatataaatttaatcaacagaggtaacctacatgcataattgctatcatttctttcttttacttgcaagttgtgaacctacatatgttctaccaatacgccttgaggcccttgaacatgctcgtcctaggggagtgcccccaaagaactatttagtaacattaaatattttctatttatattggtgcttaacattcagtcaaacttttaaaactacatcattgattttattttataacaagtttataaaaactattaagtttataatactgtggaagtgcttttaaaggcaactctacacataccatatttgtttttttataatgaaccatttgagaaattaccaatggtcataatttcaccacatcttgttattaatacgaacatagacaaatgaattactcgatttcaattttgttcctctccgccgatgaaatcatagggaaattatatataaattgaatgattagattaggatagcatggatatgctaagatttctctactactatatgttttattataactgtatagatatctaatattttttatttggaattttttctcctttgtcttgggagttctcttcttacgatgattaatttcatagcatcctttctgtataaaaatatggtgcacatgttattttgaatttatttttagtaaagttgttttccaacctttgatgataattgaaatcaaattttagatattttctctatggtctgaaagtgacaaacaatttggcggactaaatttctcgtctgaggatgttggtcaagttcttgcaattacaggtacatgtcaagttatcaaattggtcaatattcttgcattctattcagggtagctaaatacactatacaaagctttactgatatgtatttatatttaaatgaagagcaagacgtttttctactgatgcgtgacaatgcataaattataacttggtataacatggccagaaataaatattggctacataacatcgcaaaaacttggtaattagctgttggacacttaatgtactattttattatatttgatgcaaatggagagagaagcaacacggaaaatacagatttgcccttgtatcgatcggcttgtaagatgactcggactggttcgaactagatccaatccattctcactccctcgatgcagttcattctcactccctagtctaggtttggttcgaaattgacctgatggggttaaaaagaagcatgccctatgggcaaacttgtcttttctaaaatatttatctccatttggactagatataacaaaaaaacaatgtgttcaatgtacaacggctaattactgtgttttcacgatgtcctgtaagaaatacattttctttgagtatcctacaacaaagactataaattttgagtgccttgtagcaaattttgccaaatttttttatacaatatcaacttttcctattttgtttaagttgtagaaaccatatttaatggtatagtctcatatcttcttttatatcataggtgctagcatacttatataccagacatttatctacccacatattgtgaaagttctaggaataatcaacacttctcgggttgcagtagtaagtacaagttcccttgattattcagtgaaagttttatctttaatttaattttagtaatgtttgtctcttatttgttgcagattctttctatggcaattctttgtagttatcctcctatgacatatctctcaagaccttggttgtccatagtagtaaatattgcatcgatgcttaaaaataactttgtggtgagtaaacataaaacctaaagttttattcatccatgctcataacaaaccacactgatggatgtttttgtacttccattttcttttctctatttgcatataccacactttttagtgcaaactaccggtgtacatggtagtacaagtaagtattggaatacatcattaatgctaaagtataatatgttgccacaaatcaataataaaagggtggtacctctcattatttcctcatgcattgtacaactactcttgcattaaagtaacatactaaactttggtaaggtacactttaatttgtttgattgctttttggttgagcaaggttaatttcatctaaccaattttctaggttcaacaaacaagttgaatatttagaagatttgaagaattttttttgtgcaagtaattttcttgctcctgaagtattaggaattctgttactaggtaatttgtcttttctaaaatgttgctacactagcaatcacacataggaaactataaacgtgaaatgtagaattgcaaaatataagtgtaattttggcttcgccactgagctcataatattagtgtaactcattgcttttatatcttataagcaaaacaaatatttgcatgaataacatatatcatacaagtcttggccactaatgctttgtcatttgctcctacatatttattaggttactatcaatacatgctctttcattcttcagaacaactctgtggtatgtatcccgttatctaattaaattttattaaccttttctacatacaattattgttttaatgcttatttctctattgaataaatagccccagcatcaaagagcaaccgcaaatggcttagccaccactttaatgtccttcttcaaggcatttgctccagcaggagcaggcattctgtaagtaaaaaaaaatatttgctagtatttctgtggtaaaaatctagaattagtctatagttatcaagctaaaagaaaacaaaaccatccacacatctaagcaatgaattttaggattagggctgtcaacatgttacgaccaagtgagcccattcaggttttgcttgagatcgatttacgagtggaattttagtggtccaaaaaatacacttaattggcttgtttataatataataataaattttattgttccattcatttcaaattagttatcattttagtattgtcctaaggcaaacgtatctatccttgacaattaatttctagaaaatcgtataggttaacaacatgtgaattatatattatgaaagtatatatcaaggcgaatctacaaacataaatcttatgatattaaactacatgaatgtctagaagttgatggcaaaatatacaaatgtttaaattaaaacaaacctagaataagaagtaatttgaaacagagggattacatcattaaaatgaataaatatttgacttgagtggttagtaactaagctgattactgcttataaaaaaatgcaatggttgaattgatatgtatcatgggtcttgttggcatattaattatgattggttaatgtaggttttcgtgggcacaaaaacgccaacatgcatttttctttccaggtaaatttacgacatcattattatgcataagtaacaaaaaaatcatcattgctttaatagaccacgtggctggttaaatgcaccaagtcttgagctttatgatagttacctcgtattttgattttatctggatatttatttctatcccttaacgttagtgatttatcaaaagtagtgattattgggtgttggatgctccttcatagcttataccaatacatgattaattgtgaaggaaccataactctgatctttctattgtttgcatcattgttgtctgccatcttttcgatgtgttctcattgttacatttttgtacgcaggtgaccaaatggtgttcttcattttgattattattgaatttttggaactcatttggaccttcaaaccatttctggccgtgccatagtaattctcttcaaccccaagtaattaagctttcagatcatcgataagttgggtggcatgtcatgtttatacggcagatatgtttgtttgggtatttggatggtagctaataaagagttatgcatatttgaggagcaatacttatgtatcctgtcatgtaattatacataagtatttaaatgacctttctcctttggtttgtaaaatttaaatactcgatttttcacgaagatgaagcataatatcacgtaaattgcaagtgtgaataaaaacaaatggcaaggtaccatataatattatatagatttatatttttccatgttaatttctaagtagtaatataggcatgacacattttaaacgatattaccagataaaatcataaagctatgaccttattatgctttgtatctgtatataatgtatgcttgttgtttatcgcagtggctattgattaattgtagcttaatcgaatacgtgaaatttgtatatgttacattaaaccatgattgctaaagatggctaaagaaatgttagtatacatgagaacattcttcaatggctaaagtgggcacacttcaccaagaatggagaagtttaaaaaaaatacttggagctccttacatccttatggcaagccattgattatgcaattgaagatctatcaggcagtttaactattcggattcccagctaactggttcgataaccagttgaaccggtcggatcaccagtcaggctggtctgctacaagtcaacttgctccgaaatgctcaagatggtgttgctcaatggatacaaggcgcttggggactagctgtggagggtataacccccggtacccacaacaaggtgcatgggccggcccaccaggaatggcctgacccagtacctgaagacccgtggcgcacggcagcgctcggaggtgctcggcgtgcaccgcaagtctaccataaggcaattagcagatatatagggatctgatctgataagctagatatcagatcccttgattgatgcttatcattgtaaaccaactagattagatcttaaccgacttgtaaaccctatctcccggctatataaggagggcatggtaacccctcaaaaacccgataactacacctcatcttgtatcaatatacaatccaccaaaacacatgacgtagggtattacgtcaccatgatggcccgaaacctatctaaagcttcgtgtccctgctcttcgtgttcatcatctagttctgatcatgcacgtccctccacgtagttaatctaccatcgtggttatccccctcagtggattgccgactatatttagtcgaagtgaactataggagcctttgagcaagtttaattgcatagccaactactaactccaaatcatctatagctaatctaatagctcattcatacaatagttatccataaaccattaatatatggtctcacctctcatacacacataatgtattggagtttgtgctacagctggctacgaatctgtagcccgctttccttctctcttttctcttctctcctccacatatacttacagttgacttgtagcctgctattgtactcactcttatagattaccgtaccctgcccttaacaactaattaaggtggaattaaaattccacggtctcatataacacagtaacacatgagccaaattcaaataggccgactgtcacctaatttaaggtgactaaataaaagggctaccatgccaaaaataaaattatagttcttggacgtgcaaagctgtcgagcttgtcaacgtcgattctttggcctgatctgttgtagtatgttgttgctctccggggtagatatgtgtagatttctcaatatcgtcatcagtgacatcatcagtctcattaccctctttgctcttaccccagagcatggtgtaaagacttccgaccagcaaaattccacccaagatgctgccaataaaggaagagcagaaaaggaaagtttgtttattttagcgtgtttttagaatattgcacctttgatcagctgacagtgagtatatatatgatttaatttacctgccgaggtgaacaatctctccaagaaagaaggatgagcaaaatattgtgaacacgaagcagagtggcgtccaggaggcaaagaacatggggcctctcatctctaggcaccacgtttgcaggtagtaggacactcccgtcaccataacaccctgaagcaaaccaccagttgtctaatagtcatatgtgtgtgccgaagaccatgtcaatagtgaatacactagtggaagaggatgactgaaaattttatgtgcacaacttaccgagtataggatggcgagcaagctgatgtcgaatcttagcttccatctggagaagtcgcgctctgcgaccaccgcgacgacaaacgactgcaccgtgctgaacaggcactgagtcacagtcacaaccattttatctggatattccttttgcaccgcagcctacacagtcaatagacaaggattagagaccccgatttgtcagcaattgcagctgtgaatcaatgtagacaagcatgcaagaacagctcagattttttttggtaaatagttaaatatgcatgcatccgaacctgaaaaatgatccacaaagaccagcacatgttggcgaccaccataaggaatgtccatttgatccacacacccctcggaactactgttttcgagcttgtgtcagaggcgaaggcacggtgatggttgatagggcttatggacgggccggtgaagaaggcgatggtgaagactccagccagacagattgctacactagtgaccttggtatgcctgaagagctcctcagcttcacatactccgtcctgtcctggcaagcaacatttcaatcttggtattatatactactccatccattcaaattataaggcggtttggtttttcaagttacatattccttttattatgtgtgttgatatggtgtatatctaaatatctatatcaaaatttatgtgttcagaaaagtcaaaacatcttataattaatattttcacaactaacttgaatctatttatggtacattctcaagttaggctttggtgatatcgatgatgataaacctcaaaagcaccgccaagaagaaggtgatggctgggagtgagctgtttactgcagatgccactgttgcagaggtgaacttgagacttacatggtacagatttaccccaagcgtaatcctgaaaagcaatttccacaagtaaaccagggactaattaaactcttgacatgccatgagtatacaatcgattgttttgttttgtaccaataaattagagtttgcaaagatgagcgcatacccgattaaggcacaaaagaagagctttatgagcaccccaagtgtcatggcgggtcgtgtacttctcctacaaatataatcaaacggacctgtatttctcagctaatcaaacaatatagtaaactaagcgaagtggcaatataacaatataggaaaatgattctatactcccaggagtacgtactccagctttcatccaccatccatcagcaagaggtcccgatcaagattactatcggatctacactttatacccgttttgtgttttatttgaaaaaaataatacataattttccctcattaatcggatcagcaaacgacccaaataaatcccagaagacggcagatcgctctacccagtccccaaccaattcgggattcgcgagcgacggcaagccgacgccagcggcagcgtgaagtatcagcggcaacggtgcaaaatcattcatccagaccttggtgtgttatgcacctcgcatgcaccattttctcttctatcctattttctttgccttctcttgccgatcgagcatatccttattttttcctgttggatctataagggaagagcacatatgttggatgcatagatgcccagtgattttggtggtttgggaattgtgatgtatctttttcacggtaattcaatttattctttaattagttacttgactgattaaccccctataattgggcatgcagacggctgtcggccggcggcaattcatgtcgactccggcggcagttctgttattttttttaatcatgactaaaaataaactttagtccgatcaaaaagttttgaaccagaacgaaatatcatttttagtcccggtttataacagaaccggaactattgtaaaatttggcagatcgatcaaaagatcgttctccagtagtagctctcaacccagcggccagtggcactgctatctgctgaatgtattgcatgttttgatcggcgaaaagatgtactgatactctccattcagaatttagtttgctgctacagcatcaaatatattttctagtgattttgtttgtgaatctgtcagtggcagatacttctcatggtgatactcatgtcctaatgtattctgattttttctgagatctagtgtgttctgtgattcatatctaaggtggtgtttggatccagggacttaactttagtccctgtctttagacactaatttagagtattaaatatagactacttacaaaactaattacataaatgaaagctaattcacgagacaatttttttaagcctaattaatccataattagagaatgtttactgtagcatcacataggctaatcatggattagttaggctcaatagattcgtctcgcgaattagtccaagattatggatgggttttattaatagtctacgtttaatatttataattaatattcaaacatccgatatgatagggacttaaaagttttagtcccatttaaacagggtctaagcaaccccataccaattactatctttaaaaatagcatatactatatttatactaatagcatatactatatttatactaactaaaaatagataaaattaaattagtacataccgcaactaacctaaaatgtggagtaatatatactgctactttataaaagcatatactgctattaacttaaaaattagtatataatgctacaaagttgaaaagcagtacataccactactactattgtaaaaatatgacatataatgctactggtagaatttagtatatactactactaagttaaaaattaaacagtatgtaccactactactctataaaatagtaccacctccgttttttaaatagatgacgctgttgactttttcttacatgtttgaccattcgtcttattcaaaattttatgctaatgtatatgatataaatcacacttaaaatactatgagtgataaaacaactcataacaaaataaattataattacgtaaattttttgaataagacgaatggttaaacatgtgagaaaaagtcaacgtcgtcatctattaaaaaacagagagagtatatactgctagtaactaaataaacagtatatactgcatgctactaacatttaaaaaaagtatatactgctactaagttaaaaatagtatatacctactacattacaaaatagtatatactactattaacttaacaaaaggtatatactgtactaactcttcaaaggagaagaattcagtacatactctttcggagaagtaatcagtataactgattaagaaaatagtatatgctgctctaattaagtgagtacaatttatgctgctagtacttaaaaaaaaggtatatacttaaaatatttataaccctttttctaatcagtttgaatggtagaagatccatctgtttagaggatggtacgttcattattcaaatttaaactaacagcacactccgcgatccctacgttcaattgtgcaccaaatgcggtttgtacctgtgcatgcatgcaccatgcagcgattagagaaaaacaatattttcattcttttcccaccagtttaattagatgctaatggttatccactaaggggagagagtatgtactcccgggagtacataacaatgatcctataaattaaaatggttctatactaccgtccatataaggcagccccgatgaagagcgctattggattcacatgtggacccgttttgatttctattcgagaaaaaaatccgtagtacgacataactatcccacattaatcgacataccggggcgttcttgaacgcgcataaatacctctctcccaaaccatcctattggtaaatcgagtcctcggcgagaacgcgatctaccggcggcgatccggacggatcaatggcaccgattttacggtgacgtcggtgtccatccgatactaggttttttttttaatttcacgatcttgtttgatttgatttcagatgcatcaagcaagagagagagatgggttgttacatactccctacatctacttttgatagtcatatttcatcttggcacacagaccaatgataagtaattctacttatcatccatttaaacatgctactagtcattactcgtaaacaagcgattcattaatatttacatttcacgatgctcaagtagccaatattgtgtggaagaatggagagtcatgcattaaatccgagaaagtcatgaagatgataggttgttgaattgaaatatgcctatcaaaaataaaattttcagatttaaaaatatgactatcaaaagtagatggaaggagtacctttctagaagaaatgtagggagcaagatgagggagccaactgcctggcgatagaagacgaagatgtagatgttcatcccgtggttgaaagcagccttggatatcacaaacatgccagtgtagatcagttggacgacgatggcgacaaaataaggcttcatacttgctttcaccatctcgatcgatccagcaatggcaggcgtgcgtggtgttttgtgcgagtgtgttgtcttcagtgtgcggagtgtgttgtcttcagtgtacgagagcgcccgtttagtttctctccatcaacctggcactacttctatatatttatataaaaaaagaagaagcaggcagtatgccaagtgtaaacgcaagagcacggtaggtaatgtagctttgattttgggtaactgatcagcacgccagatccacacaatctgctatttttagtctccacaaataggagacccacttcgagtgtacattgacggattcggcggcggccagctcgagaagaccgatgctccatggctgaccgtgccatgcagatgcctattcgtaactaaccgagtggtgccctgcgttttctcctctcccgtaactaatagagtggtggcatgcattttttcttctcccataactaaccaagttagtttagaataataatgataattaagaaaaagattttgtttacttacatattgaaaagaaatctatatgtgaaataaacttccatgtaaaatttaaaactttctatcgaaaaattaagggaattgatagatgtctattagattaatgggctaggccaaattaaatcccaataaatttcaatggcctaaatttagtgctatgggtaataatatcaccttgaaaatttaagtgaagagatctcaacttaaatatggagctagtagttaaccgagctgtgtattaactcgggttaatagtacggattgaattctccgaacgtaactctcgcatgcgctacaaatactccatgattaatcgcattaactcgggttaatcgcgcggatgctctctctcttgttttgtaacggacgatgattaattctggtgtattaactcgggttaatcgcgcggattgaattctccgaacgtaactctcgcatgcgctacaaatcctccgtgattaatcgcattaactcgggttaatcgtgtggattgaattctccgaacgtaactctcgcatgcctcgcgccgattaaattctccgaacgtaactctcgcatgcgctacaaatcatccgcgattaatcgcattaactcgggttagtcgtgcggattgaattctctgaacgtaactctcgcatgcgctacaaatcctccgtgattaatcgcattatattctggtgtattaactcgggttaatcgtgcggattgaattctccgaatgtaactctcgcatgcgctacaaatcctccgcgattaatcgcattaactcgggttaattgtgcggattgaattatccgaacgtaactctcgcatgcgctacaaatcctccgctaacggggttaatcgcgcggattgaattctccgaacgtaactctcgcatgcgctacaaatcctctgctaacggggttaatcgcgcggattgaattctccgaatgtaactctcgcatgcgctacaaatcctcctcgattaatcgcattaactcgggttaatcgcgtggattgaattctccgaacttaactcttgcatgcgctacaaatcctccgctaacgggatgaacagacacaatgctcacacttatgttcttcctctctcgcactttcttcccggctgttctcctgttccggaactccgtctgcttgcgtacttgcacgagtaggcaggcaatcaagtttttggggagcgtattggcgcaactgctcctgttctgcttcgacttcttcctctgcatcgcgatggcttccattggagatggcgcaccaggagctgtagggaacggcagtgctccaggaggaggagggaacggcagtgctccaggagacaataccaacgaaggcaatacaaatgcctcaacctcctctgcactgttttctgggtatatggttctatctctaattgatgttcttcatgttacttatatattaatcatgctatccttaggattacaatcctatgtgaatgttgatgatgcttatgcttatgttatgaaaagcatgcccatatttctatttagtcacaccactagattacttactattgtgaatgttatgtttattatcttgttattttagattaaaatataccgaattatgatcaaatttacaacaatgccagcctgagagatcgacatctcagcgagcgagattggtgaattgaaaagtggggaggaagctgatcatggacgtcggcggcaggcagaggcgccgctgctagagaagaagggcagcaccggcatcggcaatgggtactgcattgagaggtgcccaggtgcggcgtcgaccggcgtaaggccgcgagctccggcatcccctacaggagcttcctcttcgtctggatcatcacgctctgcacaggtaacccccacttcattcttctctcttccactcacccacatgcatcatcaatcgcgcgcatctgcacctgattcgattccccctcccctcaattgatgtccacatttttatcgagttatatcatgagtttgtgtttaatttctcctatatatgttctccattgatcataccaccttggagtgctatatagaagtatatacatagaggaaatcccctatgtacccatgaaagttcacctaatcccttctatacccctgaattttgctcaaccccttacatacccctgaattttagttaggatcctttccatgccctttccactagttgaccgttagttgaccgttaaattcttttgaaaaagtccattttgccctttgctatgaagaaacataataaattaatgaagtatattgttggaatgtaaaaatttattggatgagactattatatttatgagtatgtgatgcaccatattatttgtgacaaatttactttcacatataatataaaaagttgatacttatttattagttattaaaagttcttttatgtagcatatgtgttttcatagtaatacaacagatttgtttattacttcagaacacatatgctaaaaaaaatcttttaataactaataaataagtattaattttttatgtcatatctaaaagtatatttatcgcaaataatatggtgcataactatctcataaacataatagtctcatataacaaatttctatgctctaacaatatactctattaatttatatgcttctttataccaaagggcaaaatggactttttcataagaatttaacggttaactagcggaaagggcatggaaggaatccaaactaaaattcaagggtatataagggattgagcacaattcaggggtacagaagggattaggtgaacttccaagggtacacaggggattttctcatatacatactaatgcaggcccttcaattaatcaaaatatttaaattaacaattactactaattttatgaattgctttgagattcgtgaacctcaaccaactattgaatttgggcatgacactgagggcttttttggagagattctgaataactatagcttctctcataatcagaagctctccaaataatttagtttttcattcagattctaataagttgtagttgtataatcttacgcaataaaatagaagtcagaagctagaaaatctaacttttttagattctaaaaagactcttcaaatttatctctggccagatctaggagcggggagggagagagggtgagccgccgccgccgccgccccgtccgcgctggcgccgtcgcaccccctcctccggccagatctaggactggggaaggagaggggggagccgccgccaccatcgccccgtccgtgccaacgtcgtcatccacaccgccaccaccgcgtttgcaccgccgacgtcgctcccctcctccggtcggattaggagggagagagggaggaaggggatgggaggagagagacgggccggtgagagagagagagagagagagttgagagggaaatgagtggtggcccgtggggaggggtggaggagaagataagaaagacttaaaaagatatttttggggcaggtatgatttttgcaggcgaaccacataaggttccgcctgcgaaaatcaatttttccaagcggaccacttaagaggtccgcctgtgaaaataaagttatttttcgcaggcagacctctgcctggaggactttcgcaggtggatgacgaaatccaccccgttttatattttcataggcggatatttagcttcgagggtcatacccgttttggaaaataaaaggccaacgtcgataaaaatcgtttttctagtagtggtggctattgattaattgtagcttaatcgaatacgtgaaatttgtatatgttacgttaaaccatgattgctaaagatggctataaagaaatgttagtatacatgagaacattcttcaattaatcagcatacaaagtgatctactgctaactgatgaaaacgaggcaacatctaagccactaattaaacattattacttttgaccaaggtaaaataatgagtatagtactggttttgtttacacaaagatcgagggttgcactctacgcacatgtttgttaagtagttaatcatgagtgatggagaagctgggagttaatcatatttgccacacaaaatcaatatgcaattattgaattcatatggacaagctgacgatgtagactgataaataaaatcctgtatgcatgcatgtgccattttgtactccagtaatcttttgtttggcatgcatgtcagcatgtgtgcgtggttcaggcaatgtgaaagtagtgaattgattggcaatgtgagagtgagttgattgaagtagcaacgacctgtcgggcctagcggccggccggcctgactgactgacgtaggagctgacgatgccaagttagttgcacattgttggtgctactgatgctcaaccagggctctgtttagttcacatcaaacgtcccctaaactttcaacttttcatcacatcatatcacatccaaaacttttttactcacataaactcctaaccttttttctaaactatcaactttcccccgaacttctccccaatttcagaaactaaacacatatatcctcattaataataagctactagtagtgttttactgtttgatgataacttatttctagcagtactgggctaacatgtatggtaatactgaaattaaggaactgctggattcaagcagcagctgattgactttggttaccagcacacaattaacctaaaatttaatgaactgttgggtctggccgattaactagttatcttacggttgcagcagcaatggtgttaccattaaattttttaatttctacgtaatctatcgatgggatgtacgatggattaataaacttcaactaccttttaaaaaaataaacttcaactacataattgttattattgtcatatactctgactaggagcagtacataccgtactgtttaagaagattggcagcaactgcagagcaggtggcaattccgacttggattagtgcagctatggctgtgtttagttcagcgtaaagtttagattttggttgaaattggagatgatgtgactgaaaagttatgtgtatgacaggttgatgtgatagaaaaagactgaaatttggatccaaactttggatctaaacacagcctatacatgatgtaacgtgagaaagtttattcgtctcttaaggaaacactcctttatttttttatacggtttgaaaaatcacaaaaatattaataaaaagtagatcaataatacaatatataaataaaatacaagctcaaattcagcttgaaatgaaaataataaattggctccgaataaaatgtgtcattcatagttaaatttattttttaattatatatatcaaattgaaattacataattgtcgagtgacacccccacatatttaattaatcttaatattttttattaaaataattaatgattttttaaaatggcatacaccgacatacacaagtaaagaaacgtagcctcgaacaacaaaaatccattttacaatcatatactatttggacaacgggaagcctgtttcgtcttctaactttcttcccgtggctttttttgttccatgcggtttctgctctgctcccaaaagtaaaaaccgccc

SEQ ID NO: 60379 - DNA, 2358 bp, Oryza sativa
ttctttaaaggctgcgtacgagagcagttataagctaaaaactatggttgtgtttagtttcacatcagaattggaagtttggttaaaattagaatgatgtaacggaaatgttggaagtttatgtttataggaaagttttgatgtgatgaaaaagttgaaagtttgaaggattattttggaactaaacacggcctataagagaaaaaaaaaagaccatcatttttcgtgcgtacgttttccaaacggttaaacactgtgatttttaatatttttttagaaaagttgtttaaaaaaataatattaattcatttttaagtttaaaattatcaatacttaatttgttacacactaatagttaacctcgttttgcatgtcttctcaatcttctctatttcttttcttctaaaaatggaatattctcttcaatagaaaataccgttttgatgcctgataaactgaaaaaaaagtttttgagactaggtatactactttcgataggatatctctgaggaagaaaaaaaacttattaatacagctacagtatagttgtaatataatatattgtaagctacaacgcaacttttatataatttggttggaaataaacaagaaatgtggcacgacgagtagcttggaaggctgacacatataaacaacagtaccttttttaaatctctgatacaagaaaagaaatagcccttattttcttgaggttgtaaaaaaatgtattgtttttttttctacggcgtgaaacatggcattggtaaaattgatgaagtggatatagatgctctggctactccattattgtccttgtggtttgtggtgatggattggcctcgccaagaaccaagcgttggtaaaagggcaaagagcgttttgtttacgtcgtcttgcgttggtaatcaccacgagagcatctactggactaccactactagcagcagcatctaccgatggatcccaccgtttctcgttactggttggtaagtaataagagtagtttaacactatttatctttaacgtttcatcgtttattttatttaaataaattttatgattactatttttattattattagatgataaaacatgaatagtactttatgtgtgactaatttttttaaaatttttaataatttttttaaataagacggacggtcaaatattggacacggattttcacctctgcatttattttgggacggagggtagtacgtgtgttggtggtgagcttcgtcctgtacataccgccgtaccattttgaaaatgtttttggattcattcgagattgccaaattgtttcgaattgtttggtctcacactccggatctgttcggcagttgtccttgttaattctttaatctgaaggcacaatcattggtagtacctctgtaactgttcgatcagtgttcagaatttgagatggttgttttatcttgaaaatatatttacttgaatttgttgaacagcttgcaatagagtttcaggtactagctacatatgtcttgtttcaggtagctctaccaatttgttgggagaagatacagttattagaagctctcctaaaaccagggtcggccctagggggagggggggttaggccgtgcggccgcctgaggcccccaaaatctagggccccctatatacacatatagtatactatataattctagtccatgggccatgtgcctatattaagttagacaactgaatagcccaatatagaaaatgaattttagtccatcgtcaggcctgtctcagcgaaaccgaagcgatcttcatctgactctcgtcgcttcgcctcgatcacatcacgccactcgcgtcgtgccgtctcgatcacatcacaccgctcgctgctcctgcgctctcggcgacttctcgacttctcggcgtctcgcaaacagaagcaacaagtcggcaaatcgcggctcgccagtagccacactcgtgtcgatcgtccgccgatcgccttctctgctcgttactgctatttatttctctttgaaatttcataatattatatatagataattttatcacaacgaatattcaatgttgtgtgtttataagactatataaatatatattagtttatgtatatatataggggcatctatataagtttttgccctggggccccaagaccctaggaccggccctgcctaagaccatcacagtagtatagccatctactagctccaaatcatctatagccaatataatagccaattcatacaatagttgcttactatactattaatacatggtcctacctgtcatacacacattacgtcttggaatctgtgctgcagctggctacagatctgtagcctgctgctcttctctctctt

SEQ ID NO: 60380 - DNA, 1732 bp, Oryza sativa
cttttaagcctaattgctctatgatttgacaatgtggtgctacagtaaacatttactagtgacagattaattaggcttaataaattcgtctcgcggtttactgacggattctataattagttttttattagtgcccgaacacccatgcgacaccctatataataccttatgtgacacgccaaaactttacgcccctggagctaaacaccccctaatatgtgttgcatgtgtgttaatttctagttgtctttagtacatcatcattgatggtggtgtgtttaattagtttctagtaagaagcttccatctttggggaataaagtggcatatatatgaaagctaagaaggcattgatcttcaaaaaaagaggctaagatagagaaagacaccgtccgattgttctactccatgcatatataggagatcatataagttctattcctctagggttctgaagaatcaactaggttagcttaattatacgtacatatgccctggtccctctgtttgctaagcatatacattaaaaaggcacatctgactttggtctcctccattgaacatttgtactggccattaatataatttgaaggtatctaggtgtagttgggttttttttcttattggtattggatacacaatttgatccattagatccaaaatccaaataatctgaccaatcatcccctcaacacatataaagctccctggaaattaccttaatttcaattactaaatatatcttactaataagaaatcaatactatgtatttcagtgtctactaagcaaatggttcttcaaactgattactgaacaggttgtttggcaagagaagaaaatatttgaaaaaacactcaattactcaagtagggtcaaaacaaggagattctcattttttttgtcgggtcttgtgaaagctaaagataaatccttacttctggaaattgggtagtaaataggggcgaataagtaagatcttgggggatgtttgggttgggaatttccaactctatatatcatttttcgtaagagaaatgtctcgatcgcaactgttatgaattttgttccgcttaatgtttcttttaggagaacgttggttggtcagaactgaattaactggtataatttaattgtcttgattttgtatactagtttgaatggatctaatgattctttcaaatggaatcttcatcagaatagaattttctgttagatcaatatatttatctttgattaataatggttttattgagaggaacaagtttatatggaaattaaaggttccaattaagattaataacttttgtggtttttgttcaaaaagttgtgatctaaccaaggataatttagcgagaagaaattggaatgggagtcaaagatatttttgtttgtataatgagactattcaacattttttttaatgtcatattgcaaaaatttctttggagaatagtttatatttcctttggactgaaaccccctgatagtatatctaatatggttggaaattggcttagtggtgttgagtcaaaaactaagaatctcatatttgttggagcttctgctttatgttgggctctatggttaagtagaaattaatgatgtttttgataaatctccaactaaatcttatatgcaagtgttctgcagggcaactttctggctccggttctaggcacaacttcaaaagtgtgaagagaacaaggagctcctattttctacatgtcgaaa

SEQ ID NO: 60381 - DNA, 8487 bp, Oryza sativa
aagaggacctttgctccaccaaacaccataatttgtcccatccctaatattctgcataagttcattggtattaggtaaggtctcctcttgatcataaagcgggcaactgatcaacactccagcatctatctagtgaggccaaccaaacagagaaatgacaacaacgcacgtagaatttttctttcacactgaagaaacaaatatttttgttttatggaaataagaaagatggaagatcttttttttttcatttcactgtgtattctccattatccagactccagagaaacaattttttactctatttttgtttcgtggaaatggggaagatccattaggcaggaaaacatggaaaaactcgaatgcctagttgcatgcagccaagcaaaccccctacaaagaagcaaaggcagaatgcctcaaaattgcatagagccgttgtagacttgtgatataatctatagattcatatggtagcacttgggacatttaaaccagcagaacgtaaagagtggttttgtatgcatggtagacacgcgtctaaccagcggacgcccaaggtgttctactgcagtgcatgcagtagaaagtgcatagactctgctttagcccttgtttagttcctaactttttctttaaactttcaacttttccatcacatcaaaacttcactacacaaataaactttcaacttttttcttcaaactttcaattttagtcaaacttctaattttagcgtggaactaaacacatccttattccgtgctctccttcggttatcaacaagacgtctttcaggcggttgctgggctgggagctatctctgctgtgcagtgctctccatctcttctttgttcagcacggttgctggacgcccagtcgcccagcgtaccgtgcgaatgcctctggagttgggatcaccctctagatccgccaatgctatccagagctaagcagcgtccataggcgagccgagacatggatacaaatggaagcagtggggaggagaactcgatagccctcatctttaattttcacccgtgggtgttgtgttagccataataatgggttattgtacttgtgtgcattatcccattgttgcacaaataccagttacatccatcagtttttctttttccggccaagatgagacaccagcacacaacataacactatccacgccattcatgtctagttttgcaactctcaagttgaacagcccccacaacgttaagaatcagctccacaaggcctcaactgcatctatttcccttaaaaattacattataaattagctatcataaatctactatgtgaaattagctatcataaatctactatgtgtgtgcttccatacttctagtagtagagagcatggctcacctcaatccccatgttcaaccttcaatttaagggggaaaaacatctatattccagcacatgacaatgcaatacgctcttcatgggtgccatttgatgctgcacccgacactataggaacaagaagcaaatgcaagtaaatgataaagtgaagtgacatacatggtgattaaagcaacacagattctctaggaactaaaggaaacctgggttttggcacaaaaggtagctcttgtccactaagtgcacaatcaatcgcacgacttaaatccctacaaataagataccaaataagcacaggggagggtgaactggaaattttgttcaagatgttagaaaacataccttccggtaactggcacgttgttactcggtcttgaatcgtcaaactgcccatggtagaaaagctcaaatggccttcgtccatcctggcaccgggaaaccaaaatgattagatagaataatagtagattacgctcgtagtgtgcaaatttgtgaggttagtgtaattcagtacaacttgcaagatgagaaccgacataacttgggcagcatatggaccagcacaatagtccacattagctaattagagtgtttcagtcctgaataggaaacccaagtcacaaggctgcagggggtaggctaggctgctagatttcttttccagaaaaatgcttcctgattttattttcccattgaagtccctgagttgctgcatgatgtatttcaatggtgatctgctcactgtcaggagctacaaatgcagtaaacaatttgtatcataaaaacagaacaacaatcaaatgatacctcgttgtacccttgctcagttggtgtcccagtcagtgctgagacactctaattagctaacatggattgtctagccgtggttagcatgcaacttgcaagttattgcagcagttcaagtattttgcatggcgttgcattaaatttctttcaggaacaacgtgttagcatcctagacattggacatagcagcatcatgaattcatgattctaggcataagcatagatgatgttacctttttgaacaagtaaaactctggcgtgcagacggctcgaaaagctttagcaacttcttgagactgcaggttgcagtaggacaaatgagttaaatagagaaagcatggccgctgtgtctggacaaatagccatacaattgaagggaataatgtggtcaaacctcatcatatagatacgggaaagagtatttatacaattttgcttcctcagctatgtaatcaggaccatcctacaaaatcagatgaacttgtgttaaaatggaaaaatctgacaagtatcacatagatcacatggaacagaagaacataaaacaactagtttccatatccatggatcactgataggaaggaattgttgcctaatcctatactacagtaactcaagaagtatttttctcatacaccaagagaaactcatgacatcttatcggatagcctataagcttgtcagcttacatataatataaccagcagctaaatggctatctaattatctatagccattgtattttataccctgcaggacaaatcctaaaattcgatgcttctccagcatacatatctgtgttaaggtacaacttaaaacgaaaattccaccaaacaggcagagatgggaaatgttttctttgccagacttggttgggcgtgtggctaaaagcaatagttactcagacgacggttgatttcctaaaaaaattagatagggtaacaatttgaattaaatctgctatttaaaagttttaaacaatttttagtagcttctatattactatagagtatgtggtttaaatttcatgatcatctgtatctttataatttttttgtattttatttcgtttcaatataatttcaggacttccacaactgctactacattcaaataaaatattttataacaaaatccattaagctctcaacaagagaacttctggttacttaagattcataagcatgcagaagaccaaaataaaaggtatacagttcattggttgtaactcaacctgtgggtgtgtcacaattgagttcgaggatatggcaacagcagcaagccctttctgcattgtatcgagatgtcaatacaaacacacaagttaaagggaaaagctcactacccattctagagtccatacctccatgtagaatgaggtgagcttcgcaatatcttttttgagatgctttacgaatggacagtgattacatacaaacataacctgaaaggaggaaaataatcatataagatgtagataatctatgcagtggctgatcgattgctcaattgcctacatcccctcctttctcttcttaaatacagactacgagtttcccaacaaaacaaaatcaatatgtcaagagctgatagctacttcttgaagagataaagatacatgctgacataaatatcattcagcacttattaagacttgcaatttggcaaagaaattcagagggaactcaaggactaatttgacaaaatggagataataaactggtaatgttcttccatcaaagtcataagccacatcttgaatttttgatctgtttcattcataaagaggctgtaatacctacaagacctaacagtttttccacataaatgactagatagacggctcataactaatccaagcacaaagccactactattgaccaggtgtgggacaatccaaacagttgtaagtgtaagcgtatagctaatgggaaaatgagaaagcatattagcatttcaatatttcattgagtttcatggggaaatgggagtggcaaaatcgacgaaatgtagttaagcatatagcatggataaactcatttctattcagttctccagtttagagtgaaattaactgaacctggtttttttctttcctaaaaaataaataaatgcagaattgaattcaagcacgaagcaacctagaaccaatcactgaccagcagcgcggggttgccttcgaagtcatccaatgtccagagcttccccgtcagtggctccgggagctgcacgccaagaaaaaacctcgaaatcaatcaacgcccacgcccaaatcccgtccgatgaaaccttccccgagacaaacttaaaactccggcggagggaagcacctcgaactggggcgcgcggaacccgacggagacgcccgtggactccgtccttgccgcgcgcacctggaggagcggacgacgacgacgccgccttgccgcggcggcggcggcggcgagagatccatgcgggcggcggtggcgggcggcggcgacggcgagcaggggccgcgacgaggacgccgcggcggcggaggaggaggagcggacgaacggttgcgctccggcggcggcggtggcgagtgacatggcgcgggtggggctgtgtggctgagagatgcaccgtgttggctctcgttttcttttcttttcttttcttttctttttaaatatggaaaaagggatttggtttttggtttttggcggagtaaattctagaaaaatctcagttgcactgtcacgttgagaagattgctgaggtggaatatttagtaattaggagtgaggaatacctaaataaacaagatttaattggatcatgccatttttgctagttttgaaaaatatcgttgttattccttaattcgtaaccataccaatataatactctcaaatttagatccatgccatgctctacaattaacatacattttgaatcgttttaggtgtactatattttttatagactaaaatacctatgccgattctcttttaccttatgccggagtgctgagcacaacggcacgatgggccgcaacgtcggggatggttagtccagcagtgacgtgcgacccgatagcggtggagaaatcggcggtagcgatgatggggtggtatgctacgggcgcagtacaaggacagatggtccagcggcagctgcgacgctgcccatggcggtgccatctgttgcgagctcaacacgaggagatctagtggtgacggcggcaaggtctaggtgttctgtagatctagcagcggcgatgttgggtctggcgtccgctaggtctagcgggcagcaatgagctgagctgcgtcatgcggtccaacaacggcgacgttgggtctggcgtatctagaggtgggcaatgagctgagttacgacgtgcggttttggtggcgatgacaagcttagctgcgacgttgcccgtgctgatgacgaaggagacgagctggccagctcgggcggtcgtcgtggatggcaacggcaaccaccccaccaccatttctttatttttattcttcatattttacttttctaaaattgttatacttttttttcatgtgtatgtataaattttttttaccgaaatttaaccggtgcttgagttctaggaggggtacttaggtcaatacggaaatatagtacacataaaacgattaagaatgtatatcaagtgcacaacatggcatggatctaatttcaaaagtgttgcagtggcatggttgtaaataaagaagtagtaatgttatttttcaacactagcaaactgtataatttaattaacccaaaactatgaaacgttagacttgggccctgatcgagagtgagggacgaggaataatccctccggcacgaaaaacagagcaggccattagcgcgtgattaattaagtattagctaatcttttttttaaaaaaatggatcaatatgaatttttaagcaacttttatatataattttttttaaaaaatacaccgtttaacagtttgggaagcatgcgcgtgaaaaacgaggtgacaggagcggtcgcccgcgggaacgagcgcacccttaaaaaggccagcgatagctgttatgtaaaaggagataatttattattagcatattagctgctacaaacatggaaaataagtttatttgatttattatgaaacttttatatacaaatttataaagaaaacatattaatttgtagttcgggaagcatggaagatgatcaagttgccaagtggcccttaggtttgttacaattaaaatgagtttttttttttgcactggttaggttttccttgtcgttgtatgtatggcaatttgttatctatcgtacaaatgctacaccaatactccctttgttttatattataagtcgctttgttttatattataagtcgcttgatattttttcctaatcaaatttatttaagtttgattaagcttataaagatatataatagtatttttaatataaaacaaatatattatcaaaatatattcaatgttagatttaacgaaactaatttgatattttagatgttactaattttttttttaaattttgttaaacttaaccaagtttgattagttaagccacgtcattaagaaattgttagccattggattaaatcctaattatataattgtagccgtttgatcatccaattcacagcaaatcagcaatgttggaacgtacgcaagcaccaagcagtacctgggcccagcttcttcgttgagccatattgcgcagcccatcagagagagacaaggcctcaaccttatccatgaacgcggccgatagctcgctgctcgctgcccctcccacgcctccctcgcgcggacagtataggtgagcatttttttccatagctcaattttgatcgctggataggccaatggagggggaaacaaaacccaagtttttggttttttcagcatctgtctaggactcttcctatgctacagttgacaacaactccgtttttcagatggtgtgttgaatgggaattgttcgcttctgctaaacatccaattattttttacccccatttttgccattaaacttctttgtgtggctgatgccatggacgcttgttctcccttatcccagaataaaaccttctttggaatgaatggaggaattttcagtgtttgttctgtgagaatcgaactaatgtcgatgaaaatcctatgaaattttacactattttctcatgaattaattcaatctttgtaaaaaaaatcctcccgaaattcatcaaatccaaaggctgcatgtgttgctgaattattaataaaaacctgatggagatgattggctttcttcccgatattgagaccctgaccctagaaattatgttgcaagggcatgcctttggatcatgtgtattttatctgctcaagatgtgtgtacaagaataagtaggctggagttggcaataagtggtgacccggaggtaaatttgtttttcctaatatgaggtttccccaaggatgacgaaaccattctgcattttttgttcataagtttaatggtcaaattatactctagcaatttatctctaactcacatttctacttctcttaatctttcatttcggcctgaccgccatttcaacctagtctttacatattatcctcatttcaggctaagattattgattgcccatttgattgcatctgtggagaactgaagatatccagctgaattttcttgtggacataacaatcaaaagcatgagaggaatcgaacaaagattgaatttgtgtttttgagaagcctacttaggtcagccacatcactccgacggatcacattggctttccatggtatgattatgagtcctgacaatggggagccattccagaacttcctggttgaactatccagcctgatgaaattcaaggaaatttaccgcgctgagagatccgcattcagaccaaactgggagtaagcgtgatcattcagaaacagcgtgctacagatcaacaccaaaattcctaaattgcatgtccttgccaaaattgtaatagacaatgtgtaatgcttgtattatatttttctgccttctaatatattcgacaatactcttgccgctttcatataaaaaaaccaccaaaattccgaataactgaaggcatggtctatcgtgttgcatgcataccagaattattcctgaaccgctgagagcatgccgtactgtgttgcagatcgatagcagtattgcgagcgcaaaataaaggccgtaaaacttgtttaattcgtgttttacttagagagatatttttttagataataaaatagaatatcctgac

SEQ ID NO: 60382 - DNA, 983 bp, Oryza sativa
atttccattagcaagaagacttaagtaaggggataacaactggactagtacgcatatctagtggttaattaccaaataattgttaaaataagtctattgtttcccaattggccattttttttgaaaacttgctatagttataatataattaaattgcatacaactatatattatagttatatatactatagttctttttaaaagtattttttttaaaaaaaaacttatgacagtgcaattaaacattgttaatccctccattctaaaatgtattgtatatcatagccttttacacgggctctagtgaggcaagcccatcgctgcgagagttcggtgactcgacctttcctcccccatcttccccctcttctataaggacatcagccagaaagctcgcgggggacaattatcgatggcactcatgacagcaacagggataggctagctcacaatgaagagattttgacactccaacctcctcgtcataaccctcctcacgacttcattcaccacctacaaatcttggtcgtggagggccctagagatggcccggttacaatgtgtcctccatatatccatggtagacaagtcagcagagccaccttcatccttcgcaaactcacgcgccacccttttatccttctttcgcagccactaagcttgcctggaaaaggaaagagatgtcggtgctgaggggaaatgtgatggatggtaggtaggtcttggtagcacacattaacttaggagagacaggaggggggggggtgagagacaagagaagagggagaggaagtcaacaacatgtgaatcctaacatcgaattatccatctttgttgacataagtgtgctaggttagaccgaaaccgcctagcttgggggttgagggtgtaatttgctccagtttaagggcgtgagggtgtcaaatgtctggtgttgtaatttaatattataaatcaaactattatagtagttgaggtgcact

SEQ ID NO: 60383 - DNA, 4246 bp, Oryza sativa
ttatggtgtatcaaagacaagacaataaattaaaaagctcacatggtggttggatgcattattgttttttttatattggaaatggtaactggatgcgttattgttaatagacattcatgcttttctgatagaacatgcctactcacagtatcccaacaactaatcaaggcacttaatcccaagccatacaagctaacgtctactcctccgtcccaaaataatctaatctagtacttgctaggtcaattttttttagaacggagaaagtatatatcgtctcacaaatttcaatctctgaaagcatttaaagcatccattagaaccatttggcatctctgagctagcgttcatagaacttggcttggttagactaagtacatatcgtatcatgtgagatatgcatgcatcgatcggtgggcttatttatatacatgtcattaatatttatgagagttcttgcaactaacattttgggtgaatttactatcatattaattactctctcagtttctaaatacatgagagtttgtcctaaacgtcacatataaaaacgaagagactaatttgatgttagggtttgtaatttacaaaacataaagttccacgcatggcaatcatagaagaattcgatgtgtcaacgatttcgcgctctataaaatagggagaaaatcaggaagaaaataaaggtggcatggtgactcccgaacgatcatgattgtgcacgtcatatttaatttcctcctccaatttgttggatgtagagtttttaattactgtattttcatgcaaccagattaatttgcactctctcctgtcctgaatatttgactttaagaaaaacattttatcaacattttaaaacattaaaatcaatagcttctgaaatgcttcgttaaaataaaaggaaaaatcgtatacatggatttgccttgaaaagtagtactatgtattaaacttattagatttattctaatgtagaattgatggtcagagttcgaatggtttgatggaatcatgtttgcaactgtcaaatagtattaattatcagagggactataacacccccactatatattttatatatccatccaaacatatgcttttgttggtgtgtacttaagttattacaccctaaaaggtagagattccaaagaaatcaaatgcttgcatgtcattggcaccggccacttggtcaatgttttcatgttctcttatggttcactcaaaaaatcagcactaatagttccggacaaccttctctacttgtcattaaaagctgccagaaagttctgggcctcttgccaagaagttccgggctctatatttaactgctaaaattttaagtaattttcagaaacatatattcaacccttaggtgatatctccgggtttcagaaacaaggggacatcatatccccttgagagaaaaaaaaacatctacccacactggggtggatctatccgggtctagggtagttagagttcaagccataggcctagaacccaaactctatgcaaattccatttaaatatcagaaaatcttaggaatttgtagagagtttggataagatcaatagaactgagcctatgtacccacatgcctgcatgtatgtaagcaaggacttatttttttttctttttgtcttcagtcgttggctacctaattaaacttattggaggatcacatcgcaaaacctaatcgatcagctgtttataacgaatttgttcgtcaatattccacacttccacaggatagctagctaggacgaaaaaccaggagctattaggcatcaaaccagaatttgttgtacatgctttcttccctcctggacgtattcttgagatcctaattaaagacatatattctaagctacattattgtggatgaatcggcaacgtgcagtttatatttttgaccagatggtattcatgtccattgtacatctccaactttagaaagatcacgctgactgaagtagctgaaccaatatgcaaatattgtaggaaagcgatagagagtgtaaaaaaatcgtataataaatctggtcgtcggctacattattcaaacatgcatacaaattaatgtatgcatgtcaactccagccaatagtttgtcagccatatatatatataccgttaaagaaaacggcttgctcatcatcatcatcaatcgtagactttgtcatatactctctccatccctaaatatttgacaccattaactttttttaaatatgattgaccgttcgtcttattgaaaaaatttaagtaattattaattattttcctatcatttgattcattttaaatatacttttatgtatacatatagttttacatatttcataaaagtttttaaataagacgaacggtcaaacatgtttaaaaaaatcaatggcgtcaaatattttacatatagttttacatatttcataaaagtttttaaataagacgaacggtcaaacatgtttaaaaaaatcaatggcgtcaaatatttagggacggagggagtatatgttgcaagtagtattcgtttaatatatataataatccccctttaggtcacacaaaaaacattatagatttaagatcagagaatgctggccaccgttaattaattgatatatatctgcatatgccgttctacatttcatatttaatttgaatatagttatatatgctctcaagttgatctggacccatgcggcatatatacaatgttccaacacactctcagtcatcaacatgtactaaaagaatattcaagacttaccctaatcacatgcatgcatgtctctctctaatttgatactaatctgatcaccttttgcgctatctaacacgctacacattcttaacatatagctaaacaggtgcatgcacacatgaaattcaactatataagtatatatctttggccacttgaattggaagaattggaagcattgtcaccttgtggctgtacgtttatatatacacgtgttcgatcatatattccatacacggatacactgtacatgtgtgctgcacccacattcatatatataggtagatattacatatgcattgatcacacaacacacatgtatctcttgtagctttcattttcgtactaggtgcaaatcctcatctgtaaagaaaggtagcatttttaaaaagggatcgaattaaattaaaaaggttggagatcgatggagatggaatttcgtcccatgaggggatgtcgtccctcgcttcttcaagtcatggcatgttctccaaatagtaccaaatagagttcaatgtgttgtttgtgttacaactcatataaatcggatttgaacttgtattcatataaatcggatttgaacttgtatcgttcttgagtgatatattacatataaaccgatttacatacctgattaactttttaaaattaaattataaccgtttagattatatgcaagaaactatatatatgacatctcttaaggagcaaaattattttcccatcgatggatatgaaagcactcagtttgtcggtataaatagctatcagcgtcaaactatccgttaggaaagacatttgccgacacgcagtctaccaccagcatctacgagggatctacagcagtcgggaaaagtttttaccggcagaatgatccaaatatatatcactgatctgcatcatatcgtacctgatactgttcgaaaaggccggcatctatctatctatctaactgcagctgaatgatccgatgcagctgcagctggtatatatcgagcacctaaacccacttcgatctgcaacttgcagggaggcaccatattcgattataaatttcgttttattcgatcgatcgatcaagagagagcattagcacatgcaggcacgcgtaaacgtttcagatggcgacgatcgaagacgacgacgacgacgatgatgatcgatcagttgctctgctgctaatgctgatcagttgatcgatcgatctttcctatcactttcgcatgcagagaattaataaagtttagttgagatcgatcgaatcgttttatgttgttgttgttttcttcggtttggaattgattaaagtagtatcagtactaatcgatcgcctgatgtattgctggagatttttgttgttttgtcgttcatcctctgtgggagaaatttataaaggactgatcgatcacaaaagtgaaagtcggtcgtcaattaattaattaattaatccttgttgatctcacatgcagtttgagatt

SEQ ID NO: 60384 - DNA, 7512 bp, Oryza sativa
agccacatgggtttgggaatggctcctccctctacacttgatatcccaggcccatatcaccgacaatagcccccggcgttagccgtgaccaaaaccttccttaggtggtcagggttgatgccactcttttagtctaatgacatgtgggcccggtctttctttcgtgttttgtgaagcgattcggtagttgtggccccacgcgaagcaaaaaccgcctccccggcaatgatgggctatcacttcgtaactgccacatcacctgggtaggtgcgcggggcagatatgtcagtggatttgccagcgaataatgatggcggcttccccggttaccgcgcgcaattaaggagggcgtggttccacttccgtctcagtcgcaacggcagcgtgcctagcacgcgcgctagaaacggatgcgtggagatagtgggcacgaaaaacgagggggcgaagtgagtggccgcaagaatcgaggtgccaggcgtggaggaggggaggataaagggcgtcgaggagggattttgttcacatcctttcaccactagaatccgctgcgctcctatgccctagctctcgccgctctcttgcctcctctcgccacacacactcgcttctcgccacaccaccttcgttgacgccatgacacggagctccgtgccgctggatggcagcttcctgcctccctctcgcattaccaacgagaggttcgcgggtctgccgcgcaagttcatgccgacgctgtcggctcccaaaactaatgattcggaaaccgatatgtttaactgtatcaagccctggatcagtagattgatacagcttcaacaatctggatcttcattgcgtacatttaaacaaggctccaaaggagatgttattacataaaataataggggaatttgcaagtttgtggctaactatcacaacagaagctatagaatgactcaactctaatgttttgctatagacttaaaccatctaactaatctagatttgagaactaggttgaaataagactaacttatatgattgaactcctggcttcagcaagaacttcaatttaactctggaaaaagggggttgaagcaaggatgagtacaacgtactcagcaagctattatattcaataatgaatgtatgaaaaggtaatatttgagtaggattacgattacttgcagaaggcagagaatatagaaatagaaagcctgatgcttgaaatgcagcagcatttagtaaaatcttgaattaagtttctaaccaaagtaccatctgagtcccgatactcaattccatgagcacggctattcgaatagattcatttttactttactgcagtaaatgtacgctttacccgcaatccatgacatgccaatattcattagcttagtcatggcaaagcttttcggttactaacatcagtggtacctgttccatgaactctcatcctaatgcgctctgaacgtaacgttatcagtagcgagaggagttctggcgttcccgaggtttttagagagagaactggttgagagacccccgtcatctcaactaggttttcacaatatacacacacttgagctcaacatatcatttacctgcgcctcagtaaatgttatatttgcccttcgtggcatatgcccttcgcggcataagtttgcctcctgagcgaggacttaaataagaaccactgtatagaggtaccacctttgctagataacttactttgcaaggtctgtccctattctaaaattgcggtcgtactcgttcgtttgacataagtacttggtaataactatattgactgagacagtactagccacccgaaaatcaaccaattcctacgtactgtcccaatctaagttcattatatttttatgcagactaactaggcagggctaagcaaagctagcatatgtctggtttgctatatgttcaggttatgtattcaaaatcatgaatgactaatgcatagaatagagatatagaatataggataattatgctcaaggggaggaataataacttgctttgctccaacgcaaataaatccaagataggcaacctgattatccgatgctagaaatacctcaggttgccatccagaatataatagactctactagagaagaggaagagccaatttcaataaaatccataaaatagcaaaagatcgataaacggctaagagagctagggtttagggtataagctatcttctttatagggtatagggattatgggctaatactttatgtggaggttctagagggttggaggctagaggggattaagtaacaattgtcacttgtattttatgtgtgggttttagtttcttggagagtaggggatatactaaataatctaattggttaagtggatatgtggctagtattggttgtagttgggctttggtagaagaatggctaggatttacttgttctcgagtcgatgctgaaataggatagcatatgggctcgtatttcatgtataggttatgggtagttggagggtaaatggttggtatggagtttggatagcagactggctggggtttcatttgattaagccgatatcgaggtaggatgaatatcggctgggatttgggtgtttgctagtcgttgctagagttgggcagtataacgactaaaattggtatcttctctagccagtgtcaacagacagcataacggttagagggataggaagtttgtgtgggtttagtggggcggaagtgttactccgacaaccgtgagtggcagcagaacggttaggatcacacagagcccaagagctaactgtgcggcgtgctgtggaggtcgagggaacagtgaagctccgaccactatacgcatcgaggcgtggggtgccaggagcagcacttcgaccttaggtttggttttgccgggctttacaaccaacggtccgacatcggggatagtaaaccgcgaacgtcccatggaaggcgtaaagttccaaccggcggctttttagtggctaaagggtattttgggttaaaaagaaatatttgaaaagacaaacataaattcaaacagtatttgaataaattcaaataaaatattaaaatagcaaatttggggtcaaaagatggggtttgaatttagatgaatttaggtctaagtttcactggaattggatctacggtttaggagatatggacttctaaagaataggatttgaattaaataaggaaaatataaaatgttactgtgcaggggcccacctgtcagtctttctttttctttttcttttctttcttcttcttcctcccgtcatcttcctcctctccttcccgtgtaacagcatagagagagagaaggggcatatagactaaagaaaccgacatgtttagactgtatcaagccctagatcagtagattgttacaggtttaacaatctggatcttcattgcatatattagaataaggctccaaaggagttgatattacaaaataataggggaatttacaaaattgtggcaaattgtggctaactaatacaacagaagctatagaatgactcaatcctaatgttttgctatagacttaaaccatctaactaatctagacttgagaactaggttgaaaggaaactaacttatatgattgaactctcggcttcggcaagaactccaaattaactctgaaagaagggggttaaagcaagggtgagtacaacgtactcagcaagctattatattcaagtatgaatgtatgaaataatagtatttgagtagagcactactacagatctgggcttcagtgacgggtcatttgtgacgggccaacacaattcgtcaaagatgagtcatctctgacgggccgaaaaaatatcctcttcaatatatggctaccagggaggacccgtcacagatgtgaggtcatctgtgacggcttgcacttgtaacccgtcacagatcgtctgtgacgggtcacaacaatggctcgtcacagatcatctgtgacgggtgtagtattatgaaccatcacaaaagagaccacttatctctgatgggtctttaactaacatacgtcacagataacgttatctctgacgggtggtagtcatgacccgttagtgatgagtgaaaattcaaattttcaaattttacaaaaaacctcggattgagacatgtcctatataaaagttgtagctctcgatgatatccacaactttataactaacaacatttctattagagatcatttacatccccgaacatgcattacaagtgatcagatctacttttaaaaacaaaattttgagtttttttcaaatgacatggatggatacatgccccgtatcaaagtcatagaactcaaccagatctacaatattataattgaaaatattttcatttcacaaagtttacatgttataaagtgagatatattttgaaaaatgaaattttgaattcttcaaacaacatcgaatgaagatattttctatgtaaaagttataaaacacgatgagatctataactatttagttgataatattttcatttgaagtcatttagggtgttaaatatatgttaaatgattcagacaagcatagacaaaataataacattgggtgagtagtcaatatttgttgagtaggtgagttggtaagggagctctatatggaggttgaggtcttgagttcgaatctcatgtgtagcatacaagttatattgcgtaaaaaattgtgaatttgtaggtagttgatgtgtgaccatgtataggatggctagtaaaattcaaaatatttttttgaggtttttttgttgcgtttaaaattcaaaaattgtatttcttgctttgtcatcactgacgggtcgtaagttacaacccgtcagagatgagtcatcagtgacggacaggtagttacgacacgtcactgataactcatatgtgatgggtgacaagttttatcccgtcagagatgacacacccgtcacaggtgattttgtcatcagtgaccactaatcactgaccaagaccaaacctgtcaaaggtgagggtttgggcccgtcagagatgacatggtccggcgtagtggctagatctatttgcagaaagctaagaaagtagaaggagaaattctataatgttttgaatgcaacaatatttaataaaatctggagttatatttctaaccaagatgccatagtgagtctcgatgcttaatatccgtaagcacggctattcgaatagtttcagaaatactcatactgcagtagatgtatgctttacccgccatccatgacatgctaatattcatcaaacctgtcaaaggtgagggtttgggcccgtcagagatgacatggtctcgcgtagtggctagatctatttgcagaaagctaagaaagtagaaggagaaattctataatgttttgaatgcaacaatatttaataaaatctggagttatatttctaaccaagatgccatagtgagtcccgatgcttaatatccgtgagcacggctattcgaatagtttcagaaatactcatactacagtagatgtatgctttacccgccatccatgacatgctaatattcatcagcttagtcatggcaaaacttttcggttactaacatcagtggcatctgttccatgaactctcatcctcatgcgctctgaacataacgttatcagcagcgagaggagttctggcgttcccgaggtttttagagagagaattggttgagagacccccgtcatcccaaccaggttttcacaatacacacacagcgcgcaataatcaatatatttacctgtgcctcggtaaatattataatcgccctgctcggcgtaaatttgcctcctgcgtgaggacttaaagaagaaccactgtacagaggtaccacctttgctagataacctactttgctaagtctgtccccattctagaattggcggtcgtactcgttcgttcttcagatgtacttggcaatcttatgtcggttggaacagtatgagccacccggaaatcatgcatttctaccgtactgttccaatctaagttcgttatattttatgcaatctaactaggcatggctaagcaaaatctagcatatatctggtttgctatatgttcaagttatgcatttaaaatcatgaatgggtaatgcatggaataatagagatatagaatataggataataatgctcaaaggggaggaataataacttgccttgctccaacgcaaataaatccgagataggcaacctgattatccgatcctcgaaataccacaggttgccatccaaaataaaatagattctactaagaaagacgaagaaccaatttcaataaaagccataaataacaagaaaacgataaatggttaggagggctagggtttggtggtgtgctagtcgatgctagagcataatgactaggtttggtatcttctctagccggtgtcaacagatagcataacggctagagggataggaggtttgtgtgggtttagtggggcggaagtgttactccgacaaccgtgagtggcggctaggatcacacacagagcccgagagctaactgtgcggcgtgctgtggaggtcgagggaatagtgaagctccgaccgctgtacgcatcaaggcatggggtgccaggagcagcacttcgaccttgggtttggtttatgccgggctttacaaccaacggtctgacgtcggggatagaaaaccgcgaacgtccccatggaaggcgtaaagttccaaccgacagcttttagtggctaaagcgtattttgaaaataaaaggaaatatttggaatacaaatataaatttaaattggaaattcaaatataagaataattaaatcaaatatttattcaaatggtatttgaataaattaaggaaatttaaataaaatcttaaaatagcaaatttgatatcaaaatgaaggatttgaatttagatgaatttaggtccaagttttatcggaatcggatctacggtttaggagatatgggtttctaaagattggaatttggattaaatagagtaaattgcgaaagtatactgttcatgggcccacctgtcagggattcttttctttttcttttctttcttcttcctcccgtcgtcttcttcctcccgcttcacagagggccgagagaagggagaggagagggagagaggggcggcggcgctccggcggccggggggtggcgacgtcggcggccatgcgcgttcccgagcaacgcgcatacgaggagggtggtggccggcagagggagttagggaggaggccggaacggcgacaacaagagctcggtttcggccggtatagggggcggcggtggtggcttaactcggaggggaaaacgaagggaaaggttagggaatggatttgcctcccccaggcgaatgtagtggcgcgagggcttggtcggaaatgctccgacgagggagatcgggcgatggccagcatttggcagagagagagaagagagaagctcggggctcggcttggtgttgggaaaaaagaaaggcttgccggctatt

SEQ ID NO: 60385 - DNA, 15319 bp, Oryza sativa
ccccctccacgtgtcagcccatgtgagcagggttaggtgggcgcgcctaacacccacctaaccgcatttaaggtgagccagatggccgcgcctcgtcgcatttaatgtggcatgcaggcgtggctgacaggccgcacgtcgcccgaatgatgggtccgacggggttagtgcacctgactgctgactgcttgttagacggcttgcagcttgcgctgccccatcacatcggtatgttgagggttgtttgccccttgcctaggcctgagtccacgttccgctccggtccgatccgggtttccgttccctagtgggacagggtgcccagaagtcttcatccattaatgaggagtgacacatgcgtcccccgtgtcgtccggcttgaattgatgagggcacatgccgcaccaatgggcgtaaggacttccaagtcagaggaacaagacatgcattaaatgtaaagaatgttttccttcttccctaggtagcttttagggcctctgtggtaaccccttgaggtataaaaggaggtccaggcctagtgaagaaggggggttttttgaaggcattcggcttgcgtgaacacttgtattccccacagaatcaaccacatgcaggagtagggtgttacgcttctcagtggcccgaacctataaaaatcccttttgtctcgttgctctagaggggcccgaccccctccacatctctcttccactaagcctcaattctcacccgctacccccgatcgaactaaagggggccccatagtcccactacacgacacgacacgacccacgacacgatcatttggcccgcccaagcacggcacggtgcgactggtgttgagctcatgccggcccgacccaacagttggatcgtgcctgggccgatgccttgtcatggtgggtcgccccggcatgacggtcaaagaaaaatagttgaggggtccaaaatagacttacagccatataaggtacggcccaaagaaaaaaggatacaaaatagacttattgtagccatataagacgcaacgcaaagctatgagggaggaaaaatagacttattatatggagaaacacgatgttgggcctctccagggccatgggtgcagcccgtgagaaggctcggcatgtaggtcgggtcgggcgggccatttggccatctatatcatagagtgcaagggaggggatgatcgaggcaatctgggacgttagatttggtgatcaaacggctacgattgcgcatgtctgcctaatgcgtctactgtgtcaaaaatcaagaccaccattacgaataggggtgaaaatggggtgagtatttcccgacgtaccgcccgcctgacccgaggctcgcgggaggaatatgggagaaaaaatgggatatccgatactatccgagtttaaatctgaatttgttgggaaaatgtgggttaggatacgggaagacatgtatccgcccgtatgtccctattatataacatgtatgaaaatttattataaatccacctaaaaacatgataaaagattagttaatcactatttacgtgctcatatgtatattgtataattttttttcttgacgtatcttttttaatactttaattaccttattttatttaatatctatgaattagagatacaaatagatatccattcccgaatccgattcgaagcaaataatataggataggatatgggatgagtgatatattatccggcactacccgtatccgactccgaatttaaaagaaaatatgggttagggtatgggaatggcataatccgaccatacttgctcgttttcacccctaattatgattttttttaagtagaagaagatttacaaaactacttggtcaaaaatatatttacagtactatatctttttgttttcaagttttacggatctttaacgttctttggaagctttatttatatatctagataatactccgtacattgctgcgggacatttttatatgacctagagttgtaaacttgtagtaatagatatagcccgaaagttgtttcatgtagtctaatgttacatgataattaatttgaaaccctgatgtttgtaacagtaaattgtgaagatgttcacctgaaataatggaagttcttaattaattatcagcttctttgttttctgaatcacattcaccagtttgttatattcttaactcatgattgaatggttagcctgattaggttgcaagcaacttctgagctccagccatagctagctataagccagctacaaacatattttaaggagataaataagaagagagaagagtagagggctacagatttgtagctagctgtagcacgaacttcaagacgcagtgtgtgtatgacaggtgggaccatgtattaatagtgtagtatgtaactattgtatggatgagctattagattggctatagatgaattagagctagtagtgggctatactattaaacttgctcttacaacaaatgaacctgccatctacagtaacaaactcggttagtcgagcaacaatatgtaggctgcacatgtgaagttaacggtgtgtaattaacagtgtacatattttcaaatataaaaaaaatacgtacaacacactttgaacaatagattaagtaaaattctatgggaacatttggaagggccagttttacctcgtagtgctgtattgcactttattgagtaaacaaatagctgaaaaatttccctagtaaagcttatacatttctagacttttttaaactaaacaaaaacgtgatatttgcaggatgaattcagaaagagaaaaaaacaatccgtaaaatagaagctacggagaacgaatactaacacacttaactgatggatctaatatgagttttgagcagagagtagtgaaatacctgccctatactgcagatgacgatcagttgcacttctattttgtgtattgatcaaatcacttcatgcaattacatcctttcactacatctgaatcacctgataatactatggtaaggtagtgaatcacttgatgatactatggcaagaaaaatgagaaagaaaggagaaagattagagcaccttcggaatcaccttctattatgaaaaggaaaactggattctcataaaggcaaaaaccatgacatttaaaggtagaagacctggggataataaagtaaactacctcatcatcagagaataaaggtggccggttgggtagaagcttgcttcatcacttcagtttagggaaaattaaatctatgcaatatggtcattggctgggaaagaggacagaataatctgagccagctgcgggcctaataccaagatcaaagatgaataatgtaagagagagagagagagagagagagagagaatagaagtatagctgcctacccgcaggataatggtggcaggtgagagaatcttgaccaattgttagcgccaatacattgagcgagcacatgttcttattgtacaacaaatcaatgacttaactgcgggggactccctgcaatgtttgattcagaaaatcaacctagtactaatcagctggattgaacatacgttagatcgagagtacaactgaataaaattcagttaaatggtataaggtattcatcaccgttagctatttaaaataaccattgaacttaactctgacaaagagaatagggtaaattgatcattcgcttagagacaactgaataaatttcggaggaaggtttaaggaaaagcggtgcacacctttttttttttccttttttcagattgaagatctacaggagcagcataacacattcagaaggaaggctgtagataccacatcaccaaataactttctgtacatatcaaatatccaaagggataaaaataaagctacttactacggttatcaatgcagaacattgtacatgtggaaactcagatgaagcagagttggtgccttggtggagaaggacagagaacctgattgaagcattccccagtaataagcgaaggccaaggatgaattcaccatgacgttatgggagcagtaaattgatgtctttgatgacaaccatgaagtctgctctcgaagcagcggtttcatttctcatgacattccgaggaggcgaaaaggctaggaggcggcagccggcaggtgggcttgaactaaaggcagagggagcgccggatagggggagggacacgacacgggagaggaagtgacgggcgccgtcacctaaggcgctgcggtatagggaactggagggtttgcctctggttagggatggatacccgttgagttgggccataacatgggcttctttcggcccaataaacaaccggggaactctgggaggctgcttcatggcttcccttccgaatgattcagatcgtacggttcatagcaaatggggcgatgtgaagcaccaggaagcagagatttcctagtagtggggatgatttgtataggtatataggataaacgctcttcaaaaggtgcttttttaattttttttatgtcacgtcaaacgaccaaccaccggtcacaccatgctaagagacaggtataattcttgaggcagcctacttgccaccctcccaaataatgttatcatagattaggtggacttgaaatgatttggtactcacaaactcatccaaatgtataaatttggatgtcattaagcaagacctcttcatgttcctatgtgttcgatcctctcatgtgtttgatctgttaaattaggatggaacgacgccgacttcattgagcgtcatcttttcatatttacatacatgtatttgatcttataaattgggatgaatttgtgaagcgccaaataattttaggccccctagtcaggcaaaaaagatcctctaagagggtcgcaactcacaagtgggccggctgcaaaattgctaatgcccacgcatcagccggcgttaacattggtgaagtttaccacataagaaaaaatgtcctttggaaggtgttttcaagaaagaaaacactccaaaaacgttatggatatactcaatccgtttattgatagatgactaacttttgaaaacacaatcgggaactgactatccaattgtcgggtgatttctaacaaaaattcacctagattttttctactattatatttacatccaacagactacgaaagaaaatagcaaaattgaatcgggaaatactctatactccagcaacaactgggcccattcgctcggcccggcccacctcctcgcacgccatgcccacgccacgggcgcgcacgcgcagctgaagagagagcacccgcgcgcccacgcggcggcgcgtgcccggcacgcggcggcgcgcgcccccgcggcgaccggaggatctccgctcgaactccctctctctctctctctccaactaaccgcacgtcaccggaggccgccacgtacatgtgttatacattatatatatcagtcgtggtcgagtaggaggtttcttgcagagatcggggttcggcgccggcggcgagttgttgagaggcaaggcaaactcaggcgactgagctaaagaagccgcactagtatgggggtgacgaaggcggaggcggttgccggcgacggcgggaaggtggtggacgacatcgaggcgctcgccgatctcagaaaggttaattctctctgcaaatactcctggttgctcatacttaaatctacctatgaatgagggatcgcatcgatgtcgcagttggagttggacggacaggagtgagaaattattatctctgatctgattcctgttggtatgcactcttgctgtttgtgaaaatgccccagaggatgcatccacaggacacggcgccttcaatatttataagttgattcaatgatgggtttctttcatgtttctttgctgaaaaatcgtgtttagtagagtagtcttctatgtctctattcaaaagaaaagtggcattaagttataggagaaaataaaagggagaagtcgttttgttaattaggagcttctcctttcgataactatgacttaatagttcatttttattatggaacaaagatgagatacaaaacaatagattgtgatcacctcagtttttttgtttgatatcaagtctgacaaactaaggcattacggttctctgctcttgtttgacaaacgaagtctattgtacaatagaagtctgttgtttaatgtctctacttttggtcatctcttgtatggtttagcctagatctcagtttatcttactataggtcgccgatagtacaatatgatttgtttctccgccgtacctaatccaaaatcatatagcttgacattatctgcttcgcatagatgttcgttataagcttcaaattacaaatttcatattgaaagtttagcctcttcttgttggactataatagcgagtccatgtgaacatcatttcttacattaatatacatttcttcacatttgtggctagttattttacttgccctaccattgtcgcatttatttatatttccataactcattttccaatgcttagttgaatgtatcattcactcattcttgtattgtttgtacgtctttgagactttgactgaaaatagtcttagttttgtacctattttatattttgctttatgttttaattattttctttgacatgatgtgcatgcatatttattactaattggtcatgtaacacaggagccagcatggaaaaggtttttgtcccacattggaccaggctttatggtctgtttggcttacctcgatcctggaaatagtaatattctctctctaaatttattttctcacactcatatggtttctcacgcttgacgaattgaaacagtggagactgatctacaagctggtgccaatcacaaatatgaggtacattctctagccttttctatatgacttttcctgccatttatcacagttgtcatgtcttttgttacagcgagaagaaagaaacaattaactgatatgcttcttgatgtgctctttcatatgtttcttagcttctttgggtgattttgattggcctgatctttgcactgattatacaatcattatcggctaatcttggagtggtgacaggtaataaatagacactttcagcacacaattgatttaacatttcagttggaagtagcaagtaatgaatgtcaattgatacagggcgccatcttgctgagctgtgcaagactgaatatccagtatgggtgaaaacctgcttatggctgctagcagaactagctgtgattgcttccgatattccagaaggttggaaatagaatgatagatctaaataaaaaaaagttaatgtttaactgtcacctttgagtttcagttgattaagtttataaactctctcactgatataagtgtacgagcaacacttgcactgattgtatacagtctcttatccactaaacattatgatatgtagcactttttctgagaagaaagcaacaacatctaatctaatatttggtgttttttacacatgtaccttttgtgcagttataggtacaggatttgctttcaaccttttgttccacataccagtgtggaccggggttctcattgctggctctagcacgcttcttcttcttggactgcaaagatatggggtaaccaactatttatgactggatatatgatagatgtctgtataaaatgttttaatgaatgtctaaacatcattgtattgtatttgatcattactgtttggtcattgtaaatggtggtcattacaaatgggtttgttgttgaattgacttgtttgcatttttccttcatctatataactaggtaaggaaactggaggttgtggtcgcgctattggtgtttgtcatggcagggtgcttcttcgtggagatgagcatagtcaagcctccggttaatgaggtccttcaaggattattcatccccaggctcagtgggcccggtgccacaggagactccattgcccttcttggggctcttgtaatgccgtaagcagtcaaacatgcatatatacccccagttgttaatgtgtgcaatgtcttttttgcgtcttaagattcttctagggtagctgtaaacatgcataaggttttcaactctccagtaattacaaatctccacaatggtagttttagtctttttttagattttgacaaaatgcactcttgttaatcataagtgagcattatcagttattaattacaggcacaatctattcttgcactctgccctggtgctgtcgaggaatacacccgcatcagcaaaaggaatgaaggtgatcagatgtccgtgttcttgcattaaaaaagaaatggtactcctagttggctgatacatattccttcattcttttgtactccaggatgtctgtaggttcttcctctttgagagtgggatagctcttttcgtggctctgcttgtcaacattgcaatcatctctgtctccggcactgtatgtaatgcaaccaacctttcaccagaagatgctgtaaaatgcagcgaccttacattggactcctcatccttcctcctcagggtactgcatatatgtgcaaagttcatcaccatttatatttagttgtgttattttcttcacaaaaataaattagtcatgttatcattgaccatataatggtcatttacagaattattatttatttttttttcagaatgtgctaggaaagtcaagtgcgacagtgtacggtgtagcactcttggcttctggacagagctcgaccattactggcacttatgctgggcaatatgttatgcaggtatattttacctgaactctaaccttgtttacaaattaaccaagtactatctgtgaactattttcttaatgaccagttcaagtggtatagtattaaccacgcagtaaactagaagatctccaaaatggtgaaagaaatgaaaaaaagtttgcaatctatcaagcttgaatgtatagtaacagttttttttttccatgtatctacaggggttcctagacatcaaaatgaaacagtggcttcggaacctgatgacacgcagcattgccattgtgcctagcttaatcgtctccatcattggagggtctagtggcgccggtcgtctcatcgtcattgcatcggtacaatcttttactacaaatgaaaatatcagtttgcccataagaacactcattaaaaaaaactgccatacaatcaaccatcttctaattttctcaataattagtaagttatttgctaatcgaaatgcttctttcttcaaaaaatggacggtatgtaatttgttgtacctcattccttctgatcatactgttaaaaagaatcaaaacctaatgcttgttttggtttggctgttacgtttcatacagatgattctatcctttgagctaccatttgctctgatccctcttctcaagttcagcagcagcagcaacaagatgggtgaaaacaagaactccatctatgtaagcactcccccatcaatcaatcaatccttctttctagcttgtccacacatagaaaacaaaaacaaaaaaaatcctggaaaactaataatgcattggtaattaaaacctgcagattgttggattctcctgggtgctggggttcgtcatcatcgggataaacatctacttcctcagcacaaagctggtcggctggatcctccacaacgcgctcccgacattcgccaacgtgctcatcggcatcgtgctgttcccgctcatgctgctctacgtcgtcgccgtgatctacctgacgttcaggaaggacaccgtcaagttcgtgtctcgtcgtgagctgcaggccggcgacgacaccgagaaagcacaggtagccacctgcgtcgccgacgagcacagcaaagagccacccgtgtagtacccttccagaccggttaccggtgttggctggtttttattggatagatgtttaggtccaattttttttatataaaaaatccaatagatgtttaggtccaaatttttgaattcaaaaaccggttagcagtgataaccggctgaaattttggcccatgggagtagattgttgctttttttcttagtgattagttattggcagattggcagaatgttgtagctaggcaatctaattgtatggttagatatttagtcataaatccaagagtgagttttcttggatgcgaggacaaggacaatctaattgtatggttagatatttagtcataaatccaagagtgagttttcttggatgcgaggacaaggacaaatataaatgtaaataaatgcagttaaagtaacaccttgctcaaatataaatgtaaataaatgcagttaaagtaacaccttgctccttgtggacatctatctcttgttgatgccagtgttgtggatgacggaatatggatgtcggacggagatggttccgctaaacgaataatcggagtacgggcgaataatcggaatttgacggaaatttaacgttttggacaaatatatgtacataactcataatagcttattatttttgatagataaatgcatataactacatatatacctactattcttaaataaaaataaggataacatggcattaactcggcatatagtaaaatatatgtctgaacatatagtgataggtttggctcgtaacgcataaaggaaataccaaaagcatgtaacactatataagtgacactaaaacgacgttctgtagctatatattgctaggttacacaactaatgggcagtatcatgggctggctggcagggccttctggccttgtcacatgatttggcccgtttattcggctgattagtcggaaacggctgattaattgctaatgacggtgattatacgtccttaaacgattaatgatcagcgttttgctcattcgtgacggaggggtcggcgccaccgtattaacgcccgaatatacggccgtaccaaccgttatccataacactggttgatgctgaattcatttgggctactgttatgcccaggtcttgctacgtctattgatttccatgtttccttgagatttagatttggttacaagttaaaataatctctagagtttgagtgaagtttgagtgaaccatctcttagacttccatgtttcttgagatttagatttggttacaagttaaaataatctctaatctctagcgtttgagtgaaccttctctttttcttatttttcttgtggctcattaacttttctttaagctttcccgcaaaaaataacgtcttaggtactcttaaatcctgaataggaagctgtgagcaggtataaccaccttgtatcttgagaaatcggacttctcttctcaccttatctccgtttacattttttaattaaaattttgtagagctcttttttgataaaatctattttgtgcgcatgctcgatttggacttaccgaacgacacatctgtgcccacaagaaaaacccacacagcacggagccatgttcgtgatgctattttgggaaaggcgtgaatggaagagaaggaaatgagtaggcgtgcattaggactaatgcgctactgcacaaagcgtcttttttttttcctccatattggtcatttgcttttatttaggttcaacgttagagcttttcttccgtagccccgactcgagctgtttaatttggcttctctttagatcttttgtttttccatttcttcgctctacagatcgccttaaattagtcagaataatggcaagtaatatcaatagttttccccatcgctctcgcgtgggcggctcggggacgaaacctagccgccagcgccgccaaccccctcacccttccttgccacctcgccgccgcaagagcccgccactggaaaccaagggaccagccgggaaggtggtggtgggggacacaaccccgatgaaactccttctcgacacgaggtggagtggcgcgtgtcgggtgtggggaccagtggttagagtggttggcgtgatggagccagccacctcggaggcggatctgcctcccccctcagccccccccacacaccccgcaaccagatcgggagaggacggcgaagttcgcggcgacggcagcacagtggagtcgcggggcggcccgagaaagtgcggtcgtggccggcgaagggggatgcacgacgcggccggtggcaaggccgacgcgttcggtggcagcgtaggctagcgtgggcgatgatagggaggatgtcgcggtctaagaccgcgagaggccggcgtggcagacggcatgaaggctgtcgtggcttgtgaccgtgagaggccggcgtgttcggcggcagtgaccctttcacgtcaacggcaggggtcactgcgctgtgggagagggagctagcaagctgcggaggcgtcatggctgtggaggagaccggtggcagggccagctagcgatggggcactggtgcagctgaggttgagttggtagacattgtgtaggtggcagtgcttgggggtggcgggggcaagtgtggtagggaggcttgcagacgaaaacctagcttgggacttcccaagccagcaatggcagcgttttcggatatcgcgttccccctttcggggtgttgtcgagcggccacccttccatccttgataggaccctccaggtgaaaaccgagtctagctggatgggcaacgatgactgaagatgcacttaaaccccctagtgggttttggtaattaatgacaaggtggttaaaggggactaacgtgtttatcaagtttattcacaggagtttagtcccaaagcaagttgtgatggctaagaatgcaaggagaccccccaatttgaatgctcctaagtgcgaaaatcaccgaaggtgattagactaggtttttcactttcgaaattgagtttaggaaaaaccgtactattaaaaggggtttcaagtgtggttctagggtatacaaagtgctcttagtcatatccatgtgtcaaaatatttttggaatcatttttgaaaaatgatttttctccccgggacagagagggctacccggaggttctggccagaacttccgggcgccatttcaacagcaaattttcctaagtgctgcccggaagttcctggcactttttgcccggaacctcctggcaggcttccagtttaaacttgtgagtaacggctagatgacgtcatctagccgttatatatatggatttcgtccccaggccaccctttggctattccacttcagctctttcatgttctagggttttctagccactcccaagcttcctttacttcctccactcaaatctagagcctatcttgtgagattgagagattagattagagtgtaagagtattttggagatggcttgaagattaggtttgtttgagcactttggataccttgtgggctgtcacttgggcttattactcttggagatcttctcatagacggttaggtgtcgcccgtgagcttccaaagatcttgtggatgtcccgggaaagtttgtgaaggttttcttcacctccgcaaggaaacgaggtaagtgagtaaagattcttgtgctgagttttcagaggttgtcctaggtagagcaacttacacttgtggtcttttctagaaggaattgtgagttggatcttggtggtcactcaattctagaaaatgacctagaagtgttgagttgaaggttgtggacttcttctgggatctttgcataagtgaggcaaggggttaatcgagacccggctctttgagcacctcaacggagagtaggatccgtgtgatccgaacttcaggaaaaaatcgcctttgtctctcttgtgcatgatctgtgtttgaatctgctggtatcttgtgatttacatcttgtgcaaccttgtgcctgattgtctctagctaggacctgttttgcttccccaaattttgattttctctgttgctaggaagttcctggctcaagaactccggaagttccgggctgctcatctctgccaggaagttccggtgttcttcaccaggaggttccgggccctgttaatttaactgctgtgattattgaaaaaatttcagaaaaacctattcacccccccccctctaggctacatctctgcgcgttcaatgacgtctaagacgtcatggccttcctgaagacattgtctaggaggtcatgttccttgcattcaccaccttttctttgtttggtcatcggcggtttttggttgtcttcatcaggttgggtgagggactagtggatctccttctctcttgacctcttcctctcctcaacctctctacgtgtggataactgaaagctttttgacgtctttctatattgagtcggtgtttagcagagcatttgtaacctcccggttggccaagtggtgattgatcacgcttagcggcggtcggcttggtgctattgtcctctctagggtgtgctacgaggagttgccagctcttggtggtggtgtgtttgttttcatttgtttttcttggttacgacctcgtagggttgtaatattgtaactttttcttgctatactaatatgaattttgcattgtctagcgtgaatcattaaaaagagaatctaagaaatgccattgataagcatccaatttcaagaaataccatcaacaagttcaagttccatgaaataccatcttacaagcaattttatcctagaaatgccatcatcattaggattccgtccatcccgcgccattaaatacattgtaacttgtaagtgcaagttttattattgaaagaatagcgtatgtgactacgaggagtccatggaattgtcatcaactataagagctttcataaagaatatagacagagttatccataaaataaaggggttgtttggttttcataaactccctgcctcccagcgcacgcaagcgacgtggatgcctccgcgtgcgaacatgctactcgaagcgctctcagctaggggtggaaacgagccgagcctcgtgaaagcttggtgcaagggaagcttggcttggcttgctcgctacaaacaacgagctaaaactgtagctcggctcggctcggctcggctcgttaatgggctcgagctggcttgcgagcctggcatcaagtaaatctcaagtaggtctaacagaaatcgagaaacattttaccacatagaatttataatactgtgatagttttctttaatatgtcatcacaacacataaatagataatgtggcaatcaaacttaccatttccaacaaataaatagttagaaaaggtgcaaaatttttgtatataaccctatgcactaagccaaacgagcttgcgagcggctcgtgaaccagctcgggcttgactcgtttttgaaacaagctaggaaggaggcttgggctcggctcat

SEQ ID NO: 60386 - DNA, 3100 bp, Oryza sativa
tactccactgttaggcacctaggccacattggtgttccatagtatatacattgactgttttacactaggcaaattccacacttggccgtcatcacattccatatttccagcaccagcagtatatttaaaagtaggaatcttctgtttcataaaaaaatacaaatattaagctgacgaagccattataatattttaactggaagtcgcttaacctttttttcctttatttatattatttcaggtgaattctgctgctgagatcatctatgaccttgttgatccaaatgctaatctgatatttggtgctgtcatagacccatcactcaatggccaagtaagtcacagacaaatttatcttgatatagttttcttatcaaatatcttgaaaatatggttcagctggtgcataagtttatacttgcagctgttataaaccttcactcggtgccatatacaatttttttcaatataattttcttgtccaatatacctaacatcgtggtccaatactccagttatgtgccattactcattagtttcgacaaatttgcaactcaccatttggtttgtacctgaaattatgtatgcacataattttgtttctgcacgcaggtgagcataaccttgattgccactggcttcaaacgtcaagatgaaccagaaggtcgcaccacaaaggtaaatgcagttaaataactgctggcccgagttgcacgacaaaaatacttacctggtttcactttggcaactgaagggtggccaacaaacgcaaggagacaatggtcgacgcccatcctctgcagaaggcagcatgattgagattcctgagttccttcggaggagaggaccttctcgcttcccgcgagtctgactgcccaggctcccttcccttgcccagtatctatgcttatcagcattctcctagatcagtcgcctcatgtaggataccaggcatgtacagtactgtagttgtttggttgttcagttttgtttactcccttatgttctatattttgagatcttactgttaataatttgtagcaatgagcttgctaatgctatagaaatcgttttatcccagtaggtcaaaatgatcatatgcccctactcaagttgtgttcatctcacgaggcttttactcggttgagagcctggaggttcctctgttttatcgacattgtgtgtgcattgcctgacaagcatggcaaatcgtatcccttaattttggtttctatgccataatcactattgtcacttggtgcttaaacttaccaagcactatgattatgagtgttcacttcggttaaaatacaggttcaaaagttgtgcgtgcctatgattggcgaaattgaatcagggataacagtaacgattcaacgacaacggatataaaggatgtttttcatgtcgttaacctgtgtaaaaccattgagaccatttgaacaatgcaaagagagaatggcctcctgggtgaaaattgtacaataaagcgctaaaaacgaaccgatcatctttagaacgacagtttttagagctgtttgctttggagtggcacatatctttttttttacttgttttaattgatcattttttatatttttacacgataacctccctcagagcaaccttgccccacagacactagaatatacaaaatattactttcagaatgtacacaatattgctttcgcatctttattgtatttggcaaagatgtgaacccagaactaaagcacatatatgtttgttgtattagatattcggtgcagtaagaaatttctcgacaacgaaacaaaatgaaattcctcgactgaattgcaataaatacaaagcaattccaagtgaatccaatacacacagatatgcgtagaatattatagctagaatataaatgaggaagcccattttacttgaactcaccagcttatcagtaaactgaacggaaaataaatgagccagcttcatgtattcaggctattataagattacaatacttaacaaactaaggcatgtatggaaaaacaaaactgaagtgaatccaggtaatacaagaatgtttgcactcaactatcaactgcttgatagtgcagtcaaacattcaatcctcttaaacaggatttctgcctaccatggtagttgattacttgattgtacattctgttgctcactgttccctgggtgttcatggagcgacagactgtcagcgaaatcatcttgaagcccatttgcaacacaagctccaatttcaacctgtgattattcatggagttgatagactgccaccaaaatcatcttgatgaccaattcgaatgcaagcgccaacttcgaccctgtgcttggtacctctatccctttgcgcgtgatcggtatcatccgcatcctcatcatcactgtcctcatctctagaagcaacaccagcttccatatctttcttctcaccttcctcatcatcatcatcatcatcgctgtcctcatctccagaagcaacaccagcttccatgtcttcctcctcatcatcatcatactcttcgtcttcttcatcgtcattctcgccctccgcaccaaactcctcccctatcatctgctcgccgcgaactgtcttccgacccttgcccttgcgcttcccggcctcctcctgccccatatgcatcaaatgcaggtactgataccttatccccatcatcgggtgcttgtcgaccagcatatgccgccggaatgactcccggagcaccaccgtctgcgtcctcagcttgtgagataagtagaagatccccgggtgcctcgccaacaccttcctgaaccccggcggcagccgcagggcctcgccgagcttcaccagcacctccttctccatcttcttccccacggtgaggctcagcacctcgtgcagcaccgccgcggtcctcttctccgtgatgtcgctcctcggtgtcaggtgtgagccgtcctcgtacggcgagatgtatggcagcctctgccagtcgtcgagccacttgcgcaccttcttgtcgagctcgaaccctcgcgggaacgagagcgggaaggggactgtgtcgccgaccttgtacccgccggtgcgctgcgcgtaggtctgcattgc

SEQ ID NO: 60387 - DNA, 1090 bp, Oryza sativa
ctatcatttgtacgaagtgagcgtagctcaactagtttgcatggttttccttgtggtgcaactagcaccaagactcaagttctatatttaacacgggtgctcgtatttaaggttaactatatttcagtggtagacaacatactcgtcaacagcgagacgcctatgatgatttcgtcaatctcaagatataccggcatagtcttctcgagatgctcacagagataggatgtgcgtgtgtgatgacttcgtcaattttaaaatatgccggcacagttttgtggaggtgctcataggggcaaggtgtgcgtgtgtatttatagggacgagcgtacgcatattatgaatgtctgcgtttgtattgtgtttttaaaataacctatcattgttactataatcagaataaataaatatttgcactaatatataggacagagctaatggtttggaactggtatgattaaatcctggatgcatcaattaacgttatctgcaatgatagaacagaatgaattggaacatttctggtggtattaaagacattttacagtttttaagaggtaagacatctgatacctgaggtactgatgatagatatcatttttttaaaaaaaaagtacctccttctaaagaagtatacaatcacgtgctggtggatacttcctccattccaaaatatccaaaatataaagcataaccacttctaacccaaagactaagaaaataattaatatcatcttgtagtttggatcatcctaacagatacaatgcatgcatccaatagaattagagaacatgagaatggaggatttaaaaagtaataatttaatggataagaggtaatagttaatggcctacatgcatgcataccttatattatgaaacatgtaaaaaagtggttgtgtcttatattacagaatggagagagtaatttcttactatggatgaagttctcgtcatcgtgtgtgtgtgtgtaaaatgaagcatcgcccaccgtttcaccgataatcatatatgtatatatatggtcactgagagcacaaatgaacataacttaatttaatttgctactttccttgtgatatcttttttt

SEQ ID NO: 60388 - DNA, 21914 bp, Oryza sativa
ccttatatttagggacggtgggtgtcataggtagtgggccgaggggtcgaggccctagggataaggatagagttggttggataggattagactgggtcctccctccatctatataaggatggtttgtatcatcattctaattaagcaatgaatcaagattagtctctcccaacctaagtccccctctcatccctagcagccgtcgccgcccggctatcctctcggcggtgtttaccccctatgaatcctaacccataacagtgggagtattgttttaattttctaaaatcaccacttttattcataatgcagccagagggagtagcaattgaatcaaggaaggtgcttcttgagcgggcgtctcaaggaacaacgatcttcgtgatgaacaagtgatgtcctctctgctcaatttcaacacccattagtaagctaataatcaataatgagtatgctagctgacacaataccgtaaattttgattgacaggccttcctggatgatagagactgatccaaaggaagttggcctgggaatatatgtgtaggggaatagtatgtttccctcactatatgtctatattgaagtttacagctcctaattataattttgacggtgaaatcttagcacttactacaaagttcttgggtatgagtaagagcaagagcgacaaataggacagggcaatgaacaagtaaattcttatccattttcaacaaggcacctctgtctctttgttaatcgcactgttctgaatgtggctgtaaataatagaacgaatttgtaatgctctaagagtatggggtggatgaatgaaatgaattggagcacaatacaaccaaacgagggttacagttttgatgaagtatcctagtgcctgttattgtcttagcagaaatgtgtggtgagtttatgaggtctctaaagaattcgttacattccaagagcattaatgcatccaccgaaatgaattatccgtagcaattttggtcatcgtgtttagcatcgacttgtgcagcctgtgaattgaagtagaagggcatatatatatatatatatatatttctctgttctgctcttgcctctgtctacaaaattccacgtattctttaaaagcaacggaagctaaataacatttgtgggtgggtgtggggggtaaaacttatctcgttctatacagattgctgagactaagatatcatatatacctatgtaagctacgaagagctgatgatagttcgttagcattttatcattacctactttacatttcaactctgacataattcgcatgttcaacaatggcgatcctcgtactgcagctcttgttcgactatgatatgcattctacatcaccattgatgttgcaggaaacagcctgtccagtagggtataaacccctccacccagtagaaatgcaccactaccaagcaaatggcaaatgttagcgcaaggcgttaatccaaaaaaaataaagtataaaaggcagattttttaaagaaggaatggcttatatttttttagagatccttcctttttttaaaaaagaaagaacacgaatgtttctgaggaattggaactgtgcaaagcacatgacagaattgtggcaagaagtttagaacaatatcttacaaaagaatattaaatggatgataaggtaaatttgatgtgctatattctctgaaagaagcatgcccaacaaatgtgatttcaagctctttgaaccaagacagtgaaattgtagcgaatgctatcaattaacaaatatggattttcagtgtttcctttgtaaaaggtagtaaaaaaattattactattcatacagataattaattgcaacgtgcaggtcttttgcaatcaaattacaaaccaggaacctctcaagatccagaaagagctaaggcacatacctgattgggtttatccatgcagaatacctcctgaaggaaagcaaactctacagaaagcaaataatttatcaggcactaaacttaaaatgaacaggtgttgttgttctaggatttgtgctgttaaactgttagtcaagtctaagtgagatttaaagttccatatttgatggaactatcttatctatacttaaccagatgtgtatatcagaaggcatttatacctgcagtgctccagcaaaagaagctgcaatgagaagaggtgcaacatagccagttgtataagtcaataacaaacttcccccaacaatcggatcctgacagaaaatgtattgtaatcagcatgtcagaaaattaataaattaggcgaacataaacttcttgccaacaattatgacagattgctaagtcaagtgtaacatatattagaaacaaagaaatcaaaattactgcatatcgtacggtatgtgatttactaactttagtaattaaagacactatggtaaaatttatgacagttttactgttttgaaatttaagaaaaagtaataaaatattaatgtaacttatgaatgttcctgttatgcatactcttgaagtggcaacatatcccagaagggtagcaagaacaggtgtactgcaaggtgatgctgctaatgcaaacgtaagtccggcaaggtatgcttgtacacctatagggaaacagcaagatatcatttaccgtaactgaaataaacataatgaggcatatggtactttgatacaaaatagaaaattatgtcaaagcattactggaagggaggttagctgcagcagctcgagggtcataatcgctgaaaaatgagggaagttgtagctcaattacctgtaaatacaagataaccagcatagagaacagtttaaggcagtgagctaatatctactataacaggagtgatacacatttcattgaaataaattaccatcgcggcaaaggatttacaattatttataaaaggaaaaccatcaaatcaactgatacttgatttgaattgtggcaacaagttagcttgaaaaattaattggcatgctccgctttatgagttttcacattggatcatgaatttacctcaagaaggttcaatcccatgataactgctaaccctgaagcagccactggaagtccttgtcctacctgtccataggcctttccagcaaaagaagcagcaacaccaaggatggctaaggttgttgccagtcctaatgaaaaagcaactgaatttccaacaacctaatagatagaatggaaacatatcaatttacatcaagaataacatggatgaagtttttttcttctacatggtgaatggatgttatggcatacgaggttttgggtatacatgctctatttaatttctataagttattttataaataatagaatatacctcagatcgatctttgcccgagccaaaagcacctgaaagattttaaagaatatgtcatcagatcagtgccatcaattgtaactgatcctgggcaacaaaaaaaaagcatctcaaaaggcaatcgctatacttgcctatatatcctagagtcaatggtagaacactgagtgtacaaggagacaaactagttacaagtccagcaccgaaaattacagccaagctggagaatagagaaacatgtcagaaaaaaatatggacatgaaacataaaatataatctgagaaagtaagtaaacagattctgtccataggcaattgaccgcaggggaaaaaaatgcttacctagtgaaactaagagcagagagctgatcctgaacagcctcgttggcttgctgacccgctgaataaagcaaatttccaaaccaatctccaatgctaaggtcagccaaagcaagtccagatgaccctaactgatcataataaaattttatgcacgcattagctatatgccatcacaatgtaataaaaaggaatatatgatattctctttcctatgacagataactacactgttgactacaattcattattgtttctacgcagtagtacaatttgacatgttaaaatcacaacttgatacaggcatcacgaactcttttgtgatcagcaagaaggggacagaaaattcgaaggcacatagtgctccctcaccagagaatcaccaatttctgtagcatttgcagcgccagcagcaaccaaccagactccccactgcgaccaagaaacaccactcactaacgtcagagacatttcatcaaacagattgccagcgatagaacacatgaagggagcagtcaacagctaacactctacccgccacggtcgccagcagcatggggcgctggcggacgagagagcacctcgccgcggcctccaatctcgctccacgaatcgctgccttggaaaccgagctcccgcgctcgcggggcacacccacgagcacacccgtaccaggggacgaggaggtggagggcttggaagcagcggcctgcgccgggcggcaggggcggcaggtggaggtggtgctactaacggggcgcgcggccatggcgacgcagagcacggaggagtggatggagcgaaggataccggagaagagggagaagagacgcttctgcttgggtcaaagggagaagaaggccacacgcccgcggggagacgtgtagccttcgatgggccggggcccacgagtcagtgtgaagctatagcagcttcctctttgggcttcatttaaagctatagctttctccggcaagccgtcgcctcagctcatctccctgtttgcgaaattgcggcggcggcgcccaatctcgcggtgcaggggcggcgcctagttcttccatggcgagatagcattccggtttgccggaggagattgccgtcgagagcgagagagagcatcggcgaatcattttgaagttgggtgttcctcctcttcctcccggcgatggggaactggaatcaccatcggcggccatggcacaggaggagccgccacgaacgccctccgcctccgccttcacctcctccgcatcccggtatggatgactgatttgcttgttctgttccctttgtttctatggattggattgcgtttttgtatgattcgatttaagttcaggtggtgatttgttaggcaagaatagggttagaaatttttaaatctaggtatctagtcagtaggtctggtaatgtcggttaatgctttttctgtgaattggaattttaggaatcgacatgaatatcattctacttcttgccatcctaagaatgcacaaccgtcatagatagtggactgtctgcttagaaccagagttgctactgcaactttctttaccaataatcttattgtttgtctaattgtcttaatatttcaaaatgtggtgcttaaatgtcagaaagttctagttttattcaactaccaagtatcaatttgtcgtttgagctgtaatggtattgcagtttgccatctactaatgtgcaaactttgtatatacgagttggtcatttgatccaaccacacagtaagcacagtgtgtcatctgttccgacaagaatatgtaacggaaatagtggtgatgcatttctagattaggatattctccgcttcccgccaaagtaatatacaacggcctaatggaaatagtaataatttaggatggtcttttcttcccaccaaaatttaaaacaccgcctctccttatccactagaagaaatttttttttgaacgaatcactagaagaaatataaatgttgaaacataaccatggtgcaccacttctgtacttgaatcttgctagacaccaacctgccacctagcacggttgccattcaggccaactattgctaactaggaactagacaccaccatgttaccccgtcactcgcctagcatcattttgaacactactaaattgccctagctcatttcgttattacatggggggttccaactcacctggaccttaatgtggcatgactaggagcctagcctaggaattttttttagagcaagggccattcccagttcccacatttccattaacagaaatgtagctacagatttcaggaaaacataaaaggaaaccaccaactatcctgatagagttttcattggtcaatttgggttgggtgtcaacacacaacctcctaattgccagcagccagcacaaagtaaagacacagggagccactctagggactcagccaaacagaacccagcagcccaacctgatcaaaagcccaccctactgagagacttccagttttttgtcaacagtgagaagaaccgggtcagtgcttcaggtgaaatcaaactccagagtgaagccttctagctggtagccgcttcatccccaccctccacccgaaccttgtgttgaagatgtcatttacaaattgctttaggagctggaccccccacagcagccctcttcgctcttcctcctgcatctgcaaaccagctcaacatgtaatccaatgacaagcataataaatcaaatctgtgggatctccaggaagttgtttcttaaaacaagcagaattttttgttttccaaatgacccataaaatagcagccacaccaacccaaatgggatgtttcatgtttttctgaaagctctccatccaactaccaaaaagatgatttatatctctaaaaggtttcaagttgctacaaacaacattccagatcacttttgcaattcggcattcgataaaaaggtgttgcattgattctgctgtatcacagaattgacaaaatttatcccccttctgccaacctcttataattaaattatcttttgttagtatactgtttctcaaaagaagccgcaggaacactttgatttttcaaggggatcttgaatttccatatttcctatgtgaaaaataaatgcgtattttcatatctttgtaaaaagatttaacagtgaattactctatctgcttttgacccatcaagagtaagctgatctgagtaagcttaccctaggagatggaaggcagagttatgttattatgatcatacaagttatttctctaaaattaggataattctagaagcttcaaaagagcgttgctttgcattagccatatcacagtcatctggttgaggttgtacttaatggagaaaggaaacgaagcgctgtacttactgcacatttctttagaaaaatgaggagccacaaaatgttaagttggctattgataacttcttatgtgggcgtaacatttttttcctcaagcggcagtatgcttaatctatgatatacttgaagaaacattgttagtacttgctattaaaataaactattaggtaactgacatagccatgaaaggtgcagttgtgtggcgacaaaggagcatccattagaaggaatgctagtattttaggattgaacccttttatctagtactttgaataattcttctgtttagtctgttatgaaagtaactgttgggtgtcttttttttccatacttttagaagagatgctgctatttcaggcgatttctaaatctgtacagtggtgttcagatggtaatttgttagggaagactcgggttggaaaattttcgatctagatatctaggtctagtactttcttgttggctgacgattttcctgtggattggaggtctcggaatgggcatgaatatcattttgcttcctgccaccctaacaatgacacaactgttgtagatggtggactgtcctgtactgtgtgatgcggtcaatttaagcttagaaccagagttgctactgcgacttcctttacaattaggcttattatttttggtctaatttgtcttactatttgaaaaggtacccaaatgtcagaaaatgctagttttatttgactaccaagtatcagttcatagtttgaactgtaatggtattgcaataagcaaactaatccctctgtttttttatttgactttggttaattcaacgtcaaataaaaaaaatagagggagcacttgtgtgcacatatcttcagaaaaaatgaggggacacaaaatgttaaattggctattgataacttcttacgtggccattacattttttcctcaagcagccggatcctaaatccatgatatgcgtaaggagacgttattaattgctattaaaaataaactattagataactgacatagtcatgagaggcgcagttgtgtggcgacaaaggagcatcccttagaaggaatgctagtgttttagtactgaacccatttatccagtagcctgaatggttcttctgtttagcctgttaggaagtaaccgttgggtgctttggtgtctttgtttcccatacttttagaagggatgctaatattttggatttgacccgtccaaaatctgcaggcgatttctaatctgtacagtagtcttaagcaatctaaccagaatttttttgtatatgttatttgtttgtataaacattttagaattcatcatctccttgcatttttatgctgctacaatgaatctgatattgcttttgtatttacaggacacaattgccacccagtcccattatgggaaagggaattttgcatttatgttggcggcatttcttggcacaggttctgtgacaacaagagatatgtctgcatgtataagaacattgagcaatgggatgactcagaagcctttgataattttaagaatgcaaaggctagattctgggctaattaccatggccaaccttcagacatatctttgccagaccctgatatgtatattgacaagattgaccacaatagcaagatcgaccctgagttgatagctgacctgaagatggtacgcttaccattcgagagggatgatgagttactcccagctgatggattgggcagcactgatacagataacaagtgccagcagaagcagaaccaatctggaaactgggacatctatgtagaaaagcccactgaagttaacaagtgggagcaagattcaagatccaacatggactggggaacaaagcatgaatcttggaatgaatggagtaaaaattgctctggttggggtagtgccttggcggattctagtgccttggcggattctagttggggcaattggaataatagtaacaatcatcattcatcaaataacagggatagcttcaatggggtcaacaggaatagataccaggacccaaacagcatatctggaaggaaaaggaatagtggtgggcacattcagcaaagaaacagtagacagagaaaccagactgagggctaccaaggaagtactcctagatggtgagaccatataagacaagagaatggtctccatttgataatagtgtaaagggggtaaatgaccacacaatagaatgtggcctcttagtagtgcgaaagattggatcagaatgaacttttgtctggagactacagggatagcttcaatggggtcaacaggaatagataccaggacccaaacagcatatctggaaggaaaaggaatagtggtgggcacattcagcaaagaaacagtagacagagaaaccagactgagggctaccaaggaagtactcctagatggtgagaccatataagacaagagaatggtctccatttgataatagtgtaaagggggtaaatgaccacacaatagaatgtggcctcttagtagtgcgaaagattggatcagaatgaacttttgtctggagactagagcagttagcaatagttggcagttagaacaaatgatctatgtaaagagatgctcgagttttttccttctctagaaagaaagtttcttcatgtcgcttgagacatgatgtttttgggtaatggaagcagaatgctgccatttcgttgtaaaggtgatcgccataagttagttgttttttttctctttctttctttcaagctccatgaatatgtagtttgttcaagtgaaacatagaattcatgtactggtagcatgttagtactaacatatactgatatattgataattcgtgtctagtgctaataaagatactcataagtcataaccagatgaaagagtctggtacagtatgtgttactaacataaattttgcaactaccaaacataaatttgtgtgcaagtgtactcaaccataagggcatttccaacccaagacactagacataatttccataaactccacatcatcaagaaactagtactagacactactctttcaatgcaaacactactattccatacttaaatttaatgctacttatctcacatgatatcttggacgttgtgtagaaaccatatctcatgcaatatatggtttccttctcttttctcatttattcacttgccatttcattttttatcctaggtggcagcttatttaatgctatggacatcatcctagtcattgggttgggaatgccctaagtcttctttcatctgattaatttgttaaccataagcgtactcgcaactgtcaagggttaatactagattcatcacaaagtgtttttcacactttccttaaataaaagtgtttttcacacacatacacacaaacttccacacataaattcgcttgcaaaaaaataggatctttttttaatgttcgatgctgaaacaggggctttaacaaaaataatacttaaaaaccattttatattatacaagtcgctttgacttttcacttagtcaaacttctaaaagtttgatcatgtttataaaaaaaatctagcaacatttctaacacaaaacaaataaaatatatttaatatcatatttaaagaaactaatttggtattatagatattgctaagtttttatataaatttagttttatactaggaaaagtatcaaaaagatttataatattaaatggagttaggagtgttgtgttaccttagggtgaaaacaaaccgtaaggggtgttatgcaaaaactaggatcaccttcatgacaaaaatagcccgaaacaagggcctttttgtaaacattactgccagtccgtcagcgcgcggaacacagcgatctctgccgttggatcgatcatcaacgctccatcggagcaacgccgccccgtcaacaaatgcggcgcctcccccctcccccctcccgacgtttcccgtttcccttccttcgcgcggcgctgctccggtagggtttttagccggcgatctctcccctctcgcgcgctcggcgactgagaatggtcgaggtggaggaagtcagcaacaagatgcaggcgcagatgcgcctccaccccgcggcggcggcggaggaggaggacgccgacctcccgctccctgccctcttcgacaaggcgtcccacctccactccctcgcctccagctcctccctcgatcaggttttccctcgattcacccccccttctcctcatccccatcaaccctctcatggcggtttcatgcgagcgcttactgtggctgcttggtttggtttgggatatttgcaggaagggatccgcaagggggtcgacctgctgcggcggtgcgacgagatggtcagtaagctcggcctcttctcctccaacgagaccaaggatgacgtctccactgccaacctcaaatacctactcgtatgcttgtttcccccactacatctgcgtttagttccgtttctcttatcatatcatgtttgtgcatctgcgacatgtggttatatctgtgatttcgattgattttcttcaggtgccgtactaccttggggaaatgactgaaagggtagcgcaggaagatcggatcccagtccttaaggcgtcgcaggatcatttgaaggttatatcagtttgtcctgtcacatttagttgatttggtgcatatttgtcatgtctttcttatgcccttttcaattgggagcactctgtcatcacaacactcatgttttaatcactacggttacgcaggaattcatttctatctgtgaagcactggagcttatatcagaggatgagcttgaattgtctaggcagaagcaacctgataccatggcaaatcgaagagcacagaaggtgagccttggcaaaatattttttctcgaatatgttaaagccttaaaggggtcatcaatcattctgcaatttacaaacacaataagctgggatccaaatctcttattgagactgcaaaatctgggactcataatctgcttgaccttttccaaagtcggttaatttccactctaattttcttgtttgaccaaacctaggttgcacggttcaagcgccaaaaggctgcagaaacaaagctcctagaaatcaaggagaggaaagaaaggcgtaggcggtcattgagagcagctgctttatcagctcctattgaagctggggaggaagatgcttttgaggatgatggagaggaagaaagagaggttagcagttagcaccagacatttagaacccatttacgtagcaaatctgatcttgtttaccaaatggaaacatcatgatatattcttaaattaccacatagcatatttgaaaatactccaaactaaaattagctacaatgtactagaagtggaagaaaaatatttacttttccagaaaagaaaaggaaaggaaaggctttgttctgttcaatagaagatggaatttgacaaatttgatgattcaagataggttttaaaaatctcatagggaactgatcgcatttcctgaattagcccatttttgtggccatgaaacacacaacagatttgttctgtagtgccagattgtcaccaccaatcttttttcctgtaacaatatgatgcttaatgtctttcctatgctttttatatacaatctcttacttttgtgggcaatcaaccttttgggatctgtcgatgtgtgcttccaaagtttgggctccatgcctgtcataactttactttgatgtacaaatgacaaacggttatgctgtggttttgattcttttttttggttctatgttgcaggcatggttagctactatctcattggctctatgcaaggtttgtgttttgtgggcaagaatgattctcttatactgcttggaatgtttatttgcattcttttaagctactgtgctcgctttgttatcctgatcatcagacgtactcatttctacttcattttataggcttttgaccttcttgacatgttaaagaaggaagaagaaatgcttctggcagtaaaagaaaggcaagcgaaggtaaaacaaatgaataaactttgccaatgtcttgtcaatagtatctttggttgatcctttccagtatcatattgaccttttaacctttcttctgtaaccgttctgtaaccttatacaattattgaacttcgctttggataagccttgagcttatgttgtagtagggcttaccttcaccaagtagatagctggatagttgtatacagtaattccgtttgaaaaaaaatatacaccggattctgagtttggacatacaattaaattaattgtcataatatgataataacttgccattgcaagtatttcatcacacttctctctctctgtgtgtgtgtgtgtgtgtgtgtgcagagtgctgagtgttttgttgttactacatgcaagtaatattagatatttgattttgttttcatgatccttttgtagcactcgatggtagatattctaccgtaagaaaaaaaagaagattttttttatctttgctcccattgtgttgcatatctgtttcaataaactctgcacttacatggaggtttcctttagtaatgaaataattgcctgcttatgatgttttaggatggtaatgcatttgctcgtgaaatgcttgatgaacgtacaaaaaaggctgaagcatggcaccataatgctgccaaccgtgcaccatattccaagccagctgatccaatcacttgtgcaacatttgctcaagatgtcattgaaggtagagcaagtgtttcacaagcacatgagcacaaacaccagccgctgatatttggccctgcaagtcttgttggtggaggactaaccagtgaaagagagagaatggcagcacaagtttttcagccaagttacaggtatgctttaaaatactgctacgtacctggctgaaaactgcactgcttcttttaatatttgtggagggggcattatttgtggcaacttttaatgcatcatattagtcatactttgatatatttgtaggaactttgacctcctattccattgagcattactcgatgagcaaattatttcttggtaaatttgtaaagtggttctttacattgtatttgcttcaccacattagtatgtgactgtgtttattcaatcgtaggtgtttccttgttctattgttgtatgttctgccataagtctgtgacaaatttgtggtttacattgttgatatcattctttttttttcatgctggaaaggcaccatgttaaatttgctactcagtgcaatactagattcactgacaataaactgttgtcttgtactctgttgtgactacgaacgcttggtgcaatcgtatagatgctgagatagtgatttgtaggtgcgaccttatgtttagtcataatccatgaaaaattccaagaaatggtactattctgcaattgctcataaaaaacattagatttcccctgcagcaactaagtgttgagctgtagatcatctctattaaagtgatattgcattgttcagtaaaagttagtgaaaatatgcatatgagactatcctttgatccaattattctgtttccatttttcctgtatttggactattaggttgccaacgatgagcatagaagaagctggcttacgtgagatgaaaatgatggagaaatggcaagaaagaactgctaagatgattcaagaatcaaactccgcatggcacaaggatggcagtcggtcagcccaagaggatgaggacgctgaagaggagaaagcaagagcatgggatgactggaaggacgataaccctcgtggtgcaggcaacaagaagctcactccctgtggctagattatatgctatggcaattctattgaacttagatctgaaactgtagctcttgtaaaaatatgtggttttttactttccttactgcggcatttgttgactgttgagtaataatgtgttccatatgcctattgtaatggtgcatggttttcttctgccaatatattgggaagtaatgccaaaaaaaagctggtttgagaagcaagcttacctgctcggtacaaagatcttatctgctcggtacaagtatgttacactcgtcagccatgcccaaagggtagatcaccctattgggcatgtttggcttagagcaagtttaatagtatagtcaactactagcttcaaaatatctccagccaattcggacaatagttacttaaaaatatatactacatcattaatatctggtcttatatctcatacatacacatcgtcttggagtttatgctacagttgactacacagtttatgctacagttggctacaaatatgtagctcgctttttctctcatatcttatcttctctatatgtgcttgtagctgacttaatagtctgttattgtacttgttcttagctccatggaagatatttttctcgagattaaggtgtcccattgccccatatttggtaatattcatcgatgattaaaacgtttcgaaatgcttgcggaacttaaagtagtcttacactttggtgggtttgcagggggcacgaagaagacaattatgtgacacaaaagccaaacaaatgacaaacccaacttactgctaatcgacctgttattactcgaagcagcttgcaataatttgattcatagaattacagtacacatatccttcacatatttcatgaatactacacatgtccagctgttcgcttcaaacatgaatacatgatagttacttctattctcctttttgtcgtaaaagctgtggatgaaacaacaagccagttccttcaaacttgatctcgatgatctcatcaattttcattgccatctccggtgtcagatagttcctccaatctccgactactccacgccggaagaatatgttgttcggtacgtctttctcgataaagtcagttgtccccgacagattcacctctaacctcgacaagctctccatggcacagatctccacaatcttcctatccactccagcctcttgctcctcaaccgtgaacgggtgcccaacgaactcggccaaacgtctcaataggccaagcgtgtcagcggcaagctcctcgtaggtcaagaagaacacctggcttggcatctcgacgtgccaccgccagtagccgaggacgtgctcccaaaacggcccgaaatgcgagatgccatcgcagaattgccggacagccacatcaatgttccatgacatgaatctattccagaagtgccagagagagacaaaacaatccttgggatcccggcacaggtacaccaccttgctgccggaggcggcaatggagtccggcagcgattgggccgggatgtgcgtcgtcaagagccttggttccgggagcgagctcagatcggggatgcggtcgttgacgaacaactgggactccagaaaagggacgctagctcgtgggcgtcgtggtggagagcagagtacataagcgccttgagccatgtggtgccggacttggggaaggtggcgatgaagacgtccgtggtgcgcgccatcagatgcctcttgatggccatggcgctcacaaccccccgcctggacatgtaccatccgtcagggtggcgacagttgttggaattaatgaatgggccttagcccactcgaagattaattctttggaaaatcacaaaagcccacctcatggaatggcatgcatgtggagtttagtaccaccttgcttattctaggagagggggacctccttaaaagggaggatgccctcctagccacttgaagcatgtgtggtggagagaagaggggaaacacacgcgcgcgctcggctcgcctggcagggcagggcaggcggcgcgcgtgcacgacgtacgcgtcgaatggtccgaaaaaattggctcctcacccttgcgcagatgcagcctccttttgcagttttgttttgctgcaaattcggattcgttttgttttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgtgactgctccctgttcgttcacgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttattctgcgtagtttacatgtgtagatctaatgatgcgttcatgctagttttcatctgtaatgtcatgatttatttatggaataaattaaatcattatatgcccataatctcaacaacagtatggttggccgatgccgctgactgccgccgggaaggtctccacgacttgccggagttggtcatagatttccatgtgagacgttccgtcggccgcttcggcagttgaggaggaagccatgaagtgtgtagtcctacgaaaacaataatgagtcttagtcccgtgaacctgacaatatatgattgagatgtaacttgcaaacatgcatctaagagaagagacaaatcccagcagagttctcaagctagctggcactgataatccaccattaattgattgttagagtctgtacatccgtacttatgtgacctatttttcattccttaattccctcctctcaaattatggtgttaggttgagaaatttcatgaacatgggggttaaactttaccttgcaaaaaaatgctgttttttctgagggacaaatttatcatggtgtctagtagtaagatcagctttaattaactatgcgcaccgaaacaagggtttggtagtgatgtaattgtgaattacagtctttcttttcagagatgaaatcatgcaaactactttctagactagaaggtaatggacaatcatctcaataaagtatatatacgacatactcctagttgctaagtgtaagatcagttcagctaactatagatgtgactcgaaaaaataatttggaggaaaacaaatggaagagcagattagcaggtccgtagcatatcatccttatagccttggacagttggactagaatcgcagtttctctttgctcgtgcctccctatgccaattgaggtagctcgttttactgctctaaaataaattgttttggacattgaatggtccttcggttcaagtaataatcaatggtttaatgttttttgcttttttccctcagtatttttatttttatttctaatttattagagtgtcacttggtggtatagaaatgtttcggaggatgtttaataatctttagcatatcaagaaacagtgtggatcatttgaacgttattagtgaattttgatgaatgatctgaaaactgtatgacgatagttacgtacaccaaactaatccacaaagccaaacaacctaacaacccaactcacggctaaccggcaacattttattatattacttgcaatgatttgatttacaaatttccagtacatatatgtatttcttcactcgtgaatacgcaagagattgtatctctattaaacaccgaaaacggcacacaaactattttttgaaagaaaaaacatatactcctagtttgttttaatttattctctttttacttgtaaaaactgcggatgtaacaacaagccagaccctttaaacttgctctttgtaatctcatcaatcctccttgccatctctggcgtcaggtggtttctccaatctccgaccacgccacgccggaagaacgtgttgtttgggacagtgctatcgactatggtgatcgttcccgaccgattcacctctaatccggacatgttctccaatgcgcaggcctccacgatattcctatccaccccgtgcttctgctcctccgtcgtgaatggacatccgacaaactcggcaaggcgtctcaactggccgagtgtgtcggcggcgagctcctcgtaggtcaagaagagtacctggttcggcttctcgacgtgccacctccagtagccgaggatatgctcccagaacggcccaaactgcgagacgccatcgcagaattgccggtgcgcctcgtcgatgtcccacggcatgaacctgttccaaaagtgccagagcgagacgaagcagtccttggggtcccgacaaaggtacaccaccttacaaccggatgtagcgacggagtttggcagtgactgggacgggatgtgcgtcataaacaaccgcggcgaagataaggagctcaggtcagggatccggtcattgacgaacacctgggactcgaggaaagggacgagctggtgcgggctgtgcgccaccagctcgtcagttccgcggtggagagtcgagtacagaagcaccttgagccaagtggtgccggacttggggaaggtggtgaggaagatgtcggtggcgcgcgccgtcaggtgctccttgatcaccatggagctcacaaccccattcgtgaacgtgtaccacccgtccgggtggcggctgcacgggaggccgatgaggctgggagccgacggaaaggtctctgcgactcgtcggagttggtcgtatatctccttatgagctgttgcttcgtcggccgactcgggtgcagaagagagccggaaggagggcgccatgaagaatgaatccagcagaacaccagttaatgagcaatgtattttttctttgatccaatcatactctctgggagtatgaagtgcaaatatatagtactatctcggagaggagagtagtccggaagtaataataaagtattcaagttgacattaattagtattaacttgttattatgtctaggtgttagcatcttttttagatcatcaaagatttcgttgaacaatagcatctctagttatgtagattaattttatctctttttctttctttaatgcacgtgatgctcaacttgagcttgaaaaaagttgttaatgcttcggagggttaaatttaccgtgacatatggatttagcttttaggggagggcattattttgtccattgtatagttttttctttacaaagttcggggggggggggggggggagtttccccacctgaattttatgaaaggaatgaagacttgcagttacatcttagattacagagtttcgaaaagcagacgatagtgtttccttccacgaggaaacaatgcccctatcatccgaattgaaacgctttgcccaaagagttgcatcatctatacatttagttactagtctacgcaaggatgtttgcagccccttgaaaacaacatcatgcctgtggttccacaggccccaaaagcagagaaagaagaagactctgaagtgcttgatgggaatgccatctaggcggcctaaacttgcgagattggctgagcttgtcagtcctgggacaatctaaatggtcgaccagaacgtctgagaaaaagagcaatcaacacagaaatgaaaagcattttcttctaaaacaccacaaagatcgcagttcacggacgaaacaattttctttttgtacaggttctgctttgtggggaggcgttctttagataataaccaaatgaagaactgaatcttcggaggagatttacttttccaaattattttccaattttggtcgtcttggcggtcttcatgcaagtactcgtagatttgcttggacttcaagatggtggcgtgtggagcattgagggctcccctttcgttcagttgatcaacttagtacgaaatcactcaaagcgagaaggagatgttgtagctgagaaggagatcttgtccattgtatagtgatagcagatggtggtattatcttgctcattgtattatgattgatgacaatcgtgagaacgatgtatatcaaaatacattcaatgttatatttaatgaaactaatttagtattattgctaattatttttatagatagatttgataaaatgtcaaaacgattgataagatgaaacgaatggagtagttgctaagttagtgaaacctatataatcttggacatagtaaactatgacaaaatatgactggcaacctaacgcgtcgtattttactatgacattgatgagtggattagctcttagcaagatgcattatcttgcccattttatagtatatatacactacactgatcagaagatatcattaggatcttacgatgaaaattattgatcgaacatgataagacaagcgttattaattatcaacctaaagcaccaaagtgtactgatcatttatagtttagcagtaagcttgtagacttctagtttggttagttacacccaccgatatgacaacgatataataactaggaattgcatagtgttgtatttcagatatacatcatgcaaaactagtactccataagatatgcgaacgtggttgcgaagcgtaacagtaggtcagatcgatccattattaattacacagaaagaaatatctagtatactttataaaccaaacttgaagaatagccgagtgtatctgcacgcttctaaacatgacatccatcagcaaaattgcaaaggacggctgcaaattaaaggtgagatcaccaggctacattcattaattacctatcagtccagcacgacattttagagcatcatatcgatcatatcttgctataaaattataacccactaatcttaaagatcaatatataaacatgtcacatcattatccact

SEQ ID NO: 60389 - DNA, 5889 bp, Oryza sativa
ctacgtgaaatctattaactacagggacatgaggaaaacgaacttccgagagcggagtaaactaaggctgtgttcgaatggacatcttgcctaaaactttcaatgacacgtaaaaggagaccagtcattagcacattattaattgagtattaatcatttcaaatttaaaaaataagtttgtttgatttttaagaacacttttatataaaaatcatactgtttagtttgggaaacgtgattacgataaacgaaggggtagtttagcctattgtagaattttctgcgtgaaagattgtaattggacacttttacacatcagccaaagatccaaatgcccgataaaatggacaaaacatgacaatgcatgcgaattacaaagaaacacaaaaacgatgacttagcttatacagagaaagatcgttgctattaagcctaagtaagacaagcacacatccagacgctcgcgtatatattttgattgaattctattatcgacaaaaaagaaaacttgcatattcgagatatgaaccaatcggaacgatgatagaggctgataatggagcccacatgttaaggtacacgtgccaaattaagttggtcccagataagaatatttcaagcaactaaaatcttgttattcatttccttcaaacaggtagtactaccgtgtaagtagaccaacatgtcccaacattttctagaactaagatatgcatatggtctaacttttgttcataactaacttgcactcgaaggtttcctgctagatcttttagatgtttgtgtatttatttcttgggaaaattatatatttacattttttatgctccaaattcaggtttaccctcagaaagaattaaggagctctaagccagtgttccattattgcaggaattttgtgggattagtttaattattttaggaatcaagaagaattccctcagcaaaaatattatttagtatgagcgatgcttatccatgtttttctttccaaacattggggcggaatcaaaatgtcacggattatgcaatcagctaataagtaaatgtttagttttacaagatcgtcttaaggtgaaaaaggacacagtgaacaccatgaacatgatcttgatatttccttaattaattaattaatacagcacagctagcccttatcttacggtttacactatcccgagttccaaaggctaattggaacattattgcaatcagcaagatctagctagccagctctctgcagaactgtagtgtactctactgtagatgctagatatcctatgaaacaagttccaaagacacaagtcaaacataacagtatatgactgtgtttagagttaggggtgtaaagttttgatgtgtcacttcggatatacggacacatatttaaaatattaaacgtagactaataacaaaataaattacagaatccgtctgtaaaccgcgagacgaatttattaagcctaattaatccgtcattagtaaatatttactataacaccacattatcagatcatggagcaattaggcttaaaattaaagatctgttttgcaatttacacacaatctgtgtaattagttattttttcgtttatatttaatactccatacatgtatccaaatatttgaaagtcaccgggtaaaaatttttgtcagggtatctaaacagggcctatggattgcatagattgtacccattttgcagcatatataattgactttgaatacatccaaacatttcgcatagattgtaccaccattttgcagtatatataattgactttgaattttttttttttggtttttcgctaaagcagggagcagcagctagatagctagcacaagtcccatccatttctttttgcatcgctgtttctttctttaggtaaagctaaagacgtaccaaagctgtggcgacagctcaaaggatcgtatctctggccgaatctttaattttctgctggtatatatatatgaatatatgcctagtagaatatgaggtgaaacttggttggtataagctaaggattttactaatcagtgttaaataaaggtccatatatatatatatacataatatgaggtagtacaataaacagtacttcaccgagtagtcaaccagtttaaagaaaaccctagttaactccctaaaccatatcgtccttccctccctccctgatccctcccacttggtccccctcatcccttcaattcccagctgctttcacgcacttgacgtgggacggcgacaccggtcgccgacgacaccgattcgtggctcatcccacctccataaactccccgagccaccctatttcttactcggactctaaagagccactacgcgtcgtgtgggcagtgcccggcggttaatttggcacctcatcagtctcaactcaagtcaccggttcattgctctcctccttggctctagtcctcctcccggccactcttcggtgacacagattaaaactctaggcttccctccctatgccatctgcgtcgctaccgtccaagggtcgcgagctggctcgatcaagcatgtcaacaaaccgagccaaacctcaattttaattagcttgttccccatatcaatcctagtcaaccgaatgccccttatttctaccagaaactggctagagagatgagggtgagataaggctattttgcataagcacccttatacttatcatgtttacaacgtcatccctagaaacagaattttgtcttccttgcattatattttgtaaaaaaaaacgagggccattccagataaaacaccacaggctgtcaggtagtggaagggtctgtttaaaattctatatatgcatgaggagtttttttttttcaaaataaccaggctgcgcgtggcatgtgtgtaagttgaaaccgggtacacacggttggccaaaccggacactatgcaaagcacatgcaaatgtaaacatgttattgaccgtatcaaccgtttctaggtagtctgctggcccaaacaaggagcctgcaacttatcttttcacgttgcacgtagtgcgagtagcaaaaaatagttgaaaagaacggagaaaaataaaatgggagccgctgttatcagctgatgattactgcaaaagttgatactccctccgtctcaagatataaatatttttaatatagtgtcaagttaaatatttgtaactttgactattaataaaaaaataaaaaggattaatcttataaatttaatgttactggatttatcattaaacaaactatcacaatatgcaactcttttattgaaaacatcatacttttatagatatcattgttaaaatagcatctcgaggaccgtatgtatcgaagttcaaaagtgtttacattttggaacggatattaattaaatgcatgcaatgcaacacgacataaatttgatttagatacgcgtaaatcttagcgtggttaaatacaactagctatagctagcatacacattgctattggcgtttaatttctaagtggatctaagagacacttgtcagtgctcttatgtatttatttatttatatatgttttctacagcatgatatgagctagggaatggtacacatgtgtcaatctcagatgcaagccactaaaattaatgaaaggtacgcataacttaactatagctagctagctagtccagttagtgtcaaggaagatttatttaattgttgaatgaaaagaagcaccaacactactacgcatcgggaatttattaattagtcaacattattcaaatcgcagttttatattcagcagtacgtatatacttcctttggttaaaaatatttaatgtttagcacaagatatgtatagtcaaaattttaaagtcatgacaatcaatattctcaaatacttatcagttactttaaagaaaatggtatttagatttgcctttaaaaatattgtcaggatatcataaatttattagatttcataaacttatatattctactatacattgattgctatatttgaaaaggttaaataaatcttgttctagacaataattatttatgaaaaggagagaataattaattaatttggaaaaatgctagctaaggtcaatgcggtagctagctgtaaagttatgtgaattatctcagttacgtagaccatttgatagtgaagctgcattctaattaggtatcatcttgagattctagaacaaacatagtcctttacatgctagtaattaattaaatttaaccaagatcattcaataattgcggaacagggaccacaatatgattggtcacaatcgatggtcttcaccagatcattcaacacacttaagatactctacgacattcttaagctagctaaatgcatgcattatgcatctacttgtcaagacttgcacgagccaatcacttgatccacaatgagtagttgtgtcaaaagtgttgtagtcttcctcttcaattcaggctagatcatggaatcattagagtaaggttaggccaaaggcatttgcacatttggaccgtccaaaatagttgctagctaaattacaagtgccacaatttcaatggcacaagaaaaggcccggataattctgtactcagtatttcatagataatgtagaataaaggtcgatgtgttggtaggggatatttatcttttgcagtcgaagagggaaataaaattcccatccagctgcctggatttttcacattttggtccttttgaaaaacttattttgtaagtagacccctagaaaaacttatcccaaaaatggtcctttttggggcgccagagtgcctggcgccgtcgttcaacagtacggcgccagcctctttggcgccgtccccctgccgacgtggcggggcgatgctgaggtggctagggggagtgcgccagagtggttggcgccccccctcggaaattttttatttttgttttatttgtttgatatttttttcacgcttagggacacacaagaaccaaccatagaaaaattgaactcaaatggacgtaatatgtgacatgtagaatttttcgtttcctctcctctctccgaactagtgcagaggagagagatgtgcaacttttttatttttattttatttttttgatatttttttcacacttaggaactcacaggaaccaaccatgtaaaaaataaactcaaacggacgaaatatgtggcatgtggaattttccaaagctccaccgaaaaacttctctcctcgaaaacacaatcttgcaagcggaatttggaggttttaatatcgccaaacccggcaaagcggtggagaatcggatgtaactttttctgtagatgtccgtgcatatattatttgcctgattccgtgtccgtatgagaaaattatgcctattttaatagatgacatattttgtccgtttcggtagagttttggaaaattctacatgtcacatattttgtccgtttgagtttatttttatacggttggttcctatgttctcctaagtgtgaaaaaaatatcaaaaaaatgaaataaaaataaaaaattgcatctctatgtactgtttaacttatatatgtcatttcatgtggttatattttgaattagattaagtaatttcatatagtggtagagtgcattatgtttaacatgctgatcaaagagttttactaaaggagttatggtctaattttagtgaaggtgcaaagtagactaagtggtatgctagatattttcagacttagctaggtggtagttcgagtttaaattttttttgtggttggttgtatcgtgatcctgagtgtgaaaaaacatctaaaaaaataaaataaaaatgacaccgttgcaactccatacagagaaacaggaatggaggcggcggcgccagccatgctggcgccctcctccctggggcgga

SEQ ID NO: 60390 - DNA, 24448 bp, Oryza sativa
  unsure (1)..(24448): unsure at all n locations
aatattaaaaaaataaatttaaaaattcaaaactcgtgtccatagaagttgggctgggccgtaggccaactcggcccacaaaaaccaccgcctcgtctcgtcgcctcgcctccgcttcgttcgccacccttccttcgattcgcgccgccgagagttctgtgtctctctcttcttctccttccctacttcgccgccacgccgtgcaggtggagatgggaggcggcggcggcggcggcgggaggaaggaccgcggcgaggggctcggccgcgcgctgacccggcagcggaacaaggccgcggcggcggccaaggagaggggccacgcgctcgccctcgcccgccgcgcgcgccagccgctcgagtccgtcatcgaggtcagcgacatcgacgccgtgctccagcgcgccgcagaggaatacctcctcctcggtggtggtggcggcgacggtgccggcgacgtcgccctctccgcctcgctcggctccgggcttatcgatctgtaacatcttaaacgaactttttttgttgggtatcctaagtgttcgacgaaatgtctctgaagcgggttgctcattcgggcgcgggcgcgggcgctcctttgcgatgcagggatgggacggtggagacggaggaggagaggcggtggctgcgggaggagcaggaggcccttcacgcgggcagcctcaaggtgccccgccggtgggtgctcaacagcgcttctctttcttctcgtcttctaaattttgggtcagtgatgtataggtggatgtgatgttctcgatttcagaccgccatggactccccagatgacggtggaggagctcgacgccaacgagaagcgggccttcctggagtggcggaggaacctcgcaaggttggtcaggtttcattggttattatgctgattcttgtatgtcttccaatgtttgttgtgtttatgtgccaaaaaaaataatatttggacagctacttatgcttggttatgaaaatttgggatggattcctttctacttctttaatttagatattacactggcaacaagtgaaatgttggcctgtatctaattgtgtacaatatatcctttttccttcttggactaagaaaagttgaaactcgtatcttgaatgtgtgcgcagtgagcttctggtgcatcaaagtcaagcatgatgttgcctatcgttctgtttatttttatataccaaaagattctttttttctcctgcagattggaagagaacgaaaaacttgtccttaccccttttgagaagaacattgatatctggagacagctctggagagtacttgaacgcagtgatctggtgagtgcgtatgcatgagaagactatgttacagttcaaatatggacacgttactactttaccacatttcatcatatatcttttttcaacattaaaacttgttccctattcaattgtggcctatttgaaatttctgagttgcttagcagctaacagcataacaaatgtatcctgtagttatattatagtctgttttattcattatcctagtagcttttaattttctgtccaactgtatgttgcttatctttgaatgagctgacagttctggaaattatgtggaagtgcttgacttctgttttccttctttcttgaagctggtcatggtagttgatgctcgagatcccttgttctaccgctgccctgatcttgaggtacttattcccaagattccagtatttttcttttgactactctttttgggtttaagataaacttttagatgattggtaatttacatatccagcctcttgcaagttgcaactactgattataaccttattacattctatggttatctggaagcattagctgaatgcccatttaccatgaaaatttcaggcacttgaatattaaaaccacgatattggatatacagcatattcagtagtcccacatctcgttgcattcattcctagacacgttagtgtttaagattttaagttgctcaggcactggcaaatcacaaaggcacaacctgacgggcgcgatgatacaactgtaaattcagtttaccttcatatcgcagatgttgtcctgtttgatttctttgttttattgtctgccaacagcataatgcttaaatacttccttgcgtgtgtttctgtgctgatagcatgtggtgctagggttagtgtaattcattagtttctggtgttccctctttgtgataaatatgatttgtaataatagcatagaagagatataactgtgtaagctttcactattgtgtggatctttgcagttttgtgttgtcttctgacatgtctttatgtatgttgtaaggtatacgcacaggaaattgatgagcacaagagaacactgcttcttgtaaacaaggctgatcttttaccactgaatgtcaggttagtaacaccacacaagcgcatttttcaatattctaaatgcctttagtgtctgcgatgatccatacagtaatttctcattgaaaaaaaaattgcagacagagatgggcagaatactttaagcaacacgatatcctttatctgttctggtctgccaaagctgctactgctgatttagagggaaagaagttgagcagctattccatggaaaactggaatacagcagatcttgacaccaagatatatggccgggatgaactcttggtgagattgcagggtgaagctgagtatattgtgaaccaaaagggagcattaagagctgaagagggtcatgaatctagtcgttcagattctgtctcaacacgacccaagcatgtggttgttggatttgtaggctatccaaatgttgggaagagttcaaccatcaatgctttggtaggccagaagagaactggtgtaacctctacacctggcaagaccaagcattttcagacattggtaatctcagaagaactcattctctgtgattgtccaggtctggtcttcccttccttttcaagctcaaggcatgagatggtagcctgtggtgtcttgccaattgataggatgacaaagcataggggcgctattcaagtggtggcaaatcgtgtgccaagaaatgttctagaacagatttataaaatcaccctgccaaagcccaaggcatatgaacaactgtcccgaccaccaactgccgctgagttgctgcgggcgtactgcacatctcgagggcatgtcagtcatgctgggctgcctgatgagactagggctgctagacagattctgaaggattacttagatggaaagatcccacactttgagcttccccctggtgatacagattctgaaactgacccagaggaaaccactgaccttgaaggctcagatactgcagtaggtgccacagcagatcattgtgcttctgatgaacaagatgaggaaatcagtcaagctgatccaaacattagtcatgtactaagtgaccttgaatctttcgacctggccagtgaagtgtccaagaactctacaaagaagaagaaagaggcatcctataagcatcacaagaaaccccagaggaagaaggatcgttcatggagggttggaaatgatggcgctgatggatctgctgttgttcgggtgttccagaaacctgccgtcaattttgctaccgttacaggttaatgtttttttgcggcactctgtgcgacttcattctcttttttagcttacggtaattgaagatgtcgttgaaagtcaaactacattttatccattttgtttcatcttctgctgtttgttatggccatctgtaattctgtattggaaatttggaatggtacgcaatgtggctatttttcgatgctagctttcatagcatttgactgaaaggatgaaaccttatgaatgttctattaggttatgaactgagaggtttgttacgatcagttgcaatgagaggatttctctcaaaaaaaaaaagaatgagaggaagataatttcgtacaacaatatagaggaagatatttatacgacaatattatttcctttgttaaaagtgttcgatacacaacgtggtctgttgaattaacgcagatcatttttccagtttgcagacacatgaaggcagtggctaaaacgaacagcggggattgcctgcagtactgaggtttgaagcatgaaagcaaatccattaaggagaaaaaatatggcaaatcacattaaccgcaccaaattttacttaatagaaggtttgaagtatgggtttgggtccataaaaagaactccgatgccactgatctgaaagttttgaaggagcaacgtttagcaattagcattgcaacaagaatgttatgcacttgaaacttacgcaatccatatatccaattcactgccctgctgaaattcatataaaacgcggataatttgctagagagtagtagcgaatcaaatatcactatcagttatcacaagacacaagttagcaaagtaacaatcagatggagcgcaatcgcttgtcaattaaacagaaactgcattgcaatgtacgcaacatcagcacaggagctcaagcatattgacacatggatggagagcaaatatataggatgatctattgaaaaagctattaataatccatgtcagttaatctaatcaagaaaaagctattaataatccatgtcagttaatctaatcaaaacatcacattattagagcatgagatctccgtataattcagaactcgtgtatagtttccacccaaaaatgaatttgacattttcttggagagatccatccccctctccatccgtctcatggatcaaagtttaactaattaatccttgaaaaaaaaagagaaaagaattcacaatctgaaacgcctcagatcgatccctcaaaaaaaatttcttctcaagatccccaccgttttgaccaatcaggccgcgacatcttgcttctccgggaccaccgcttcctcctccgcctgcttcttctcgccggcagcttcttcctccgttggcggcggctgctgctgctgcgaggaggaggcggcggcgtcggaggaggcctcggcggcctggtctgccttggcggcctcgaggtcggcggccatggcgcgctcggcgctgaggatggggtggtagtactcggcgtgggcctccatgcacttgtggagcgcggcggtgacctcgtagcagcgctcgacgacgtcgtcgccggccttctccgcgtcctccacgcacttctcccacccgacaaactcctccctgcacccgccgcccttcatgaagaggcagaacccgcactccccttcctcctccccctccgcatccccctccccggcggcggcgtccaggatcaccgtctccccctcctccgccgccaccgccgcccccgcgtcgctgacgggcgccgccgcatccgccgtggtgttctggggctcttccttggccggtggatcggcggcgggttccgcgggttggggaggaggaggaggagctgaggaggaggcggcggcggttgccatggcgggttagggtttttggggggtgcggagagatcggagtttcggcgacgagacgagatgcttaaaccctttgacgaatcaggacggtgttagtggttggtcctacgaggactattagtagacttggcaggaagtgtctaggcccaacacgacgcggcgcgtccgggcccgatttggtttcggcggtggtcagaaggctcggtttcgcggccggacgggggactcgactcgaatccggatctcgaggttccgtttaggcaccgataacggctacgaaattgaaaaacaaaaaagttacacgatagacgaacatgcaccactgcacatacaatatcacactcacatttccgcgaattcatcctatagcacatgctctaagaaataaaaaccagcggtacatccctgatcccactgaagtcatattaaaaatttatctatatgtatgtaatattcgtgggcaccagtatttaaactctagtaggtgttgaattattgagcgctgccctagtattaatcattttaaatttgagaaatagaataatatattttttaaaagcaactttcctatagtctttttttagaaaacgcatcgtttagtattttaaaaaacatacgtatttttctatttattgttgatattgtaaaccctagtcctgacgcaatatagcctgctataggcttcggtatggttttttttcccatgaacgagtacatccctacgaacagacagcctgtgaaattttgttgcgtgtgttgagtgctatattgtcattctagctgattccagttcgttacaacaactcatattttgcggcctggagcaaagcacagatcgaattaacaggtcaagccgtattttagagatttccaagtggtctcttaatgtattcagcatggctgaatattgcttgattggccatgttgacaaattcgtgatttcctggtcagacaccacttttttgcttcatgcaggtcagctaccaccacttcctcagcccacggctttcagagtatgaagaacacttgcagccgcctgccaacaacaaaccataagaacagtcgttaatttcattgtttattttattttacagctaggtaacgggttaatttcatgcatggtataaaagcaagtataatagtagactataagccgactaaatgctgaggtggagaagaaaagagagaggagaagcggactgtaaacttacagccagcttagacacaagaaccaataaaccctgtgagagatacaagtgtgttctatattaattataaagagctaactattttatagacaggctgaaagaaaactataaataaccttatagctaacaagtcggttgtattattagcctcgctctaaaaagggttaaagtacacgtgtttcatgagtttattccaggaatactaattaagaaatgagtatgcactaaaaggagtccccggtagaaaaataatgacatttatagattattgaaaagagagcatatatacgatgatgcgatgtattattttcataaccaccgtaatgaactacaagtactattacgctaattattctttttaagaaaacagtacaaacttgtacacgctcacaatacatacaccctcacctataattacacatttaatatttcacctaaaacaaaaacaaacaagttactattagttttgaggttgctgttgggcataccgcatatgcagacgtagtagtattagtatctccgttacaatgcatttgcttgggataaaggtggtagtgaatagtaatggattgttcggtaaggctccagtttcaggctctagctctaacaattttttttttggctgaagtctaaccaaataatcacaactcttactcctattagaaaagagtggagtgagttaaagtgctttaaaaaataaactaaaacgagtggggtccagtcgctcgcaaactgtattctacacttcatttctaaagttaagattgctaagtagaccctcacaatttgccaaatgaaagctggcggtgtgcggcttgggcccagtggagttgaaataacgcgatgtatatctgaaaaaactgtaagtgccggccttttgtcttatttgtggaaataagacaaacatcatttttacaaatgaaaaataatttacgaaaaaaacttttatatacatgtcttaacagtctaaaagaaagaaagactaaaaaataaactaaaataaaaaaaacctaaaatcaactttaaatttaaagttaaaaatttaaattttgactgataggtttacgtataagcgaagtgaaaagataagatcggcaattaaaacgcatgttggttctcggggtagggaatggaaagtgatgcacggtttaagccacgtcgttctcacaacattctgcagggtagcgtgaggcctccttgcctcccgtctctcgctctgctctgtagtagtagtaggactgtaggagtactagtgattgctcagcgcgtcagccagtgatcgaagatgtaccccggttcactccgagatgcacgaggggagggagaaacccccacgtcagtcctgtgcttgccattcctgattccattcttttggctatgtttagatctaaggtgtaaagtttgatatcacatcggatacatgaaaaccgtaagacgaatttattaagcataattaatctgtcattagcaaatgtttactgtaacatcatattatcaaatcatggcgcaattagtcttaaaagatttatctcgcaatttacacgtaatctacatattttctatttatatttaatactccatacatatgactaaacattcgatgtgatagggtgtaaaattttaccagaggatctaaccgggaccaaatttgtcaacgccgatacgagaagaaagagcacggaaatagtatttcaactccaatatgcgatgtggtttgaccttgtcaacgtccgacactgaccaggtcggggatctttctgtttgggacacgacgggcgcggcctggtccagcacactgcagcaaagaggatggttggattggaattggatccatctcacgcggcagctttgctttatctgtggctgccaacatcagcagcatgagccgccgccggctccgttggttcaggggacggagacgggcgaggccaccgaggctgtgacgcacatgggaaacataactctgccttcccctttcctttgttttttcttctttcttttgggctttccaggcgtggcgtttttgcgtgtgcgtcctctacgtctctcgatttcacgttcacgtcgctcctgttactactagtagcagtattatgtagagagagctgtttgttatctgtccaaagacgatggtgcacgagagcctgggataaccacttctactggaaaggaacccctaaaaggtgagtgagagtatctatcgatcgctcattcgctcgtacggcgaggtgctgggtgctggtccactctactcgtctttgctgttgtttatccaaagtgatcttgtttgagctgtcacggctaattcaaagctttctaacatagctgagatgaaatctgaatttatgacggattattccacacatagatgatagatttcaaatcatttttaggctacggccgtgtttagaccgtgtttagttccccctattcccaactttccatcaaatcacatcacatcaaaaacttttctacacataaactttcaacttttttccaaactctcaactttcttcaaacttccaacttttttcagaaactaaatacacccttagttcacccccaactaccccaaacttccaactttccatcacatctaaaatttttctacacacatactgtatgtttagttcctgaaaaaagttggaagtttgggaaaggttggaagtttagaaaaaaagttagaagtttatgtgtgtaggaaagttttggatgtgatgtgatggccctgtttggatccaagggttagagttagtttgagctagttggggctcaaatagccctaaaggatccaaacatgaggggttagattggggctagtcgcatctaacccacaaaaaaactagcccctccaagagatgcttattggagctagtttgagtggggcccactgtagaagccacttttctctctctctctctccccgcatcggatccccatctcctcccaatcccgcacggtcgccgtactgtagagcaattttttcctccgctggtcgtcgcctcctccccgatccacgccgccaccaccactgatccgcgcctccgctgccgatccgcgcggcgcggcctccccaactacctgcaccgcggcctccgtccaaccgcgccgccgcctccaccgttccgctccgccggccaacctcagcgccaccgccagccccgagccgcaccgcctccgtccaaccacgccgccgcctccaccgttccgcgcagccagccaacctcagcgccgccgccagccccgagccgcgcctcctccgtccaaccgcgccgccgcctccaccgatctgcgccgtcgggcaacttcagcgccgccgccacccccgagccgcacctcctccgtccaaccgcgccgccgcctccaccgatctgcgccactgagcaacctcagcgccgccgccacccccaagccgcgcctcctccgaccatccgcgtcgccgcctccaccgatctgcgccgccggccacgcatggacggtgacggcttcgacgacctcaacgtgtgggctacgcagctgtcggcgagcggccccgccaccgctccctctgccggcgctggcttcgacctcaactcacaagcgccggcagcggaggggttcccggggcttgggatgtacggagccttcctccagggcgacaacgacgagctcctcactagccgtggcaggggctccagcctccctccctatcgccaccgcgtgtcggagccagagagggaagggcaactctaaatctgtcaaggcgactgaacttgggcggctcctccacggcaggcactggtcacggaggaggaaatggtggcgccttcccaggcgggctgtcttcggggagaggcgggcgcgttcgacagcgctcatgttcggtcgccgcggcacctggccgccagagccagcgcagcaacacggcggtacgtgccggcggcagcggccagcgcctaccgcgtccccgggcaccgagggcagcaaggagtgccgtccgtgggcaagcatccggctccggcgctcccttcaacaatgaagatgaagaattggaggatgatgtggaggagtttgcgagcttcggcggacccccggtgagccaagctagtcgagcccaatggaatgaagttaataatgcttgcttgttagatttgtgcattgagcggcgtagagtaggcacgtataatggtgcacaaatgagtggtgaagggtaccaagccatcgtcgacggcttacttgatagaagggggttggtgtatacccattgccaggtgaagaaccaaatactcgtactgaaaaccacccactctttctggcgatacttgcaagcgcacatagggttggggaggttaccagatggaaccattgatgttgagtcttcgttctggaaaatacatacagaggtataagcagccaatctgtgtattctatttttcagtttcctagtttcaaattgtccaatgaactgatctctcataggactgacttactgttgtagttactaactttcagctattaagtaggcaaaaatttgacagtacgctgtataaactatactcttcctttatgatagtacagtactctgtaattcaggttatatgagcatgtaatttagttttctgtgcactagtatagtacatatatgctcatccattttatttatcgctgcagaagaaaccatacctaaagaggctgcaatgggatcctccggaaaacgaggagttgcttgatcaactattcagagggtacactgtggatggaagcacagcctttgtgcctggagatgattatggtcaggactaggggcaagaggatgaggaggagtttcaaccaacacctattagtacaagcagccagaggagccaaaagggcaagatgccattaagtagcacttcaagcactttgtccagtccagtgaagaagagcaagagcccaatgcttaagattgtgaaggacatagccagtaccttcaaagaggctgtcatagtcaacactaagcaaatgcagaaacgggcaagtgacaaggctgcattttcagtcaagaggtgtcaggagctggcatttgagtgtggtgtagagcaaaccattgaatctgtctctgctatgtccaagatgttcgaaacagagtatcaaagggagttcttctgtggccaattaactcctgaccttaggttgggttacttcaagaaatggtgcaaggacaacaatttggagtagtagatgtcttgctctcatatgtctgtagaactatttatttgtgtgttgaacctatcatctctgagtcagaagttgaactatttatctgtgtgtcgagactattatctgtgcgatgagactattatttgtgtattgaaactattatctatgtgtgttgaacctattatctatatattattttcgaatgtngaccnaattgtacatgtgttgaagcacgaagaagatcatggccctatggttgaggaagcagaagatgatggaggcagcacaagtgaggatgagattgtatcgatgtgccgcaacaatctagtgcatgcagagaatttgatcgtgcaattgggtgctatcttgggtatgtactctgataactactttgtgaaactacctaagagggtcaatggagattctggtatggattgggtcatggatacactagcccgagatgcccaatgctacaacatgtttagggtagagagagctttatttaacaggctacataatactttggtccagtcttatgggttgaagtccactacaaaaatgacatctatagaggctcttgctatgtttttaatggattgttggttcaccacagtcagttagacaggctgataactgtttaaggaggtctttggatacagtaagcaggacatttaacagagttttgacatgcctccttaggttagctcatgacataattgtacccaaggacccaaccttttcagaggtgcacccaaacttggaaaatccagcattttggccacacttcaacgactgcataggagctatagatgggacacatgtgaatgttgtggtgcctaagagtaagagggttccgtacttgaacaggcacaatgaaaccagtcagaatgtgcttgctgtttgtgatttcgacatgagatttacctttgtgttgtcgggatggcctggttcggcacatgacatgagagttttcaaaaatgctgtgagtacttatcatcacaaatttccgcatccaccaccaggtttgttacttgaactatcttgcaacaatccttatccaattgcacttgttcatctaagtctcattgcgtgcctcactttcacaatatgtagggaagtattatgtggttgatgcggggtacccaaaccggccgggctacctttcaccatacacacgtataaggtaccatgtcgcgcaatggaacgatggaccgccgccacaaggtatgaaagaaaccttcaaccatgcacatgccaaagttaggaatgtcatagagcgatcttttggagtgttgaagatgaaatttaggatcttgttgaacatgccaagttttcctgaagcaaagcaaactagaattattgttgcttgtatggctcttcataatttcattcgagagatagggaatttgatgcctgtgatgaggatgaaaattataacccaatgcctagttctgttgcatccgaatggccagcagatgaacctcttgttgaagatgcccacatgaatgccttccgtgatgaattagctcaagctttattttatggagtgtaattttttcttgtctagcttcatttgtatggactaaactacctatcgcgtatgttgagtgagatatctcatttgtacggacaaataaaatttttcgtgtttcggatgcttggtttgaaatatgatttgtttgtgtcatttgtgagaggaaggaagccacacatgagtcttccacaccaaatccggttggaaaggagccaaatgattggaaaagtatatttattgtcaatctaacccttccatccaaacacctctagggctagagttagttcagggttagttgagagctagaaactaactctaacctctaactctaacccttctatccaaacagggccgatgtgatggaaagttggaagtttggggtagttgggggtgaactaaacacagccataaacttccaactttttttccaaacttccaactttcccaaacttccaacttttttcaggaactaaacatagcatacattcttttcagaggtccgggctagctaattccttggattattgtgagtaattcttcaaaccaccaaatggtgtgtttttttttaaaaataatgcttttttaaaataactttcttaaaagtaaaatatcacaagtttcaattgtccagtatttagagtcaaatttatctttctctaatagtttatcttgttttatgtgtggatgataagctcgactgactctccgaatcaatcaccgccttagaatactttgaagtttgctcgtgataattcatttcctaagatactggataaaaaaaatttggacctctacatctagcacagatgtacatagtcatcctcgtgataattcataagctataaagtatatataaaagaacatgaccttaattttagaattaactaagtgtttttttctttgtggttttacttacagtcttgtcttttgggcattaggacacatggaatataaaaagagcacaaaaaaattgtttatgtgatgaaaaccaattttttttatataaaatccttatttgtccataaaagttgacatgatcccttatttacccctcattttcttaatgacttgtgggttcaggatttgcttgtagtttctttttaggatttgtagttttttccttattattactccctatgtttttaaatgtacgtcattgtggatttttaatcttgttttcttttcatgcatgtacaagcaaacaaattgttacgttgcaccacacgtctatacagtaacatcgtacttctctttctttatttagttttacgctcgctcttctattttttttatttcatgtattatattcgtgtgttttgcttgtctcgtattgcaaacaccccaaaaacctctctctatgcaaatccaatatatttttgagaagactgaccatccactctacacatgcttactaacttatcaatatgtttctaagtcaattgtcgggctggactatttatgggcttgcaactaagtggtttatggaccgaagcatccaagtatccaccaaatagtctagtggataatccgcattcgtaaagtatcagagattctacatctgtacctcactatccgaattcgatcatatatccaccgaatttctgaaaacatcataccatatcatcgttttggagtggatcatatcagcatttccgtaccttctctcggtaaacaactaaacacagaaagggatcatctaacgtgaacttctcactaaatatagaaatggatcatccgacgtgaactttctaatactaatatatgagcctcaccacttacatgatccaggtatacgtgatcacggatcccatacactaaacacgtatccggatccataataataggcgtttgaacagcaggtggcagcatcggagaggagagtggcatttcgaaacggggaggccacgacggtaaaaccgctgcgagtaaaaaccaaaaaaagccgttcttaattgaatcaccatttcctctcacacacttctctcctcctcctcctgtctgtctcctccaccccacctcacctcgccgtcctcctccctacgttggggtcgccatagccggatttgcgcgttggccccccgacccctcccggaattgccaactcctcctcccccttcttcttctctcctctcttctgtcttcccttcccccgcgccgcgcgcacggcccggccggcctcccgaatccccacgcaattcccaaatctcccggggccaaaagctttgccgccgctccaccaccacccaccacttcctccctcccccctcccctccgccacgatcgcgcccagcccgagccccaaaccacccgacgaatccgcccccgcgggattctctccgccgccgccgccgacgaggaggacgccgacgacgacgaggagggggaggaggctagggttccggcggagaattcgcggccgcgggcggcgcgccgcgtagggggggccacccccgcggcgcagctccggatctcgaggcccccgaactctaggaggggtggggtggggggctcggcgatggacgtggactcccgcatgacgacggagtcggactccgactccgacgccgccgccaccgccgccgcctccgcctcggttgctgcgcaaggaggcttagcgagcgagacctcgtcgtcgtcgtcggcctcggccccgtccacgccagggacgcccacggtagctccggctcctgcggccgcgggagccacggggcccaggccggcgccggggtacacggcggtcagcgctgtgatcgagaagaaggaggacgggccgggctgccgctgcgggcacacgctcacggcggtgccggccgtcggggaggaaggcacgccggggtacatcggcccacgcctcatcctcttcgggggcgccacggcgctcgagggcaactccgccacgccaccctcctcggccggcagtgctgggatccgtacgctttctatctagtatcatatatatgcctaataatttctgcttttttcaaatgtcgattggtcgtgtctcgtggatattaagcgacgctcttgggtgatcatgatggcaacctggagctatttttattcccagtttgcaatttcattttgaaatgaatttggaggcttcaggagttttactgagaaatcatttgctattttgtgggtaattcgggtcggtctatacctcgatggctggaagctcatagctggcttgagcctttaccatcagaggatttaaataggcatagcatcatttcagacaccattttgacttaggaattgcgcttgagctgtttctggaaccgaatatcattggttgaattagtgaagatgggtgctgatggctgattccagatgccatggtcatgggagctgaaatgttcgaactgtttcatatatcagtcgtattgcataattttgaattcttatttttgaacgtatcccctgattcactgggcatgcgctttcatggacctctcatctaaagtttctaactatcttcaatgttatgcttagcaagttggaaggaacatttactgcattctagattttgtgtcatcgtgttgcacattgtatgacagtaggagaaaccttttttttttttgtttttccttttggcaagttaaagtaggtgagcggaacttctaaggcacgactctgatatgaaattgaaggttttcttttttgggagctatattattgctgatgtaatctatttaaagcatatatacaaaactagttgctccattgtgtacaaaattgttttcggttaaaaaaatgttatctggtatacaatgctatttttactctccagttagtcacaaaggtggattattcattgatctctccttggtttataggtcttgccggtgccacagcagatgtccactgttatgatgtgttatcaaataagtggagcaggtaggatattccataaatggtttccaccttcttttgagcatttaatcgttgcgttgctactttggttgactttagcaacttttgttttagagtaacacgattattttgttggtagcataaagcaactcagcaaacttatttaattgcgccaccactttggcaggcttactccacaaggtgagcctccttcaccaagagccgcacatgtagcaactgcagttggaaccatggttgtcatccaggtatttctatattttacctgtggtttctgagatttattacctagtgcttaattagtatcagaaacaattacttcccaagtaacctgttttatgtactctttgattgtttacataaattttatggaggtaacttctaaatatggtttgtttttgtttcatcattcgttgcaatgcagggtggcattggccctgctggtttatctgccgaggatcttcatgttctagaccttacacaacaacgaccgcgatggcacaggtaaactattattctgtactgtgagtgtggagttgcatttcttcagcacatcttctgaggtgctaatgtttctatgtagagtggtggttcaaggacctggtccaggtccacgatatgggcatgtcatggccttggttggacagaggtttttgttgacaattggtggaaatgatggtaagcaattgctcccagatgcacctgtcaaattcaaactagagaacctttgcacttggatctatgctgaaatggtttctataatgggataatttttattctctagggaaacggccgctggcagatgtatgggctctagatactgcagctaagccatacgaatggaggaaacttgaaccagaaggtgaaggaccgccaccatgcatgtaagtttgctagctgaaacacattacagtaatttaattattgaggatggtgacgtaaagtttaatagcaattcctggggaggtatccattatattacattacttaccatgtgttgcatgttacttcattaatttaatatcaaattatccacaatgcaaccagctatttactttcttggttcagaataacatacggtagcacagttaacccaccatatttcccaattagttgtcaggcatgaccctcaggttattttcctttattttttttactggaagtagagctagaactaggtttggcatccttttgctaagtatactgcatggtgttgttgttcaggtatgccactgccagtgcacgctctgatggtcttcttttactttgtggtgggagggatgccaacagtgtggtaagtaaaataatcaacttatataaataaagataataaatagtctagtaaatatttcgctgatcaaaatatgtaaagaactaaaactaatggaattagagacttgaatgtataacacttggctgtcaattttaccatctcagtgattggatgtcatactgttgtaacaaggttctatatagcctgtgatgtgaggactgcaattctctctagattacaccttcaaattttgtatctaaaatattgaaacagcagtgatgtggcaattggtggatttccatgatctgaaaaataagaaagctattactttgttatcagtttcatctcatgtagatcaagagaaaatgaacataattatgcatggcatatgggcatcttgtcatgtaacttacacagacatcagttgccaagtagcaaatattgagtgactggaactacaagtagcaaatatttgttttctataacaaagatgtctagttatccttatattcggcaagtaaaatgatactccccctgtttcacattataagtttatagaaaaatttaacaacatctgcaacacaaaattagtttaattcaagctaacatttaatatattttgataatatatttgttttgtgtcaaaaatattgctaatcttttttttataaacttgttcaaacttaaaaaaagtttgattagggaaaaaaaactcaaaatgacttatagtatgaaacggagtatattttagtcacaccatactagttgtacatcaagctattttcatttgagatgtcaatttgatttaaattactaataattacctgtagaagttcaatatcaataataggatttctctaatgtctttgtatacatgttacttctgtaaacccatcagccgctggcaagtgcatatggtcttgcaaaacacagagatgggcgatgggagtgggcaatcgcccctggtgtttctccatcacccagatatcaacatgcagctgtaagctgttctttcattgttttttcatctaaaaggtgtacccactttggctcttatacaatgcttgattcatctgttgtttaggtttttgtgaatgcacgtctccatgtatcaggaggagctcttggaggtggtcggatggtagaagactcctcaagtgttgcaggttctagttttaatcttgaaataactgacatatttcttaaggtattcatgaaataccttaagaaatatcttgcactgacattaaccagaagaataatcttgagatgaaataatgtagctcttttagtttgctggatgctcagcatataaaatacttagtttttgttggtgtatgtgcaatatttgttatcttaataagatctagattgcagaaaagcactcagatacttgaatagtttagttgctttcagcattggccactcatgcaccataactacacttgctaattatgttaatctatatgactgcatgtgagtattacaaaagcatttcctgtctttagcctttttttactcatcactctgtgatgacattgccagattttcttcctttttttggtagcattgagattctcttgtgttgaggtataggtaattgttggtttcctctagaatgacaatatgcactcctataaatttcttataagttgcacgattctatctggttcagtgctagacacagctgctggagtctggtgcgacacaaagtcagttgtcacaactcccaggataggaagatatagtgcagatgcagcagggggtgatgctgctgttgaacttacacggcggtgcaggcatgcagctgctgctgttggtgatcaaatattcatttatggaggtctacgaggaggtaagaaaacctgtttgtttagtattatgctataggctttgagcctttgctgggccatcaagtcatcattgtacagttcagattcaagttatttgtggtgttatttctgatttgatggggataacttggccccactgccacatgatatgcaacttggatgccacatgatatatattatagttggcatacttttcgtttggatgaaaacttttagtggactggaaattgtcaagtttgacatttgttctcaccgttggattttatgcaccttcaatttgctttctaacatcaaacgactgccattgtaggggtactgctagatgatcttcttgtagctgaagatcttgctgctgctgaaacgacaaccgctgctaatcatgcagcggcaagtgcagcagccactaatgtacaaagcggaagaacacccggaagatatgcttataatgatgagcgagcgagacaaacagctccagaatcagctcaggatggatctgtagttcttggaactccagttgcccctcctgtcaacggtgacatgtacactgatatcagccctgagaatgctgtgcttcagggacagaggttattttcaattttttttccctatgaatatgtcctggtgatattcctatggcaagttactattagttttgtaattgctattttcctaaggtttcaatattaatttctctacaggagattaagcaaaggtgtcgattacttagttgaagcatcagcagcagaggcagaggctattagtgcaactttagctgcagtgaaggctaggcaggttaacggtgagatggagcaattgcctgacaaggagcaatctccagattccgcatcgaccagcaagcattcaagcctcatcaaaccagacagtattctctctaacaacatgacgcctccacctggggttcggttgcatcatagagctgtgagtagtctgtatgcagtttgttacattgtctgcagttcatttgtcagtttttttttatgttataatattgctgtagatacttgtctttctagcgactaaaaacaattgtattatctcttcattttgcatcacatgaggtgatatcctctatttttccttttacctcaggttgtagtggctgcagaaactggaggtgccttaggtggcatggtcaggcagctgtcaattgaccaatttgaaaatgagggaagaagagtcagctatggcacccctgagaatgcaactgctgcaagaaagttgctagatcgacagatgtccattaatagtgttcctaaaaaggtatcatggagaatttggtccattcaactgctttggcactaggatttagtgatgcagaagctgaatgcacaatatagccatgattgagaaaagacttagctagttactacgcgtattctgaactacttaattactttgttctatctgctgcgatacttatccaggtgattgcatctctattgaaacctcgtggttggaagccccctgtgcgaagacagttcttcttggactgcaatgagattgcagatctatgtgatagtgctgagagaatattttcaagtgaaccaagtgttctgcaacttaaagctcctgttaagatatttggtgatttacatggtcaatttggtgacctcatgcgattgtttgatgagtatggtgctccttcaacagcaggagacattgcgtgagttcttgctttgagaaactagtaatcacacactttttaaattttgcttcaattgtgatattttacttgccaaattaacttgaaaagccttgttattaatgtgtttaatgaattatcttaggctatctatacatactccctccgtactcgtaaaggaagtcgtttaggacaatatttaagtcaaaccttgggaatataaatcatgaataactctcaagttgttgagtttgaaaatgtaaaaattatatgaatagatttgtcttgaaaaatattttcataaaagtatacatatatcacttttcaataaatattattatagaagcaataagtcaaagttgtgttttggagaccgtgttgctgtccaaaacgacttcctttacgagtatggagggagtatgtacttttcttttcttttttggttcagaaggtatttccccacctttcttggtcttgtgctgatccataattttgtatgaacctgcagttacattgattatctcttcttgggtgattatgtggatcgtggccagcatagcttagaaacaatgactcttcttcttgcattgaaggtattaagctgcctacttaccttgatgccacatatacttactgtgttgtgacgatttattaaaatcgtaatatataaacaattgtacatttcaggttgagtatcctcagaatgtacatttgattcgtggaaatcatgaagctgcagatattaatgctttgtttggcttccgaatagagtgcatagagcgaatggtaatctattttattctgcatctcacgttacaacaaaaccttttcctcttttgcttatgaggatgttatttgctcaaaaaacagggtgagagagatggtatttggacatggcaccgaatgaatagattatttaactggcttcctttggctgcacttatcgaaaagaaaattatatgtatgcatggtggaattggtcggtcaatcaaccatgttgagcaaattgagaatcttcagagaccaattaccatggaagcaggctctgttgtccttatggatcttctatggtaaaacatttcaacaataattgctatttaaccttccatgagcatttatttatgtgccatgttcagatgttctctttatgatgcttataggtctgatccaaccgagaatgacagtgttgaaggattgagaccaaatgctcgaggccctggccttgttacgtttggggtttgtgttccctaaccctaaccttctgaattcgtcttccctttgttgaccccctttgttctctgaagctaacatttgctgttcatacagcctgatcgtgttatggagttttgcaacaataatgatcttcaactaattgtgcgagcgcatgagtgtgtgatggatggctttgagcgctttgctcaaggtcacctgatcactcttttctctgcaacaaactattgtggtatgaattattctaaaatattcttttttcaaacttttttgctggatttctacgattgcttgacatggtatgctcacaggtactgcaaataatgccggtgctatcttagttttgggcagagatcttgtggtcgttccaaaactgattcatcctttgcccccggcaatcacatcacctgagacctctccggagcatcatattgaggacacatggatgcaggtaatactattttgttgcaaagatattcctgtttgtaaactaactggtactaccaccttcctcgtaacacggtaacatttgaaatgaaattcaggagctgaatgcaaacagaccaccgactccaacaaggggccgcccccaagtagcagctaacgatcgaggttctcttgcctggatatagtagagtggccagatattgattaatctgatctatatatgaagtctcgatcggcgcgatcttgctatttttatttttttctgcacagagtaaagtgatttgtgtttgcgagacagtggcccacagccatgccaaaaggtaaacatttaaagtgagcaaggtagtagataagatggatgaacagatgatcatcctgaacagcgccgtccagtccaagctgtttcccgaacacgacagtaaaacaattcaattcacagagattatctggagatcgacgaggcttcacttcacctgtatatactcggctgctggtggataggcagttgtatgtggtttttgcatccaattggaatggcaaaaaggaatagtgttattgtactagctattctttcctctctttttttttttcctttctttttgggatcttgagttctgattttgcaaggtgcttctgacctgctggagagagaccgatggctggtgttcgtggtccagtcgtgtataatagccttccctcctgcta

SEQ ID NO: 60391 - DNA, 10436 bp, Oryza sativa
agccactctggcgccccaaaaaggaccatttctgggataaattttttcaggggtctatttgcgaaataagttttttaaaaggaccaaaatgtgaaaaatccagtccagctgctctagctgtaaagggatctttccaaaatgtgcattattgcatgccgtatatttggcttttccagaaaaacaaaaaagacagaactatactataagaaatattcttctcactcccacttttcttgcatggagaagaaaatattttgtactttaattagatgtagaagtaatgtatctaacacagacattcaaccatacgtacgttaattagaatttcacaaagtagtaaatttacttcagtctttttacttatggatttaactactagaaagtattaattatatttcgcatcgatctcggacctttgtaaaaataaattaatttcacttataagaacttatgacaatgaacgctcatgaaaagccaacttagatgttgtacaatactatatatgaaatgataaacaaaataagggaaacatgaaaaattaatactacacaacatatttgttcccattgtatatgtatgtagcatatctgcttatatgttgctcccacacggtaacaattaatgacaacctccagttgcaattatactcacatagtaatatataatgcacaagagatcagtcatgcatcgacagcatcattctgcaaacgttatccaatagctagatggcacctagcatgcatgacacagatgttgagatggaattggactcaatccagagaatataattcaggacatgatcgatcgatcgatcgccaccagtagaacaagaataaaacaaaccgcatacagtactgtgctaactcttatctcatgctgacgaaaactaaacaggaagagagagaatattatctcacatatatcatgcaatgcatcgatcagtgcatatgataattaagaaacaaattaatcagagtatatgcctagctagggtctctctctctgcaggtgttgtagtactgatcaatcaatcacatatatatcatatctgagcacagcatatagtatgtgtcaagaattatatatatactcttcatatcaggaatcgatcgagagcttgtcacgcttagacgctaagtgctctctctaccaagcgttcgttggtcttaatcattggtcgatgcaatgcaaatatttatatgtgtttctaatgtgtagatgctacctggctagctagcttacacgttacatgcacatatatgcatgcgttgatcactctcaagtttgttgagtttgtctttcttttgaaggtgaatgacatgtagccatcctccaaaaagcagcttttttttccctctcctccctttcatctctatctgtcttaatttctgcactatgcacatgctagcatagctgcaagatattgtagtcagtgatgatcgatcttaatttggatggacaacaggttggctgccaaaatattggaggtcagatgtctacatatttctcataagttaaagtgtatgtacttttcactaataaggtttgtgctcaaaattgcaaagttgacaaaaagcaaacggtcatactccaaattctcagtaatatagaattaactgagatttttttttcaaatagtactaatttaataaaaaaaattgcaaagattgtgtccgatttcgccaatgagagaagacacatgtttgcaaaccatttgccacaagaaacccgtcacaaatgaaatacggataggtcggttgcgttgcccgtgcactagctgccccatataggcatgtcagaatcaaattgccgacaactcccttatattggcagtattgagtactacttcagtataattattatattattgaaataatattatctaaacataaatcaagcaccgaataataatcaaccgatcgaaacataattatcaggccacattttctcttcttttggaaaaaaaagaaggaaatatcttgcatctgctagctagctagaatgctagatgttggaagccaacaccggatcgatcatagatcaggtgctccataacatgctgcacgcatgatcgatgcaggtagccaaccagcaacaatccagcaaaaaaaaaaatctgcctttttttttctgctgcttttcagcggcatcctagcttgcgtcgctgcacctggcctccgatccttggtgccaacttttctgtggccgtagctttgcacgtggaaggccggccggcgaagccctgccccacctagttgccggacaattctcggtgggaagaaccgatcaaagcatccatagacggtcaggatgcgtgcacgtttccagcctagtggactatcgatctccatgttcattctcaccgtctgattgttgcgcggaaaatgcatatgtataaattaaagttatatacagcccccgtttataaatacgtgtgacgttatttactttcaaacattatgagcctgtttggcacagctccagctctagctccacccctcttggagctggagctcagccaaacagtttcagctcatcaaaactaggagtgaagttgggtggagctctctcacaaaatatattagagttgtggaactgggttttggcagctccataactccactccagactcaactcctggagttatatttaggagttggagctgtaccaaacaggccctatgtttaatgatatagcaagttataacaaactaaacaatagttaactatttatttttcaagaagatgaatagtaaaaactcatgtacaaaagtcgataatgtcatatagttaaaaacggagttagtataataatccttggactgttagcgtatatgttgattaatagttaaggcgatttttgctttttttaaattaatttttattaaattaaagctaaaaaacacgaataatagtgaatgacctaatatcaaataaatagaaggggtgaggcttcgaagtcaggccggttagcccatcaccttaattatggagctagctggaaaacctgtgtgtttctctatattaaagctacacaatgagtaaaattaactcgatccagtagacgagtacagatttacttcaactttgttgtgcacccttatgtagttatgtagatgttgacgaaaaaaatcgaattactatattttatatattgacaaggatcaacacaaaattaaatacaatttttaaaatgtcaaagttgtgaacacatcatttgtttcactcccgaaagaaaacaagtgacatatagcatgccttggatttagttagatatcgatgacctacataatggttgcaaaaaagattgatagataaggggcttgcttttactgaaatagttcttctattaatcagagaaaaaaaatccgtacactccaaacggagtcgtttaaatttatagttacttgtttacacaagcatataaaatatatgcacaactagtgacggtgtacatttatatatttcaatcgtgctgggaccgggcctgacgtttcggcatcatatcacaagcagagaaaaggtgtgaaagaaaaagctaaaatcatgcaaaactttagtaaaaagagtagattaattcccatggtggaggaccctcttcctctcactctctctttctctccattgtgaaaattaggatataccaaatcaataagggtaaattaaatgacatgcgcaatgatgtcattttcatgacccttcttccaagcagattccatggtggggatcaaaatcgattttgttatcacatacacaacaaataatattcaatatatatatgggggacaaaagctcaattaaaggcaaagtcatgctctttttctctttagtattttccagagattatgcccttgaatctcctgtgtgcttgaccacaaccaatgggtgattagtttaatcaaataaccaggaattaagtggagtagtaattattaattttaccaccaagcctttgtcccattggagatgtcaaagctataatttgggcatatatgatatagtagctaggaagatataggttatcatgtatataaccaccagctgcacataatattagttgcagagtttgacgacatatcactttcacctctctctcgcccatttgttaatctttttgtgtccttgatggcttgaccacacacattgtcataggctgatgacatgctatatctaattaattaactgttcatctgagattgactgctcgcactttacctacagtattgcacttaattaatataactaccacgacgaaggcaccatagaaatatgttttcacagtggggtcgagctcgtgcgcttggtgacgtggataattaaatgcaagttaattaatttaaagcagcgcacaagatagtcgtaatggtgaaagatgtagttacctctaaacagaaaggctagaaagagaaacttaattaattaattttgtttctacacttctggtttatttggatcttgcatggattcctttttcttatttatgcaaagtggtttattgcagcaagctgtagatcggggaacaccattttggatgtgttcagctctcatgagtgaaggtctggcaacagcaattgtgaaaattgaaaattggcattacttcttcttgttggcaacttgttactttatttatattaatttcatttattgtgtagcatttgcaaaaatgtatccaccacttaaaaaaaaccaattttcacaacacccctttttatttttgcagacggcataaaaaaatacacacatgtagaagtcgatctttataggtggttaggctaggagagttgtctgcaaaaataactatatttttataggcgctcactactacaggaatgatttttcgtacaggagtcattttagattgcagatgaaccgtaagtggtcgcgtctgtaaaaatcgtgttctattttcgcttgcggctgtttaaaatgaccgcacggaaaaatcaattttcgcaggcgggccacttaacaggtctacacgcaaaaataggcttattttcgcgtgtggacatatcaagtgacttgcacacaaaaatagccacccaccttttaatcccgccgtcgccgccccacacccactcctcccatctccctctcagatcccatcgccctctccgtcccacacccactcctcccatatccttctacgtcccacacccacctcctccctctccctttcaccctcctcctcccatctcccggcaacggcagcggtggcggcctcggctagggcggcggaggtggcggcatcgggttggagcagcggaggcagcggcggaggcgagtgcggcatcagccatggtgggggcggcggagcggatccgtcgccggcgaccgcggggaggctagatccgtcgctggccaccgcagggaggccggatccgtcactggcaaccaccgggacgacgacggcgggcctcgggcaaggcggcgatgacgacggtggtgatggcaacgatagtggtgacggcgacgatggcggtgacggcgtttttgatttttttttttgttttgattttttattttcccatgcagacgactaaagtgcctgcacgtgaaaatcgcgatttttgcgcgcgggtgcgtcacccacatgcgaaaatcgcgattttcgtagacacctcattccagacgggtggaagatccgcatgtaaaaaccgattccgaatgcacagaaaaatcgttattgtactagtggctcctctcaaagtaaaacaaggatttttgtaggcgttcctttaagatggttgcctgtaagaatattgttacgttttgcaggcaggtcttctaacccaaccgtctggaaaaagagatgtgcattgtgaaaacaatagtccctcacccatgacctctcaccatcccccttcctctctccatcacctctggtacgtgctccaagcctccaactaggagtagggtgggggtggtgaaggggaggggaggggttgtggttgaggaggcggatctagtgtggcggtgagacgacattcgtgagtgtcaaatccggtgactccaaagggcatgaaggggcaacaatagcggcaaaggggtgtggctcaatccctctctcgacgatcaggtccaaggtggcggtgttggaaactgggtaaggggagaatggggcagccatgacgaggaccctgacgaccgcgctggcccgatcaaggccactagattcggtggagagggctcaacaactgcggcgagtgcaaaggggaggagcggcggtcgagtcaaaggggagaggcaatctcatccagctggagctcgggaaggagatggcaaccgcttcggggcgtctaagagggtggcgagggctatagcttggtggcgggcaccagatctgccgaaggtcatatagctcaatgctaacacgatggctgttgttagtggtgtgacctaaatccaccggcgggaaggccgggtcggtgcatgccaccaccaatatatggggcttgatgggctggtcatcgtctctcgcccctacctacagcattggttctagcaggcccacgcatgtacaacctccacttctctatgatgtattctctctgctgtcaagacattgtgaatttgtgatatgatcgatgatttagaaatccatgatgaaattgtgatgtattctctctgtttgttatggaactgcatatgtttttttttcaattgtatttttattttttctagctaaaataaatcactgtggatggtcaacttaacctacctgttttctcaggcgggtgaagcctgccatgtgaagatcatcgattttcacatgcttttggtcataggtgagtcgtctagtcacttacagaaacttgttttggcatcctacagaaacttgttttggcatcctacaaaaacttgtttcatagtagtgatctttggtctttctgtctttgagtagccgctttgtctgcaggaatcaagttaattggctcatatgaaaatatgccaaaattcaattgttacggaggctttcactttttgttaagctaattggctaagccatttatatatatgctactaattcttcttaattgaatatgaacagctatttgtctattctctttttcaagaaaaacgaatccaaactaatattttcttatttatttaataaaaattagagaaatctagacaagttagcttaagcgcctttaatttgctgccatctaaaaatttggttgttttttaaaagaagttctgttacactgcatgaatagaaggatccttgttaaagtatatatactcccctccgtctaaaaaagaaaccaacatagaattgagatgtaacataatctagcccatcaaatatagatgtaagcagtctgtctagattcgttatactagattatgtatcatcataattctagattgagtttttatgggacggagggagtagctaggatcgttacaataattaaggagatgaagaatatggcatatatgcatatatacatgcatgaatgaagatttagcatgattttaccaagtcacttcaatatattatcaactggcatcttattatcccttgcaaccaaattttgtggtgcatcatacatagaaagatggaaaaaattcctatttccaaaactgcactgcttacatattcctggggccggcaaaattaaacatatgtgatgtgtacagttcattttcatcatgcatgcatgctgggataaagcaaagatgctcacaaatccagtaagcactgtacacaactaatcaacatacaaaaaaggctataatacatgtacatctcctgacatcctgtacatagagtacctagctcttttgtaggatgaggctaatgcacgttccagggctaagggggcaaggtctcattgttggccccccaaagatactggtgctagatcatatatataaatattcatttcacactactacccaaaacatctttccatacagctaaaactaattttacagacggccaagccaaccatctcactctaatcatttgtaaaaatcactattttcacgtgtggatcatgtcacaaccacacgcgaaaataacttttcacaagtggcctccatggaagccacctgcggaaagcgatttttcaagtgggcatattaaaatgcccgacaacaaacttttttctgaaaaataaaaaaaaataaagaaacgctatcccaatgtcttgaagaagctgccactacattatgccgccgttgtcatagctagtagcccgcaagtcgtggtcgttgtagtagcccacattgcaaagccgcggcaagatccacgatttgtcttggatccgcctaggctccaccaccgccggatccgccgctctccaccgttggaagtctcctatcgccgcaccatccctcccaaggcatctatcggcggatccatcactcttgaggccataggtgacagatctgccgctcccgtcactgctcatgggtagatctgcctggctcatggttgtcgctgtcatggccaccgtcactccagaagactcctgcgcggccacgccgctgggctttcctctgttggcatggctgctgccactctcgaagcgcgctgtgctaccgcctgagcctcccgtcgccatccggagaagtgtggaggtaggctgggagtgggagatcgagggagagacaagagtaggaagtgagagagatgaggagtccagcagtgagaattatgagacagctcgcacattatcctcgtttttgtatcgttctctacttttcaagcagtagtgttgagagctccgcttgtaaaatagccatatttttacgggtgagcctcttactacccacttaaaaattaaaaaataaggattttcacagacgaactcaaaataggatctcctataaaaaatggcattctataaaaaccaatgttcaagtgcgagcctcgacctttcacaggtgactcttctttttatcgccctatgaaaatagagggggtgtatgggaaaatggttttttaagtgtttatgcctccaaaacgacattaatccgttccaataatgtaaggctcatccatgtaggtataacatctggcttacgcatttattctcgctttgtgtaaaatgtttaatccaaggttactactatatgtttgatgcacatgattttgacatattaaccaatttactgaaaagctagctagtaattgagcctatatatacaagcctaacctcatcatttttgaaatatatacggagcataaaagtataatgttattgatctgcacgcgcacaacattctgcttctagactgagacatattgcgaccaaactctcatgatcaatatatagccctagataattcatacatatatcgcccagtggctttaataatttggaatcgatggatgccaatttcattcgtacgacatttctatcacttcattgacatatagatacagtggtttaggtatatatacttgggctagctagtaataagctagcttttgttgctttgaacttgtcacaaaagtgtgcgtgcatgcgtaaaataataggcccacgatgatgtttatcacacataaaaagaggacaatttctagcatacacatttgatataactccttgatacttttcctcaatcgatatcatggattgatatggattgatattatgtaacttttctttctgtacataattatatgtatatatttttaatataccgtgggatgccgcactgttttcaggttaaaaaaaataccttgataatcttgcgacagtaaaatatttacattttatattagtatatttcagtcgtttttagtggttaaatctctagtgcgatgtataacctcttcttactatgcatttactacctttttagccttcgaattttagtttattttttaccataacatacaaaaccaccctcacttttgaacctgaagaaaaaactcattggtaccttttttagtggttttgtttgaaatatgggtgattttgtttcataattaagaaaggttcgatcggagacaaacacttctcataaatcgatcagtactgatccacaagccggccaagctttggcaagaaaagttaaccatggaaattgaagacaatgatttgtactggcagctggctgagtcatcccagcacacacatatataaattaaaatttatctgccataattttctagtattttttagttagcatgtctgaagattaagcacgtacggcaagtgatcgatggcataggggtaacagtgcaagttccctagaatttcctgtccacaaatgcttaactgcacatatccccgaatcttctcatatactccctccgtattttaatgtatgagacaccgttgattttttaataaacgtttgacctttcgtcttattcaaaaaaattatgtaattattatttattttattgtgatttgatttatcatcaaatgttctttaagcatgacataagcatttttatatttgcataaaaaa

SEQ ID NO: 60392 - DNA, 63784 bp, Oryza sativa
ctcgtccagtcatcccacgtcacccgccgccaccgcctccgcgtcccccgccaccgccgtctcctcgtccggttgtcccacggcgccgcccaccgccgctgaccccgtgagagagagagggagagagaggaagagtgagagagtgtgtgtgtgagagagaagagagagttgtgtatgacaggtgggtcctataatttttttaaaatagaatgttgactggactgccacgtgtactccacgtagaccaaaatcaccgcggattgggtccaggagggtaattcatcatgtattcatagttgagggtgaagaatgttccgttttgcggttcgggggtaattcggacgaccgtgatagttcgagggggtaattcgtactttttcctatatatattattctctttaactacaaaagtacaagtgcacgtgcgttgcatgtttctagctcagctctacagatttaattagagatctcttctaccggtttgaccgataacacaaaagacatgtctatatataacttcttattttctccgtccaaaatagatataatatatagttacatttatcttagaaattttgtatttttcaaagccacttctcttaaattttggagtttacttccgcacgccagctcgccattggcagagataataacgtggtctggtcctatttcgaacaaatcttaaactaacgacactgcactacacgcttgatccgaaagttgaccttaagcacctaattaattcattaattagtcggataaggcctaagaacagtttaataatatagccaacggctggctctaaatcatttatagtcaacttaatagccaatttatatattaggtatttgtaaacatatactacataattaatatctagtctcacctgtcatacacgcatgcatcttggagtccgtactataactgtctataaatctgtatgttttatcttctcgaaatctgtttatagttgatttatagtctgctagtgtatatgctgtaagcatttctagtaaggaaaaagtacaccggaggtccctcaacttatcatcgagttacaaaaatcatcccccaaccacaaaaccagatatatgacatccctcaaattttaaatccattcattttaggtccttcagtggttttgaccctgtttttatacgacgtggtggctgaatcaccatggaacccacgtgggccccacctatcaggatgccacatatcatcctctctctccttcccctcctttcccttcctcctctctctctgtatctcacttttctcctctagcaggctggccggcgggtcgtgaggaggtcgccgggacgaggagggagaggagaaggaccgacggctagcaacaggcgacgcgggaggaggccggttagggaggaggtcggttagggcgacgacggaggagcgggggcggtaggatcatagggccgacgggcggtggccgcgtggagaaagaggcctccccacctcctccctccccgtgcgcgctcgccgctggactccccactcccctcagcggccgtcccgctcgtggctgggagggcaaggtggaggaggtcaccgtcggtccaaagggaggagacggaatcggcatacctcaacctgggcgtcgccgccacctccaactctacctcctggatcgtcgagacgaagatgtggccgtgcaaatttggtagcttagcgacgtctgccggtctccaccgtgggaggaggcaggaggaggacccaacgccaacgagcgcagtggtgggagatggcggggcggtggccgtcatcgggcgacgacgcctgggcgatcatggttcttgatgacgaggtcagcaagggaggtcgggaagccagtctgcacgggggagggccggcgtgggaaggtggatggagggaggaaggtgaggaggcgaacgagaggatgcggcggaggagggagcggaggaaatcggaggcgaaggcctcggcgaggagggaggaatggacggcgtcattgtggcggtaggaggagccgtcgtctccccttcttgcgcatcggccatcgccggccgcagccgccctagcatcggccgccaccggccaccctccctctcgtcttctccggcggtaggaggagccatcgtcttgccttttcccgcgtcggccatcgccggccaccgctggccgccctccctctctcccaccttgtgcccgtgggccggcctacccaaagaagaatgagagagagagagagagagagtaaccgagtaagggagaagagaggatcaggagagatgggaaaaagagtgagtgatgacatggacacactgacatgtggggcccacgccgacttagccatcacgtagaacaaaactagagccaaaaccaccgaagaacctattgggactagttttgattagttaagggacgccggatatctggttttgcatttgggggacgattttgtaactcgatgacaagttgaggaccttcggtgtactttttccaaaatatcatgtcttggccaggcccatgcacaggcccatgaatcggtcgagccaaccttgtgataatgtgcagggttgcgtgatgataactccacatgaccacatgcgttgcagctaggacgagcgagacttaacgggaaactattttgatttgtcgagagaatatttcctcattttcttaaaaatcatgttatgaaaaattctaaaaaaatttgatgctactcatacaacatatctatacaactccacaaaatctcaggtttgaattcatctcacacgtcgagatataaaaaaacaaattcagcttatgaatagtagcatactattcacatatgcatttttttccttgagatgtacattgaatttgaatttgatttttgatgtatcgatagatatcatcgtacaactatttgtatcaaatttagaagaaaaatatacataagggatatcctcaagtgattagaatccactctcgagttaacgggcacacataataagatgcacgtattgtattgtccgttgcctgatgaaaacgaccccacgctagctttgcttgttccgcagacatcgtcctgatgatctgtgctatgaaaaatataatactccatctatcactaatcacttaccctaatccatttcccaaagcttccagtgtcagaaaagctatatcctagtatatggactctggagtagtactatgcgagtattgaaatgtatggagtacatcaatcacgcattcacgcttcgaatgaagcaaagaaaattcgagagagcaaaaattgtctacagagcacagtaacatatgtgacatgtgaacctgtgtggctgtgtcatcgagcgtgcgcagcgaggggcacggcctccgcgagcggcgtggccatcggcgacggcagcggcgagtcgcggcacaccgggcaggtggcgctcacccgcagccaccgctccacgcactccgcgtggaaccggtgcccgcacccgggccctcgccggagcgcgtcgccggccacgaactccccgaggcagatggcgcactgcgcccccgcgcacgcgttgtcgtcgtcaccgacgccgacgtgtaggaacttggggtagagcgcgtcgatggcagggccgtcgaggcctagcaccacgacggcggacgctgccggggcgccgccgtcgtcgtcgtcgtcggcgaggagcacggcagctgcgccggccttggcgcggacgcagatgtaggaggcgagcatgacggtggagatgaagacgaggacgccgacggcgatggcgatgccgtagccgaggcacacggcgccgccgacgtccgctgcggcgggcgcgaaggaggcggcgtcgggcgaagatgcgggcgcgaaggagatgggcgcgtgcattcgtagcagcagtcgcgcgtgcatttcagtgtgagcaaataaaatggaagagatggagacagcagctgcagggaagtggggcttgcggctggacagtggcacgaacgagctgcgatgcgagcggcgtatgagtcggaatggcgtgacaaaatttaaggcggagttggtagaagctgatccgaatcgattctgaatttggatggcgagagtgcgtacgtgcagtggcagtgagagtgaagtactgaaggtgaaccaggaattactcggatcacacagccacatagattactaaattacagggcttatagggttacagcaacagttgatatattcttgcgcaaatgctcaccgtgcaatcacgtggctcgcgttcatcgtgatttatgaagcaggaagaggaccacattgcaaattgcaagcttgaacaatgtaaatggagtacaatcgtaaatgaatgtaagcacaagtaatcactcgaggcgggacgacagtcgagacagtaggttgttggcatcacaggaagccacagagaagtagacaaccaactcgaatcagttcttctatgggaccatgaatctgaccacaagccccacggccctccgcgtgctgttttctgcctaaaaaatgctccaggaaacggatcataaatcgctatcagtcgaataatcactcgtataatatttgcgtcccataatttgcagaaaatgaataagaactgtactccagtttgaatccaagttatgtgccaatgctaaataacaactggagaaaaaaattgtaatagcatccgatcaagttgctgttcaacaaacaatcccacgatggcgccatgttacttgacattagcatcaatctatcctatccacccaccaaatagcgcgaatctcactgaactgcggggaccacatctaccaacattctcagcactcgacgccggcgcacgcggcgcggcggaaccctggcggcaggtccggcgcgcggctccacttgccgccggcgatgtcgtacaccagcaccatcccttccaacgcgccgccgccggcattgtgacccctcacggccgcagcgctcaccacggccgccaccctgttggttcctaggccggccatcgccacgcgcaccgccatgccgagccccaccgaccccctcggcatcggcggcgcctcaagcgccacccacccgccccagcctctgccgtcaccggcacggccggtggcgccgcaccacctccagaaggagagctccaccgcgtggctcgccaccatgtacaggtggtcaccgacgccgcacgcccccacgacgcagccgccgccggggagcgcacgggggcgcgcccaggcgccggacgcgacgtgcagcgcgtccaccgacccggcgcacacgtgcgcctcgagcgcccgcgcgccctcgccggacaccgcgacgcccccggcgacgtagaacacgcctcccgcgctcgcgccggcgcacccgtacctccgccgcggcgcctcgccgaccacgcgccacgcgtcagcctccgggtcgtactcctcgaccaccgcggtgcgcgcggacccgccggcgacgtagatccggtcgcccacggcggcagcggcgaacttcttccgcgggaagagcgtgggcgcgcacgcgcgggccgcgccggtgagcgcgtcgacgcgcagcgtcgccccgcggccgatgaggaagacatcccgacccagcacgaccgcgcgggcgtgcgcgaacacggagccgccgcaatgcagcagggtcgggggcaacggcagcgcggcgacctcgagcacgggcacggaggattcaaaccggagcagcgcctgcgcgatgcagccgttgtcggagacggagaggccgaggagggaggggcggaggtgggcgtgggcgcggcggaggtggaggaaggcgtcggaggcgaggagcgtggcgaagcggcgggagacggcggggagcggagggatggaggcgcgggggacgcgggcgaggcactcgaggaggaggtcgtcggggagggcggagattgggggtgccggcggcgacgagggaggcggcggttgcggggtggggcaaagaacggggacagcgatgtggcgggcggggtcggcggggatgcaggacttgacgagccacgagaggctgcgggagtggcagctctcggcggcgggcatggcggattgccggattgggagctcagctgctgctcggggagcgaggtgggttgtgattggacgtggggaatcgtgggaggtggagtggagtggaggggaagtcgttgggcggctgggctcgtgcccccaccttgtgcggggcgcagcaacggcgacggtggtggagccgttgcttttctttgaaattcgaaggtttgggtttaaaatttgagcgttttgaattggttaggtcagctttggcctgtaggaataacagtgtacttcactttacatcatctgatctattatatactaaaagtctattaaactttctacaaacgtcctcaaacggccacgtggactcctacaaacattcctagaccaccacgtggcactttctaataatttatagaaaaacaaagcatctcaccattaattttcatttaaattggtggatccattagtatacaccattagattagatctattggataaaattaatcccttccaccaaatctcgcgtgtatacaaacaaaatacgtaactatttcactgggaaattttaactacgtatttacgtacgataaaaaataattaaagctggcgaactgttcaccagccaaaaaacccaagaaaccatacgtagtacgtacgagtagaaaaagttaaagcccaaataaaacatgtatacgtgcgttagtgccatcgggaaaaaaggacggtctatataattttctataatataaaaataaaacatattacttctaaacatacacccatgtttaaaattattttttaaatcagatattcaatttgtgatcatattgtattcctctaattaaatgaactaccgtggacttatagtaatgatattataatgttaaatacatcacgacacataagaccgacataaaataattaatttcatgatatttttttagataatatcacaacatattttagagaaaattttctatgtgtccctaaagttttacccaattccttctttgctcccaagttttctatcgcatggaaaaattctttctttactacaaggtaatgtgaaaaatactataaaaaatattttgagtcaatgatctttccataacacaagcaccttaatccataacaaggattatgatggtatatgtatgattttttttatgcataatagttttagctataaatgaacagtccaataacatgcacattaaactactcatgatatattttattattgttgatgaattctaatatgtcgggcataatttctagatgtatgccatatcccccgctaacttgactataagtgcacttgaacaaattaattatgtaaataagtttgagaaaataaatatattcttggaattagtaaaagtttttcatataattacgaacaacatgtgttaaaagcaaattttgccaaaaaaaagatctaggtcaaaatataaataataatgataggatgctctatagattatcatcgtgatatgtctctttatatataattttttaagcacagtcgaatgatcaatcatgcttatcttcaaaacataatattgtatctataaaaaatattaaatagtactgattaacactataaacaaatcatgtctactttataccacaaatctactcaaaacgtaaataaaactatttctgtgagaaaaactatttttatcatctccatcatctctcttgtccttagttgaaggacatcaaacatggatgagaaaactttctacgttgttgtaagcgttagcaaaggcttacatttggttgagttgaggtggccctattggaggctactgttggtaatagtgctcaactttctacttaccattgtaatcctctatgagcatgccgatagtgatttaggcgttaaattgccctcaacgccaggtttaagtgacatggctacatggatgtgtgagaaagaaagcttggcggctacggcaagcttcatccgttagaggggttttacgtcaaattttaacggtgttattccattaaccagtagaagtggtattcttacaataaatatacatggatttggaaataagtgagacctgaacactcagattaatggtaaaccttttagtatattaataatgtattaggcttaattttggtgataggacatatgcaatttcatccattaaataggcccaggttttaaaacaatgataataaatagtcgtgataatatgggaatttatacataaccgggtgaacgtcatttttattagaatctgggagaaattattatcatctaacatatctagggtctatttgacaacgtagatacttttttattataaggtaataacgaaatcttataataaatatgtttttttagcgttgtgttcatgaaatagtaaataagacacccgcgcatttgtgcgggcttcctttctagtttcatttaaaaatagttttgaattggttagactagattatctgatcataatttagttgcccattctgaaatgtttggcttgaccaacacgtgaagaggaatacacaagactttacaggcagatcaacctgaccacgtacagtacaaacgattcaccgtctagcgcacatagtagcttccaaagttccaatgtgtgccattcagcgatcagcactccatcgttttttcatgccctaaagttgaacatgcaaatacacaagacaagttagtgctttatggtttatggaaagggaagggacatagagcgcaccagtaaacggtaaagtgcattgtcctgagctggtggttaatggccatcatcaaagttgatggatgcaaatcaccaaagtcagaccagattggcagtcaattgtgccaaggaaaaaaggacaacgattatggttaacacgagtgcaaagaatagaagaatgtaagaccaagtggcatcagaaagcatcacatgattcgttcaaaaaaagaaagcatcacgtgtgtggtttccgggaagctgcaaatcacctgcaaactcaactagctgcagcctccttcagatacatatattctcctctctgtagtccgtagcagcctggcagattgcagatgccagtaccaaccacaatgactcaatgagcgagcggacgattcctcctcctgtgtcgtcgcatggcgaggacttcgccgaggttgtggtggtgcgccatggggagacatcggcgaacgccttgtgcatcattcaggtcggcggtcttgtcttccctttgttcctgtcaccaataacttgtccttttcaatttttcttgagaattatacttggttgatggccttcttcagtcaatagctcttcagtcccctcgtcgtcattccatcaattttctcgagttgacagatcatcagaacaattttaacagggacaaatggatatagagttgaatgaggctggcagacagcaagctgttatggtgagctttaccaatacatttcaaataatgaaacaggattgtaatttggggttttgtctgaacttggaattctattatcgaaaaacctgaacttggaattggtgctaacgtctaaggttgctcgtcggttggctaaagaagctaagccagttgccgtgtactcctctgatctgaagcgtgctgccgaaacggctcaaactatagctacagcttgcaatgtgtccaacgtaagtacatgcattatatgctgaagcttccattttccagtggtaaacttgctatgtttctcatttgatttgctttcagctggtgttgagtcctgcactgagagaaaggcacatgggagatctccatggtttgaagtttgatgatgccgtcagaagcaagcctgacgcttacaaggctttctcatctgaagacagaagccaagaaatccctgtaactttcatccttaattttctcaccaacttcttaggcttgataatgattggcctaacattagtagatgtgtttcgaacaattttctgttttgacagggtggcggggagagccttgaccaactatctgagcggtgtgtttcgtacttgaacacaatagctgggaagcacaagggtaggcagtattgtaatattctcactctgaagtttttgtatggttgacagaatagtgaaatttgcttgttgagttagctatttcaaatctggtaagcatgctattagtaaagtgaaagctagcggtgcaaagaaaattcagaatgcacctgcacattcttatgccgagtcattcaagcagttgctcataatacacagaaaatgaagttattatgtatgctgcattggcaggggagcgagtgattgtggtctcccatggagcgagcatcgaggaactctgcagacacgccgatccaaccagctcagttcgcaggagaatcccaaacacttcgatctgcgtcttcaacatttctggctccaccggccattggattctcgagaggtttggagatgtcgcccatctcaacgaagacgacttcccgtagaatgcatttggtggcgatgaggcctctacgtagtgcctccaaccaaccaaccaaccggcttcttgggccatttcatgaatccgggcatgaactgttatctgtttgtctctcttttctctcaatttgacaattgtagaactttcgtgctaactgagtcacatcgcataactcacgaattcacaaattgtaattgcttgattgaaactagctactggacttttcatatttagtactagttaaatagtcacacattcgtgtgactataacctcctgctctgctagatgataatcaaccaaacttttggtttccaaagtatgacaatagaaacacggtcccttgtatatgattattcgatttgctggtggctttgatctggggattagtcaagcacctcagttagtggaaaaaaaataatcacgttcagaatccaacccaggcaaggaccgaagcattaactccgattgtggaatcattcataaaactaaaagtccttgaaaaaatttcaagcttaattagaacagaacatgggatatttatttaccagagaagtaagaaaaagaaaattgataggggctgaagtaaaaaacagcaggaatgcagacatgagaaagaatactgataagggccgaagtaccaaatgcttttattgctaatttggatgtcttaataccctgaatatgtgatgtcacatccgcatatcggcatgagtttcaaaaaacattctcctgcatgtgtgcgcctaaacagaattagctgcttaatgagctggggttcaccacccaggataaccttcactaagctccgccactagacggagttagtacgaaatgaaggggcagagttagtacaaaataaaagggtatcactcctttattttactttaatttggatcgagttaaggctgatgtaagtatttaagtttggacagagggtgcaaataggatggaaatatatgaagtatagattaaaaatattttgaaccgggttgttaggcaccccctcagctccactctacgaccaagcaaccgtctggtctactattcttgatccatttcgtgatttcagacatgatcaaaccatccgattatctttctcttttgcagtacaaatacaaatttgtcggtacggcagcacagtactactgtgtactagcagaaaatgaaatcaatagagttgctataaaacattgaccaaggtctctcccgctccccgctctatagatacatgtccatatcgtccgaagcttcctactcaaacatttctcaattaacctccattggattaaataattgatcttcgagttggtcttctgaagtctgcaacgcaagtccctatcttgggcaacaagaacaaacaatttggcatacatgtgccaatccatggccttacacactctttagtacagttcacaatattttagcattcatctcagagtaggactttcaattaaacagctcaacatctctgaactctgaagcgtagataggcagatagctcaacatataaaagcagtagcaaatgcatgtccatatatgtcaaccaacagcgaaagtagcaattaattcagtcagttgaaatggagttctacgcctattccatgctcctcatcctgcctctgatactgtacatgtcctaccacctcacaagaaccctagccgagaagaagcccaccacccatggcctcaaggcacacccgctgctcggccacctaccggccttcgtcaagaacagccaccgcttccttgattggtcgacggagctcatcgccggcagcccggagatgaggattggattgtggatccccgggatgcggagcggcatcgtcaccggcaacccggccgacgtcgagcacatcctgcgcaccaacttcgcaaactatcccaagggccagcacgccattggcacgctcgaggatttcctcggccatggcctcttcaactccgacggcgagcagtggctctggcagcgcaagaacgccagctacgagttcagcaagcgctccctgcgcaagttcgtcgtcgacgtcgtgcaggccgaggtcgccaaccgcctgctcccgctgctccgccgcgctgccggtgatggtgtcggtggtgatgccgtcgtcctcgacttgcaggacgtgctccagcgattcgggttcgacaccatctgtatggtggcgttcgggcatgacccgcgctgcctcgccgacggcggggtcctggaggaggccaagtcggagttcatgcacaacttcggcgaggcactggacctcgtcatcggccgcttcatggaccccatcgaggtctcctggaagatcaagaaatggctcaacatcggcaccgagcgccgcctgaagaaagccatcgccgacgtccatgccttcgccatggacattgtccgcgcccggcgccagagcgcgtccgtgaaagacagagacgacgtcttgtcaaggttcgtggcgagcgacgagtacagcgacgaggtcctccgcgacatcgtcctcagcttcctcgtcgccggccgtgagacgacgtcgtcggggctgacgtggttcttctggctgttgtcatcccggcccgacgtcgtggcgcggatcgccgacgaggtccgcgctgtgaggaaggcgaccggcacgcgccccggcgagccattcgggttcgacgcgctccgggagatgcactacctccacgccgcgctcacggagtcgatgcggctgtacccgccggtgccgaccgacccgcagtcgtgcgcggcggacgacacactccccgacggcacgttcgtccgcgccggctggttcgtgaactacagcgcgtacgccatggggaggctcgccgccatatggggcgaggactgcatggagtacaggccggagcgatggctcggtgacgacggcgcgttccagccggcgagcccgttccggttcacggtgttccacgcggggccgaggatgtgcctcgggaaggagatggcgtacgtgcagatgaagtccatagttgctaacgtgatcgaggagttggtggtcgacgtcgtcaaggaggtcgccggcgggggcgttccggagcatgtgttctctatatcgctgaggatgaagggtggcttacctgtgaagataaggagaaagggtgaatctttttaggggatggtttggtgattcttgcaactgaattaacaggagaactatatatcttagcgctgtgtttcttacttgaacacctgttgttgaaagatgaacgcttgtgccggtcgtttcgaaaaaacttctatcggtagcgtgttaccacttactccctctctcattttaaatgtagttctgattttttttttcaatctttgaccgcacgtcttatttaaaaatttatatatttttttaaaataagtcacacataaaatattatttatattttatcatctaataagaaaaattttaaataggattgacggtcaatattagacataaaaactcacaactgtatttaaaatggaacggaacgagtaccactttccttatacggttgtgttcagcagtggattttaccgggtttgtgcacgaggaaaacgtggtctcttgcttttcactcatcagattttgtttattcgtactgcgtcgccatccttggatagtggttacaaatactgaaatgacccaatagctgatgttacgtgtggtccggcaggacatatgcgaggcactgttcgtccaagcattcaggccgcagcacctggtccccggtggctgaggctagcagccaccctccgccccatctcgccggcgacggcggctgtcaggtatcctctgttccctctcgcctgcggccatcaggtgtcagctgtcaccatggcgaaggaggtcgatcggttcgtggagctggtggttgtccggcacggcgagacgtcgtggaactcctcccgcatcgttcaggtcggtagccaacaccaagcatctgttgctttatccttctgacgattcgttgtgttggaaaaatgaaaatacatactcctgatagaacactgaacttctgcaataggggcaaatggatccagagctgaacgagattggaaaacagcaggctgttgtggtacgatacacactagctcaaaatttcgaagcagaaccaccaatatgtggatttatggtattaccagcattggtagtttaatttgatattttctgtctgaatgaatcgatctgatgcgaacttacaaggtggctcgtcgtcttgcaagaaaagctaggccagctgctatatactcgtctgatttgaagcgtgctgctgagactgtaaaaatcatagcaaaagtctgtgatgtatcaaacgtgagttcttctagcctaccttttcctgctttctcctccatgagtaacaccaataatttgttccagttagtgttgattgaagcactaagagaaaggcacatgggatatctgcaaggtttgacgtgggatgatgctatgaataaaagcccaggcgttttcaaaggctttgctaattttgaagtcaaaaatggtttggactttgatggcagaaaccacgaatttccggtaagttccaaaccgtattttttctttggaacacttataacccgagaaatgtaactttgtctaggtctgttaaatcagaagtggagtgagtgtataccattttgtagcactagtactatataacttttgaaaagtttatcattgtttcaaatgatgtttaggatggtggagaaagtcttaatcagttaagtgagcagggcatctcctacctgaacaaagttgctcagaatcatatcggtaagtatcaaactatcataaaaaaaaatcgaacttttactccatttcatttgtgtatgccattgtacaccttatcctgacaagctgctatcctggaaccttaaagatgttttgctaatgttgcattgacaggggagcgggtgattgttgtcggccatggtgctgccatactagaactctgccggcacactgatccacccaacagctcgattcgtaggaaaattcccaatacttcactgaacattttccgcatttccggcgtcaccggccggtggatccttgagaggtgtggagacgtcggccatctcagtgaaaatggctttctggagaacgcatttggcggtgatggagcctctgcctaacacattcagcgactcatcttgtcagtgtattcagtgattcaatcacccatgacttgaagtctgaaacatttttcgtttttctgattgctattttcttcggtgtgataatcatgatgaattgatcataaactactcgttgtttcgtcgtgttagctgtatatcaatctgcaaaacaatcgcaaaaaggggggaaagatgcaaatctgaagggaaaaaaaaggctaattcggatgtcctcccttagactgaggaccggctctctgccgttggatgatcttctcggtactgtagcattgcaattgaacggttaagattgcgtttagatcgtcaggtcaggagcgtctctgctgttttaaggccggcccatcggttgctgcttctcgcctccgcgtttcctcaccccgccgccgcagccgcagccgccgccgccgccgtcgccgtcgccgtcgccgtcgccgtcgccgtcgccgccgccgcagccgcagccgccgtcgccgtcgccgtcgccatcgccgccgccgcgtcgtctgcgtttcatgttcaggctcctgccccgcatcaccccgctcccgcgccgccgcctccgtcgcagccacaacccaaacccactaatctcccccgccgtcgctgcttccctcgccggcgtcctcgccacccgctccacgaaccccacctgggcacggtccctcgcggcgctgctcccctccccgctctccgacgcccacctcgccgccgccgtctcctccctgcccgaccccgacctcgccgtcgctctcctctcctggtcacagtcccccgaccaccatgtcgccctccaggaccctactcctctcgcccactccacgctgctccgcctcctcgcccgctcccgccgtttcgacgccgtggacgacacgctccagtctatgtctctcgcgggcgccgcgcccacgcgcgcctgcctcggcgcgctcgtcgccgcctacgccgacgctggcatgcttggaaaggccaccgagatgtgcgagcgcgtaagggagcagtacggctcgctcccggaggtgacccattgcaaccgcctgctcaagctcctagtggagcagcggcgctgggatgacgcccgtaagctgtatgatgaaatgcttggcaaggatagtggtgcggataactacagtacttgtgtgcttgtccggggactgtgcctggaaaggcgagtggaagaggggttgaaattgattgaagcaaggtggggagctgggtgcattccacatgtagtgttctataacgtcttgatcgatgggtattgccggcgtggagatatgggtagaggattgttgctgttgggggaaatggagacaaatggattcttgccaacccttgtgacatatggttctcttataaattggcttggaaagaagggtgatctagagaagattgggagtttatttttggagatgaggaaaaggggattttcccccaatgtccagatttataacagtgtcatagatgctttgtgcaattgccggtctgcaacacaggctatggtgatcttgaagcagatgtttgcaagtggatgtgacccagatatcatcacatttaatactttgataactgggctgtgccacgaagggcatgttcgaaaggctgagcattttttgagggaggccatcaggagggagttgaacccaaatcagcttagctacactccattgattcatgggttctgcatgagaggggagttgatggttgcatcagatttgcttgtggaaatgatgggcagagggcatactcctgatgttgtcacatttggagcactaattcatggtcttgtagttgctggcaaagtcagtgaggctttgattgttcgtgagaagatgacagaaagacaggtattcccggatgttaacatatacaatgtattgattagtggtttgtgcaagaaacgcatgcttcctgcagctaagaacattcttgaagagatgcttgagaaaaatgtccaacctgatgagtttgtttacgccacattaattgatggattcattaggagtgagaatcttggtgatgcaaggaaaatattcgaattcatggaacacaagggtgtctgccctgacattgttagctgcaatgccatgataaaaggttattgtcagtttggaatgatgagcgaggcaattctatgcatgagcaacatgagaaaggttgggtgcatcccggacgagtttacatatactacagttattagtggctatgctaaacaaggtaaccttaatggagctctaaggtggttatgtgatatgatcaagcggaaatgcaagccaaatgttgttacatactcttcattaataaatggatactgtaagacaggtgatacagactctgcagaaggcttgtttgcaaatatgcaggctgaagctctatctcctaatgtggtaacttataccatcctaattggtagtctgtttaaaaaagacaaagtactcagagctggtttgtactttgaaaccatgttgcttaaccattgttctcctaatgatgttaccttacattatctagtcaatgggctcactagttgtactccttgtgtcatcaactctatctgctgtaacactagtgaggtgcatggcaaggatgcccttttagtcgtattcaagaaattggtttttgacataggggatccaaggaattcagcatacaatgccatcatcttcagcctgtgtagacataatatgctcagggaagcattggattttaaaaataggatggctaaaaagggctatgtgccgaatcctatcaccttcctttcacttctttatggcttttgttctgttggaaaatcagtgaattggaggaccatccttcctaatgaatttcagcaagaggagttcgagataatatttagatacaagtttttgtttgaccaatatgcaactgagtcagtttgctgtgaagtctccagggttttacagcatcttgcagggtgtaaatccttgcagcgtgtggagcagaaatttgctaattcttgatgcccgtctacctggctcttgtaaatgagggagatcatttattcttttgtttggccagaaaaatcaccagccaaattcattatgaaagaaaggagagtgtagggtacaaagttactgcaacaaggttgttgttacggcttatttgatttttttacttcagcaactggaggttgaaagatcaggaacgttcatagtaccatctaactggaggagtggtattaatatgaccaaatctcccgcagagatctccacccaaaggtattaatcttgctatgactggtcatatgtgattttagattatgcttgaatctttgatggttgaagactcaaaagtttttctgacaactcaactacaggaaaattgaacattagaacttctaaaattccatgtgctagttccccttctttaaattgtttactcaactagacttgctagaggaaacaaaaaaaacatactactggtgtcctgtttctgtaaacatagttatcttctcattcacaattcattggcatcattcgtttggaattacatgtgaaaggaaaatgttgcattagtttcttgtccatgttgatgctgtgtctgaattaatatttgctgttgttctcaaggtcgttagtaactaaattatagtatgtttttatgttgcagtaatcattaacctgtaactgaagtcatcagtcgacattgattttttttttcattttactctgttcaattcttcagtaacatatcaataaatgtaagacttatgaaacttcgaattcgtactggtatagagctttcgtgcttgcactttagttgcctgtcaagcagaagcaatgcttatgagattcttactgaaaaataaataacttcttgctgcttttcaggtgaatttatttaaccctatgacttttccatggttagtgtctccaatggccactcaactacagttgatgctattgtgacactgcaagcaagattatttggcaggatgcgcaggtgtaaatcagactgcaatgtcgcttaagcgcaggaccgtcgtagcaactgcagctagatcatactccctccatcccataaaaaaccaacctaatacttgatgttgacacatcatagtattacgaatctagacatatcgctatccagatacgtagtattaggatgtgtcaacgtccagtactagattggttttttatgggtacgcgatttagaattttgttgtccttctatcattcggtataggcgacggttgcagacttgcagatcacaacaccctccgtcagaccatcactcagtaagtatgcaggtagtttcttttagctttaggtgtaggagtgcaggacattgtatagcttacacgtaattttacatgtacaaacactcgttggtatcatgacaaatctggaaatcttgccgtcttgctcatctagaacaatgccattacaaagttttttttatggccatgaccgacattttgggtgctgcatcatcactatccactataggagtcccatgtctcagtattttgtgtattttctgcacaaatctgctcaaatgtgtcattagttttctgcacaaatctgctcaaatgtatcattagttttccgcagaaatctgctcaaatttatcattagttcatcagtaatgtacttacagtattcatttggcagtaagaacaacacctgaaagttggtcaaatagttgcttaaacaggtctatttgtgtcttacatggctgatttcaacttgttaaatttgtacaatacagtgatacgccatccttttattgattaattggcatcaattcaacccagggcaaatcatttttctgccgctgtagtccagtaggaaatggaaaacggccaaaaacaaccaaatcacaaacgttattcttaacccataagctcaaaacgaaaagagcaaaacttgaagcttaactaattatagtaccattcagcggcaaagtacccttgtggccttctctagtaagcttcagtctttctcctaatcttcacaggtagtccacccttcatcctcagcgtcaccgagagcacgtgctccggcacgccgccgccggcgatctccttgacgacgtcgacctcgaactcctcaagcacgtttgcaactatggacttcatctgcacgtacgccatctccttcccgaggcacatcctcggccccgcatggaacaccgtgaaccggaacgggctcgccggctggaacgcgccgtcgtcgccgagccaccgctccggcctgtactccaagcagtcctcgccccagatggcggcgagacgccccatggcgtacgcgctgtacgtcaccgaccagccggcgcggaggagcgtgccgtcggggagcgtgtcgtccgccgcgcacgactgcgagtcgatcggcgccggcgggtacagccgcattgactcggtgagcgcggcgtgaaggtagtgcatctcccggagcgcgtcgaacccgaacggctcgccggggcgcgtgccggtcgcctccctcaccgcacggacctcgtcggcgatgcgcgccacgacgtcgggccgggacgacaagaaccagaagaaccagctcagccccgacgctgtcgtctcgcggccggcgatgaggaagctgaggacgatgtcgcggaggacctcgtcgctgtgctcgtcgctcgccacgaacctcgacaagacgtcgtctctgtcttgcacggacgcgctctggcgccgtgtgcggacaatgtccatggcgaaggcatggacgtcggcgatggccttcctcaggcggtgctcggtgccgacgttgagccacttcttgatcttccaggagacctcgatgggatcaaagaagcggccgacgacgaggtcctgcgcctcgccgaaggtgtgcatgtactccgacctggcatcctccatgacactgccgtcggcgaggcagcgcgggtcgtgcccgaacgccaccatacagatggtatcaaacccgaatcgctggagcacttcctgcaagtcgaggacgacgatatcaccaccacgaccatcaccggcggcgcggcggagcagcgggaggaagcggtcggcgacctcggcctgcacgacgtcgacgacgaacctgcgcagggagcgcttgctgaactcgtagctggcgttcttgcgctgccagagccactgctcgccgtcggagttgaagaggccatgtccgaggaagtcctcgagcatgccaatggcgtgctcccccttgggatagttggcgaagttggtgcgcaggatgtgctcgacgtcggccggggttgccggtgatgatgccggtgcgcatcccggggatccagaagcccatcctcatctccgggctgccgacgatgagctccgtcgtccagtcgaggaagcggtggctgttgttgacgaacgccgggaggtggccgagcagcgggtgcgccttgaggccatgggtggtgggcttcttcttgtcggcgaggattcttgtgaggtggtaggagacgtagagtatcggagggaggaagaagagcatggaacagtagtaagagtccattgccattgatcgacttggtagcaagctggttgatggaagaggagtgttcacctggcattatatactgggacactggatctccaaagcaatttataattgcaatgtcaagtcgattaaacttctatcaatccactaattaattactttgaagatcaatgcaattcttaaattatacgtatattgtgaagaaccgtgtgcctgaccatgatagggataggcacatgagtggcaagttgtttcggcttgttagccaagacagggccttgcgttgcaggcaatactagttaaatccagtggaggataagaaatgttttaattaggaaccttctgatgatgaactgccctgctatacatcgatgagaacatgattctacttctatatcgatggcaatatgcttacaagttacaaacggatctgttggtgaaccgaaacataaatagcatcatcagcagctttgaacctgctgctgcttgggcagcgcgtagcggcagagaggacagaggcagctttcgctgagccaacggaagaggcagatctcgtggaaggagtggttacacggcatcgtcctcagcatgtctttctcctcgaagtccctgaggcacacggcgcactcctcctgcctcgcgtcgcacgccttcgtcagcgcgaggcccaggaggacatctcgcgacatcttgcatcggggcatccccgtcggcggcgcggcgacgtcgtcctagcatgggcgaaggacgaggcctgatcactcggccagcccagtacacctctccctggtacacccctcgacggaactcttgtagcatgtcgcggatgctccgggcatcgctgttggggtcgattcctaggcgttggagcgtgcggtggaatctcatcggaactcgcgctgccgccgctgccggatccatccatctcccggcgctacggactacagtgtggatactagggtcgacccccaattctcggagtaggtcttcgaatttttctgccgcgtatggatcagaaagtggcgccgccaactgcgccgccgcccgagaatccatcaatctgcgagccggcggatccatcgcctgcagcagtcagaccagcttttgcgttgttgcaacaactggatgagtaccagattttattatagtggacgatgtgaggcacaacgagattgattaggactcggaatcgatcggagtcggagtaatccattcccgcgcgcagcacagcgcggcgcgtgccacgcaatctcgaccactgtctacgtatacctgcttcatctgaacgtatatacgtccggttcctagtactcgtagtaggtatttttgtctcccgtacaactgagacccctcgcacgtatgcacggttgaatttctggcagctcaacaaatcaagcattgcatgcctcaacagattggcacgcgtacgcacacttcaaatgttaatagcaacacagctgagctagtgacatactgacatatatatacgcaagtggcggctgccgtgctatatatacatgaaccactgccaccatctatccatcacacaaaagcatcatctatctatctaaccagagtgataaaatggaggtgcaggtgaagaggagttcggtcgtgccgccgccgccgcgcgagacggaggagacgccgctcaccgtgttcgaactcgtcgcgccgacgtaccacgtcaccgtcctcttcgccttctcgccgcccaacccgaccacccgcgccctcctcgacgctctctccgccacgctcccgcacttcccgctcctcaccgcgcgcctcgaccgccgcggcgcccgtcgccgcccgttcttcgtcacgggcagaggtggcgccggcgcactcgtcgtggaggccgaggtgtcgtccgacctcgctgaccacctcccgctcgcgccgtcgccggagctcgcgcgcctccacccgccggtcaacacggacgcgccgacgccgcatgtgctgctggtgcagatcaaccgcttcgcgtgcggcggcctcgtggtcgtctcgtcggctcaccaccaggccgccgacgggttctccatgagcaccttctttcacgcctggaccgacgccgtccgtcgcaacggagctccgctgcttgaccgacctgtaccgtacggccccggcgcgctctcgccgcgccggccgccgcggtgcgagttcgagcaccgcggcaaggagttcttgccgcacgacggcgtcacgagcaggcaaggacaaggcgccgacaccggcgccgtccgcatcgacccttccgaggtcgccaacgtgctgctgcactacccgagcgagttcgtcgccgagctcaagcggcgcgcgcagggcaagtacaccacgttcgagaccgtgtcggcgcacgtctggaagaagatcaccgccgtgcgcgggctcgacgccggcgcgcgcacgtcggtgaacgtctccgtgaacggccgcgcccggctcgggacaggaaccgtgccaaacggcttcttcggcaacctcatcatcaacgcgagctccggcccgacagcgagggagctgaccaccggtactctcgcggacgcggcggcgctgatccgcgcggggatccgcgccgtcgaccggcgctacttccagtcgttcatcgacttcggggcgctccacgtcgacggcggcagggacgaggaggagccgcttcagccggcgaacgtggacgagcccggcgtgctgtcgccggacgtggactcggacagctggctgcacctggagctgcaccggctggacatggggctcggcgggcggctcgccgggatcctgccggcgaaggtgccagaggacggggtggtggtggtgatgccgagcctgaggaaaagtggtggggtggaggtgttcgtggcgctgtgggagaagcacgcgaatgagctcaccagcatcgcttacaccatggattagtgaaacactaaccaagatgtagctgcctaatcacgcatgtaataataacaacctatctgattactactcatgtatactactcaagtatactgctgcaattaacgaatgtgtgcgtgcgtaaataaagaaaaggttatcttagaagtaatcagcgtaattgaatccgaatccgaatccatcacgatcgacattctagttgtgcttcactcacacccgtcgtctataaattgtacaagcatctatgatctatctatctttcccaactcacagctagtaacaagattaattgatggattcaccggcatcgtccacggaggcgatggcactgggaccatctcttcctagttaacttaaccgagagaagaatcagcggcttgccaccaccaggcttccgcctaaagttgcatcgcggccagctattctgggtggctcccttcaaccaggtgtactgtgtgggacgaccagatcggcctcgttggccgacacgcatacggccgcgccgatcagggccggcgaacgacgccgatcagccgccgccgccgccgtgcaagcgcgctcgacgagtaggcacggtgtcgctcgatctcctcctgagcctggtccctacgagggcggccgacgcgagggaggagacgtgcgccgtgtgcctgagggacttcaaggagagagacttgctgaggacgacgccctgcttccacagcttccatgagcgctgcatcttccgtaggctcaaggatagcagcctctgcccaatttaccgccatgttctgcccaagccgtaatatgatgacaacgatgatatttatgttaaaattgactgataaattaatcctcagcaatgagaagaaaagaagcacattgccatgtcgatgtgtttagtgtttatttttctcttcaatgtgtataatttgtagtgtagtggagtgtgtacattgccatgtttatttcagctcacttcttatttttgtcaatgatgggtattgctaacactgtttttttattttgtcaacactagtaccagacgacgaccgctgcatgtttcgcgggctctgatgcccaatcagcagcaggatgatcatgctctaaatagaggttgaaaacagtttattacccacacacataaaaacgaaaaacatgattaacatataattaattaagtatttttagtgttagatgatttaactgtcaacaacgagacgctcgtggtgacttcataaatctcaaaatatatcggcctagtcttctgaaggtggttatagggataggatgtgtatattcaattggtgagtgtgcgcgcattgtgagcgtctgcatttgtactgtgtttctaaaaaaaataagtattaattattaaaattttaaaatgaatttgtttattttttaaaaacagtttatatagagagaaaatttgcataaaatatactatttagcagtttaaaaaaatgctaacaaaaattgaaaaagtagcaagtcaatgcctacctgcaagccacggccaacggctgatgaaccactgctcaaatgatgatttttttggggggggtctcaggctctcagctcaccaacaaatcaatcttttgcagtgggcagcagcttcttgattgctttgttttcaacagcatttgtcttcccaacaatgtaaaaatgtattcatggattgaagcgttgaacaagaacgcgttatgcatggatcaatgaagattcaagttatgattgtctcctgccttttggtttaatgtacacaaatatgctatacaattaagttccatgaaatgtacgtacgcatgcgcagcgtctacagggcgatagtaagtaattaaacaggctatcaagtcaaaggaccacatatatctgaaactgcagttttgtcaatcaccatgtaccagttttaaaactagtcatcacaatataccacatcatcgccatcatcaatttctggtgttcactttactattgctatgcacaagcaaagtttagtacagtctatcattcaatattgatcatcagcaactgtagtattttactactttagcaggatatacatctcaaaatgcttttgtttctcaaaaatctccaaaagcttgaaatggaaaatgtagtatggcagaatgcatcttcacttgattctagtcaaactagtttcatgcgcagtgcaggaatactatgctaaaccttccacacattttgcacttcccactcaattggtgatgatgtatcaaacttggagccatcagtcctactgtcctagtgtttcaaacttgaaccttagcacattctacattaaggaagtagcaagtcttcagccctctacccaaacaagatcatcatcatcatcatcatcaattgattcttgggtctccacatccagatcagccaacttatatacctctcctatattccctacaaacacattagatacaaagccaacacattaaaagataaggtgaaggttgacatgttaaaaaaacactgcaccagtgagctttccgttcaaaatattatatgactaacatttttgagaactatcatcgcaatcacataaaccaggccatatcattatctaactcaacaacaagtataagaaactaaaaaatggcggtaatatcatatacatttcaaacaatgataataaacaattacctttttataaaacgaagtcaaggggtatgtaattagattagtagaagggtcaataaaaagctagactacagctagaatggttaatgattaatattttacagaaggttgtttttttttgttgtgtgtgttttttcatgtgaaggctaatgccagttggtggttcgggtgatggtgggtgctgctcccttccccgttcctatttttctcccttactaatgaaatgacacgcaactctcatgcgtattcaagaaaaaaacaatattttacagaaaattttttggctcctatgtgaaattatagataggaacacaagttttgatcaagaaatacctgttggttgctccactttcatttcaatgccatcatcaccagagtcaccaccatcatcacgttttgatttggcacccaaccgcctctcaaactgtgcatcagaagcaaatggctggtcagaaatacatgtaaggctttcttcttgtatcatccttttgtcctcatcttcctgccttttctggatagcctcataataagcttttgcatatgcctcctacaccattaaataaaaggtgaatttatatttaacattcactcaactagctagttcttgattgtgaaacttataattgatattgaaatgcaaattttatcagctcacctgtatgctcttcatctcatctttctctgagagctgtttcttgtcactcttggcttctgaactttgatccagatctgcagtgttgctgatttctcctttatgttcccctgtgaggactgtactcttacgattcatccatgagggctgtggctttatactttccataccagattcaacaccttcctgtgctccagtacttcctaagaaattaacttcaacctggaaaggagaattggattaatcaggcagtgcaatatctagtttaaatgaagtaattagtacttacaggggcaaatcctaataatcaaaccatttgattccaatctagaaaggcatgagatgtttcaggaagtatagaagttctaacagtattcccagcataacaccatggtcatgttatatgcctcatcaatgttgcctttattggcttcacatttatctaaatttgcacctttaactactaacgtatacaactcaatgcatataccaggcttacctctgtttccccaaggaagggcattggtttactgctgtatcgcccttctgaattctgagatgaaccaactgcaccatttgcagatgcctccatagttgctctttcccaatcttgcaaactcataaaagatggaaaaggaagatcctttaccctgtcaagtactgctattaatggcttcaattgctcctgcattcatgtatgttcaatgttagagcagaaatctacaaaacgaaagcatcacaatccacactatcatcaagattccagaacatgcactttgccatccatgtttaagctaaaaactaccttgcagtcagcatcttgaggggcacgcttagccaatatgggagaacatacaccgttatatttattttatatacgagatataaacatatacaagtgatcagcgaagtgatgcttcatagatgacataaccaatctatagaaatatttccatctctgctatagatattgaaactatatatatggttcatgtcaaagaaagtccttctcacaacaatgaaatgctatattgttatcgtgctattatcacaaatgcaataatggttaaatagatgttaaattatgtattatctaagtgcaatgtaaaaaattatagaaagtttatgcacaatttactggataacaatctgattattggccaaaatgcagatacactaatttagtctttctgacaaaggcgaaacaaatttaattgttttccaatagttatagtatgtaagctgtactaaaaactgaacaattctaacatcatttatgtttgatctatgctcccaaatttggaaacaaatttctaactgaataaaaagtaataacctccattctttgctgcatatcctttagtttatcgtgcttatgctttattgcattgtcaccaccacacacaacttcatccaaagtaagcttttcactttctggaagaagttgttctttgcaatgctcacagtgaaaatagtcatccatatcgcttacaagttgcagtgcatcaaatgctgaatacctactgtcggtgacatgggaccgggagtatcatgacttagagacttgaggcagacacgatcacccacgtggcctaaccccctcggggggggggggggggtcgggcccgagggtgatacggccgcccttctctttgtctccccgaggggtcggaccgctcccgcctcggccccgagggccgaggcgccccgaccccttgtgggttttgcgccgcgtgtatgggttaggtgagcgcagcggggctcacctaaccgcatttattgcggtttgggtgagcacgtcacgccgcacgtaatgcagtacagcgcgctcgtttatccggtctgtgactggtcacagaccggtcagattgcgggttaggtggcaacaggcgatctgacacacgcctcgccccgtcccgtcaggatgagagtctctaggcactcgtccctagccagagccagcgtgctagctcctggagatggcacgttggtcctggtcaggtatatgccaggcttcatcccaaccattacaagcaagaaattgtatgaagaagggtggacatgcagattgctaaactgacgcgtggtggacaagaatgaccgatttgtgaccggtctgacactggtcatgtcgtcggcaaacagctgtgttcccacgtcgcgcctgcttccggcggaagtggaggtaggtatgggccgtcccatcagaaggtcattcggacggcaaccatacaagtctccgtctgtttaagaaaagataggataagtccccacaaaaaagagagagatggtgcatgtggtatccccttgaggtataaaaggaggaccttgcccacttagaagggggattgattttttgggggggatccagaacgatcagagagggagagagtaagagctctctggttctccagctcttttgtagcttcttcgtacatagattcaccaaaacacaggagtagggtattacgcttctcagcggcccgaacctgtatacatcgcccgtgtcttgtgtgtttccattatcgcgaaccttccacacaccgagagcttagaatctcacccagggcccccggccgaaccggcaaaggggggcctgcgcggtctcccggtgaggagccccacgctccgtcatctggcgcgccaggtagggggttctgcgtgtgttcttctaagctctcgcactctttcgtgtgcgccaagcttttcctgttcagcccaatggccgaacaagcaaaggcgcacaacctctctccgagtgttagcggtgacgacggggagccgaacccacgccgtcgagctcgtactccaccctccacgccaaagtcctaggcaggaggaggcgctcgagagggtcaaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcctattgtccctgacccggagtctccagcccaacgttggctggacgacgtggccaacttggtcatgacggcacggcagcgcctaggtgctggtgggcggtcctccgccaccaagacctctggcgctgctaccaccggctccgtatcgtcaaggcggagggcgcggcgagcggcggctgttgctcgccattcggccgccactccttcgtcagcgcctccgacccaggaagatctgcgtggggggccggatgcccgcatcagtatcgagcgccggcgtaatggccgacgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccaccagcgccgaaaaatatgacgggagcgtcaaccccgccgagtttctccaggtctacacgaccgggattgaggccgccgggggtgacgacagggtcatggcgaatttttttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcgctcatacattcagcggttctgtcaagtccgcaacactataccatgcatccctgcacacgcggtgatctacgcgttcagggggggtgtgcggcacaaccgcatgctcgaaaagatcgcctccaaagagccccagactaccgcggagctttttcagctcgcggaccgagtggctcgtaaggaagaggcatggaactggaacccctccggttccgatgtggcagcttcggccgcccccggatccgctgctcggacagggcggcgtgacaggaggaggaagaagaggtcagcccattccgatgacgagggtcatgtcctcgccgtcgagggcgcttcgcgggccacccgaaaggggaggcctgcgagcgacaaaaagaaggaggccggcgctcccagtagggagcgcccaaccggcaagtggtgcatcgtccacaacacctcccttcatgacctcgcggactgccgcgcagtcaaaagtttggctgagcggacgaggaagtgggaggagaggaggcaggagcgccgagagggcaagtccccggcggttccttccggcaatcggcgaagtgaggccaagcagaaggaccccgccgaggacatcgatgacggcgatgatgacctaggtttccaagagcctggggccaccattgccactgtcgatgggggagcgtgtgctcacgtttctcaccggagcctcaaggccatgaagcgagagcttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatgggggagcagccctcaacatcctttcccccgcagcctttgacgctatcaaggccccggggatggtgccccggccgtcccagccgattatcggtgtgacgccgggtcacacttggccgctaggtcatatcgacctcccggtcaccttcggtggatccgccaacttccgcacggaacgggtgaactttgatgtggcggacctcagtctgccctacaacgcggtcctagggaggcccgcgttggtgaagttcatggcggcggtccattacgcctacctccagatgaagatgccgggccccggtggccccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgggcgacgacccgtccaagaccacacggatcggtggtcttctggacggcaaataggaagacgcgctcgtctctttcctgcgggcaaacgctgacgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctagttaccatcagattcgcatggctagggaggatgaggaaaaaactgcattcattacccccataggaacttattgttatacgacaatgcccttcgggttaaagaatgcaggtcctacttttcaacgtactactcgaatttctttgggtagccaaattggacgtaatgttgaggcttatgtcgatgacttggttgtaaagacgcgcagccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcatcggttgcatggccgccctaagtcggttcatatcgaggctgggagagaaggcgctacccttatttaagctcctcaaacgctccgggccgtttacttggacggaggaagctgaacgtgccctcactcagttgaaggcgtatctcagctctcccccagttctggtcgccccggagccaaatgaacccttgctactctacttagcggcgaccccgcaagtggttagtgcggcgttggttgtggagcgcgatgaggacaatcctcattccgcgcacccccaccctgtgctggcttggcctgggagagagcagggaggagaggcccccgagccgaacggtggcccaaggcccccgacgaccggagcaggccctctgcccgcttgtcagacggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggccgcccctgtcgtcctccgacctcgaggtcgtcggcacagaagacgagtgcaccccgtgaggccgcttggacaaagagcgccccggggatgtggcccctggcgaagaggatcggccccaccgaaaggtgcagcggcccgtctactttgttagtgaggccctccgggatgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtaatggacgggtggtgaaatgggcaatcgaactttctgagtttgatttgcactttgaaccacgccacgctatcaagagccaggccctcgccgattttgtggcagagtggaccccagctcccgagcccgtctcagtccccgaggccagctcgggcccctcgcagctgccttacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggtgtatggagcgccattttgacgggatagagcttcggcacgtgcccagacgggataacacggttgccgacgaactctcacggctcgcttcctcgcgggcccagaccccaccgggcgcctttgaagaaaggcttgcccagccgtcggcgcgaccccaccccttaggggagacggacgcgcctgacaggcccccgatgcccgtcggagtccaggcctcgggacccgaggggagcgctcccagctcccttagattgattgcttggatcgctgagatccaagcatacctcacagataagactctacccaggaccgcgaagggagtgaacgcgtccagcgcatctccaaatgctacgtgctggtagaagggaccctctatcggcgcgcggctaacggaatcctcctgaagtgcattcctcgggaacaaggcgtcgagcttcttgccgatatccatgaaggcgaattgcggagcccactccgcctcgcgcaccttggttggcaaagcctttcgacaaggtttctattggccgacagctctcaatgatgcggtcgacctggtccggcgatgcagagcgtgtcaattccacgccaagcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccacgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgatgacctcgtcctacgccgcgtccaaacgcgtgctggattgagcaagctctcaccaatgtgggagggtccgtatcgagtgatcggcgtcccccgggcgggctctgttcggctggccacgggcgacggcacagagctgcctaacccgtggaacatcgaacaccttcgtcgcttctacccctaaagggggatcgggtgacaggtttccggctcgggccaaccccgcacccccctcgggcgtgcagggttggccgggggctaccacatatgcatattcttatttctcttatatctatatttcaataaaagcattttcgatttcctaaaggctgtatctgtgctgttgtttccttttgaaggatcttgacttgaaataagtcactcgtgttcaatcctgccctcgggggctcgggtcggctaaaatcgctaaacggggcccagaaccgagccgtgccccggggcgtagtgaactccgggggggaatcggcaaaaacccacaatcgggtcacccataaccctcggtcaccacgctcccggcttggccagtctcgacatgtggatctccccaggcactagccccgacccgagccatttgaggactaggacctgggcacgagcccttgttcaagccaagacacaaaaggaccgtggcacagacatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcacccgggtcgccagcgtcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatctccaagaggcgctgggcgaggcccccctggttggcggcgtacttcgcagtccgcccgccccagaggcccgcctgccggccggcgcggtctagacgggagacggcgtcccgaagcatgccgggccctacctcgcctgccaagcggagggcctcgacctccccagcggacgagtctagcgcgccctgcagatcggcgatggtgtgttcggcagctgcgaggcgggcggttaagtcgctttcgcccgcggccgccccgccactgcgcaccctcgcgtccagccccttctcccgcgcctcgagctcagcggcccgctggttcagcgcggccctctcggcgcgggcaccttccagattacgacgcgcctgctcctcccgcactgcctcgcggagggacaggctgtccgccagccgttgcgccgcggcctcggcctcctcgagagctcgctcccgctcggtgagcgcgtcctcgcggaggcggagcgcggactcctcttcggcgcaggcggcctcgtgcgcagtcagcgttgcctcccggatggcaacggcggcctcgcgatccgccaggtccctctccacggcgcaggcacgctcttccagcgccatggcacgggcctcaagggcttcttcgcgccgccgggatgccacctcggtctccgccgcccgccgttctcgggcagcggcaacgtcaaggaccccccgggcggcgtcgagcttcttccctagctccgcctcctagctcccgtattgaaggcggagggtgtcctgcgcctcgttcatcacggtggtggcaatgagggcagccccccgctcctcctccacctccttggcgatctcccccagcatcttccgacgggcttcgagctctgagacgtgccggcgatgtgccttgcggcccacctccaccatggcctccaccgagcgacgcccctcttcgacacgtgcccatgcggtgtcgagctccacccgctctgcttgcaaggcctccatctgggcacttaacccgtccaacaccgtggtgtttgcgacggccaaggcctgcagaaggggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcgcgagttgcctcggaagtcgtcgtcgcctcggcctggcgaagtctggcctcctcccgagcggcttcttcagcttggcgagctcggacggccacctgggcagcttcctcggcttctcgaaggcgatccgcggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccgcggcttctcgccgatcagattcccgcctccgggcctctgtggtcgccgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggagccgtttcttcttccgctccccctcgggctgcgacgtcggcgtggccccctccgggcgcctgctgctggcacgcgccgccccgccccctcggggaggagatgggggaggggttccttcctgcttcctcttcccccaggcgtcggcagggcggccgctccccgggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatctgaccccctggtgggtcctcatgaagtcttcggacccggtgtactcccaggcgccccgggcgcgccgctggagtggcgcgatccggcgacgaagatagtcgccgaacaccatggcccctgtgagcccctgggatcgcaggcccaccaggcggtcgaggacggcgtcgtagccatctcccagatctaccggcgcccgccagttggaggcctgcgctggaggctggctcggaagtcggaggcgcgcttcgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgcgaagatggccaatgtcattaccgcgttgggggtgaggtgcgccatctggagatcgtaaaactccagaacatccatgaagaaagaagaaaatggcggaaccagccctgccatagcaaaagggaggaagaagacggaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagttagggcgcaagcggcgaagacaaggggaataatggcgagaggaaggaagcaaatctcttcctcggcgactttatacccatgccaacgctgtgcccggctcctcgtttctcgcgcccactatcttgccccctcgtttctcgcgcccacgcttccactaatcccattcgcccgtttgcggtgcatgaggtggatatgcggctgtggcagtcgagatggaacatctcgtgcgcgcgttaattacgctcgccgaccgaagcgccatcaccatatctccaggaaaaacgaaccggcttgtcccgatttttagaccggccccacctgtcatcaggccttaggaagtggcgtcacgcccgaccgcttccctcgaggagggcgatcgccctggcataacgccgggggctactgtcggtgacatgggaccgggagtatcatgacttagagacttgaggcagacacgatcacccacgtggcctaaccccctcggggggggtcgggcccgagggtgatacggccgcccttctctttgtctccccgaggggtcggaccgctcccgcctcggccccgagggccaaggcgccccgaccccttgtgggttttgcgccgcgtgtatgggttaggtgagcgcagcggggctcacctaaccgcatttattgcggtttgggtgagcacgtcacgccgcacgtaatgcagtacagcgcgctcgtttatccggtctgtgactggtcacagaccggtcagattgcgggttaggtggcaacaggcgatctgacacacgcctcgccccgtcccgtcaggatgagagtctctaggcactcgtccctagccggagccagcgtgctagctcctggagatggcacgttggtcctggtcaggtatatgccaggcttcatcccaaccattacaagcaagaaattgtatgaagaagggtggacatgcagattgctaaactgacgcgtggtggacaagaatgaccgatttgtgaccggtctgacactggtcatgtcgtcggcaaacagctgtgttcccacgtcgcgcctgcttccggcggaagtggaggtaggtatgggccgtcccatcagaaggtcattcggacggcaaccatacaagtctccgtctgtttaagaaaagataggataagtccccacaaaaaagagagagatggtgcatgtggtatccccttgaggtataaaaggaggaccttgcccacttagaagggggattgattttttggggggatccagaacgattagagagggagagagtaagagctctctggttctccagctcttttgtagcttcttcgtacatagattcaccaaaacacaggagtagggtattacgcttctcagcggcccgaacctgtatacatcgcccgtgtcttgtgtgtttccattctcgcgaaccttccacacaccgagagcttagaatctcacccagggcccccggccgaaccggcaaaggggggcctgcgcggtctcccggtgaggagccccacgctccgtcacctacagttcaacagagacaataatgtaagcttcattttttttaatggtactatatatccagaataatcagaagtatacttagtaccttcttttacagttaggacatacataatgctgaactgtatctctgtcatctaactcatcttttaattttttcctcatgcggtgtatcctatgtcttacaacatcatatacctgtatttcagaaaaatatgcacattaaaatctatatcagattatgaccagatcaaaagacatttttggatcatgggatgggtaaggtacaagcagattttattctatgactaaagatgggtaatgttatcgctaacgctgtggtgagagagatttgtctcactttctgttcaacaaattttcagtaggattctgtcctaataattctaataaagccaagtgacttagatttgccaacctatggaagagagatcaatttaatcaaaacaaccaccatgcatgcagaaaaactgcaatgttcaattgaagattatatgagaaggtccgcttgtgtgatttttggcccatgcagttttacaatgttaaaataagtttccatgcacagagtctatatcaaatctcattgagctctgccacacgtaaaaacataagaaatagatatagcgctacatgtcccactcatgtgctttgtggataaatgtgagcggccaaatatcttgtgtatgcgaaaaatttcagctaacaagtttctctttcattttttcgccgggcaagtttctctttcattagagaagtaattcttttcctcaaacaagcaagagaattgcgtgtcatttcattaagaagagaataagaggagagaagcaattgcattgaaaattaaatgttcaatcaatgagtaacctgagcatagtccaaacaacagtaggaatgtgtgtgcatctttgctttctctcctcctttagtaaaaggatgcacatcaccagcggtgccagagacattgttagatatgtttactccttttggtgactgctatgacataacacaacacaaggtgagaaggggcaaaaaaaaaactgacaatcagattaacaaacaaagatgactaatgactggacgttcatattgattgcacctccaaccacaccacccagaaaacaaaagagttcaagcaatgttcaggtcacctcgtgctgtcactaatgatcctgtgaatgttgattgtcttaagctctttggatgcttacgttcataaagtgaacctaaagttactccttatttagcagtactgcacactcgaagtgatccagtgtaccaagcaaaatagtgtaaatagaaggctaattttttagtacataggaaaacagagccgccttcatatatgtaagaaaatggctatacatgagtgtgtggcgcaaatggtgtctaaagagacctatacaacaaccatcacaaaaaacaacaaaaattccacgggcacaaatagatagtcagatttaatgaaatatgcatattccaggaaactgtttaatatgggctatacaagagagcgtagcacacacatgtttatgcctcagcagtatcagaacacagatgaaatatacatgacataaagtttcatttattgaagtcttacctaagttctgctgaacttttctgctttgtccatgtaagattatacaagtcattaatgcaccgatatagttatgcaactaattcatttcccatgtatttccattaaccatgtacaagcttatgtgaagtaggtgctcaaaaacatatttcaggcactcattctatagtctaaagaaataaaataataacgccactgcatataaatgtggataaattgtagaatatcttgacatcttgactcagttggaaagtggtcagcattttttttactttttaggataagtggaaaatggctgagggcaaaacgggcagagagaaaatagaaatgtaaacattttgcaaaaagaccccaacgtgacaaatgctagagatgcgctctttaacagtggtgattcactactcattgggagtgggtggcatatcctacagtagtacagtgccgaggtgacaatcgttgattctcactctcctatcaggtcttgctttcagaaactactaataacctaattaacaacttctgttttaagtggagtagatggcgattccatgctaaaattaaaaaaaaaagtgctatacaaaaatgagaacaactctctctcagaaattctaatctccttccgatgacatcttctcactagcttctcttcttcaaaaaactggagaatgcggcgcagttgcttagaggaaatctttaatgctttagccaaatcttcctctcggacccactggcgccgcctgcggtaaaaaagaagggtatcacaatttgtgcattgacactacatataattagttaacacgaaaaaagatgaatattgaaacgagagaaaaaaatgttttagagagagagagggggaagataatagatttaagactaaattctttgtgatcataattggacaattgaagcagcttctccaattgctgatttccatctctagtaatcaaagttttcttatttacgaaaaggcaagggctctgcctcatgcattaaataaaggaagaagagtcatagtaagagagagtgaggagtggaagccgccttctcacacaagcccgagcatatgcacgctaggaaaaactcaatagacttgacagatgtacactccggggtgcaaaagataggattaaaggaggagaaaaaaagaatacagaggcaagggcctagtagtcaaaactgcacgttcaaaactgagcaagcagcattataaaaataaaatgtgggacatcaacgagtaccaagtaacactacaatatgaggaggcaaaatgttctctcagcagttccacatggataatgagtcataagaaatcataaaggagtactcagtatatttgtttcataatgttgtgtacaaacttgatccagttggtgatagtgttgattaaccattatttgccatagatttgataaacgacaaaccatgagtagcagttactccaaaacagtccctcagggatcataacaaaattgctcatcactcactctaaaaaaaatcttcaaatgcttgtttgagcacttaacgggacgttgtagccaaccagcaagaaacgaaataatcaatttaaccttgaaaaataaatcctagaccatgccataaatttgaaatgcacaggcacaaaaggtctgcattaattatctcggtcactgtaaattctccttgcctaaaatcacaagaggccaagagggagcagtattcaacatggaggtttcctcattggcactagcgagtagaaactagcatcatcaatcaatcaggtgagtgaaaccaacacaatagaacaggtcatgaaacatgtacagaaacacatgcaacagggcacattgatcattgatcagtgacagcaccgaggtcaggactttggttgaggatttaggtttggtctcacctggtgagggcgtcgaggacaacgacggcaagcccacagttgtcgccgcgagcggacttggggtctctggccagcgagacgttgtcgtagaatgcgcgcgccaccatcctcaccatcctgcaatgccagccaaaaattcccaaaccaaaaccagtaaaattacacctcccgcggatgccagctatcatcaatgcatcatggatacacggaggggagcacagcgggaggatccgcaccggttcaagggctccatggaggccatggcggcgacggcggcgatggcgagcggcggttggggtttcgcgggttttcgccgcgatcaggaggttttagccgctgcagcgcagggcgcaaggcttgagggcaaagaagaaagcagcgaccgcgccgagttggttgggttgggtttcgtttcgtttcgttctcgagtgtaccgactcgtgtgggtcggacccgagcccgacacgatccccctctcgttttgagcggtttggactcgaacccgactcgaccatctttcttcttctaaccttcttgtggtggaaggaaacacgggcgactgagcagctgagtccaacatcgccgggagagagatggcggagacatcgtcgccggcggccgccgcggcggcggcggcgcagaccgacgcggagagggaggaggcgctggaccggatgctgacgcggctggccctcgccgaagacgcgcggctcgcgccgctgctcgcccgcgtcctcccctacgccatcacctcgctcgcctcccccgccgcatccgtccgcaagctcgtaagtataccgttcctcaggtcctgaatctattgaagtttgtatgtgagacatatgtgtaggtgtcattattctgcttcggttggtttagttggtctcttggttggtgatgtttacaatgttcctgcttcaatttgatgaaattcgagcaacagtgcctattatactgttttagtgatttgttcatgtacacataatcttctaaacgacgtaattagagagactattgtgctttatgttgcaagaattacttgcatttgttactgtaacctgaaccagttcagagtagcagagtgccagtcctgttttccttcagttctttgcatgattctatagcataatttccatgtcaattagacaatggcatgtaatggaaaataataccatttttggactccattaggttatggaaattctcagccacattaacaaacgggtgaagcacaggcctgagatttcactgcccatgctggatttatggaggatttatactgaatctacttcctccacaatagtccggaatttttgcattgtttatattgagatggcatttgaacgtctgctaagtgaggtatcctattctgcttcgtttgtttctcattttctctaggctgttttaccttttctgcaaagccaacaacatgaagttaacattctgtaacaggacaagggaagcatagcacctgatcttttaatcaacatatcaaatgttacagagcagcatcagggaatcatcttgagacttgtggtgaaggtttgtcacaatttaattaagactgctgtccaccacagagtttacacgattacacatgatcagcaaaaatatgtacattggtttaaatggtttccattgaagaattcaaggaaaggatccggcaaaattatgtagtttactaggttacacatggactggcaacaaccaaatctcacccttccagtcaaaatcataaagttgatgcacatactaaattgatcattatcagcttttttctatcatcagcccatggcattgaatttagtcaagtctataatgatttttgataagttactcatagttttcttttcttcctttggtgtatctgcatcctaaaaagcttgctagtttttctctgtttttttaaatcttgttgtcaggctattggtgaatgtaacacacataaggtgggtgacaatgttgcttcaaaatatcaatccataagtggatctaatgatgatctagtcttcgctgacttctgttttcacacagtagtgtatcaaacaccacctcaagggtaggtttccttgctaaattaggtacaagtatgaaactttttttgatttatggagagttgactgctagtattcttcagtgttggatgcccggctggactttcggttgctcaatcagatcgtgttactggaaagcagccactaaaaggtgacacacttacatcaagaaaggtaatacagaaatgcatgtatcatttattcatgctatgcctgtgtatgcaatcatgtcagcatatacattcgcacattttaagtccttgagtatagtaactgcaccttcttacagttgaatttcacttgtgatatcttcagctaggaatcttgaacgtcattgaagctatgcagttggcaccagagattgtttaccctctttatttagctgctgcttcggataggtacttttttggaattatgtttacaatccactgaaatgtttgtacggatcattaatcatgcggatcattgtttcaatgaagtcaagagtcagttactaagagaggagaggagttattaaagcgcaaagcttcagctgtgaacctagaagattccaaccttatgaagaaactgttcacactgttcaatggtatggattaaggattttgtagcatgctaactcaagcaaatttatatttcaatataatactgtcactttgttcttatgtattgtcatttttgttgggtggcatatgttattctgtccttgaggtgactaaaatgcattgttgaaatccagttccttacataaagggcaaagctaaaattaaaattatctagtataactttgcctccacttcaaaatatatatagaaggctttatagttttttcgagctttattgttgcatggtcaaaagatgggtgcggatacctttgttgcccctcatcttcataactctagcaaggtccttttggtacagcacatgtctattccatgaacatatttcctctagcctagtcccgaagcagtaggtcattgggggtacccctccaacaagtttcatttaaaatatatcactcatgagaatttactgatcctttttacaccatcttctctcaccttgtaattataactaatgttctaactaactgttctcttccgtatttttaactgagataacaaggtcatgtcctctccttctcttgttttcatacccttcttaatccttgttcccatccaaagtaagccttacattttgtaaaggtttgtgtatgttagcaggccagcatttgcacattgcactctcctgtaccaacatgtacacaatgcttctctttattttgttttgtaaaaatctctttcttgtttttatcagtgcaaatctgaatatttgtggtttctcatggtatatgatagatactgttctcttttgcctcaggtactgcaagtgcagaaaatatagctgcagagctgaaagtcgccccagcacatagttcactgcgagtccgccttatgggtgttttctgccgatcgattgctgcagcaaacgcattcccgtacacacttcagtgcatctttggctgcatctatggtattctgtttatatatatttttactttgtgtatttattttagttttcttatttgttgtcatgaccaataaaatgaaattttaataagctgtgtattaacaaatgcactcttttactagttttgattatttacatcaccaaaccgcatctttaagtagtacatagaaactgatttggtatgtttgtcattttgtacaataatctttcttttaagcatcttttagagttttatggaatggtaggagctgcagaggatgatcttctgaaaaactattaatatcaaattaacaataatgtacagcatacattacaatagaatgataaaagataaaggtgggcctagaaatttatatctggaacaagtgaaagagttgaaagatatgggctagggttcatggaggataaacaccattaggaggatagcaaggtggcagcggctccctgggatgagaagtaggcatagactgggatgcagaacattgaggaaaatggattgatattttttcttgctaacagtgacatccttatatagaggtgctagagcccaaatgatagaaactaaataaaatcataccttggatatagccatctacttccatgaaatatctaacatagaaactaataatctttatccccaaatcaattgcgcagcccataacacatatatgcatgacttcctttaaagagggaaatgcaagatgagcactccatttgctttttaagtgtctatttctatgatatggaacacattctatgatatttcttgttatgttgcattcaattcattgctaaaactactcaattgacgtttcagcaaggcaataactcaacttcagcatgccatgtatcgttactaaactcatatttgtttctgctgtgtttctatgcctgaaggaaacgggactacttcaaggctgaagcagttagggatggagttcactgtctgggttttcaaacatgtaggtgcactttgtatgttttcagttcaccaacattgattagcttctagcattctttacttgtgctcttccaattttagctttttcacttggagcagttctgttcctttctgtcaaccttgtttcatggtctcaaacttttatcaattatcattgtttccttattgatttaggcagcaaatgaccagctaaagttaattggtccagtcattctcagtggaatattacgttcacttgatggttcttccactactgaagcaggttttgcacttgtcatcgactctacttgtttaggcatgcatgtgatttatcttcacattcctttgctttgaattacttgggttttaacacttctttgacttcctattttgccatgtcaaataagttgagaaacagtgaatgatttattgatttcctttatgtccagattcttccagtagggatattaaaatatttgcataccaggcaattggtttgcttgccactcgcatgcctaatttattcaggtatgcccttttcttactcttctgctttcttgcctcatgattcatttctgttatggagactgattttttctactttttatgaacattgcagcaacaaaactgacatggctatacgactctttactgctttaagattagaggagcaatctcttcgtttgacaattcaggaggcagctactgcccttgctacagcatataaggtacttacttgtaggatatgctaatttcccccaaaatggtgctgtactgctgtcctgacctgttaaaatgttggcaaaagatggttgtgaaatgtgtttcgagggtgtagtgatttccctagggtgctgtacttctgtccttgacatttctcattattttgaatggtcagatatttttacgctgtagttgactaatgacttgatgcggaacaaacttattagttttgttgatgaagcacatgaacggatcgtgacgccccatggtccaaacatggtacaatctatccactttgctggattaaaccacatacattgcaattctttgaagcttttgatctcgtttgctgcagttgggttaacctggaattgccttcatacaccaagttttgtatgctgcattgtcacactcacacctttcacagccaacataaactgactaacccacccccatccattcacgcacacacgcatatggacctccaagttctggcttggctagatgctaaaagatgccttgtaaattgcaattttgtattcttgctattattttacggaaagaaaatcttaacatgtgacttgaaatagttattcgttgaatgtgttcttcgttctaattataacagcgtgtatctaactcatttcctgacatcaaagttagtaccgcctggagtgtaacagatacgtgctgaggaagagccttggcaagaagtagaaatatagtgctcacaagttccatgaactgagggagggagggtgggctttgcatggtatggggtagtggtaagtaggtacatgccatgattgtctagcagttgagggaggattggaggagattaccagttcagcttgcaacagagatcgacagataagtccttgggtttggttaagagataagtttaatcaggagataatcattagttgaggtattcttcttaaattgttcgggattcttgctgtctgatctataaatgcagccactagagaatgtattcggcacagagggaagatacaagaaggcaaatgttctgttgagtgttgacatttttgggttttacatacttgtgacttgtaatatttattgctttgtcctgttactgcatcatgtcttcagtcagtgtcattcatatgctgttatgttactccactttttctggaaatatatttgtgatttccttttttcttaccagggtgcttcggttgtaatattgaaggatcttgaggcacttctcttggaaaattctcaaatggtaagttcccattcttgtcattgtagattcttaaatactcaagagcccacagctgcatcaaaattttcctatctacagttgaatttgtgggtgttacttctattatttttctcagactcatctagatatacgtgaaagcaatagtttgaaaagatggaatattttattgtttatatgttgttgattggcctgatgagaagttctattggaatacaactatatcttcttacttttgtgatagttgaaagttgaaccctactgttcgaggaatgcaagtacttttagtcatttagattttgcatacttttgtgattttacattttttatcctattttttcttcaaggagcaaagtgaggtccgattttctgctgtaagatgggcaacaacactatacgatatgaagcactgcccaagccgatacatttgcatgcttggtgcttcagatgtaaaactggacataaggtttgttagaaaagatcttgccgagttgttgacatcttgtttcctttggtttctatttattttttttaaaaaatataattatatgattatgtttgtcatcagggaaatggctttaactggtctgaatctgttaaatgatgaaagggagtcatctgcaatagcaactgattccaactatcctgatattgcagacatggtaaattatgtatacagccaacagcctcagttgctacactgtgatgagcagaggaacggaaaattgcttttcccaacaaaaacatttcttgcaatgataaagtttctaatgaagtgctttcagaaaagtgatggctcggattttcttcaagaagatctatctaattgtccagtatcaaaattgtgtatcattttagaacatgccatgtcatatgaaggatctagtgaacttcatgcattggccttgaagtcattggtcgatatttcctctcgtcaaccaaaggtttctgtcctatattatttgttaaagcaaactatgctttcttcacatgtttaaacttttccttttttaattttagttggtgtcatcgcgctatgtgaaccgtttactttggctaagaactttactgggccatgttgatgctgatgctcgtgaagcaacttcacgtctgcttggtattacttcttcagccctttcaagcactgctgcactggatcttctctctgagctcacttcaacatttgatcaaaatcgcccatcaaggtatggaagagaaatttaaaacacaaatccattttctctgtactgttatgctacttctaattcacgtggatatttgatgaattgcaccagattcgaaaattaccatggattgttatgtgcaattgggtatataactgctggttgtttaaaagaatcttatgtaagtttatgcttctttcatgatactattttttttgcagtttgtttatgtcatttctttgctacatgtgctttacatgaaagtttagtgcattcgctgttcacttgacaccgttaaacctatcttgaatataatttaatggtgttatatcagaacgacttgatggacatcccattagtaataccatccatgagaatcctttttgttattctctagtactaagaatatgatagcgaaatggactagtgtaagacggttcttgtttggagtgtcatgtgagggacagaattgcaggcagggaaagaatgagagtagtacttctctttccataagttaaatgtgttttgagattggggattcgaagaaagaaagggatgaattacattataatttacctatgccatacaatgttcagttgttcacaaaactataggacaacacaagaaactatgttgatttttatttttattctctctctgtttttttcctaatataaatctttagttaattttagggtattcccgtgctggtttcttgggcggttaatgtgccaaagtggctggggtgccccagggaagaaggcacaagggagtctgtagctaggcagttaagaattctaatccactgggttaagtttggcttgcattcctaactagagatgaactgacaaaggcgatctaccatgctggcaaaataagtccatagctcagtaaaccaacgcattacctattttgttgtgtccttcctcgtgtttagatggtggcaagaatggtgctttttcatcagtcttcgataatcctttgcactgtaaaaatatatgtaatgaatgcaactgagggctactgtgctgttattttttatgaatatgtacagataactgaagaaatagtgcagaaatcaattgatgttcttgtaaaagttgtcgagtctgagggttcagcattggcatccactgcgatggaagctcttggtcatattggtctccgttgtttattgccttctattaatcgaaattcctctcaaggtaaaatgtgtttcctcgcacttctgatagacgtgaactgtgctactcaccagcttcctctactatgtatttgtttaagctaatttcgtttgacttgcagctgcacttttaacaatcctgaatgagaagctggctaagctgctttcagaaaatgatactaaagctaaacaaaagattttgatatcgctgggacacctatcttggaacgagttgtcatttgcacacctgaataatgcattggacttaatttttagtctttcacgctctaaggtagttcttttgataaattcaaaatttgtggttgaaaatattctatatttgacaatattctattcctaaatatcattattcaggtggaagatgttctttttgcagccggggaggccctatcttttatatggggggaagttcctgtgaccacagatgtaatactagaaacgaactttgtctccctttcccaggccacaaactatcttactggtgatgcacccctacttgtctcgagtaactctaataaaggaagtgattgtgaagaagcacacgcaatggctcgagaagaaattataaaacggttatttgatacactaatttatagcagtagaaaagaggaaaggtgcgcaggtactgtctggttggtctcacttacaatgtactgtggtcagcatccaaagatccttgaactacttccacaaattcaggtctgccaatcaataataacatatatttatcattgtagaagtactatatcttaggacaaacaagagtggtgcactccaaagtttacattagaattgatacaccataggttgtgtgaattattaatctgtcctaaaattaaaacaatgccagtatgctggacagggcacagaagccaacaactgttaataattgtgtacctttcatctaaaacatgtgcttgcttatagtataattcagagttcctcagaggtttcagctgtcaagctgtcactgaaaaatattaatttcagtactgatacaatcacctatgtttagacttgatccatgtccaagtgcacttctttttaggttttatcctcaatggtgtttacgcatttcagttgaagaaaaccagaaactttgagtatttgattctacaaattgtgcatgcatatactgatgtagtgtagtgttttcagttagtggggtccctgtcttggggtgaaagagtgtcctttaatgttgagctattctcatattcaaactttgtcttttgctgtcattatatgtttctcttctaaatgtcttctatcttgtatcattatgttcattccagcgtataacagtttgctctaggtttctgcttaccttttgaagttcattccttttataggaagcccttacccaccttcttggtgatcagaatgatcttacacaagatctggcatcccaaggcatgagtattgtatatgagcttggtgatgcatctatgaaggagcagctggttcatgctctcgtgaatacactgtctggcgcagcaaaaaagaaaagggccatcaaggtgcacactatgtttccagtttccattttgagagaacctggaatacccccgaacccgtacccaaaaaaaaaactgtaaaatgattaatgttttctctgtctgcattagctgatggaggattcagaggtttttcaagaaggaactattggcaataatcctactggaggaaagcttagcacatacaaggaactttgtagccttgccaacgagatgggccaacctgacttaatatacaagtttatggatctagctaactatcaggctgctatcaattccaagaggggtgctgcttttgggttttccaagatagccaagcaagctggtgaggcacttcagcctcatctgcataccttaattcccaggcttgtccgttaccaatatgatcctgataagaacatccaggtattgaactatacacttccattatcacatatgccgtgttttgttttctgatttttgtgtttggtttaagttcttaaagtgtttgtatgctataaccttatgatccttcattgcaccaaagtgagtatgaatcttgttagctatggcctgcaaaatttcagcaactccacagctgaggtcgtatgcatgtttgtaatcttacctagagaattattggtttgttttttccaatagtgtatagatataaaagtataatgcggtcttcttgttcatatagaatccaaggcagtcaggaagtactacagtgcatcagacagctcagattatctgattttgatcacttaactatttcaaaaatggttcttcctagctaactgacactttgtatttcattctaggattctatggcacacatatggaaattaattgttgcagatccaaaaaaaacaatagatgaacattatgatctaatagtagaagatttattggttcaatctggatcgaggctttggcgttcacgtgaagcttcatgtcttgcacttgcagacattattcaaggtcgaagatatggtcaggtagttaatttgttttgctaattttgatttttttaaaaaaaaatttatgtaactatgttgttttgcataagctatgaataactggttttggatttattttgagaataaaatattgcttatctttccctttgttaaggtttctaagcatttgagaaaaatatggattaccaccttccgagcaatggatgatattaaggaaactgtgcgaaatgctggtgacagtttgtgccgagctgtaagcttgttgacagttaggctctgtgatgtgtcacttactacttcatctgatgcaaatgaaacaatgaacattgtactgccatacttgctttctgaaggcatactcagtaaagtttcaagtgttcaaaaggcatctataagtttggttatgaagcttgctaaggtatactcattgtcaaattcaaaaaaagttatctgcattaacattttagtggcaattttttgctccactgtaattttctttatgtatgctgctgtcatgaattgaattacatgaactaactgcccgatgttcacagggggctggccctgcacttaagccacatctgtcagaacttgtcagctgtatgctcgaatgcttatcaagtctggaggatcaaagattgaactatgttgaggtatgctacttttcttggtttttgttaagcacggatgggtagtgattttccaagacaattaacagtttctatacttcactcatttctgaatttggaccaaagatgcatgcaggaaatgctggcatccaaactgaaaagcttgagagcttgcgtatagctgtggctaaagattctccgatgtgggaaacccttgatatctgtttaaaagtttttgacaaagaatcactggatcttttagttcctcgtctggctcaaatggttaaatctgctgttggtcttaatacaaggttagttttgatgctactatgaaccttgtagtataattgaaataataaattgttgcttttcatgtacttcaatcttattgtcattcattttatgtttgtcttatttcagggttggtgttgctagcttcatcaccttgttagtacagaaggtcatggttgaaatcaagccatatgcggcaacattgctgaggttactgtatagtgctgttctggaggaaaagagttctgcagctaaaagggcctttgcatcatcttgtgctgcagtcttaaaatatgccagcccttctcaggctcagaaacttattgaagataccacttctctgcatttaggtgaaaaaaatgctcagttgtctgctgcaattcttattaaatcttatttaagcaatgcagcagatattcttagtggatacaatgcagttgttctcccagtaatttttgcttcaaggtatgtgaacgcatgtagtcttatcttagccttttatcttctctaccattgctaatggtattacagatattaatgtgttttgaagttcactatcagtctatcacagaaacttgaaatgcacatgttctttgaactgtactctgcaataacaaaacttattttcagatttgatgatgacaaagacatcggtgcattgtatggagaactttgggaggatattcctagtagcgaaagagtaaccctacagttatacttaccagaaattatctctcttttgtgtgattccatgtcctcgtcatcatgggctgggaagagaaaggtgaagcctctatttcattattttactgtctatacacataaaagtatcatagcttggaatacacttacgatactgtgtgctacttgcagtcagccaaggctataaaaaaactatgtgatgctctaggagaatccctgtctgtgcaccacaataatattcttgaatcacttttgaaagaactacctggtcgattttgggaggtaagtagtactatgatttttctatctgtggcatatcagtgaatctttccttttattcatggaataaaataggatggaatgcttagagattttcaagaaacattatccatgactaggttcataattcatttttttcgccatgaattaccacagggaaaagatgctattctggatgcactcgctgcactttgttcgagctgccatactgctatgagtgcagaagactctggcatgcctagtgttattctaaatgctgtttgtgctgcatgcagtaggaagtcaaaattgtaccgtgaagcagctttctcgtgtttgcagcaagtaagtatctctcttctctaccctgatctctatgtgaaactgaaatttgtggctagtggatactctaaagcattttactgtttgtggaccagacttttctttgataaaaggatttttagctgttagatagctgtgttcttaacctagtgctcaaaaggtttatgatcttagatgcaacaaaattgatgagaaaattactttcatgcttaatactccctccgtttcatattataagtcgttttgacttttttcctagtcaaatttatttaagttagaccaagtttatagaaaaacaatattagcattttcaccacaaaacaaacatatgaccaaaatatattcaatgttagatttaatgaaactgatttggtgttttagatgttgctaaatttttctataaatttgggcaaacttaataaagtttgaataggaaaaaagtcaaaacaacttataatatgaaacggagggagtgggtatttagtttgaagatctttccggaaatattgcaaacagctctcttctcaaaatattatggggagcaatctagattgtcagtgttatattttcacaaaagacattcatcgggtttaggtgttgtgttgggatggcattttgacattttctatatattagaatttacttagttttctttttctttctttaccacttttcaggtgattacagcattcaaagatccaggattcttcaatattgtttttcctatgctgtatgaggtttctaatcgatctgtcatttgtaaaacaaggaactcatcttcactcactgcatcctctagtgctggtcagtcattaattccagcccctcactgcattcaactaatgtcaatgctggatgaaacatcttgtaaatgaatactagaacttctattttattatctcattctttatcacataaatatgatatagtactgatagttgccatcacaacacaatgtttgaaaaccttgatgggatcggcttaacaagacaactttagaactatacattgttgcccttaatgcagcatacgtgcatgacttcaaaagccacttatcctcctttattttttatgtattactgtcttctgcagagcaagatgaaactgaaggtgtttctgtttctcttgataaggtgctcaactgtgtagcatcttcaatcactgttgctttcctgcaagatattatcaaccaaaggaagaatatcctggaaattattttaaattctctatcccccgaggagagttggcagagtatgtatcttgtatgcaagatctattataattctatgcaactgtttttgaatctcacttatttgatacatcaccactatcattgatgctttttttatggatttctatgtgcagttaagttgtcatcgttcttgtgtatcaaagagttgtgctataaattccagaattcagatggtaataacacttggcctgaggaaacaacttacttggttgaggaggtacatcacatagttgtttagtcctacacaactgtactctttagttcagtatttggtttcttcattttcctgacaaatttcttttaatttgaccgttcagttatttcattcaacagcaccaaaagttgtggatgtcatacgcttagttaagattgctcaggtaatcatcagtatatctagccctcaccaattcatattatattgtgtttgctcatatttattacaatctcatatagcacttttaaagtttcaccataagataatttgttgtcttccttctaatgaataaacatattgtagtttactacttgtatgttttatggcaatgggagcatgtgaactgaaattgcactggacggagctgttgtgggtgttatactaaatttgatgattgcataacaccatttggcaccagtttttttatagattatttagagatgatacaaaattattcatcaaatattcagggaaaaataagaacttgtctttagaaaaaaaaaaggtggctagtctggtggtttgatgaaccctggtgcacatggtttacagattactgctttgcttctttatgtaacagttcatatgcttgtttttggcttcactgattttagaacaaacagttacaaggtttcttgcactgactgtaacatataatttatatcttgaaaggacgagctatccaagatttatgtaaaatataattgttacatactatgctagagtatattagactactgtatattgcacaaaccagcagtttctggatatgcaatctgagtttgaattgccccctcatgactaacttcttctcaggttcacaccgctgcttccgagtgtctccttgagttgagcaaattgtatagagactttccattggttgacagaaaagggcccaagttctcaggcgaacttgctgaactttgtgagtcggaaaaaagcgagcaagcaaaggcatttttgaagcaatgcatggatattctcaaagacttcgaagatcccactggattagccatggagatggactaagtgaagctctcgaggttaaatcggcatagtaaatatcaaaaacaaggctgcgcatgtataaagggcgcgagcaccagggaaggtgggttattctcgcaaattggaatcaccatgtaataggatgagcgtttcattactggttgcatccgaaggaaattctgaagctttgcatccgcaacccacttgtgcaacatgccctgccgctgttacgatttaatgtttttctcccagaatgtagtggtgagctaccagagattggtttcatgattctttcaagtctcaacttctcctagaccaggcccgcttacatctggcagctttcataggtcataaactgccctcacagaccaacacatgcccacacatgcttgcgcaactgcgacacacgcgcccgtgaaaactcgggaagaatttcccgatcggtcacccatccctaaattgctccaggccaagcacacactttgtccacactcgtgcacactcgggaagaaattctcggccaagcacacactttgtcctcactcgtgcacacttgggaagaatttcccgatcggtcacccatccctaaattgcttcaggccaagcacacactttgtcctcactcgtgcacactcgggaagaaattcccggccaagcacacactttgtcctcactcgtgcacacttgggaagaatttcccgatcggttacccatccctaaattgcttcaggccaagcacgcttaaccttagactctcatagttctttgaagattggcttccggaaaaaagttgcaacttgttgatatgagtattctattaattatattaagccttagaccaggatgtcaaaaaaggaaccaagaccttattatacccgagagtgatacttatgctaggaaacatatactcatcctaaagaacgatttttgtatgaagggcattgattattcaatccaagaacttaaacacaaatgtgtctatacatatatggtttctgtttactttcacccatattgggactaaattgagacggtttacaggttacaatcacatatgacttgtgtaaaaacattaaactgacgccaaccgatgtatcttcggacttcttttctgaatccctattatgatcatcagggacttaagtggttagcttgcggagagcagtggtggtcttggagcctgactgccttcccagatgcttggagatgtaatctccagcatccatgagcttgttgaggtcaacattggtctctatccccagtccatggagcatgtacacaacgtcctccgtcgcgacattgccggtggcgccctttgcatatgggcagcctcccagtcctgacactgatgagtccactatgttgatccccagctggtaatacaaaaggaaatgttagaccaacagagcatttctggttgttctgtgtctgtttttcagtaagatggtttgttcattggcattggcaggatgtgaagtgtggttgcttacttggagagagaccagtatgttggcaagggcttggccgtatgtgtcatggaaatggacggcgatcttgtccact

SEQ ID NO: 60393 - DNA, 10131 bp, Oryza sativa
tgcatggataaatacatagagccgtacataattggatttattagcatgtgttttgttgagacgccacatctgttccgacatgctttatcatacactaggttgaatttgatttgtcgatagatagaggcgtacacaattggatttatcatgcatgttaatgagaacgtctaatctgttccgacaagcctatacgtgaggttgagtttgatttttgggtagattattgagtctgatttgttacaacattcttattgatttggactcttgcaaaagacaaaattaaacaaacggagaaatgaattgtgatgccgaccgggcaagcaccaagcttgctaagccaccaattaaccgtttgatctcagataaatccacgtactgcatgcgtggccaccctgcattacttgacaacctgaaataatatctcactttcactgcccagtccctctcctgttatcaaagtagcccatggaataattaactttaatccttttcctcttcttttttcctcaccgtaatttatgtatgctagctagctaggtcgatctggagcgactactgatcaatcgaatcttttattggatcatgatctctatcagttttgttgatcagtgacacaaaagggattgatcaagtagcagtgtaccactgcaagtttgtgaatgcctctcatattctgtccagataaaattaaagatattcatcaattcacatcaaataatatgaaagtatatatactactccctccgtattttaatgtatgacgccgttgactttttggccaacatttgaccattcgttttattcaaaaattttatgcaaatatgaaaatatttatgtcatgcttaaagaacatatgatgatgaatcaagtcacaataaaataaatgataattacataaattttttaaatatgacaaatggtcaaacgttggataaaaagtcaacagtatcatatattaaaatatagaggtagtaatatgaacacttctttttagaaacataaagaaatggctcacaatttccagagttgcgagtagaagtggcttttgttgatatatcgatcgacagagtactttgatccaatccggaccagaaaaatatcagaaacttggcctctcgtgtcgatccacggacaacgttgctatctatctgttcatcctgttgcattgtgccaattaactactgtaactatctacagatacgatcgattgcagagtgatgagtaataatttatgtgcgcgcgtgttcatagatcgtgcaggctcactaaaccatgcgtaattcatatcttgcattattgttaatatctgaatcgatggcatagtagtgcgacatctttccgatgtaatcagtgcttgcattggcggctgcttttatttaatttgcatgcaacatatatatgaacggctgcacttctagctaggtagcaccatgaccgatcagcatgcaaatatatgtaaactatgactttatgaattaatatatgcataccgataattagagcaatagctagctgaccatagatttggtctatgatcgtgctctctgagcatccatgttattagaattgagggaacaaaattacacaaacaaaacactatgatccataaaagacagttaggttggttatacactagattgtacatcaaggaaccacgcacatgcaccaaccacacatacacatgccacggagaggggaacctaacacctagccgctgcactatgcgttgcctatatcaacacccgatctacagcagcaccacaaagcggagtcttaaaaaacgatacatccacggaggttgcaacgccaaggacactattgccgcccgtccaagaaaatggacatgattttcacctagatattctcgcctagagagggaggaaagagttatcttgacaatgtccccgggtgggttgacgtgctcgaaagcgtagccgctatcagcctagtgaattgttatgctaggctttgtcctggaacccttgcaacccagttgccgcgatccgttgcccatcatcttaggtaccacaccaacaaaacattggtagtgcatggcctaccacaccggaccaacacctcttcgtcagcagacttccagttctgtgtacgactagactaccatttgcaccccgggcactgtctcaagcctcctctgcctcaccgcccacgaggctacttgatggatctgaccaaggagagcctggaattgggtgatatcatctcggcagcccaagccttcccttaataattgattgttgccttcactataccaatggagctccctatagaaagaggggcagagctcctcaaagggagagggtgctaagccgatgggaagtctgatgctcgttggtcttccaacaggctgctttggatagcggagtaggaagagggatggagaaacgacggtggtagaggttagggagctgggtgccacccatgctgcccctatctctcatccatttcgcgtgttttttctatggtctaatcaaacgtgtttttcctgtgttctataatcttctgctttgtacttgcattcctatcaaaatcctacattttttatatttctctatttttttcattcctgcaattcaaaatggcccttaaattttctaataccataacttgtgtaacgtgcgtaggccacacagctcccgattcataatattttgatgaatcattttgttcttattttagataaatatgaaactaatgtttaggtgcttcaataccataacctgtgtgtacatgcgtgaatctcggatgcaaagtgctgcgggacttatgtggtgtttgcatctatggactaaattttagtccatatcacatcggatgtttgtacactaattagaagcactaaacgtagactaataataaaacttattgcataaatgagagctagttcacgagacatattttttaagcctaattaatccataattagcacatatttattgtagcatcacataggctaatcatggattaattaggctcaattgatttgtcttacgaattagttcagagttatggaatgggtttattattagtctatgtttaatacttctaataactaattagtgtccaaatattcgatgtccagggattaaaatttagtccctgaatcccaacaccaccttactaatctttgcttcttcttttttcagaacttactaattagtcctgctatgacgacatttctgcgaggctgcatatgtatgtttcagctgggtgtagtggacctatggttggtagtgtggaagatgcatatcgcttatatacaaacctgccgagatttgcggctcctggagatttttgagctggcgtggccacctgcgcgtgccgacgcgtcagcgaggcgctggatggcgggtggttttcgtgagctctcgcacgtccgtgtcgtcgttggtgattttgcaaaaacacccttcatttacttgataatttgttatagatccctggtccttagttctaacgttgtgcgctcttacttagaggacctcttaagaaaacaatattctatatgaagaagcgaaaaaacggaaaattgaaccgcgctctgaaaactagaagtttaggggttgtttttgcaaccctcacccctttccccaaaccctagccgccaccattcctctgcctcctctcctctcgctccgctctctctcctgcccaagcgacggccgccgccgcgtgccgtcccctcatcctcttcttcccgcagttggcgacctcccccgcgcactccctactgcgagctgttgctgtcgccgcgccgtcgtcctgccatcaccatcctctcgctcccgcgccgcatccgccaacgaggaggccgggactgtcggatccggtgactccggcctcctcgccggcagatccggcagccctaaagcgaggggaagctaggagccgccttctactcttctacctctatgcccggcactgcccctctctccctctccctctccctctccatcctgttcatttccggatcagcggatgcctgcgattaggcggccacggacgtgcgtgtgggacgtcgaggagacggggaatcactggatccaggaggtcggtgaaccgatttggagagggagctgcatgatctgtggcattggtgtcccgtttcggacagcggcggtctccagtacggcgggtgctgctggatctgccgcatggagggctcctcgtcagctccatcctacctcttcttctgcctttttggaaggaggtgaggagaggaaagtttcctctggaatttcatactgcatgttatatctttgtcaagttggtggtcttagtgtgatactgtgattaatttggaccgatgaagatatgtgtattgaatttttctttgcaagtttaaatcagtgtaacactatgaatgtgagcgtgtgaatgcagcttgtagtgaagctttgttgagcttacgcaaagcagagaagggcatcggcgcggggttcctagaggatgctgccacctccatccccttgcgtcacggccgtgctgccctactggtcctctggcacagcatctaaggtcatctgccaccacaaccaggttgcatctccaccgaatatgaccccactttgatggcggcgagctttgctttggtagtgttgctgtcaatttggctgtgcatttctttaaggggttcatctacgatccattgtagcatgctgatgactttaaattacaaatgagttaatgcataagattctttgtttccaagtataagaaattgatatatcttttgttgaagtatgagtatgctgatttgttccagcaaaatatagcaatgtacaatattttttgtggataataatttgataatgctccatccaaatgtagtcatgcatcttcatcaaaatagattgtggctttgcatttttagtttgttcattactaattatgccccttgaaggtagtgacttctataaaattaatttataacgagcatgtttgtaacttgacattagatgatcttttacatgcagaatctgagactaaacgtatacactaatcacactaatcactactactgctgctatatattactgttgtaccaaaaatatacaagtgcatttgataaaggttatataggtctggatcagaactgtatattactgttgcaccaaaaataaattaatgaactgtaattttctctgtattatttttggatgtgattactaaagctcgctatgtgtctgctctttttgcactatagatgttatgtggggcattcagtatcagcgccggaaccgacgccaacagccagagcaggcgccgtgatgttggatcaagttgttaggattagtttcagtgattaagtttgttaggaagattaagttgttagttcctggttagtagctgtttggttttccattgtaagcctatataggccattcggtttaagtgattaatcaagaaagaagttaatcccagttcctgttagtttccaccacggctccggggaggtgaggcgtgcgtcctcgccctcccgtcgagcacagctacgcgctatgccacttagggccggcgcctaacaatagaaaatcaatttatctcaatttgttgcacaatccatctatagcttcaattctattctaagctatctaatcttcccaacgccaatcagctgctgcattacaatggattacattattgctttgcgaataatattagaagaaccaaagaaaacatgatggattggtgcaagatcaaaggactggcatagctgtccacttctcttattcttgtaggctttagctggtgcaatggtttcagtagtaaaactaggctatgataggctgatgcctgccttaacacgccaagactccaggtgcacacaacatagtagatcagaacaaaggatgcctgcattggtgccatcctccacgaggagaaatggcaccactggcaaccagtttggctgatcgttgttcgttgcctaccttgagttcaccgtttaaattatatttgacatgttctttacggaagtgaaaatttagttgattatctgtttaccaaataggcatatattagttctataatttggttgtttgtgaacaagaattctgttgcaagttatagctgaagattggtaactctataaaaaaaattaattattatgacataatagacattaactctgaacatattaaattatcatgacatccccacgatgtgcaacagaatttaacttgatataaaaaaaatgatgttacattgttttctaatttgcattcagtaatgcctatgatattttacaaatgtaactgacttgtccttcagatgcttctcatgttctacattggatgcatccagtttttattgcagctcactttgaatcttctacctaatgcttctaatatttatgcccttttttatttaatatgtgatgattaggtaatgcttagactagcatataaaagattggcttgattagggttctaaaattgaagttttctttgaaacgactaatgttattatttgctcttgccatagaagtggtttttcaggactcttgataatataactattggtttaggatgataaagcttcagtttaggacgatgagcgctgccctgtaggttaaaatcccattttaactaagttatgtattatttgactaacttgcactttcaccctcttcctttaaacatactgatagtatctgctcataaaattattgtgcttgctatgatttaggtattaaaatcacataccttttataatctatgtaaaagatgtacaaccagaaaccaataggttaacttgacatattgacctttacaatcctacaataccgtccattccaactttctttgctgaataaatatgctgctgtgtgcattatttggttcacatacctgattattagaaaattactgaaaacagtttggattgtttacctgtttgtttttttagtatggataaatcattactttgcttttggttggtacctttttgtgccccccctgctatttgagatgtttaattaatttcctcacattgggctaaatttgtacctgctggtggtccttcagttaattcattcacagattacttgacatcggcaattgcttctttgattcttacaatctgaatatataccaaaaaacaactatgttaacttgcttttttcacattcagaaaaagaacattactaggaaacaaggatgcttaattgttctaatattgttgagtagttcaatgccataagattattgactgccagtattgataaaaaaaattgtatttttgcatcacttctcaggcagctatgtacacgggggaagcaattcatcatagcaaaaaatattgcacttccatttgcacatcaacaaaagggcccctgtgtgaattcggtgaaggcatccaaaccatattagtagaatttagccatgtgtaatatagttttatagtcctatactcctatgtgctcatctagcagaactgtttcaatgctaccactataaaactactatgtactgtctatcctgccatcaaacatgtgacacattttgctatttaggactgtccacaatctgcatatatgttgtgattagcttttagcctctataacaactatcaatataaatgctcacgtcacaaaacttcattttttgcactacactaaacctaaatctcacaccatgtcgttagcctatacttgaccttcacagaccttgcaaatagcatttgtttcagttacctaccagaaccaacaaacagatgtaatcaatgatttccctctcctggcaccactggtgcaacgcgcgaccacaccggcagctccaaatgccggcggggacgacacgcggaaagcaccgcactgaccagaccacccgccgccgccgccgtggacagctggcgccgtggcggttccggatccaccggcgccggcatccgcttcttcgtctcggatgaatttaattggatgctgacgtaggcgtacgttaattcctacatttcgtatatatactccagctgtgtggtggccgctgcgttgtcgcatacgtacactagtcgtacaactttcttcaatatataatactaacaaagtgcaggtcgtagaggtaggcccagtgtacacgcatgtacattgtggacgatttgtatatctatactgccgaatttagtgggtgcgtctttaattaagtttcgaactttccgtgcaacacgatcgatcaactgtatacatatatttgcttctttttttttcttttggcttagctataggttttttatgttttatgagcacctccaaaatactgtaccggtatattttaagattgataaagtcatcataaacggatacttcggtagcaacagatatgtcacttaactaccacttaaaaaaataattagttgtaaacgtgtgtgtgcgaccacccgtgttaagtttataactttatttcggataggatggttttatcacaaggaatctaaccaattgatcctgtgtgtctggatagtatagattttattttctttcttgaactaaatatgcatgcgtacatgtttatatctgcatgtaaaggaagtggagttttatactccctccgtcccacaatataagagattttgagtatttgcttgcaacgtttgaccactcgtcttatttaaatttttttactcgtcttattcaaattttttttgcaaatataaaaaatgaaaatttgtgcttaaagtactgtagataataaaataataaataataatttcaaaattttttaataagacgagtggttaaatgttacaagtaaaaactcaaaatcccttatattaacggagggagtatatgtgtagcatctgtcgctgttagaagtagtggaggagtttttgcttgccatagtaattaatatataggagatcaaaaaatatatatagatatatggatagatagatcgatagatcccaaaagataatgataatgctgcaatttgacagcctactcccccagcgtgtgtagctaaagtgagcgttgaattttcagctgcggttttgttttagcttttatatatacatctttcaggataggcttacataccatcactacctacggctggctgcatattaagtactatatatactaaccttttcattttaaaataaacaaatttattatgaaagtgacacattatagtattatgaatatagacagagaatatatcatattttatttattttagaactgatagagtacttcatataatttcgttgtttctgttagggatcaaatgcgtacgaagcacactacaagataattgagctattgccaccaaattattgcaacaaaaaaataattcgtagcaatatattatactattgcaatgataatttttctgtggcaaataattattttttattgcaacgatctataatcgttgttttatttcgtacttttgttgcaatagaaaataagatatcgccacaaaaaatcgtactgttgcaaaaaaaacatgttctatcgccacaattttaatttttgtggcaatttatatagtacatggtacttttcactattttttgttgccacgatcaacaaattcgttgcaataaaaagattgtcgtctcataatttaacttaattttttcatatggacacggattgagacaaattttatatggaaattatagctctcgacgagatctacaattttataggtgataactttttcatttgaaatcttttagatattcaaatctatgattcaaatctcatttagctaggctcaaatggaacgatatgcattttccaacaaaattgatacgtagatgagttggtaaaggagagcacgcgtgaaggataggtttgggtttgaatcttagccaagacacaaaatcaaaaaaataagtatacaaatagataggatgatagattaatatttaaacttttaatttggtacgtaaaactaatgccacatatggagtggtggcaataatttttattacaacgctgtgaagtgttgcaatatgactttttgccacatccattccgtggcaacatctaaatttattaccacaaaataaaaatcgttgcaataacctattaccacgttgtttattaccacggctagcaacgattttacaattgtggcaacatgtatctattaccacaattttagt

SEQ ID NO: 60394 - DNA, 8939 bp, Oryza sativa
ttggtttactagaaggagagagatgtggtgttactcagggtgggtgtacaaaaattcaattatatcttgtttggctccgaattgaattcgattcattcaattggattttgggctatatgttttagtgtgcaagctaatgatattggtttggatatcgtagaagctacactattgattcttatgggctatttgacacgtttcattgaaggcgtacacatgattgctccatttctttgtgaaaaagcgcacgatctgaaacaattactctgaccgttcctttgtttacaaacatgaatatgcgaacagacttaaaatttcttaagcaaggtgttgttattagccacagaaatactttgaaacatgaaacagttagtgtgtactaattgtaccatttaaaactagactctgaacatcgaagtacatccaggcctcagtagaaaaaatgtaattgaggctaattcatgacgcacccgacagaaagctagcagtagttaacactaaattattactattttcttacaagatctctcatcaaacaattttgatatcgtgctggtagagccaatacaggcaatattcgagttgggatctagtatccccaaaagccaaaaaaaaataaaaaagaaacagtacaaacaacaacattttagtcccggtaaaagattgttcagtacagtcccttaatccgtatccctagtatacaagaaacaaaatttctttgcaccacttcgcccatggcgtcaatttggcataatccaagggcacagcacaccagggatatatataactcgaggatgtggcctactgactgctttctgcctcagggggtcagaccgctaagcccaagttagatttaagtattgactatgaacgaagacatagtgcgacaagcgagtgccccatgtaatatttggtctcaacgtttcttctgatccttcccagttttgttatcctgagtgagcatcctgggagcgatggccatcgccataagctcctggaacagaagcttacacgcgtagggtatatgcacctgtcagtaggtagcagtgtaattcccgttattgccatagtagttattacttctataaataggctttagattcatagtaattaacagtacagagaagaaggaattatacttacttggacaatgtcggttttgttcttgcaccctctgcactcaaaggaattcttcttgagattagcaatagcaataagcccacacttctcgcatacatggactctgtacgcatcactctggtcaaataacctttccttaaggaaaaatgcagcgccatgagcaatcatacagtccctctccatctctccaaaccggagaccaccatcgcgtgagcgcccctctgcaggttgtctggtaagtatctgcacaggaccacggcctctagagtgaatcttgtcatccaccatgtgcttaagtctctggtaataagtaggaccaaggaaaatcatggcagttaattttcttccagtgtgaccgttgtacatggtctcgaatccacgcatctgataaccacatttatgaagtgctttgctgatgttatccacctgaaatttatgtaacaaattcagattattgcaggtttgaacaataaaagaaaaagtgattgattatcacataatcttgggactataactagattataactgattgcagtaagctaggggttgaacattttcttaaaaacaagtagaatataatcaagactaagtctataaaagattactcacagtaacatcagtgaaaggagttgcatctccttcttttcccatgtgagcagcaactttacccataatacactcaatcagttgaccaatagtcatacgggatggaatagcatgtggattcacaataatatcaggtgtgatgccttcaatagtccatggcatgtcctcttgtgtataagtcattcccacagttcctttctgaccatgcctactactaaacttatccccaatctgtggtatacgaactgatcgcattctaaccttaacaaatcttaaaccatcagcatttgttgttaggagaacctgcacaaaagatagtagacttagaagtctgttgatttcagtgtcataacacagcacagaaacataagaggcggcggagggaataacagacctgatccaccatcccactttcactgtggcgcagcgaagtactgtgatcacgctttgtgtatctagtagcttgcccttgggcatcatcttgtggaataggagatgtcttcccaataatgacatcttcaccagatacccttgtaccctgatacatgaatatatatcagcacatctattatgtcgccatgataaagaaaagcctacaataatgttctctacttactggtggtgcaagtccatcatcatctagtttatcatatgacccatgacgcattccctgcaaggaaaatttcaaaaaacattagttcataagaccgacaaagataaaatcttcaatgaatctaggggagcattaccatagtattctccctatttggacggccaaactcctctttgacaagagtccccatcttcttttcctcatctctgcatatgaaggactgtcaggctacaagcattggatggaacttataaagtatacagtgtaatgtcttcatacctgtatgagcggaaaaacagagatcggaagaatccacgatctattgaagattggttcataataaccgaatcttcttgattatatccagagtagcatgcaatagcaacaattgcattcttcccaaatcatcaaagcaaggtattagtaattacatcacaaaacaaatgcagaacatgaagagaaagcaaacaaggtgtcccgcggttaagattgttcacttacaatgccagctggtaactgtctgaagtgcaaatgttccatagcacgagtagtaacaagaggcttttgtgggtagtatagcacataggccaatgtgtcctgaatacaaagttggatgtttaagaatcaaatctatacgaacagaccaagaaagcagacagatggcacactcaccattcttaactgatagttggtaacatagattcccattgcttgttttcccatagcagactgatatgtattacgaggtgactgtacattcaaaggaatgaattagacatgcttaaaaagatgcagcatacaacatcgcataatgggatgtgttacctggttatgatctggaaaaggaataatcgaggcacagacaccaagtatcaatgaaggatgaatctcacaatgtgtgtaagtttcagagtacgcctcctctggattgtgtcttgcaccaataaggtcctgaaatttatttatttagattatactagatgatgatgatgataaacattttggcccttttcacacaaaggcaaaaggagttcccatggaaggtaaccttaggtgccctacaaatagtcaatttggcatactttgcatgacagatcttacttacattaatggtcatggagatcatagtagtttcttcctcttcagtatctatgtactcaataaatcctttcgcaactaagtcatgccaaccttcctcaggtgtctcctggataaatacaccatagaataatacaagcacataagaaacatagatatatgtctaaactgtagtaaaaaaacctaggatacagtagtaaatgccagaccctttgctgcaacgctcggatatgtctctttttaataagaagcctttggttttcaacaataaacagtggacgactgcaacgcccatagtctgtataaagtctgagttctttaagacgaatatcacgaaccacaccaacttcagtgttgacatcaatctgaaaattgacaaagctcatcatgtaagtctgatctgacatgttctaggttaaacacagaccctcctaaaatagcatgatacaagtaaattccatcctcgacttgtccaatcttaatacactgagcttatatatgtttaaccaactgcagaaagcaatttacacaatactaaaagatgtcaagcaaagtatgtcaaaagaatgcagttaatttcctacacactcatctattcaccaatttattgcctgcagaattcggccccatcttccaaattattcaagttaagcacggcacatacctgtcttctcaaacgcctaagagtcttcaccaacaggtcagggttcctgtgaattccaacccaacaaccgttgacaaaaattttagcagcttgtggaatgacggctggtgatatctcctgttaaaagataaacacagaccaaaatcagtaattgttgcaaaagaccccaaaatataagacatggaggggaaacggagcaaaaccattatgttctgccaaaggaatgaaaacaaacctcaaaattttctgtgccccactcctccaaaaattccaaaataggatttgcagcagaaccaacagtgatatacaccatcaatgcaagatttttaaccaaaccacaagcctgaatacaaggcataataaataaacgtaagcacagagccttcctccaacataccataactacataaatgtcaattacttacttgtccctcaggtgtttcagcagggcacatcattccccaatgagaattatgcaattgccgaggttttgccaatttccctattaagatcaacacaatcctcagaatcaagtctcagtggataagtaatgtatgaaattgagaaaatttgatattgaccttcacgcccaattggagagttaagcctccgcagatgagataatgtagatgcataggtaaggcgattaagcacctatacgcaaaagaaaacaaggaatgaagagcatggattcatacatttgttcgctaaaccatgttggaatcagtgaaataaaaacatcaaatgttcaagaaagagtacccacctgagaaacaccagccctggtaccagcttggttagcctgtccccagtttccagtagcaagggaatacttcaacccactagtaatggttttggctttaatagcaaattgcagattgacttcctttccattatccacacactggattcaagaaaaacatcagttaatagcctccatggctgagtaaaagaaaaggagggtggtttagaaagggaaccttttgcacatatgacctcacatcccttgtcaactttctgaaaagctgtatttacaaggaaaaaaattagaacatttggtcccacttcagaaaagagactcatcactattttagttctgacatatcggagacgaaccattctaaacagtcctccaagcaatggacctgcaagatccagtcttttgttgccataatgatctctgtcatcttcagctcttcgaccaagagcgcacatcagcagacgatgaataatgtacctgcataataagtatacacgaatcagccattctgctttcaatcgaactacagcaagcttttactttcttaaagataattaaacacatgcaatttagaacgcatagtcgcatacccaaagtagtacgcctttttggtttcacagaattcacccacaccaacatggggtaacatttctttttgaagtatctctttggcatacctgcagtagccacgtagtaagtaccaacatagtaatttaacttttctagcatatacagaggtaactctctgccaccacatacttaattctcttttctttagttacaccaacagtagctccacgctttccaatgtaatccagagcaaccttaaaataggtgtattaaagctttagaaagatgaaaccaaaattaagaatcataaatttactagttcatataattagtttagttccagttgaaagctgtatgatgtattcaaacagctaaaaatacctgctgattctgaatgacgaaagcttcctctaaagatgggcgtagcaattccatcatttgtgtatcagagaaatcatagcatatgtgctctaatatatctttatcagcaacaaatcctaatgctcggaacacaatgatgatcggaatgtctgcacggatataaggcaaagtagcacgtatatattgaccagatgaaccctgcatcacaaggaatatttaacaaaaatttagggtaacaaggaaaacactaatgctcattaagaatacactagtaaatagaattacttttgttccagttggaagtcatatgaaaatatttttacactagtgctcattaagaatacagacataaaaacacgtgcacctataacggttaatttcgaagcttgtatatgattactcacccctttcgcgcctgccctagaaagcatccgcacaaacatactactagcaggtctattctggttctctgccatagaacggacttcagccacgtatgcgtatttattaggctgcctcttcttaaacacatagacatggttggtgctcatcttctcctgggcaataaggactttttcactaccattgattataaaataccctccttggtcataagggcactctccaagttctgtaagatccttttcggactgttgaaacagtgtgcaataactagaacgcaacatgataggaacctgcaggagaagaaacagttagaaagaaaactacataaaagggcaaagtatccagatatgttaattacaacctttccaataaagacttttgggtactccatagtttctgtaacctcttcacagtcatgtccttttttcataactctgtatgatacatcaacatatagtggcgccgagtatgttaggtttcggagccttgccgattttggaaataaagtagctgtctctccatcagcttctgtcatcattggtttactcagatagatttgtccaaagctgatcttgtggagtgtctaaagaagcatacaagaccatgataagtatcagcacaaaagcaaataataattgttttcaactgaaaaaaacgacaagattccgtgttgtgacactcgcaatatccaggcccgaaaataagaaacaatattcagaaacttgcataggtaggtcagtttattttattttacttttgtatatataaactctactcagtattgttactttttccccagcatgtgaagggtagcaagagataacattcatcctcagtacttgtcaaacagttttcccttttttgtggatattttttttcttgaaaactcttgtgtggatattttcactagtcattgctaaaatcccagcagagattactatttgtaattctagtttttattgaggttccaatcgcctaaaaggatttcatatgttgcaagaggaatcggagcttatcattgaactgagtaggtcccgtcttgactgcaacaataagattatgccacctatcatagcattctagctaagacataccagttcttttaatctttcttatgacccttgacacttcagcaaaaacagaagtcaaagacagtttttttagcataattcagtgtatagttctaaacagtctgatataagcctatgtcatacaggcagagtgttgcaagtcactctgaataacaaaatacccatatttattacaaaaggagacattcagtttctttccccactccagtatagtcaagtgtcttacatttactggtaagatttcttgtatgatatccatctcaaaatatcaaataggcatgcagtttcactacattgctccaagagaattttacaatagtgtataattgcatatacatgactatacatctcagaaggtcaaactagacatgaagttctacaccactgttcccagaaattttttgaatataatttctgtgagtactatgttatataacaaaactgtttgctgaaagaccacagttaggattgcgattaacttctgtctatccaacatcaattccaaatagttgaacataatatcagcacaaacaaacaacacaagccatattgacactctgcttctgctaactcactagtgataacttggaactgcagcaacgcaaagcaatgcacacttcaaaactcattgtaagctttgctagtggcaacccttgtgaatccaagagttctccactccgacccgcacaaaaaaacttgaacaaaactcctatctcaacactagaataatattagccaagactatttcaccctgaaaatccagctcaaccatcaaccctagcgttcaagttgctattgcattttaaaattcagtctccaatctgagaaagctcctcttaacccttgcaaaaccctaactgccatctaatcaagcagctagccagtgaaagaacaggttaagagacctgccccctcgccattaccaaggtcgccaaaccctagtatgccttaagccgtgcaatcgcccgcccaattcagaggagcaagcaaacagcaaaagtttttttaagcagcaacagcattcgctaggggtggtgaggggggcgcaacctcggcgaactcggcctggcggccggggttgtgctgcgactcggggcggatctcgatgtcggcggactcgtcgacgatctcctgcatggtgttctggatgaactcgtcgaaggagtcgagctgctggcgcacgaggcccttctcctcgaagtaggcggagatgacggcccaggcgtcctcctgggtgatctcctcctcgtcgggggcgtccccatccgcctcctcgtcctccatctcctccccgccgacggccccgtactcttcggcgccgtacccgccgccgtggtgcgggtggtggtgcccgcccatctccatctccatcccctcctcgtactcgtcgtcctccatggcggaaaccctagccccctcgcctcgaggtggtgggagtgggacgcccgccgcccaacaccgagcgagtaggggcggcggaaggaaggggaaaacgagtgaaaaaattttggaggtgatttggtccgcaacgcgatatattggagcgcggccgaagctgggcgtagcgaaagccaagtcggtttgggaattttgggtggggggggggggggg

SEQ ID NO: 60395 - DNA, 10454 bp, Oryza sativa
gttaagatatgctcgctccatcctaaaataaaacatgtattgaaacgatgtgtggacgtgagtataaaatagatcgaaaatatgaataattatggcacatatatgtggttaagatggtcagaaataaaaaggtgttggaaaaacaggtgtggtggtggagttgtgggtgtatgactctatccaccattacgtacgcacatgcaagtgagctagcttttaacaggattttagtgagattggggatataatatgtcgctagtgatctgtttcttagagtatgtgttagaggcgcattggcgaatgtatgtaaagtgtagtgctacgtgtgtagcgatgtgtgtatgtgtctacagtacaatataaagaaaatgaaaagtggctttgttcataaaactcactcgtgcagtgaagcaaccaaattcagggaggctgatttatacatagattgtataagcccatgcctggaactggaaggcccaatttaaaagaagagcgaattaaggaataagtccattttgcctccctcatctcttgcgcttgtgtgaataacatccctcaaccggaaaaccgtgtataacgcctccttcatctctgaaaaccagagcaaatcacctccctcggtggttttgctggcggtttcgtccgacgtggcattgttgacctggctgacaagctgactcagcgtggtgggactcacatgtcagtgtgtagcgcgctctctctcccttatctctctcttccccggcctttctcttcacacagtgcggctcgtcgacgtgggtcaggcgcaaggtggccgggcggcgcgttgcgacggagagaggtagccgtgcggcggcagtgatgcgggagagcgcacggcggtggcacgacgcggttggccggcggggctcggccgtgcggcggcgaggcgtggtcgatggtggcctggcacagccatttcgcggacgcgacgcaggtcacggaggcctttgcggcgtggtgcgcggcggccgccggcaaggccaacggccggcgatgcgggcgcggcgtggacggcgatgtggctagggaggtgtgacggctggccggatcttcccccttttctttttttcacttcttctcttctttgtttcttgttgctcctgttgcatgctgagtcttgtatatgtagatgcatgtgtgctgctgcagtttgtcgccggcgctgcttgtcacacaggccccttctttggcaacgtatcatgaggtcgacgcgccgaggatgtcgtgtggtggcggacgaagatggtatcatgaggtcatgtggcagcggcgggcgggcggccggccgtggctccggccgtccatcggcagggcccaggcgaaggcggcttggagaagctgcgtgtattcgtcaccggcgagtgcgcatggttccgccgcaatgatggcttccaatgtggtggctgtcatcacgagcagcatgtaggtggcttggtagaattgcgtggcgacggtttaatgcttggattctggcgaggtggtttccggcgtcgtggccggagaagatggagaggacgcggacgccatcgtggatggccgcgtcgagcgcagcgaggatatacgatatcggcgtgaaagcggtcgctgccgctgacgcggcattcgtcgctggcgcctctccccgccggccgccacccccttcccgtctccccgccgccaatgcccagctcctctccgccagtctacttccccgtttgtcgctagcgagcgccgctgccgccaacgagggccaccgccgggcgttgcccacctctggttctatcctgtggaaagtttctgggagaaacagcagcacgagtgctgtgcgctggatgcgtgttgatcagatgggaatagcccccatcgtggcttttacatatatcgcttcaaggaaacagatccctcaaagctaggaaacaaccatggccggctgaggttaaggttgtatttgaacctgtccagtaacctttctgacaacggttctgtaaaaccatctgcaacttgatcaccagaggaaacaaaatcaatctctaaaagtttatgacttaccctttctctgacgaagtgatagtctacttcaatatgtttagttctagcatgaaacaccggatttgctgataaatattttgctccaagattatcgcaccagatcattgctgcttgaggacttttaatccccaattctgcaagaagagtttgtacccacataatttctgctgttgcatttgcaattgccttgtactcagattttgtgctggatctagataccgtggcttgttttctagcactccaagatactagatttgaccccagaaacacagcaaacccacctgtggatctcctgtcatccaaactaccagcccaatccgcatcagagaaaccactaactagagtagaacctgacttatggatcttaagtcctaaacatgtacattgtttgagatacctaagtatccttttaactgctacccaatgtacagttgtaggtgcatgcaataattgacagactttgttaacagaaaaggctatgtcaggtctagtaagggttaaatattgaagagcaccaacgatactcctatactgggtagcatcactatctcccaaaagagatccttcatgcagagagagtttatcacttactgtcataggagtgtttgaatgtttgcaatctgacataccaacccttttcaatagatcattggcatatttgtcttgtgtcaagacaataccattctcaaccttgctcacttctataccaagaaaataatgcaactcacctagatcttttagggcaaactcccctttcaggtcttgaagcagagctgcagttgccctctctgaagaactggctacaataatgtcatcaacatatactagaacaaatatagtgacaccacctctattcagaaagaacaacaaggtatcagccttggaaccactaaaaccaagatcagtcaactttttacttaaccttgcaaaccatgctcgaggagcctgttttagtccatatagggccttgtcaagtttatagacaaactgtggtttagttggatcctcaaatccaggtggttgttgcatatacacttcttcttcaagataaccatgaaggaaagcattttgtacatctagctgtctaagactccatcctctagacacagctaaagacaaaataattctaatggtagcagctttaacaactagactaaaggtatcctcatagtcaatgccatatctttgcttaaaaccttttgctactagtctagctttatatctgtctagagtaccatcagctttcctcttaattttataaacccacttacaacctatgacattcttccctctctgaggtggaactaggtgtcaggttttattctttactagagcttcatattcagcatccattgctagtttccaatttttatcctttaatgcttctatatcagtagtaggttcaccagactcagtaaaccaggagtttttgtatttaatagtgccatcagtgtataccttttctttgcgaaccccactttgcaacctgatgcgaggtctaacgtggtcctgaggcacatcgtctgcagatgtcacatcgacatcatcagcgacatcattagcccctcctgtcggctgttgttgctctgcaccccctgtcggctgatgatgggagccgatcggatgctgccgcgcgtgctccattgtccgggagtgcctgccagcgtcggggctggagccacccgtgttgccaccggattggccggtgtcgccatcaggttggccactggccaacgtgtcgcccgacgatttgtcgccaggaatcatgtcgccaaagctactgctgagatctgtgggcgctgaaattgatggcgaatcaagctggaggtgagcgccgtcagccccggtgggatcttctacatcctgccactctgcatcgcttccctgggactcattctcatcagaaaaatcattagggtgtggattagtcacatggtttggtggttgttcattccccctagagtataccgcccaaataaatctgatggtaggagttctatctcagacctaagacgagcgccggcattggcatgaagctcagaaaaaggaaatattgtttcatcaaaaacaacatcacgagaaatatagacacggccagtggacacctctaagcacttgaaccctttgtgcatattactaaacccaaggaagacacaccgcttagatcgaaattggagtttatggttattgtagggacggagatttggccagcaggcacaaccaagcactctcaaggaggtgtaatcaggtttctgatgatgcaatttttcaagaggactcatattttggataactctgctaggaactctgttgatgagataggtggcagcctgcacagcttcatcccaaaattttaaaggcatagtcgcatgagacaaaagagagagagctacttcaactatatgacggtgtttgcgttcagcagacccgttctgttgatgtgtatgaggacatgatacatgatgaactatcccgattttagtaaagaaagaattgagagactgatattcacctccccagtcagtttgcatagccaagatttttctatcaaatgtacgttctaccatggcctgaaattcttgaaacttttcaagcacttgagatttgtactgtaaaagatagatccaagtaaatttactgaagtcatcaataaaactaacataatatttctttctcccaacagattctggagcagggccccatacataaaaaaaacaagttctaaaggatgctgagagacacttgttgacacaggaaaaggtaattgatgactctttgcttgttgacaagcattacaaactgactcatttgaagcatctaaacaaggaaggctaaatttattgacgacttgtttaacaatagggatagatggatgacccaaacgactatgccaccgctctagtgagggtttcacgacattgtaggcttccttcaaggatgattgcggcaagggatagagtcggcgccaagacctcccactaagaagcgttctcctggtgattcgatccttaagaaagaaataatcacgatgtaattcaaggaaagctgagttatcatctactaagcggtgtacagaaatgagacttttcttggtttgtggaacatataaaatattctttagatgaatatttctactaggggaatgaacaacagtatgaccaatgtggcttatatccatacctgctccgcttgcggtgtgaatttgttctcctccgttgtatttttccttgacagtaagcttgtccagctccccagtaatatgatcagtggcacccatgtcgatgtaccaatttgtgtctacaccataggagctggtagccgctgctgcaacatgcttattgttagggacaaaatcttcatcatacctacaccagcagtcggtagttgtgtgtcctcgtttgaagcacaattgacagatgggcctcttgtcaacgcctcctccagacgtgcgaccgcgacctcgtcctcctcctgggttgccgcgaccacgaccacctcccggattgccgcggccacggctgctgttgtcgctgtgcccaccttggctgaagttgccgcggttcgcaagattgacctcttgcgttccactataaatggcttgtcgtgcttcgaagttgagaacctatgaatacagatcacttacagagatgggctctacccttgcgcagatagctgagatgacctcactgtagccttctccgagtccagtgatgatatactggatcaattcttcctcatcgatggggcggcctccagcaattgccatctcatctcctagagatttcattttagcgaaatactcaggagttgtcatgttacctttcttcgtgttggtgagagcgaagcgcgtgttgatgcacctggcgcgagtatgagtggaatacatcccctcaatggcgctccaagcctcggctgcagtttcacaggttgaaacctgcatgagcacatccctcgtcaaggacgagagaaggaagcccagaacttgttgatcagtggcttcccagtcgtcgtacaccgggttcgccgtcttgtttgtggcgccatctaccgtgacgctgatcttcgccggtggcttcttcgtcgcaccagtcagatggccttgaagccgtgctcctctgacggcagcactgatttgtaccttccagagggcatgatttgccttcccgagcttctctgtgatcaggtggccttgaagtggattggagttcgtcgagctagacgacaacgccattggagactgatcgcaaggaacggatcagagctctgataccatgtggaaagtttctgggagaaacagcagcactcatgctgtgcgctggatgcgtgttgatcagatgggaatagcccccatcgtggcttttacatatatcgcttcaaggaaacagatccctcaaatctaggaaacaaactgcatgtgataacaatcaaaacaaatcttatctattctaactaccggatcaatatcacatgtggcgcaaggcctatcttcagctgaatcaaccgaacccttatcatgtcatttaacatcttcgcccgtcgccggctgcacccctcccccgccgcccgttgctgagccccgccggccaaccgcgtcgtgccgccgtcatcaggccgtgccaggtcgccacgtgccgtgcccggcctcgccatctgctgccatctgccttacccgtgccaggtcgccgcgtgccccgccgcccgtagccgaccagcacaccgtacgcgccgctcgccgccgtgcgctctcccgcatcaccgccgccacacggctacctctctgcgtcgcaacacaccgcccggccgccttgcgcccgactcacgtcgacgagccgcaccggggtgaagagaaaggccaggggagagagagatagctacacactgacatgtgggtcccaccacgctgagtcagcttgtcagccgggtcaacaacgccacgtcagacgaaaccaccagcaaaacaaccgagggaggtgatttgttctggttttcggagatggaggaggcgttatacccggttttccggttgagagatgttattcacacaagcgcaagagatgagggaggtaaaatggacttatttcacaaaataaaggcgcattcgagaatatatcagcccagtccaacaggttaattacccgtttctcaataattcacctcgccggatgggcttaaatcctttttggcccagcgcgatcgatgaaaatgctgattttttttcattttaaaatttgtattttttaatatttacagaaatattatatcatccaaaatatttacagaaatggcccctgccacccaagtggagggtgacaaggtatgcgtattttgcattgaggtcctttgctgccctctgcaaaggttgcaagtgggcaaatgcaatttttaccctgccaaaaaatgtatttttctagtttttattttcatcttgtccgttcctcgcgtcaccctaccgccctcaggtagggcggcaggatctacttctgtacaacttttcgccggtataatatttctgtaaatattaaaaaataaaaatttaaaaatgaaaaaaaattccaaaaaagctcagatttacgtgtcaacgtgatccatgcatgcagatgaggaacatgagttttggacgaagttcaattattttgtcttcaaaaactatcgatcggcttttatctgagtgcagagcctcccaaccacaaaaccggatagagagtatcccccatctattaaaccagagtaaatcggatctctcagtggtttcgtccaatatgatatgttgacttaggctctatgcacctacttcctccgtccaaaaaaaaaaagacaaaccctagctaggtttccgtgtccaacgtttgattgtccatcttatatgaaatttttgtataattagtattttcattgttgttagatgataaaacatgattaatactttatgcgtgacttgtctttttaattttttttaaataagacgaacggtcaaacgttagatacggaaacccagggtttgttttttttggacggagggagtacgtgacaacatatcactataaaaaaaaacatctctaccctgttttctccccgtatctctctcctgatccttaaccgatgtaatcccagagtgcagaagcagcaacgacatcggaggatgcgtggtgatggcattggaggagctggtcgttcccaacgaccttcaccgacgtgcgtatggcaacggggacgaaggagaaggcagttgttgtgtcggtcacggagaggcatgcagaccgtcggcggcggcgcaccccccaggatgagcatgcaggacgtccgtcacggcagccttccctctcggcgaaatttcggactgaaattgatggcatggcatggcgacggacgggcgcgcgtacgtcttccctaatcccgatagaacagaagatcgcccctgccaaacctgcacagcggcgtcgccatggtcctagacgactcgacggcatcgcacgtacgtacgcacggatcgagcggccggcgtgctcctctccgcgctgctgcgtccgtcactggcttcaactcgcctagcttccagctgctctcaccgacaacttgctgctggggctcgacgtccgtccaccatcgccaccgccaccgccggccgggtgagctctagatcgagctcgtcgcacgccggtgtgaagaaattaggaaaaggtggtgaggatgctgacacctgggtcccacatatctcttcaggttcaggggagctgccatgtgacatgtgagcgctctacgtcaatacagatcgatggacctagtcaacgtacccatatactagtaattaaaagttggggaccttttatatccggttttaatttctgtttgacggacgcaattaaactcgaccaattgttgagggatttcaagtggacttttctgtgcaataatttcctttcgtgtgtgagagtggcccaaaaaatggcccatgtagcccaagttttagagcattgcagtacgtgtctatggtcacaaataagatggcgcgtaggattaaatccgtatgacaatgcgaagtgagggtagcttaatttgttacttaggttccttgggttaaaaccagtccaatcagatttaagtcatagaattgatgtttgtatttacgactaattacgctttcggtgataggtgatatatccatcgatagggagatactcgtggtgactttgtcaatcacaagcagggtttgaaattttgtttcgaaattttcgaatttttggtaatttcgtccccttcggcaagctcatatctcgtccgaaatttttgggtttttacagttttttgtcaatttgatcaaattttattcaaattcattcaaaatttcaaagttttcgaaattttggtccgccccccctcctgcggcaaaaaaaacaaatttcaaaattaaaaaccctgatcacaagatatactgatctaatcttccagaggtgttcatatgggtaaggtgtacatgtgtggattcgtagaagtgagtgtgcgcgtctttatgaacatttgtatcttttttctaaaaaagaatgtatggcaccgtagaaaaaaagaatgtacggtaatatactccctccgtactcgtaaaaaaagtcgtttaggataatatttaagtcaatccttgagaatataaatcatgaataactttcaagttgttgagtttgaaaatgtaaaaattatatgaatagatttctcttgaaaaatactttcataagtatacatatatcatttttaaatatttatttatagaaacaagaagtcaaagttatgttttggagaccatatcgctgtccaaaacgacttcctttacgagtacggagggagtagttaatacggtgagccttaaaaaaatgtttgactccaatccctaataaatttgagtcgcggagattaaagacaacgttttgacataaaacaaacaattgttatagcatggtaaatctcagtcatctgggctgcagaacattatataatactccctccgtcccagaatgtttgacgccgttaacttttttaaacatgtttgaccgttcgtcttattcaaaattttttatgaaatatataaaactatatatatacataaaagtatatttaacaatgaatcaaatgataggaaaagaattaaaaaatacttaaattttttgaataagacgaatggtcaaacatgattaaaaaagtcaacggcgtcaaatattttaggatggagggagtagtatatattaaacataccatatgctgccatgggccgggcatcactgagccaccaagcaaagtgaggaaaagcgagagcaaccatcaggccctaaaagaaaaggcaaatcaggaagaaaacggcacaattgccagccacaataacggaggcatcgtttggggagtactattccccccccccc

SEQ ID NO: 60396 - DNA, 1954 bp, Oryza sativa
  unsure (1)..(1954): unsure at all n locations
tcaacttttataaaaaaaatgcccttgtgttgcaacaggtgaagtctattttaatcttattattgttataaggtttagctgcttaaaacctaattctgaacaaacatgtaactatttcatttgacatttttaaagtaataagaaactcttacacttttaagcctttggtctttttaaagctatgagacactcttacattgattaaccaaagaggctagattggagtagcttattcagagatacaactctatataagccaaaaagtcggcttaaaaatttaagccaataagcctatgcattgtcacatccggaaaaattttctaatcaaaattccaaacgcttacatgtgtgtaaaccctcgtccacgaatcagccgacgcacacaataacaaattgataatagagtacaattattactctaattaataagcgaataaaatgttattacagaggtagatagttcctctgtcacgcccggaatttctatccaaaattccaaacgcttacatgtgtgtaaaccctcgtccaggaatcagccgaggcacataataacaaattgataatagagtacaattattactctaattaataagcgaataaaatgtcattacagaggtagatagttcctctcaatcaataaagttctgagcagtggaaaaaaaaaagaaatagcgcaggcgactcctctccataggcagcttgaccagggctacgcctaatcatccacaccatcagcatcactgtagaactcctcctctgatgaatgattgcaaggtgagtatatgacatactcagcaagccacgcagcaaatatgcaagtgcacaggataacaaaggatggcatagtatagtctcatttgcataaatagcatttaataaatatttcagagtttaataaaacagcagagtagagtattaatttaacaatattaatccaacgctatacagcataccctgttgcataggcccaaccgttctgaacaaccaatcccagttgcacagttctatctccaaaccaggaattaaccattccaaaccaggagctaaacaagttattaccaagtacagncatcagtgttacttatggnntgagaatgtggtgcaaactcaatcacagaaagacattgttagacccgcccataaccgcgggcacggctatttgaatagttcaaactctggccagaggtgtaccactgtacccacaaggcacaacctcaacatcatgtcaaccatgcgtcgcgatacttgacaagtacccgaatagagattgtgacaataccctctatataatataattcaaagcagtgcactgttcccggatcataatcacccccttataaacaaggtatggactccccagcgacccccgttggcttatctccgccacttcacagtctggtgctctacgatgaaccatactatacagaaagtaaagccgttgcccacgctggcttgtggttggcatggtaaatgtttcacaaccgaaaatcgtgaaccggtccttaattgtcatgagcacgaccatcaaaaccatatgctcacaacccaccattatcaggttttagttggcaaattaattacttaaccaatcatgattaaccatcatgatctatcattaagttatcattaaataatagtgaagcataagttattctagtagtgtgctaatgtttctaagcatggctaagcaatcatatctaatatctagctgaactaatatgtaaagctcaactagtcaaattataataacccacggtatcaaagaataaagtaatcaagaacaaaaagggctataacaaaacaataggttatttccacccaatgacattcaaaaatatatgcagtagttgaatagaaacaatagctttaaacaggatcaacatgctcaaagggttgtttgggatctgtgtgacttgtcttgctggccttggaactcttcaaactcttctcctgc

SEQ ID NO: 60397 - DNA, 692 bp, Oryza sativa
ttttactagcgttcttccttgtactatatgtagaacatctttgtggtccagcaaagagtaccggccggtactggtaccgctcggtaccagtacacatctggccgttcattcctgtatgggtaggatggggaatagaaattcgctcggcgctcgctcggtccttctccttccacagccgcgcctgcgccctcaatccatcgtccccaacgcgcttctttcggccccacacactttccttcgcagcccaacgccggaaattgattaatgttcgaattgctatggagagatttctttagtaaaattgatttctccttctccgccgctgcccaacgccgcccaaccctaaccccccatatcatcgtctgcgtcgtccttcgtcgctcctcggcgcaagggttcaactcgaactcgcggcgcaggagcatgtacacggcgacagcagcgcagaggataacggcggcggtggcggcagagcaacatgggagtgaaaggcaaggagagcaaatactagggttcgagcgagctgccagccccgatccatccctcctgatccatccagcagcaacgcgaagttacaataatacccttccaaccaatttgtctaggcggtaccgcatcagggacattcttggtaccgggcgttaccaaacaatcccagccgttggatcaggccagatccaatggccaacatt

SEQ ID NO: 60398 - DNA, 1280 bp, Oryza sativa
caaagattaaatcagattaaatcatttatatagattttaatggaattatgacgcaataatgaattatttttgaaaagaaaaaggggattattgcatcagcggctagggtttacggtggaccgggtgcacggcggcggctcacggaaacgaacggccgaggtcgatcctatccaaaacgaacggcgagatctaatcggttcatcgcgggtccacggcgaccggcaacgatgatgtcggcgatgacgtcctcaccggcggcggctcgaacgcgcatgctcgccagcgaacgacggcgcggcggtgcaaacggagggcaccagcacgtagagggcgacgcggcgatccttaccgaggcacgaacggcggcgagcagcgaccggacgatgacggcgacgaggaagaagcggcggcgacggtcagctcgacgacgacggcggccttccaacgatcctcggcgacgacggaggggtggacgaggacggcgacggcttggcaatcacgatagcggccttcccgagcgacgacgacgaccggagcgacggcggtgctcggctaaactcgcggcggcgacggcggcgcacagttgaacgcggttagagcgctacgagcggcggcgagctaaggcgagggtggcggcggagagaggagggctcgggggtccttttatagcggctagggggcggcgaggaaggcccacggcgctagagctctaccggcggtggaaggcgaaggcgagggaaagttagggttcgggagaagaaaacgaatccgaatcaaactcaaatccgatgatttccaaaccgaattaggcgacgattccaaaagagaaaagatagaggagatcaaggggatcatttcccctctattgatttcacaggagaaggaaaggcgcggccgaattggaagggcggcggcggcgcggctcggctagggttcgggcgcgaggaggacgatgggtccgacaggtgggacccacctgtcagcggccaagggcgcgcgcgcgcgggcagctgcgggcagactgggccgactaggccgggaaagagagagagggcggttttgggccgactttcggcccaaagccaaaaggaggatttttaaaaccttttcaatttaaattattcatgaaatgcaattccatttattaaaaatacttccttggttcaaataaatcccagaaaaatctaggaactatagaatcaagcaaagtatttaataaaattttatctggcccacttttatattggaatttattatttaaaattagatcttctcttcta

SEQ ID NO: 60399 - DNA, 4273 bp, Oryza sativa
gcgagagctccccgctcgcaaagccggccccgagcgccgatgttcgcccgcgcgcagcgtggtttcccgcccgagccgcgtcgtctgcgccgtccgcgtcgcccggtcccgctgcccagccgcgccgcccgatgcttcccgcgcgcgcgtgccgagtggtcgaccgcctggtcgccgccgccgtcaccctctgccgcgccagcccgcgcctgtcgcccgtgtcgtcgcgccgctccaaaccatcccaccgtcatcgccgtcgtcatcccccggcccccgccactccgcgcgcaagccgccaagaggcggaagccgcgcccctcctccctctgccgcgacgctcccgctccccttcccctttttcccgaatcggcaaaggggcaagcccctttctccccctccttttcccctttttcctcctcgccggcgtcatcctcctgccgccgctttggctgcaagcgccgagcgccagctcgcgccttgaccgttcaatgtcggtttccctcgcccaaaccgacattgccgcccatttaagcccaagccctccccctccaaactctctcatttttgcctccgcgccattgccgccctctgtttcgccatcgccgatcgtcgttgcgcatgtcggaggagccggcacgagcaaggacgcggaagaggacttcggccgcgccctcttcttcctcttccccggcccgaggccggagagattactcccgcaccgtcggcctctcgtcacagcgccccgtcccgcacggtagtgtctccctccgttcttcctcctcgctccatctcctccccttagatttcggtagtagctcgagtagcctccccgtagttagccggcgccgccccgaccgttgccgtcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgccgggaatcggcccctcgtggcctcgtcgccgtttccctcttccctcgccaccggttgccgccgccgcaatccgccgccgtcgagcaacctccggcgaatccgagccgttggctcgtctcccctcgtcccgtgcaaccgcccggtgtgctcgcttttgcctgtatcaccgtggttcgctccgccgctcaccgccgccacccgccgtccattcgcggccgggtcgtcgtctacctcccgccggcccgcgtggcagccacgtaggcgccacgtcggcgccagctcagcctagaccgggtcgagccgaccccggtcggtccctccccgtgcgcgcgttccaccgcgagccgtgaggctgcgcgtgggcccgccgcatccgcgtccaccgcgagccgcgcgcgtgcaccgcgtcccttccccgcccgcgcgcgtgcgtcgcgtgctccctccgcacggtgagccgagccgctgataagcgggtcccacccgggaccacgcgtggtgagcccggtccaccggctccctctctctcctccctcccgcgcgcgcgcgcttgggccgtcttgggccggccggtccgttaagctcggccgagccgccccaaatctcttgggccgcaccatagccacccgagaaaagtctatattccctccctcccttcttttctttttcttttccaaaaaaagggatttaaataaatccttttcctttagacaaaaatccaataatcttagaaattcaatatcttcccaaccgtaattccgtttgactccgttcaacttctaaaatttcccaaatcttgagatctatctagtggcacgcttagaggtctttaataggctttattttcgccgtttgttgagttgttccgtttcgcgtgtagttccggagcccgaagacccgcagtgcgaggatttcgagcatcaagctccggatcgcgagcaaggcaagccacctttgaacatcttgagcctatatttgaaatttaattatattgcttgcgaaatattatgcattgataggatcacactaaatctgttgtcccgtctgcaaggcagattgacagacctacctaaattgttgcatttgatcctttccttgttaattgttacaccatgtccccttgtaaccacccagttgcgcctcgatattcgtgcactctgtgcgagtatcgacggtcgccttcaaacttaaaatctgagtaacaacttgggtaaaactggagttttacaaaagacttggaaaacccgacacctgggtcggtgcttgcgaactaaatgaatttccaaaaccgcggaccggggaacgtaccgggtgtacgatttcccgctctcgcacttaaggaccgatttccttggaatttcatccaaacataaggcaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccatggtcatgggcggatgtgaggtgattcctagcgtagttttgtttgactactgcttgtgaaattgctgttgtgaaaaggggattcgatgtttgaaaaatcagcagctgacgggatcagctaggcccgggtggccgtttgaaaagttgttggcccgggtggccgtttgaaaagctgttggccgggtgccaatcttgtttcaattctaaagattgatgcattgcacatactccgaccggacgagacgcactgtctcatccgagtcgtttgagaagcactcacctagtcgttttagaaaagagttcaaataaaataaattgcaaaaataacagcctttccttgaagcctgcaataaacacttatttcccctggcttgctgagtactcccgtactcacccttgctctatataaataatccccccccagttgctgaagaagatgaagtggatcctgctgacgaggagttcttccaggagcaagtcggctacgatgagttttagggtttcggcctagttcccaagtcgcgcctgtgatgattggtccaagtcctggcttccgctttccttttgtaatgcagttgtgagctcgggatctgtccgcagcccaacatgactgtacttctactctataataaagagacctctgttgctgtgatactctgtctccctgtgataccagcactgtttcctgggactggtatcgattaacaggttaatttggagcgtcacgggctagttccggtcgggactagttcggggcgtgacaggtgtatgcaattgaattgggtgccaagagagccccttgctgctggtgggggagtatttatactcccacccaccaacactagccgttgggggcgaaatcccccaactctgtgctctgccggtctgaccgtaggtatgtggccggtcaaaccgtgctactctgcacgggctaaaaaactagccgttgtagccctgtcagagggccccatcggcctggctggtcagaccgacatggggtggccggtcagaccggcctcggctcggtcagaccgccatcggctcggtctgaccgaatacagctccgtcggctctgtatcggccatcccgagcagcaccatcccggcctccagggggccggtctgaccgcgcatgtgccgccggtcagaccggccttatgcgccggtcagaccgccttcttgcggccggtcagaccggctagggcacgccggtcagaccgccactatgtggccggtctgaccgctcctggtcaggccgaacccagtgaagtgtgtgtgtgtgtgtgtgtgtgtgtgaaatgtgagcacaagtctaaatgcataatgacctaatgtggcaattaaaatcatctctttgctaggtcattacccctcttaatagtacggcgaaactaaaaataaactagcaaatttgatcgccctacacctcgatcaattctaaattaaagcgctagttttaccgtcttctttccctttgctttgcgccgtcaattttaatccatcgataacccacccatgcgcacgtatgacgtggacctaacttaaaatgtatag

SEQ ID NO: 60400 - DNA, 1648 bp, Oryza sativa
gccgccgccgccggccgccggacctcctctcccgtctcgccccgtcggtctcctccccacccgtcggccggcggcgcgggcttacccacagcaccagagagaagagtgagaaagagaagaggaagggagaggaggggaaagagagaggaactgatgtggacaggctgacatgtggggcttacgtgggtcccacgctgactcagcgccacgtagaccaaaaccgggtcaaaaccacgaaggacctcgggtgactggttttgtatagttaagggactccgcatatctggttttgcggttcgaggacgtttttatcccgataacaagttgagggaccttcagtgtagggtttagggttgtgcgcaccggatcgtcgagagactgcacaggcccaccaaacatgggctgtgtttagaccaaagtttggatccaaacttcagtcattttctatcacatcaacctgtcatacacatacaacttttcagtcacatcatctccaatttcaaccaaaatccaaactttgcgccctgaactaaacacaaccatgaaaactatcgctaatattgatggtaaacgagggtggttttaaagttctagcaccgtgcgataaagtttggttcacgctaaaattaaaattttggttaaaattggaacgatgtgatggaaaagttagaagaggcaagcacccactcaactagatgctaaacatttcattaggtcgttctgaggtggaatcgaaccactctgttgcgattattaaggcagggtgctactgtaccagtagtagagtggtcaagtttgtatgtgtagaaaaattttgatgtgatgaaaaagttaaaagtttgaagaaaaaatttataactaaacttggccttactttattattactaatccaactaggattgtactgatatggatcggcttataacctgctaactacgagtaagttttattatacctgttcttaccaaagtcttgtgcactgtagcatgataatacttgcacgtagtaatatttggggcttttaactatagatttggcaaataactatttgccacccctatcttaatgacatatgggtccatatgtgtctatgacatatgagtctagtggtaaaaagttaattgccacatcaaaatttgataaatggttaaatatctcagtaatatttggtcgacgtgcaagtggaattgtttcggaacaggatcgatcatgcaggcaggatcagcgagaatctgtagaatctggcagccgtggcatggtgctccgtgcacgcaggcttagcctcgctagccgccctgcagccgtcggcgagtttctctgctccctgctgtgctgtctgcgagcgctgcgcccgaggccgccccgacaccgctgagtcgctgacacctcgcgacaagcctggaccaaagcaccggctgcacgagccgaacgtatccagggctttggctcgtactcgtactacgcccagtgcatcatttaactcgtcacagctttgacaggaatgttaaaaaaaaaaagctttgacagggagcaggcaacaggagtatgtgaatgttcatcgatctgcagaattcatctaacctggacaaagctcacctgttacagctagtacctcttcttgctacagtagcaatttcctgatgaactt

SEQ ID NO: 60401 - DNA, 16771 bp, Oryza sativa
tcctgcagcccttccggcgccgatttggatttaggattttgaatctggcgcttggtggttttttatataggcgcgggggtttggcgatccgcgtgatgtggggtgcgcgccgtcggatcgagatgggagggaacggtggggattcgttttgggggggcgatccgtgggagcacgcgacggaccaatcaggtgcgcctgtttcgtgttggtgtctcaaaatggaccctcggtgttggttgggccatgcgactgaattaggaataagttcaccggaggaccctcaatttaacagcgagattttttgaggccttcaaccataaaatcagaaatgttcacccctaaactcattcaaaccgttcaaagaaggtcccatgacaatatttgcgcccggttttgctgacgtggcatcctagtcagcaaaaaatataaaaaaaatatgtagggcctacatgtaagtgagagaaaatggtgtaggccccacatctctcctttcttttctttttctcttctcttctctcctcctctcaagcaggcaaggcggccagcggcggagcaggggcggcggcggcgggagagggggagagagacggctggcacgatggcgagctcagcggcggagagtagcggtggttggggagaggagcggcaggaaagggggcgccggcagtagcagttggtgtcggcggcggcggcggccggcggcgagaagagtgtgcagccgctgcggggggcagtcgaacgaccaccgcgacgaccttgcccggggtatctactgcgctgtaggattgagatgtcgactagaggggggtaaataggcgatttaaaactaaatgacacctaatcaaaactaacctaagttgctaggcttagtgagggtgaactctaactaagcaactgagttatgttttgcaaacctagagtgatagtggctcaactatatctctaggaaagtaaatcacactcctatgtcaatgtttagcaatcctagggtgatacgatctcaagtatgtctctagaaatgtaaattgcacaaatgtaaatgcgacaatcaaatgagacaaggagacaagagatttttcaccgaggttcgaaaactcgtcggtttcctactccccgttgaggcgagcccaactccaccgctcaaccacgaagccaccgcacgcccccttcgtcaaggggtgggcaaggcgggagctggcccacggagaggactacccaagcctcgatcactagggttgttcttccttcactccgaaggtggtgaactccaaaccactcacaaaccggcgccgcgcctcctccacaatcttctcggagaggtcaccaagcaactcctccacaagccgtctaggagacggcaacctccaagagtaacaagcaatgacccgacgtggagatgatcaatcaagtgccacactagctctacaaatggaagcaatgcacttgactcttggctaactaacccactaacacactagatggatgaacacaaagctcaagtgggtgtgagaaaggtgcaaggggtgtatgcaattgaattgggtgccaagagagaacccttgctgctggagggggagtatttatactcccaccaaccaaaactagctgttgggggcgaaatcctccaactttgtgctctgccggtctgaccggaggtatgcggccggtcagaccgtgctactctgcaacggctagaaaactagccgttgtagtgctgtcagagggccccatcggcctggccggtcagaccggcgttgagtgggcggtcagaccggccttggctcggtcagaccgccatcggctcggtctgaccgaatacggctccgccggctctgtatcggccaccccgagcagcaccatcccggcctccagggggccggtctgaccgcggatgtgccgccggtcagaccggccttatgcgccggtcagaccgccgtcttgcggccggtcagaccggccagggcatgccggtcagaccgccactatgtggccagtctgactgcccctggtcacgccgaaaccagtgaaatcccaagtgattgtgtgtgtgatgaaaaacgagcacaagtctaaatgcacaatgacctaatgtggcaattaaaatcatctctttgctaggtcattacccctcttaatagtacggcgaaactaaaaataaactagcaaatttgatcgccctacacctcgatcaattctacattaaagcactagttttactgtcttctttctctttgctttgcgccgtcaattttaatccatcgatagtcatccatgtgcacacatgacgtggacctaacttaaaatattatctcaatagcaacggttagtccacaattagcgtttgtcattaattaccaaaattaacaacgggggacttgatgcttcaatcttcccctttttggtaattgatgacaaacaccacaaatatatatataatcaaacatagatcacatggacatatattgcaatggaaatcaaaagctccccctaaacatatgcatattaatcattgacaacaaatatggagccaatgcacatttcaatttcacattccaataagcacaaacacataagcaatatttcaatgtgaacttcaagaaatattcattcatgagcataagatggtcacatatatagcaatatcgcatacaccatccatcatcgcacaagttcacatcacttaaccaatcaaatcacaaaagtcacaaatcatcctaaaagggctcacaaataaacataggctattacaagaccacgaagggtccaaatgacatagagtttaacaaaacgacaaagaacacacaatatagagtaatagcccatacccatacaaaatatagcccaaaacaccttagcctattagaaatgagggcactatcctcactactactagtcccaacccacaaaacataaatcactcttttctcccccttttggcatcaagcaccaaaaaggtcttcactcttgtggaggagaaggagtacgtgccgaagtggaaggatgaggagcatcacgacgacgatgatacacaaatgcttgggagctctccaacatttggactcgagaatccaatgtacccactctagtgtgcaatctccccacggaagcattcaagtctccaacatccgtgtgcaagccacgaacatcctcatgtaaagcttcatgcctggtagacaagcgttgaatgctttcacttagggtattaatagccccaagtaccgggttgaagtattcgttgggttgcattccaaaataagcatactgtggatggaagaaagcatttggatcatgcccaagaggaggaggaggtgctgagcttgagctagctccaggatgagaggaggacgccgccctaggagcacggggagctccaagctgaaggcggggcttgtactgcttgtgcttcttcaaattttgcccagcagccccaagcttgtcttgaatcaacctcatgatgtaaggggcataatagattccctgagtaaaggtctccttggagatggcaatctcttgcatcatgagagacacaatatcgaactgacggccctgaatgatggcatcgatgacgtgccaagccacccccctaatatcatcattgttatcaaggcgagggaggatggtagctctcacaatcctgttaaccacactggggatagtcctcagaccggcaaccttcccatgtgtgtaccgcactccatcttcataaaactgagatagatagtctatggagagcggattatgggtgtgctcctcatgcaagtcatttccaaagtccaagcgaatattgaggagccgccggaattgcctcctggagatagaacactgaagggtgtcggacatccacttcatctcactatagtctcagccacccacactgtagcatagaactgccggatcaaatcttcattgtagtcttgtttgagagtcacaattcggtcaatgccaacagtcttgaagagatcctgcaagcattcaaactctagagtctcattgatgtctctccaagaaatccacttatgctctgcaaaagctttccctgcataaacctgctcatacacactcttctagaaagcggtgtgaaaacggggatccggggtgtcccgaggactaaaaaactgatcatggtgcctcaagatggtgtactgcgatagattcctcatgttcacaacaaactggatggagagatcaatgtgcatatcatcacttccttcatcctcatcctctccacttccactgtcatcatctccactagcctcctcactagccccttcaacattggcctcaacctcttcatcactttgagcgtactcatctccgctcgattcctcaggctcactcacgggatccggagtgggtgcacgacgaccatggcgagtgcggggaggcatcactgtcaaagagcaaaggatgatagatattagcaataattctagaaacaatttggagaggtgaaaatttgcctatatcctatggaggggtggtcagaccacagccagtaggacggtcagaccgacagcatcaggccggtcagaccacccatggggtcggtcagaccaacggcatcaggccggccagaccgcccgctggtggccggtcagaccgacggctgccggccggtcagaccgggcgcacacaccggtcagaccggtggctgacccacggtcagactgcctgtggctctgggcagacctcctcccacaagttcaagcatccaaaaattttcacatcttcacatttgagtctaaaaattgctagaacaatatagctcaagattggaactagaacatcaaatggtatggcctagttcatcaagattggaataactacccatagccctagggtgaaatagattgatttgagagaatgcacaagagagagagtgatttaccggttgaaggggatgaatcacaccaagaaactaccctctactggtgcaaatcaaagaacacctcgtgcttcacctagggttccatgccatggatcaaaaactcaacaaaaacacgaactaatccatggaatagagagaggaagcggaggagaatcacttacggtataaccggagagaaatccgcggtcaaaccgaggggatttggtggaggaaagagttagggtttgagggaaggtgagagagagagagagagtttttcgagttggggatgaatggggatgagatgggagagggtaggtgcgggatggagaagaaaaggggcaaaaatgcctgggtccacctcggccagtcagaccggccctattcgaccagtcagaccgctgcacctgccggtcagaccgtgcatatagcgccggtcagaccgccaggcccccgccggctgtgcacagcccttgcacaagccggcaacccccacacaataaaattcaacaaaaatttgatttttggagcaattttgaaatgtgtgaggtgaaatattgccaaccattcataacatttgaaaattatgaagatttgcaacaaaactcacttaagtgctaggaggtgaccttttatggtctataggggtttttgggcgaatttgattttcaaataacttttgaatgattaggattttgaaataggtttgaataccaaaaacatatcaaatcttcttctctaccaatttgttttgaaacttttctcaaattccttctcaatctcattttggggataaatctcattttggccaaaactaagaatctagtttcttcaaaatagggccaaaatggcatttttattcaaaaattatttttcttgcaatgtgaggcttggaaaacatataggaaaccttttgaaacattttccaagaaatagttttcaaattacattgattttgcaaaagttttgacttatgttgacttgggcattttgaaaatactactagcaccactagttgatttgctcacatataaaaggaagtagagcacatgtaagagtgcaaaactcccccttaatgtgacatgctccattttcgcaatgaagaaccaaatggcaataaatccaaagcataagagcaaatgagagcaaatatacataatgcaaaaagaagcaaccatggtgcaccatctcaagccacattagagaaatctatgacatttaactcatttctcaatttgaaaaagcgggtttcatcaagtggcttggtaaagatgtcggttagttgatcatcggttcttatgtggctaatgactatgtcacacttggcagcatggtcttttaggaagtgatggcgtatgtcaatatgcttggttctagaatgttggaccgggttattggctatctttatggcactatcattgtcacataggagtgggatttttgtgaaggatatgccatagtccaacaatgtttgtttcatccaaagcaattgggcacaacaactacccgccgaaacatattccgcctcggcggtagagagggctacggagttttgtttcttggatgaccatgacacaagggatctaccaagcatttggcaactaccggatgtgctctttctatccactttgcaaccggcataatccgaatcggaatagccaacaagcttaaacttagcaccttttgggtaccacaagccaatagtagaggaatgctttaaatatcttagaatccttttcacggccactaagtgacactccttaggagcagcttgaaaccatgcacacatgcaaacactaaccatgatatccggcctagatgcggtaaggtaaagcaagctaccaatcatagaacgataaaactttaaatctaccggtttacctccctcatcaaggtcgagatgcccgttggttgccataggtgtcttgatgggcttcgcatcctctaagccaaacctattgagtacatccttgatatacttggtttggctcacgaacgtcccgtccttgagttgctttatttgaagtccaaggaagaagctcaactcagacatctcaaattccctagacatcatatcaccaaattccatgcaaaatatctcattagtagaaccgaatatgatgtcatcaatataaatttgacacacaaagaaattatcaccaatgatttttgtgaaaagggtggtgtcaacttttccaattttgaaatcctttgacaaaagaaaatttctcaatctttcataccaagccctaggagcttgttttaaaccataaagagcttttgagagtttataaacatggttaggaaatatgcaacatttggcttcctcccaacaattagctcataagaagtctttttcaagagacgatgcaaataaagcctattggttgcatggcaagcggtgtttatggcttccgcccaaaaggaatcggaaacaccatattcatcaagcatagtccttgccatctcaatcaatgtacgatttttcctctccactacaccattttgttgaggtgagtaggtagcggaaagttcgtgtttgataccaagatcatcacaatagtcatcgatattggtattcttaaactcggaaccattgtcaattctaattttcacaagagtgcaattaaattcattttgggccctttttgtaaatttttgaaaagctcagcaacaatagacttatcatgcaaaaagaacacctaagtatagcaagaataatcatcaacaatcacaagacaatgactattaccaccaatgctcttataggttgttgggccaaacaaatccatatgcaatagctccaatggtctagatgtggacatgatactcttagtaggatgagaacatgcaacttacttgccggcttgacaagcactacaaagcttatctttctcaaacttcacatctttcaagcccacaactagatcacgttttgaaagtttgctcaattgattcatgccaacatgtgctagcctcctatgccaaagccaacccaatgaagtttttgcaactaaacaagttttcaaatttgcttcactagaattgaaatcaaccaaataaagatttccatatctaaaacctttgaacacacaagacttgtcaagaaggctagaaacaataacttcttgcgggaagaaagcacatgacaagctaagatcacaaatttgagcaaccgaaagcaaattgaaatttagagatttaacaagagagacattatcaattgacaaatcattggagatagcaattttacctaacccaattacctttcctttgctattgtctccaaatgtcactttctcttgttctttccctcctacttcaaatgtggtgaacatagccctatcacaggtcatgtgttgagtgcatccactatcaagcacccaatgggtcccaccggtgcggtagttcacctacaaaagaagatcaagctcttttaggtacccaaacttgtttgggtccttggaggttagagaccaaagctttgggcacccaaatggcattctttttaccatcgagtataggggaacccacatatctagcaacaatgctaccatcatgagccttcctaagcatataatgagaatcaaacatgcatgtcttaggaggcttaccaccagggcaatcattcaccaaatgcccaacctcacggcacttggagcaatacttaccattgctcttgacaaaacgagtggcacggtgagaaggtttcttacccttctttggaatgaatccaagtccctccttgttaaggatgcaccgttgctcactcaaaatcttgtcaagagtgttcttacccttgaagcacctctccaaactcttattgagcttggccacttgctacttaagctcattgttctcaacaacaagtgaggcatcacaaatggaaatacaagagctagagctagagctaggcatatctacaagatcatcacaagaggtagaaatgctagatgatgcaacatgagcaatatggcaagtagcactatcatcaagcaaatcacaagatatgccaacatcaatgagagctctatgttaagtagtggaaaggaggttgtcatgagcttccttaagcttctcatgagaaatggtgagtctctcatgagaagtctttagctcctcatacaaagcctcaaaagaagcatgatccttctttagggccttgaacttgacaatctccttctcactataagcatagagctcctcaaacatactcacaagctcatcataggaaacatcatcacaatcatcatcactctcactatcactaagagatgttaccttagaggagccctttgccatgagacaaagtggagagaagagtgatggagcctccttgatggcaacaacggccatcttcttcttcttggagcttgcatcatcaccaccttcttcctcagacccggatgaggcggagctctcctcatttgagtcccattccccgatgaatgcctcaatcttcttgccttctttcttaagcttcttcatgagcttgtagcctccactcttcttcttggatgacttgtctccatcatcatccttggaagggcacttggaagcaaagtgtcccttctcaccacactcaaagcacctcaagttggagagagtcttgttgggtcttctatttcttctcctatttgagttggagccactttctctctcctttctccttcccaagagatcattgaaccttctagcaagaagggaaatctcttcctccaagtcctcattgacttcattcaccttgcccttgcccttatcttcaacttcggcttggagagcaatgcacttcttggaaggtgaggcttcctccatctccttcttcttcaacttgtacatgtcattggtgttgatcttccccaagaggcttgcgggtgtcatccttgacatatcggagttgatgagcatggtgacaagggtctcatatttctccggtagagccctaagcatcttttgggcaacctcaagatcggtgtagtttgccccaaaccccttgagaccattcacaatgacattgagcctcccatacatgtcattcacactctcatgaggcaacatggagaatgtctcatattggatattgaggaaatgaagcttggcatccttgtactcgcttgtgccctcatggatctccgtcaacttgttctaaatctcatatgcggtctcaaggttgctcactctatcgaactcctcttggctcaaagagttgaacaaagcattcatggcttgggcattgagtttgaggttgcagtgatcaatctccgtcaagggcgtgccggtgatagcaaagcctacatccacaatactccaaatatggaagctcatagctttgaggtgagtagacattttaattttccaagtggagtagtttgtgtcattaaacatgggagccttccctacatggttcacctcgttcgacatcttctctctaggcggtgaagcctaatcaagagagatcaagctccgataccacttgtaggatcgagatgtcgactagagggggggtgaataggcgatttaaaactaaatgacacctaatcaaaactaacctaagttgctaggctttgtgagggtgaactctaactaagcaactaagttatgttttgcaaacctagggtgataatggctcaattatatctctaggaaagtaaatcacactcctatgtcaatgtttagcaatcctagggtgatatgatctcaagtatatctctagaaatgtaaattgcacaaatgtaaatgcgacaatcaaatgagacaaggagacaagagatttttcaccgaggttcggaaactcgtcggtttcctactccccgttgaggcgagcccaactccaccgctcaaccacgaagccaccgcacgcccccttcgtcaaggggtgggcaaggcgggagccggcccacggagaggactacccaagcctcgatcactagggttgttcttccttcactccgaagatggtgaactccaaaccactcacaaaccggcgccgggcctcctccacaatcttctcggagaggttaccgggcaactcctccacaagccgtctaggaggcggcaacctccaagagtaacaagcaatgacccggcgtggagatgatcaatcaagtgccacactagctctacaaatggaagcaatgcacttgactcttggctaattaaccctctaacacactagatagatgaacacaaagctcaagtgggtgtgagaaaggtgcaaggggtgtatgcaattgaattggatgccaagagagaccccttgctgctggagggggagtatttatactcccaccaaccaaaactagccgttgggggcgaaatcccccaactttgtgctctgccggtctaaccggaggtatgcggccggtcagaccgtgctactctgcaatggctagaaaactagccgttgtagtgctgtcagagggccccatcggcctggccggtcagaccggcgttgagtgggcggtcagaccggcctcggctcggtcagaccgccatcggctcggtctgaccgaatacggctccgtcggctctgtatcggccaccccgagcagcaccatcccggcctccagggggccggtctgaccgcgcatgtgccgccggtcagaccggccttatgcaccagtcagaccaccgtctcgtggccggtcagatcggccagggcacgccggtcagaccgccactatgtggccggtctgaccgcccctggtcaggccgaaaccagtgaaatcccaagtgattgtgtgtgtgatgaaaagcgagcacaagtctaaatgcacaatgacctaatgtggcaattaaaatcatctctttgctaggtcattacctctcttaatagtacggcgaaactaaaaaataaactagcaaatttgatcgccctacacctcgatcaattctaaattaaagcactagttttaccgtcttctttctctttgctttgcgccgtcaattttaatccatcgatagtcatccatgcgcacacatgacatggacctaacttaaaatattatctcaatagcaatggttagtccacaattagcgtttgtcattaattaccaaaattaacaacgggggcctagatgcttcatgcgccgacctgcgctctcctcctcttcgtccgctttgtcttctccttgcactttaaccatttgtctaatgcagtgatgttgtttccctcatcttctgtgatgcatgcgcgcacttggaagaactttgtgatgttaattcttctaaattttcctctatggttccgatccagtagtagagttcttgttcatgaaggattgtgttcctctgaattagttcctgtaagcattattcctctggaaggaaatccgaagcaaaatttcacaaatatggccatggaaatgaccgagattaggaaaaattgcatcacgggcagtcagatctaagaacctgggaaagaatagaacttgacggagtggtcgatggagccggacgctagcgacgcgactgaattgatgtggaagggtgacccagcccaccaactaatctggcccacgaaattcatggcggtggcacacaggcaaaaatacagtccattttgcctccctcgaacatccattatattgcattttgccttctgagcggttttgacgatggaatccaatgagggctttgtacagttttggagtttcctttaattctaattcaggtggggagtccccccccctccccgcgcggtggtggcattcaaaaaaaaatccagtgagggcacgatgtcttgcaagtagatcgcagctgcacgaatctaacggtgaagacaacactgtcaaaggtgctctggttgaatcaagaacgtgatgatgatatgtgaacaacggtacacaagaagaggctcgtcttcccgatgaaccgttgcactactgttgagggtaaagattatgtgtaccatggtagttctgcaagaaactcaccgtatagagagagccacgagggtggagtttgggatggcgtcaatggtgaccacaatagtttgggcgttcctggctgaccatgtaccatgtgctccaacagccaagcctttcctctacaagtggtgaagaacctctcgagaatgaactcctcgagttggtcgggttgaacaccacgaaccctgtcaaacagcttggagcagagcttcaggacaatgtggcccggagagccactttcatgaggtaagacacgaatatcctgaatctaccacaggtgttgaagatgccgccaaacacataggtgttaatatatacgacaaaatagaggaggggatatagagaagatggaggagaaactaagatgttttttcctgagtggaccgtcaacataataccatgcacgacaaaatcgctttcaaaagcgtttgaggatataaattaatctcgtagttgagggagcttttatactgtgttttgtggttgtgggatatgaattagaacgtatatatagctaattgagtcaaaatggactttttcccaacatgcaatggtttgtcaatttcatgccgtgttcgaggaaccaattgtaggggtgtggaaaaataactaatacgaaccaactaagaccaatactgcaatgactaagaccaaaaatttcaatcattaactctaacttaagtagagatatacgaaatgtaaacataagtttttcaaaagaaggcaaaaagaaaaaaaatgatataagctatctagttatatgtttttcattcatgtccagtaaaggtgagaccaccaaaggagagaaaaccgataagtgagacgacaaaagtaaggagcgattcactcaagacattttataaacggttcaaggtagttatattttttttctttttccactattatcttactggcataagtaacatagacaattagtttgagagtcaaatagggaagggaggtaaaaaaaaccaattttatataaaatagtaaaagaagaaggttcaggcttgcgttattacatatctgttaacgacttaacaaatttggtaagtaatggaccaggttcggcattggaatcgaagtggattcggcaaaggattgtgatcgaagaacagagtgcgtatcggctgcggaggcattggctagagtctgcatcggttgagatagatcggacaagggatagccgatacaaccgattctattaagatggctgtgggaccgtgtttgaagtcgatcaaagtgttacgaaaggattgccacgatggggataagctctcagataaggcaattgtatctattaattagaatattttgaatagtttctttagagatatgtttgggcaaaagtctaccgtaaagacttgtatcttagaatttgttagagataaggaacttgtccggcatggacttatcatgtatctcgggtataaatataacccgaccccatgtaatttacaacaacagttcaataacactttcggcgcatcgccacccttttcactttcttctatttcgacgagttcttactttcgggttgagctgcatcgattccgatcttcaactagaggtaaacttgtcatgacggcttgcgttcttgggattagtgcttccatctttatgacactctaatcctgtttatgtaattcgtcgagttatcttatacactttgcaatctctgttagttgcgctatataacttgttatcggttgttttatactactagaaagtagtcaatagagttatgtctcgttattaatctagattatatcgtgtatcaaccatcttttagaggttttcatcatcctgcctagatctcatatttatctttatgcttaatgctgcatcggttggattcgatctattaagtaatatccataattataatatctggcttgttttaagattatcgatagagatagtgtcggggtttcagccgatcttacctgatttagcaactttatatctcatatgcttgattgatatgctaggtctgccctttatgttaatatcttattgcattaaggtatattaggcttcttgtttaatatattttgcatgttttaatatcttagtataaagtggtatcggagtattagccgatacatgctagatctatctgatcggctatgctattaaacgtctatataatcattgctttaatgtatctttcgacttaagtgatttatactgtctcggcatggtgaccgatctatcccaatcacttagtctaaatatacatcgaaggaatgattatatgtcgttaatatctacagccgatcgagtagatttagtcttatcttatttattcatgactgtcgatcaattccaaacatgacatcggcttgaagataaatgatatatcatcggcaactagccgatcggctatcgtttatggatttaaccgtgtttctcttgtctttctttcttgttgattgcaggatcaaatcaactggcacgctcacgaacctaaaagcgaaattttggacctgcacaagagttaagcagatcttccaggccagtgtgtgttttttgcatcaacaatatcctatcgaataagtgttagggaaatctttcaaaagaacttttccatagataggtgtactatggatgaattcccacctccttggaggagtgaatgcaaggaccactaaaaaatggatactttactgaaaggcaagtgcttatttatgctttatgtagtggtcagccttcctaccttcatgcctctagaagcttctacaaagctttgcttccggtagaagctagtcgcttcggtagcttgcctgccaagccacctataggcgaagggccgaagcattgattttgcaaaccattagtttatatttaattttctcgattcccttccgacggactaagaatatgagaaagttaccagccgagacaccaaaggcgcgttgcaaaggattcatttgaaacttatactgcgaacgctttcctcagattcaggagatgttgtttctcgggctgagggataataacaatatcatcaatgtacaccaccaattctcgcgtacctaatcgcacttatcgccattctggttgcccttcggtttggcctaagagttgggtccctgtctgtaattatgtgggtaggtaacccatttatgacttgtagtctttctgcttatgacgtagcactattctggcaatgcatcatgaaccgatatatatattgtttgctaatacacgaccaattaatgtttataaaaaaaagtttttcagtcatcccattttaaggactcacagaaatagcttggatagtatcacaatctcttctatactgtagtactggtaattcacgttaactgaagaggagttattgaaacaaaaaataggattaaaaaggtactcactacaatagtcgttctattttttgcacaatcatctcatcggagtggatagtatagccttttttaagtaaagattttctttaagacagtgtaaaaaattcctggacagggccttacagacaagcgcgtgcacacgtgtccccttatccacccggatgtcatggagtatatataaccccctccctccacacactgcgtcaaccgtcaagagagaagtattcggaaagaagagaaggaaaaaaagaatttttagagagaggaggaaaaaaaatatccccaatcccatcatcccttcacccacccgcacgcgtctcctccgactccgatccgagctccagatctgcggcgccggcgaccaacctctccggcggcgggggcggcggcggagatccacgatgccttcgtcggagcagggggcctcgcccctgcgccgcctcctccgcgtcgacgccctcgtcctcccctccgcttgctcccaccgccttaagccttggtctctccatccccacctcctctcatcctcctaacgccatccaatctctcttctccccgtctctttctcctgctccccgttgccctcccatttcttccccttttcttct

SEQ ID NO: 60402 - DNA, 67632 bp, Oryza sativa
ccgccttcttgtctcgcgccctcatcctccccacgcgcacgccaccgagagggaggggggaagccgcgccgagctcctcatcccccgccgccgccgcctctgcgtcacgcgccgccgctccatgtcccccgccgacgacgacgagagggagggggaagcggcgccgagctcctcatcccccaccaccgccgcctccacgtcacgcgccgcggccactgccgctccgtgtcccccgccgccgctgaccccgtgagagagagaggaagagtgagagtgagagagaagtgagagagagtgtgtgtgagagagaagagagagttgtgtatgacaggtgggtctcacaattttttttaaatagaatgctgactgaactgtcacgtgtagaccaaaaccaccgcggattgggtcgaggggggtaattcgtccggtattcatagttgggggtgaagaatgtccggttttgtggttaggggggtaattcggacagccgcgatagttcgagggtaattcggacagctgcaatagttcgggggtaattcgtacttattttccttctagtaaagtatgttagaaaaatcattctttgattatatcccattatttaattagttccgttagaaaattcattctttgattctatcccattatttaattagttcctggactttgtgtattactagtactactccagcacgttagccgatattaatcatatccttgttccaacaaccaacgatgtagctcgctgacctttaaataggcggttgaggtcttctttttttttaaaaaaaaaaacaatgaaacagatcatggggtctatttagagttctgaaaagcaactggttggtagctagcttctaaaaatatgaaaaatctgtgtttcccaacttttgttttctagtttattttttaaattttacaactatatcttcttaaaatctaaataaaaaactagaccgtttgagagagtttctaattctagaaggagctgcatcagctataacctccccaaacaagcccaatatatatgatccggctttcgagagaaagccaagatagcaagagagtccacggctgaaatagcgaaatgccctccacaaccacggcgccggagaccgatcctagcaagaccgtcgtcgaggagatcaccggctggctccgcctctactccgacggcacagtcgagcggctgacaccaccgggcgcggagcccttcaccgtcatcgtcccgccctacaccgagccgcgcaatggcgtcaccgtgcacgacgtcaccacggccaggggtgtagacgcccgcctctacctcccggccgagccggcaaccgcgcaccggccacggcggcgtcctctcctccttcacttccatggtggtggtttctgtctctccagtccatcgtgggctctttaccacaacttctacgcgcctctcttacgacgaagctcgacgtcgccggcatcgtctccgtcttcctcccccttgcgcccgagcaccgcctccctgccgccattgacgctggccatgccgcgcttctctggctgcgggacgtcgcttgcggcgaggacgagaacaacaacggcgccgcccaccaccttgatccggcggtggaacgcctacgtgacgaggccgacttcgcgcgcgtgttcctcatcggcgacagctccggcggcaacctcgtgcacctcgtcgcggcacacgcggcggcgaaggatgacggcgcgggggctgatctccacccagtgaggctcgccggcggggtacttctcaatccggggttcgcacgggaggataagagccggtcggagctggagaacccgccgagcttgttcctgacggaggagatggtggacaagctcctggcgctcggggtgccattggggatgaacaaagacagcccgtacacctcgccgtcgctggcggcggaggccgtggcgcgcttgcatatgccgccgatgctgctgatggtggcggagaaggacttgctccatgatccgcaggtggagtacggcgaggccatggcgcgcgttgggaagacggtggagacggtggtgagccggggcgcggtggcgcacgttttctacctcaacttcttcgcggtggagtccgaccccctcacggcggagcggacaagggagctcatcgacaccatcaagacatttatcgacagatactgattctccctaatagcaatttgcaatgaagatcatgcatgtattgcatgcatgcatgtcctgtgagataattcgtatgtgcaggtgcatctatcttttagccatgcactggtccatctccatccgtgcatggatgtatgttgtgttcagtttctgcatgtttgttacacctagtttgatcggtttggtgaatgttttctagttgggttcaaacttccctgttaaatttcctgcgtgaataaaatagagcatactcagtatgcatgagcatattggcatccaattacatgcagcgtttttcccgattacaccgaagactgcacatataccaccatattcacaagtgtggccctcaacttacattcaaattagagaatgagaccaatgccatatccttggccccataaattcctatcgacaacacactggggtagtcgggtgtgtaatattcgtggacactaggattagatgcacattttattcgactggtaaatcacatatttcaccgcaagaatatgattgcttaacaatatagttttttttctactaataaagaaaccattcttatcgttcttaatggttcaaaagatatcttatcattcttttggaagccattaagtatgtggttccaatagtaacatattgatattactgacacacaaaaacattttttttcatatactatgatggtttttaaacccttatatgataaccctttgtatagttacatgttagtgtgcaccgaactacacgtactagttgtgtgtttacatgaaaaaaacttcgtcggggtggaaataaagaaaccctaagatatcttatagtatttgttggttgcttgatattttcaaacgctatatatcacttttgaatgatccatatactactctaaggttcgaatatatagccaggaagtaatcataacccaacaagtctctctagttctaaaaataaatacaagtattgtctctcaggcctacctcacaagcatccaccacctcatcgccctctaatggcctctcaaaaaatatgacactagatgactctcctatagagaaatacttttatctcttaaggaaatatcctttcatttttacatgacatctaaacagttacaaaaaaatataataagataattaaattattcatatgcgatatatatcatttcataaacatgcatgattattcatttgacctataaaatctgaaaaagaaagaacaaatatgacatgaatcaacgaggggaaatcgcacatcaaagtatgaaaaaaagaatgaagtgcataaacttgtgtgggtgggtcatttaggttattaggtccctgaacttgtcataggtgtaatataggtccaaacaagttctaacccgctccatgcgctgacatggcattgctatggtggcacctacgtgtcaattaatggaatccacatatcaagcatatataaaaaataaaattaaaaaccatattttctcctcttaagtagatagaaaaaagatttaaaaaaatctaaggtagagaggatagaatatgtttttttccctatatgactgacacataggtccgactaacacgtaggcactgccgtggcattgccatatcagcgcatggaacaagttaaagcttatttggaactatatatataacacctaagataagtttaggatcaaaaatgcatcttaagagacctagatgacacacccgtatggccgcataagttttagaaaccgctcgagcagttctctctatgaaaaactatctcctcctctcacaccgcactagtacagatccttctatctgtgacgggctctaatatgtttagaaatagcgggccgtcacaaggaagtcatctcaatcgggccgaaaagtgtccgattgagatatggtcgcacagacatattagatgggcataaaacttaagcccgtcacggatgacacctatcagtgacgagccacaactttaggcccaattgagataacattctatatctcaaacgggcttaaagttgtggcccgtcacagatgaccatcatctatgatgggccacaactttaggtccgtttgagataacattccatatctcaaacgggtctcaagttatggcccgtcacaaatgaccatcatctgtgacgtgcaccaacttgaggcccgtttgagataacaactaggcccgtcacagatgactcatcagtgacgggctatatacttaatctctatcgggcattaactaaagcccgttaccgatgactatttttccatttttcatatgaaatgtttatatttgtaagttgactatagcaaaataatttagtgcagtataataattcattttatgagtcaaaataattttacgggtagtaaatgatttcaaatagaaaaatgtcaataacaaagttgtataacttatgaatatttacaacttttagtttggtcatttttcaatataacatttttttgaacagtttgaatttgaatttaaaaatatgacaacttcaaacaacattttcaaatactaaatgatttcaattgaaaaagtcatcaacaacaaagttgaataactcatcaagatctaaaactttaatttttgttatttcttcatccgactaaatgttagtaatattattcacaaattttacatatatgtgttatagtttataaaaccagataagagatatgtcaattttgtgaacaatgttattatcactttgtcgtatgaagaaatgaacaaaataaaagttttagatcttgatgagttattcaactttgttgttgatgactttttcagttgatatcatttagtatttaaaaatgatgtttgaagttgtcatattttcaaattcaaattcaaacggttcaaaaaatgttatataaaaaaatgaccaaaataaaagttatagattttgatgagttatacaactttgttgttgatgactttttcagttgaagtcgttcactgatctaaaattctatttgaacttttcaaactttgaatttcaaattttgaattgtttaaatagagtcagatggagaaatgaccaaaataaaaattttgcacctcgatgagttctacaactttgattttggtgacttttccatttgaaatcatttaataaccctaatttgatatcctggcctagggcataataggattaatagaatactcatacaacatgttacaactatttttccgaaagccaatctccatagaactttgacgttaagtgtgcttagtctggagcaatttcgggatgggtgaccgaccgggaagtttgaacttcccgcgtgggtgcacacgagtgagggctagccaaaaaataaagtttatttatttttggaatatactcatctgtgacgggcattaactctagcataagttaatgcccgtcacagatgactcatctgtgatgggctagtcatctgtgatgggctagtcatctgtgacgggccatagttaatgcccgtcacagataagggtcatctgtgacgggcactagttgtggcccgattgagataggtcatctgtgacgggctatagtttgactggtcgtctgggtcaaagctatcggtgacgggctttacttagggcccgattgagatagaatcatctgtaacggccgtttgttcgattgagatagctcttaacatcagtgacttctagcctgtgacggacgccatgcccgattgagatggggcttaccgcccgattgagatgaggatatccgttctagtgccgtgccatatcccgaacatccctcgatcgaatgacagctaactcactgaaaaactgcggcattggcgatgtggtttcgctgcttggtcatcactgctccgtcgtcggcttgccgggaaaggactccgtgttagtgatatttgaagggcaatttgatctatccaacggctattgttagtcaactgcatgggatttagggaattgcagttgactgactttagcaaatacgaactgaaactccaacgaagaagcaaattaacttaattaataagttgagcagcctgtaggcctgtagttggttttggacatggacattccaaccacattactatatatcaacctataagttattggagcaaaatagtaatcctccattccagagagatttgataggacacaccattttatcggaagtgttaggtgcgaagaaggccaccattttctgtcgatcgagctttattaaagctagaccgagacgaaacgactcaccaagactaagtgaaagactcaaattaacatactacaacaaattaaagacgacttgagccaatcaacgatggcgtcaagccagcgcgtccacacgacgtacgtatgcgcgcagagtttgcaaggccaggtcatccatgctcgccgtgaatccgtgctgcgtctataaaacacaaacgcagcatagccagttcatttcacattttcactgctacgtactcgatcatctggccagctgctgccatggcaacattgccacaaatggccgcgaccaaggagcgtcaagaggcggctaacccgaccacgacgaccaggacgctggtcgagtccgtcaccaactggatccgcgtctactccgacggctccgtcgaccgcctcggcccgccggaagccgccgcgttcatggtcctcgtcccgccgtacgacgacccacgggacggggtcaccgtccacgacgtcgccacggaccatggcgtcgacgtccgcctgtacctgacgacgacgacgccggccgggcgccgccctgttctcgtccatttccacggcggcggcttctgcttgtcccacgccgcgtggtcgctctaccaccgcttctacgcccgcctcgccgtggagctcgacgtcgcgggcatcgtctccgtcgtcctcccgctcgcgccggagcaccgcctccccgccgccatcgacgccggacacgccgcgctgctctggctccgtgacgtcgcgtgcggcaccagcgacaccatcgcgcaccatgcggtcgaacgccttcgcgacgccgccgacttctcccgcgtgttcctcatcggcgacagcgcgggcggcgtcctcgtgcacaacgtggcggcacgcgccggcgaggctggggccgaggctctcgacccgatacgcctcgccggcggtgtcctcctccacccgggcttcatcttgccggagaagagcccgtcggagctggagaaccctcccacgccgttcatgacgcaggagacggtggacaagttcgtcatgctcgcgttgccggtgggaaccaccagcagggaccacccgtacacgtctccggcggcggcggtgacggcggcggagggagcccagctgccgccgatgctggtgatggtcgcggaggaggacatgctccgcgacgcgcaggtggagtacggcgaggccatggcgcgcgcgggcaaggcagtggaaacggtggtcagccacggccgcgggatcggccacgtgttctacctcaactggttcgccgtggagtcccaccccgtcgcggcggcgcgggcgcgggagctcgtcgacgccgtcaagagcttcgtcgatagccactgaatcgattccaagtttgaatcggtgtctgcttctatgtctgaatttgtgtcgaaatcctgtatccatctcaccgtcacgtagtacatgtctacatcgcaatgtctctgtagttaaacaagtttcccgcgcaatgcatacgtgttttcgtttctccgatccgcttacgaaatttcgatttgatggagaaacacgtcgagaagatgctcagtttaggctttcgtttcaacccgtctgcagaggatctcatcaccttctacctgccacggctgatcgccggcaagccaatgaaagacaccgagaaattcatctgccgcgctgatgtttacggcagcgagcccagtgacctcgccggaaagttcgcgccggtgcccaggtgcgagaaaggcggcaggttcttcttcactagctgcaagcggcacaaggggagtagcaccaagaaagagcgaacggcgggggctggcacctgggtgaggcagaacagcaaggaggtgaagaacaaggcgggggtcaaggtcggcgagacgcagaacttccgtttcaagaaggacgggagctacaccgactggctgatggaggagcaccactgctgccggcagcaagccgtcgccggcgacgaggagcccgtcatctgccggatgtacgtgtccccgcgggcgcctccggattccgcggcgcgccaggaatccgctgctttcgtgcagcagcagccggcgccgcaggtttccgagccgccgtgcgacaagaagaagagagatgatgtggcagaagaagcccctgccgcggcttaggcgtcatcagaacagaatatatgatttgaactttttttaccaactgtatgtgcatttccagtgggataaagattctaaccaaagcagagactaaaaacatgtggggtaatgttttttcaatgaccataacaaaattatttcgagagcaatacaggtgcaaagttgaagaaagacttcctgctatctgaactggggtgttgccacacatacaatgaactctgcaacccagacagcactaacctatagatcaggcatcccaattccagccttggcatcataggttttctccagcacatgttcaattcgtgtatcctttgggccagctgcatgaatgaaacaaaatggccaaatttagtttcctcacaaaaaaaaaagaaaatatatacatcatatgccgagtaatatattgacactttgacaggaaatagaacgcatttgcttgcatgtcaattacatattagtcattcgataatagatagccaaaatacaaaggcatgtaacaaacatatttagtattttgactccaggtatgtaaaggtcatggatagatcagagtcatgatttttctttttcagtttgtattattagttaactgctattatcgttccaatgcagaacaattacaaaacaaacaatagtaccacaagccaaacagcaaacaccataagaaacatctactgtagtaaactagtaattatgcatgatgttacagtaccaaagattattataagcacttgatgctttcctttattagtatttattattattgtgatctcagttgaacatcaaactggtacagcttaatttctgatccaggaaaagaacagcatagacaccacaaaagtatatatgcacttgacaagggaaccatgcaatgaacagagacatacgtgatgtaggtcttggctttcttcgctccttcaaaatttctggcctgggtatcacagcaccagatgcattcattcctctagcaaacctgactttagttccatcttccaaatacttgtatccaatcttacatggtttcctgttgccagcgttgtgtggataaatttaccttttaccagtaaactgcagtagaaatggaagaaaaaaatattctatctagatgacaagatggatggttaagtatcatacccagtgactggatcaagtacttgaacatttgaaacatgaagtggagcttcaattgagaaaatcccacctgtatgtccttctccttgcttaatatgtttcttaacctgaaatgatattaaggcacaattattattatccaaactcttatgtacaagagaaaacactcacatacataagaacaagaaactgttgtctgtcgttagttgttacttcctccgtttcacaatataagtcattctagcattttccacattcatattgatgttaatgaatctagatagatatctatctagattcattaacatcaatatgaatgtgggaaatactaaatgctaaaatgacttacattgtgaaacagagggagtactgattacagctgcccagtagtcaaaaagaaaaatgtgacacgtaacaacaaacatgtgaagattttagaaggacaaggtttttacagtttcaccattcttctattgcacccattaaaatcaattcctcaagatccatctggatactggacgaaactaattcagtatttactcctctttgttatggcatacaaatgatacaaacacacatgatatgatccaaaatagatacagcatgtaccattatgcagtacatagaacacaaggatccagcaggcatctacaatttctgattattctatgcataaaggcagatgctaaattatttgaccactgcttttgttggatcacgcatagctaattgttgagcttatcataaacaccactctctatatacgatgatatgcacaggtatccaaatcctcttgataaaaactctcttcatattatgctatccttgtgccatgatggatatatagtccgcggaataatattacgttatgagtatttacaggttcaaattcgtatgaacaacactccaatggaaacaatggtcgagcttacatctgttacagcaagtcataagctatgtttgtgacagcagtcaaaaactatgtttgcagctcctacgactaatctgaactcaggacttgggagtttaaaaaaaaaacgagtgcaccatggagatcaggtcacatactgccatctgacagatacagcgttgtaagctcttttatctcattattaaatgaagcttttgtgcctctattctaaactttcaatagttgggcttaaaaccttttcaaaaaaaaaaaggaaaaaaatgcagtagtttgcatcaggctaaataataaacggtaattttctgaaccagttaaaccgatgacacaaaaccttgaaatctttcaaccaatcagcacaaaatctatgcagtatttgacaatttctggaggagggtgcgtcagtatagcaataacttaccaaattctttccctcgacgatgacacggttctgcgaccgaatgacccgcttgatgagcccgctctcccccttgtccttgcctcttatgatcatcacctggaaataaacagcgccgaaattggagattttgctagaaagaggagaggggcgaagaggaatgcgaggacggggaaagataattacgttgtcaccgcggaggatcttccagtgtctgatgagcttctccgcagccttccaccccatctctctcgactagatccctcctctctacccagccagcggctcgctcctgggctccccctccctcccagtaagcttcaaaccttggttgcggcggagatgggggtggcggcggcggcgagggagccggcgctagcggcgaatgtgatgctggacagatcagagtgggccgagaagaatgattcgggcatttaattgggccgtttccttcaaaaggtttcggattggaataagttcgggagtgactccctttactagtgaccttatctaattcgtatccctgaaccacagtacgaatatctcgacccctaactattaaaaccagtgcaatttaactttaactgttttgctgacgtggcggtgttgacccagtcttcatccaacatttatgtggtattagaattaaaaaatatatgtagtacccatttgtcactcacacaaaaataattgtgggacccacttattatacgggcccacatgtcatcccctctctctccttcccttctccctcctcccccctctctctcttatctctctttctccctcccccctcccatggggcctttctcttcacctgggtggagcggcggtgggagcggcggcggcggggtggggagcaacggcgccctgagggagctgcgttgcacacgtagccgaggaggaaaaggcggtggcgcagcggcgcgagggcggatggggagcacatggccggcctgcacgccatggcggcggcaaggacgggcgtcgatccagctgtagaagaagagcggtgggggtgtggctccacccgatgtggacgcggtcgacatggcaagggaggcgggtggtgacaccaaggaagacatctgtgcgcaccaccggatgcctccgtcttcgctacccaccacgccaatgtctccgcttgccactgtcgccgcccttcctctggccccaacacgctgctcccacctagcaagcggcaaccacccgcctctccccacctccgccgccgctgccaaccaccggacgccgccgccgtccccactgtcatatatagtcagataaagagagaagggagagagagaggaagaaggggaggagagggccccacatgtcatcctttgtgtaaattggtcctacacataccctttttaattctaattctacttaagcgctacatcaacgccacgtgaacgaagacccggtcaatattgccacattgatgtcacatcagcaaaaccaccctccaaaactactaagggagttaaattacaccagttttaatagtttggggtcaagatatccgtattgtggttagaattagattcggccactggttaaaggagtcaacgtaaacttattcctttcggatttgtttcgtttcgcaccaaaaacctatgggcttatggtgggttttgtgaaatcctctccggcctatatatagtcatctatctctcctctctcgatttggaaaaagaaaaaaacagtttctggtaggcattctcgaacgagatatgagtaatgaaatcgaagaggcgtgttgagtgagctcaaatcatcggagttcccattcaattgccttttgtttgtcaactgtgcaggttgatgctggcatgctgttagccagcttagcacacgttcttgtcaaatactcgagtgacaagaggtgttatgcagttgattctgtttctgattaatcttaaattgttaatcctcggatccaacgcacaagcagttgaccagttgagcaaagtagcaactgagtagtgtgtatcaacgacccttctcttcgcagcaaccagcaataccattaccagtacagttcagcaactaatcgtgagctgattagctgaagcacataacacgtaaagcgtccatgacgatggagaaacgcacgtcaccgcaacaaccgccaactttattacccaccaactgctcgacgcatttcctctacgcgcgcgcgcccaccaccgccggcgtcacacctcgccagccgcatcaaagcttccgctcctacctcgcccaaatgggcggcaccggcgacgatggcgccaaggcccctgcggccgccgcggccatggacgtcgtgtcgtcgtcgtcttcttctccggcgccagcgccgtcggtgctcaagtcggtgctactgtcctatgcgtacgtgagcgtgtggatcacactcagcttctcggtgatcgtgtacaacaagtacatccttgatcccaagatgtacaactggccattccccatctccctcaccatgatccacatggcgttctgcgcctccctcgccgtggtgctcgtccgcgtcctccgcgtcgtcgccgtgccggcgtcaccgcccatgacgcccagcctctacgccgcctccgtcgtgccgatcggcgcgctctacgcgctgtcgctctggttctccaactccgcgtacatctacctctccgtctccttcatccagatgctcaaggcgctcatgcccgtcgccgtctactccctcgccgtcgccttccgcaccgactccttccgccgtgcctccatgctcaacatgctcggcatctccgcgggcgtcgccgtggctgcctacggcgaggcgcggttcgacgcgttcggcgtcatgctgcagctcgccgccgtcgccgccgaggccacgcggctcgtgctcatccagatactgctcacctccaagggcatgtcgctgaaccccatcacctcgctctactacatcgcgccgtgctgcctcgtgttcttgacgctgccgtggtacttcgtcgagctgccgcggctgcgcgccgccgcgggcgccgccgtccggcccgacgtgttcgtgttcgggacgaactcgctgtgcgcgttcgcgctcaacctggcggtgttcctgctggtggggaagacgtcggcgctgaccatgaacgtggccggcgtcgtcaaggactggctgctcatcgccttctcctggacagtgatcaaggacaccgtcacgccggtcaacctcgtcggctatggcattgccttcctcggcgtcgcctactacaaccatgccaagctgcaggggctcaaggccagggaggcagagaggagggccgcgtcaatggcgacggcgaaggacggcgacgcagaagccggtgcgcggctgctgccggagaaagatgccggtgagcagaagaactgatcaaagtcgaacaccaagcatagtacattaatgaaggttgataaatcaacggcatttttttcatctttagatagcctgaagctgcttagtattatgtttgtaaacattcattattacagaggatacaaatgatcagtgattcgaaatatgcatgcttaaattgcagcattcattttttttctcattttaaagattcagtcatcgtgttaaaactccttgctccctgggcactagtgttcatctaacatcactgtcacatggttgttaatcgtagcatactagcattctgtttgttgattgtgctatatatgaatgatttggtgcacgatgcagtaatgcagagctccaaacctgataatccactggctaccaaatactaccttcagttttactcaaagtgcaacaagaaaggaccaaaagacaaacaaatgcagcaaggaaatgacgcaaagtgtcattacagtgaagatagtatattgagtgactagtaggtcagggtagtagaagagaaagggatttgctagcttcctactcgtacttagggcaagttttataatagggatagttgtcacatctaattttatccatgtaagataagaggtgatatatataatacaccatatctacaccacctctattattataacccaaataattttattttatttgtttgtccaatcccctctttctttcatcttctttttcttggggtttgtgtggaggttgccccttgcatgatagggggctcaccttctctttcctcaattattacttccacctcatcatccaatcatacatgatatttttagaggcaacacattaagcatcatagtacttgcccttactgctgcctacgatataggagtatcctcctaaaccctataaactctaatactaagggcttctttaaaacacaggattaaaaaaagatacatttaaaaaaaaacaaaggattttgatagaaatgcaaataccaaatagagaattataaaacacaggaaaaaaacacgaatgatcgtttgattaggctataagaatcaggataagagatagacttcaaagaaattttcaaagaggttagagctcttgttaactttcctctaaaaattttaaagaaaatgagagaaaaattcacaaaactacaaatattatgactaaagcactaaaaatttaattagtgtatcacaaaacagcagatttaacactaaatttatcacaaaactatacgtttaagatgaagtgtcacaaaactacatatttagtaacaaaattatcacaaaactatgggtttagaaccattttagtcacaaaattacaacacttattgctccaacataacaatggtgttagggatttaaattctaaaatatgtacttttgtgatgaattcaatattaaatatgttgttttattttttaaacacattaaatctgtagttctgtgagaaatttggtgccaaatttgttgttttgtgatagtttggtcaacatacatgtagtttgtgaaatttacacaaaatgatatgattcaatccttgtttcaaatgcttttataggaatttttataggaattttttcgatatgattaaaatctttcaaatttgaaatcaaagggggggggggggtaagtagtactatctttaggttcattaaaagctagcaacaagaataccgaagccatcatttcgcttatttgcgaactaagagaaacgacatatttgcaaataaaaagtaatttgtgaataaaactttttatatatatgttcttaaagatctaaaagcaaaggctaaaaaataaacttcgatgaaaaaaacctcaaaattagctccaaatttacggttgaaaattcaaaatttggctgataagtataagtataaacgaaaagcagctccaaatttaaggttgaaaatttaatttttgactgataagtataagtataagagaaaagatgaggccctacatgaagtcctgtccaatcatatatgcatcattgactctctctctcctttcaattgtattaatcgagtaatatttcgctgagtctgattaacctaggccgcgttttgttcgtgtgccaattttttttaagtatacggacacacatttaaagtattaaacgtagaataataacaaaacaaattacagattccgcctgtaaactgcgagacgaatttattaagcctaattaatccgtcattagcaaatgtttactgtagcatcacattgtcaaattattgtataattaggctcaaaagattcgtgtcgtaatttacatacaaactgtgcaattggttttttatctatatttaatgattcatacatgtgtctaaatatttgttgtgacgggaatttttggaagtttgaaagaaacaaaacactgccgtgcatttcgccgcacattggaggcccatcaagattttatatggccgccatggtccaaggcctcagggacatttcctgtattgggctgagccggactcttcgtcaaggatgaatttgtaatcagtgaaaaaatcgaggggctggatgcaaatctccattcccatcgtattcctctccttccagctcgagactagggctcgcaggtggcttattccccctaatttgctcgggaccagaccacacctccccaaggtgagaaccaaatctctgattccaatcttgttacgttcttggttgttctttgccttgcgatttgggagcggcagcagcagtaaggcgctcgtcaagatctcttcttttcaattgttggggtcgcgctagttcgtcgaaatttatcctttccgattgctggattgcgtcatttcgttaatatttctccttcccaatacctatcttgtgctatttggaaacgagagcactaatctacttcttcgatctaatatgtttgtacaggcccttgtatataaacgaacaaactttactcatatattcagtccattaattttaggtcctaatagttgttttttaacttatgcgaaaattgcaatgtgctgaacagtgcaggtgatatctctttcttaacgaaaaatagagtcagcatgtaattatctatatggtacttaagatcctaaaaattaagcaagggctaggttgattgcttgctgtttgaaaattgttccagttagcattttgctccattctttgttattagtcagactctcaactgctgtcatgttatttactcaggaattagatttttacttcagatatcatattatgcaaattgtattctatttctcatcgtgcttttatctctgtgcctttttcttttcttttcctttcccttccatttcacggaatatattggcatcatcagcttgttgattattcttcgcattgcatcatctttgcttcccctcttttgcatgctcttgctgtccatgctgattggggattgtatcttgagaacctccccgtgtaatcctttgtaaccataccactgtttcctcatttgttccatatacattttctttctatccagttggatacccatggctgcatcctgtttgacattattgcataacaagtactcttgtttatttggttgtttttcttcctatccttgtatcatcactttgctctcccaatattgttggctcctttgctctttccaaagttgccttggaactttgagcttttcaagatgccaaggaggacagataatgctgcttctgccaattcagttgaaccagaaaaatcagaagaatgtttggagtttgatgatgatgaggaggaggaggtagaagaggaggaaattgaatatgaagaaattgaggaggagatagaagaggaggaggtagaggaggatgaagatgtcgtggaggaagttgaggaggtagatgaggaggaagatgaggaggaagaagaggaatctgatgaaactgaaggtgtaagtaaaactaaaggtgttcaccagaaggatgttactgaaaagggaaagcatgctgagcttcttgctcttcctccccatggttctgaagtatatgttggaggcatctccagtgatgtatcttctgaagatctgaagagactatgtgaaccagttggagaagttgtggaagtaagtactgcttacattgttcattttatgtttccatgtggcctgttttgttctgaattacatattctcccgttttatgcaggtgagaatgatgagaggaaaggacgatagcaggggatatgcttttgttaattttagaacaaaaggtttggcattaaaggctgtcaaagaattgaacaatgcaaaactgaaggtttgttttctgttgaacttgagaaatgtctatactgtcactccatcagtgccattgatttttaacctaagattggtaattgatcaagcaagttctggacatttttactacaccttttgcagtttccaaatgtgaactggtagagaacaaaatagtgatttcactcgaatattatcatgcaataagctttccttttttttaattttttttcagtcttattgcacttatatctgcagttgacttctgttgattttgacatagcacagtaatttcacacatcagctgtgctccctgtttccctggatatgtaggaagaaagagggaggggcacacacatatctactatacatgatctctagtaatatcatggttttgtaacgtgtaatatttggttaaaactactgattatgccattaacaggaaacacttgttcatgattgggagtagtggtagcttatgttctcttaccaataattttggaaaacatagctttgctgccttgatcacacacatgtgcagaatatctcctggttccctgttatagctgacaacttatctatcttgatcttttatacctactgaattttttcattatgcttctcgttacagggaaagcggataagggtttcttcctcgcaggctaagaacaagctttttattggaaatgtaccccatagttggacagatgatgatttcagaaaggttgtggaggaagttggtccaggagtattaaaagctgatctcatgaaggtatggatctgggtagttcaacaactttgttatgcaccctcgatcttgtttctcctaaaaatttctttgtacttgtaggtctcaagtgcaaatcgcaatcggggttatggttttgttgaatactacaaccatgcatgtgcagagtatgcaaggcaggagatgtcttccccaacattcaaactagattcaaatgctcctacagtcagctgggcagatcctaagaataacgactcggcctctacttctcaggttcgttcaagcataacatgaacaattttactttgtttgtgtataattcttataccatgatgttttatttgaacttgattattttgcgtgtgttttcaggttaaatctgtatatgtgaaaaatctgcccaagaatgttactcaagcacagctgaaaaggctgtttgagcaccatggtgaaattgaaaaggttgttcttcctccttcaagaggaggtcatgataataggtatggttttgttcactttaaggacagatccatggccatgagggctctgcagaacacagagagatatgagcttgatggtgagctttcctcttgcgctgtaatgtcccactatgcttgcgtattcccccaaaaaatgtcccactatgcttagtctggtttgtctggtgcattcaaggtctcacatatttctcttaacaggtcaggtcctggattgctcacttgcgaaacctcctgctgctgataagaaggatgatagagtaccactacctagttcaaatggagctccattgctcccgagttatcctccacttggatatggtatcatgtcagtaccaggtgcctatggtgctgctcctgctagtactgcacaggtacacgagtacatcatcatcatagacccctttgcccaatcaatgagtaaatacatgtagtaaaggatgattgatgcccttctaaccattgtatgctctgcattttgcagcctatgctgtatgctccaagagctcctccaggtgcagcaatggttccaatgatgttaccggatggtcgtctcgtatatgttgtgtaagcgctaccaaccatcttttcttcagaaaagctaataacatgttatcacctatcagcatgagatgagatgaaatgacttctgttcagttacatgtcattttggcatttccattgctgatgatatcttcattgcttctttgcagacaacagcctggtggacagttgccgctggcttcgccgccgccgcagcaagctggacatcgtagcggcagtggaggacgtcatggcggcagtggcggccgctatggcggtggtggtggcagctccggcagtagcaggccaggtgcaaagcggcagagaggagacgacaacagcagtagccgccacaaaggccggcgccgcccgtactgatctgatcagcatagctgtagctaccacttagaagatgtagtgtcgttgcagaaaattaccagaaaatctggtagaaataatttatactgtttgtactcgtcgatttattagaggaatgcgtttctgaaacaagactgtacatgcgtattttacctgtatcgcagagtgctgaatctgatggtgcactggtacagtataagccagtttcaggtctctttgtaagcctgttttacattatctttcgcttttgcagtaccgtcaattcacccctgtaagccacatggactatgagatttctgggccagaatctgaggtagacagtgaggtgtggcttggctgggtggcgcagcgacgtgtgtgctcaagactggagacacggttgatgctgcccgagctgaacacgtcgtgttgactctctcgagaggcggacgggtacgtgccgcccctccatccattctagccttctaatctaaaagcatccacgggctctctggtgcgctgcttctcgactagacgcctcctccggggaacctcgtacagggcggcgcgggccacagctccatattccggtcgacggcgagtccacgaagcatcggacgccggcgacgacactgcaatccggcggtcctggcagcaggtgaaaggtgcgtgctttctccgcctgagaatgattggttaattccctttgcaattaacttgcaaattctttttctaatttgtgcatcaaaatttccggccatatggtgattgtacatgttgtattggacttctaggcgccggattggccaacttctaaatttatgatgcttttgcgcatgacaaaaatgacagatcatatttatccatttacttcattctaatgaaataactcctagttaattatctttaggttgctcatagagtcatagttactcagggttgggctatccggctatgctgtaccgttctatattcattgatattttgcctgcccaatattgtacgcgaagtgctacagttaacatgatcatcaatgatgctaggtgtctgatttccctgaaacatgttaggttcatgatgctgatctttatttatatacgaactgttatgtatgctctatctggtcaagtcatgcttgatagttgatacatccttttgttctgaagaattctagtacaaatttaggtttttgaacaacagggcaatgtcaaaggttgcaattgttaggttagcttcaaatatacatttgcagcataaactgccatgtctctgtccagtagttatgccaatgtttaacctagattatttcatttacttgaggaaacattttttttgaatttagtttctctactctctgaacaatccaacctggtactgttatctgattctgtgaattttctgaactttatacagggcctatttggtgtaagaatttatatatccgcccactcatttagtcatctgcatcttctaagttgggtgaaaaaatatggatgacggggagatagagctttccagccaaatgatgtttccaaatccagagattccaaccagccttgatgacttcctgccaagcatcaggacaacatgcacacacactcatacttgcaacccgcctggtccatcggcaacagagcacacccatacatgctaccacactcacacccgtgtcttcagctcagatgatgatagttgtggaggtgacaaagccaagccaaagaagagccgcaagccattgggcaaccgcgaggctgtccgcaaataccggcagaagaagaaggctcatacagcacacttggaagaggaagtgaagaggctccgtgtcattaaccagcagctggtgaagaggctgcaagggcaggctgcacttgaggtggaggtggtacggttgaggtcgttactggtggatgtgcgatcgaggatcaatggtgcattgggtagttgcccgatccaagcacaatgtggagttgataatgttttgggttgtgatggaatggctcagtgctttgctggaaagccggagttgggtgtgagacagagttgtgcaccttctacagtgaattgccatatcagctcggattcagggcagaacctggtggtgccccatgctttaagccctagcgatgttattggaagcttcatggtctcatctacctcaaaggatgagtagatattgtaggtattattttgttgagtaaattgcatattggtccatgttttttaaccatggtttcacattggaccaccattaactgaatgctttcactttacaccagattttattaccaaaatgtatcactttggaccagtggtccacttgccagtgtggctgaggggaaaaaaaaaaggaaacttctcggttgggaaggaaccagcgagtccgctgactcatctcctaccacaccgttgatctctttccaacttcacccaaccatctcatggcggtgtgggcagagatcacgctaaagccttgggggcaacatggggagcttgtgactggaaagactcgtgtggaggtcgatgttaggcgacgtgagcaaagaggagctcgtgtacgtccaggtacagcagaagtcgagtcacggaggcgacggcggtggagaggagcttgagctccgggatggcgcgcgggcatcggagtagccgtggagatcgaggttgaaccgggacggcagagaggagcttgagcccaagtacgatgtgctagtgctactgaatatcgaggtcaagcgaggtgcgacgacggcggagaggagctctagctcggggacgacgtgcgggcgtaggtgaagaacgaagtcaagctagcgagggccgacggcggcggagaagagctcgagcttgaggacggcacgctggggcgacggagccacgtaggtcaagctggggtggtggataggagctcgagctcaaggacagcttgtgggtgctgatgcctgctggtgcctggaggtcgacgtcgagcggggggagacacggcagaggtcaaggccgggggtggcgcgtcggcatgggactatgggagagttcgaggtcaagacggggcatcaacgtcgagcggggagagacacggcagaggtcaaggccgggggtggcgcgccgacatgggactatgggagagctcgaggtcaagacggggcatgacgacagcggagattgaaatcgagactgggaaatgcgtgtgtgcgggaacaggcggaagtcgaggtcgagccaccggacgacatcggcggagattgaaatcaagccagggaatggcgtgcgagtgcgggcggaagtcgagatcaagccaccagacatcgagcttgagcctgagaccggccggcacgacgggaacaaaagtcgagctagtgtgacgccgtgttggcggaggttgaccccgtgctggctggactacgagcttgagatgcgcgggcgtcagctctgttatatatgctcgagctctcttaggcgtcgtggtctttgtggtctacagccatcgatgaaaacagttggagatgatcagatagggatgagagattggctctgagagactgactatgggccatacgcccaaagtgaaaggttttggtataaaatctggcctaaggtgaaaacattatattaagggtagcccaaagtgaaaccatggtaaaaaaatatagtccaacatgtaatttactctattttgtttctagcctttttatcagaagataagacagtagtattacagtgccgtggagcctggagggttgatgcctcgtttcctaggtggcattttacccctgaaatctggtgcaagttagtaattagttttcaggttcattatcaaatacaaatttttggtttctacgtagtgtaaaatgtctttggtttctatgcagtgtaaaatacacatttccccctcttttccagagataatgttcagttttaggaatttgtgttttaggagctgttaattctgagcatttccttcttttgcagatactctgtccaattctgtgagtggttgggtgtgatattctgtagttgttaactatgcacttttacttcttttgtagagatgatgttctgtttttggaaagatatttaggagctgcatgactcatgaatccgatggctgtataatattttctgcgtgccaaatctcatgatttttccaactcattaactggattaggacacaaatctgcaacagtcagctggagatccctgatgagcagcacaaaccggtcctgaaactgttcaaatacaacaagaacaaatctattatcttattaaagtaatagaaaaagaagccaccacatttgttctcacggcctagaaattaccacgttaatcgaagaaaataagaaaaataaaaaaggcaagcggagaaggatatgttaatagcatgaaaatatgaaaagaaatagtaaagcaatcaatcggacaaggattcatggaaactgtaaaagtgtcaaacatcaataagaaacagacttagtgtgtggaaacggaaatacaacgatacaagtaaaaatagactccggtcacagtgcattagtatcgtttagagtccaaaagtaaaaaaaaacaaaactatttaaaatacctgaaattcaaaatataactaactattgcaagaagaatctatgtataaatacaatttatactaatatgaaattacaattattttttttaggaaatctaaacattgagaccagagttatatagaatttacttaaaaaagagtccatataaaaatataatttaaaaatatctgaaattcctaattaaaaaaaaagaaatattcaaagagaagactagactccatgtatatacaatgtagaactaattaaaatttggaactaaagttagagtccataaagaaacaaaatttagaaataactaatatttggaattaaaaaataaaaaatattgaaagaatattttagattcattatggaaatacaatttacaaataacagaaattcagaattaaaagaaatatgggaagaggagtctagagttcatatagtaatacaatttaaaaataattggaattcaaaattaaaaataagaaatacttattgaaagaaaggtttagagtccatatggaaataaaatttataaataatagaacatttaaattagaaaataagaaatatttttaaattagaaaataagaaatattggaagaggagtctggaatccatatagaaatccaatttagaaattacaaaaattcaaaatttaaaaatagttagtaactatcacgtatatacaatacaatatgaatattatatgtgatatacaatacaatatgaatattacatattggttggtgctgttaagttagtacaaaatttaaaattatgttgctattttaatatattttaattatattatgtgaaaatatatgctactatgtgaaaaaaaataatgatatacaatacaataaaaatatcacacatttgttagttcaaccaagaatttaaaattatgttgtcattttaatatattttaataataaaatatgaaaatatttaagctaatatatgagaaaaaaatttaacgatactagccgtgcaatctgcgcgggccaccatgctaaatttttttttttttgacaacagaggtacacaagcaactccaacttcatttcagacgtacacagaaaacaggtacaccgtacacgaacacctttactcataggcgtgcaagaccaagtactccattcacatcgcatacacataaaaactcataaatctcacgcaaacaagaacatcataaaaataaatataaaatataagatactaaaataaccagagcaaaggagatcactaagatgattcactcatagttatacgaaaagaaagaagcaacagagagctcaaccacaatgtttcagttccagacaaacgctgcgacggcgagcacagcggcagcaacagcaagtgagcagctcccaccggcggccatggggcccgtcgccgccgcgccgttgttggacgatccgctgtactgggcggtggcatcctcaaaacagctgacgatgcatacgacgaacagcacgagcgcaatgaccggcttgggagaagaacgctccatcttgttctgcttttgcttgcctgttcagagttcagatctcagagctgagacgatacacttgagcatttcgctcaaattgacaggatttatatagaattgcctcaagttgacatggtaaacatagtacacagatgcacaatacaagtttgtccatttctctacatcgtgttctgctcgccaggatgagttgggtttgatctggacggctggtttgttgctgcatattcgtctgaaaaattcaacaagcagatgaggtgctggctttgtttctgatgctagagttccttcctttttgtcacttgtaagttgtaactttcactatccatacaacaaacgtaacaaaatttccttttcagagaacaaaactgatgatctgattgacaacgtcagttcttatgtgtgttggtcgcatcgcatttatcaatgagcttagatgatgcctatgttcagctgatgcctgatgccatcagccacagccatgtcgatacgctggctgattagctgatcgatgactccaatgtaagcatggaaaccacctagtacatcatatggcactccggtgatgagaggagttcgtgttttcttggggcgctgcgttgctggagttcatggggccagccgcgccgccgtccgaagccgccgcggcggccgacgatgtggtgctcccgtacatctcgcgtattctcatggaggaggacatcgacgacgacatgttcttctgcctgtaccccgaccaccccgctctcctcgaggcgcagcagccgttcgcccagatcctctcctcctcctccggcatcgccggtgaggtgaacagtgcacccatggaggattctgctgccttgatgatgcaggggagcggcaatggtaggggacggaagggtagtaagcatggcggggacgagctggaggccgaggtgggcagggcgagcaaactgatggccacgccggaggaggaggacgacgacgacgatggcgtcggcgagatgttggagaagatgatgctcaacggggacgaggagatgaacgcgccacgcgtccccgcggagaaaaacggcgggaaggcggcgcggcggaagaggaggcagggcaagggggaggtggtggacctgcgcgagctgctcatgtcgtgcgcgcaggcggtggcatcgggcaaccgccggagcgccggcgaactcctggagcagatcaagcggcactcgtcgccgacaggggacgccaccgagcggctggcgcattacttcgccgacggcctggaggcgcggctggccggcgcggcgagcctggagcaccggctgctcgcgtccgcggaggagcgcgcgtcggccatggagttgctggaagcgtaccaggtgttcatggcggcgtgctgcttcaagtgggtggcgttcacgttcgccaacatggccatcctccgcgcggcggaagggaggagcaaggtgcacatcgtggactacggcggtcagtaccacggcctccagtggccatccttgctgcagcggctggcggagagggaaggcgggccaccggaggtgaggatgacgctcgtcggccacccgcagccaggtttccggccagcccgacggctcgagaggacggggcgccggctcagcaactgcgcgcgcgcgttcgggctcccattcaagttccgcgccgtggcggcggcgaggtgggagacggtcaccgccgaggacgtcgtcggcgtcgaccacgacgaggcggcggtcgtcgtgaacgacgtgctcagcctgggcaccctgatggacgagagcggcgtgttcgacgacccgagccctcgggacacggtcctcggcagcatccgcgacatgcgcccggcggtgttcgtccaggccgtggtgaacggcgcccacggcgcgcccttcttcccgacgaggttccgggaggcgctcttcttcttctcggcgctgttcgacatgctggacgcgacgacgccggaggaggggagccacctgcgggcggtgctggagagggacgtgctgaggcgggcggcggtgggggtgatcgccggggaaggggcggagcgggtggagcggccggagacgtacaggcggtggcaggcgaggaatcggcgcgcggggctgagacaggtggcggtggaggccgacgtggtggaggcggtgaggcgcagggtgaggaggcggcatcacgaggaattcgtgatcgaggaggatgcagggtggttgctgcaggggtggaaggggcgcatcctgtatgctcactcggcgtgggtcgtggcagaggatggtgcgcactagcaactagccgccatgacggtgttcgtgtgtactgggaatgcttgtttgctgttggatcagtggagtttatggtctttggattgtttcatatccctgcagcaactagcgttggagagctcacagtagtaacaacaagcttagtggcaataatcctttcagctgcttcagcacaagacgagcttccattgtccaccaatgaatgactaatgtaatataccaggaaaaccataacggcataaccactagcttcctttcagcacaagacgagcttccattgccatttgtccaccaatgaacgaccaaccaatgtaataataccaggaaaaccacagaccagaccacataaccacagattagagttcagtccttgaagattgctgaagttcgatgctgatcccacgggatctttcaactgttggcgttacagcctttctttctttggtgcttagcttgggcaacgtacaggtacaggcaccgcccatatttctgcagttctgctctttctgaagcttattgggcgaaagatattgccgtgtcaacattagtgaccactgaccagccaacacaacataagatacttctcaccgagatcaccccaacacacacacacacaactcaaaaacttgaagaaaccggtgccccctccacttttatccgggcttgggaccggcactggcagtgttaggcacccccctacccccaaacataacaccccaacacgtcaagtgaaaaaacaattggagcacctctgactgttaaacagtatgaagttagtgagtataaagaatagatcgagttagctacccatagcccatcatagcatctaccaacatcaaggagagcaaaaacgtcgaataaagcaactatcgtcataatcaaatactagtaattcaccacaagcaacctaggcagaaggagctatatataaccataccgacgaaaataaacaaatgcaaatgcagtttgcattagactaacaatgcaaatgcgcatagaaaaacagactaactaccaccactaggttccggtaattatactagtatatgctagtttgccaaacaggcagataacataaactaagttcaacatctaaggataactggaacgctacgctaataaatttagctaaaaccaaattttccgaatgaaatcgtcttatcattgattaaccgattttctgtgataaatttttagcatccgacaagtggaagtccatactcaatattgccttcaaaggatatacatgaaatacaaagtcagcacaagtgcattttcagaacttaggacattcaacatggttaatactcccaacacataatttaggatattcaacatggttaaataccacaacacatatctcaattattagtgtactatgcaaagaaaaaaattagattgagcatggcgacgttacggagtaaaaattatgttcggattatatattccctaaataaatgttagctcatgtaaacaaactgacagaaggtatatgccaatcaatacacacacaaaagggaagatattataagaacaagttatcattttaataatatttaatttaattacatattcatcatcctgttaaagatcatatcaaaccacgtttgaatggataagttgaaaatattttaaataatatagattcaaaactatgtgcactatattaaatttaattccatatccatcaccctattaagtaacttactaaatcagaactgtagtgcatcaaaggaaatagctgaagaaaacacgacataaatcagaagaaacttggcaaatgatcaagtcataataaaattacattaatgtaagcattttaagtgtatcacattgcaaaaaacattttgaagacatcttctgatatgtactttatgcacaataataggaggtaaatcaacgataaccacacagaatgggcaatgacacacgaaatatgattaaacaaacatgagctggtaaaagaaaactaaatacataattactagctcagcaatttccataaaaaaaacatacaaacactatatctatttgacctcaatctcatgaattactagatcttcacaagtattcgcatagtaacacaacatatattgacatcaaataaataaacatcagaaagcaaccatagaacatggatatgatactttctagcctttggaacagaatgcagatggaaaactaattagcaagaatgaaatgttaatcacgcgaacaaaatttagtaaaaaacaatttttgggaatgaaatcatcttatcgtcatgcaaatgatcatttttactaaattccaaacatctgacaactagaagtccatactgtaacatgaaaaagacaatatttggcagaaagctcatgtaaaatatattctcacacaactgaaatcatctggtgccagtggatttcagaatttaggacatttaacatgattaatacttgtacattccaacacatacaactctaaattagcaccttattatgcaaagcaactaaatttggattgagcgtgtatagcaatcactattaacaacattaaaaatgttaggattagattttcctaaaataactgttactaggtcatgtttacaaactgacggagcatatatagcaacattattaacacagtaaagaaaatgttaggattagattttccctaaataaatcttactaggtcatgcacacaaactgatagaacgtacttacgtacatgccgacacacacataagggtaaggcattaagagaacaagttatcaatttttaataatattcaatttaattgcatgttctaaatcctgttaaagatcatatcaattcaggagtcaggtggtggaaaggataggtttaataagtagctatatagattcaggagtcaggactatgtgcattatatttaattaaatccatcatcttgttaaagtaactacgaagactatcagaacagtactgcatcaaagcttggttagggatcaagtcattatcaaaatgatattaatgtaagcattttaggtgtatatcacacttaaaaccattttaaagtcattttctgatatgtactttaagcactttcaatatgtcgtacgtcactgcactctaataggaagtaaatcaaagaataaccaaaaagcattggcacatgcaatataattaaacaaaattcttgcaggagctaaagtaaaagaaaactctaattaaaccaaattagccgccttatcgccttatttataaaaacgcgaaaggtgtgaaggcatcaaagcttttaatagcaatacaaatggcagctactagcttagtaatgcctagaaagaacacacacaaacagtatttatttgaacttgtatctcatgcattactagacatagacacaagtaatggcacagtaattgcattgacgtcaaacaagcaaccatagaacattgatacgatatttctaatatttggttatgcagatggaaaacaaacaatctgggaattaataattagcaagaaaaaaaatgaaatgttaaggcgctagctggatataggatatatttagcacaaagaaagcatcaagttttagaccataaaataaaactatttgcctagaataaattaatgctacaaaaactaaagcacctatacatttagccaaaaagagattactaaaaccaccagataatgtatgaagagatttaaggttggttcaaattaaaaagacaaactgaaaccatgcacacagagttgatgcacaaataaaacaactggtggacaatcaaggttctcaaaaccactatactagtctaattagacaaataaaatggagaacttgtatgcagtttcaatcacagatttattgacaagagaaataaccagttagtgaattctgtagcttgtatgcaatttcaatcacacaagaaaaatgatgcaacaaaacaagtcttaaggacaaaattgaaactaaggaagaatgctagccatctagcaaaaacatgcaagggccaccctagaatgaaatggaagttccacacatgcaggtatataaaaaaaatgaaatggaagttccacacgtgcaggtatataaaaaaaggaagaagggattctacacaaaacaagaaaatgaaatggaagttccacacatgcaggtatatataaaaaaaaaaggaagaagggattctacacaaaacaaggtcccagttgagctaagtttatcttcacaacgtataataaaattgataactatataaagcattacactggacaaaaatactaataagcatgcacatttaagtgaattaatacatgcaaaaggatgctatatattagttgttctgttagtatggcactacctcacaaggcaaaaaattctcattggcaagcaacaatgtgctcttgtttaaggtcctttcttggcaaatcttaattggggatactatgttgaatgagatataataattataaagaaagaaatataccagacaaactgtaagaagaaacaagttagtgataatgtgttgttgtgattagcaactaagttcaagggattcacctcaattcaaaagccctggacataagatatataatttaggacaattcctatcaagcataatatttaaaaaacatccacatttccatcttttatgagcctaagcaaaaattgcctcgacactgtaaacttcagttatctaccaagttagtatagaagatgaataactttcaaaactgtggaagctgcaagacgatccaaaatattcctggaaatatcctagttcctgaatgaagtgctacaatgctacattcaacactcacaaaatgaaagcaagagagaacaatgccacaagagccatagagtttcattctatacagactaaatcagtatatggacaaaattaccatgttacaactcaggattatcaaaacaaattaccatgttacaactattatacagactaaatcagtatatggacgtctatatcatttgataattacaatttccaacatcagagggaagcttaatgaacacacaaattacaagatgacaccaaaccaacatacaagagggccaatcatatgttgaaatgaacccatatcctagctagttatggaacagtacaagcccatatgtaaaggatactactggagatgcaagctggaccaagtagaaatcaaatactgctactgagaactcctccatggttcataaagcaattgtttctactcagaagaaacttcaaacagatggctttataatgttgaggtccataaatgttcttgaaataaatcttcaaattaatttcacccaaagtagtcaaaagatttcagaatcaccttcacaaccttgtaatattgttcgaaagaactgccaaatgaatcgtctaccacagaaactttaggatgtgtcttcttagttactacataaccaccctcacagcaagttaataactgactgatatagcttttccggaagtaaacaagttaacgtcaaattctcggagaactatggccatgtctatgttctgacaagacaaccataaaagcgcagcaggatggacttaaataaccagagttttccaagcagacaaatggcctccaaataatatcaatctcacttgttattttgacccaaaagcgtagcagcagtcttgaatggaatggagaaaacatcttatacaccaaagactattcctaacaatgaccaatcccatacaacaagcttcaatttctctggtttataaatgttcgtattacaaataaaatgttcttggacagttgcttgtaatggaagcaaaccaactgcacaatattgacatattgaaatttcaataaattgcaattaaccatagccctaaaccaaagcatcaaggttcctaaaactaacaccagtaaacagggaaatcacgagatctgtacctcaaactgagcaggtcaagcagcaagtaatctgtagttcctgtactaggataaattaatccacagggaaggcggtcaaaaagagctccttaaatcctcgcgagaaatcctgatgttaaactttaactaagaactgacacagaagaatcattccaacgccctagcacatagtgacgatttttatcaaagccaaaaagcaatacatggtccggttaagatgacacacaaccatattcaagataatctgaagagtatgtcttgccgaaattgaacaagttaaagccggtgatttgaaagctctgaacagaccttaaattttctgatatgacttgaccttatcataaaaattactagatccgaaggaaaaactgcatagctgcaagcagacgaacggtctcaaacaaaaccaagcatcacgaacttgaaaggaaccgaacaataatctgaggccagtgagcaatcctaaccatgaccaattcagagcgaaaacttcagttcatctagcctttgatcaagcccaaaatatccatgacaaatccatcgcaccaaacatgaattgacacaaaccaaccgatcgcgcatattgtacccaacacagcaaaccacaattagccataaaccaatcgaaagagatactgtgttcagaaaactaacacaacagcagaagcaaatcgccgaaactagaccccccccaaaccgaacggatcaagcaccagaaaaggacgagcaagcgggcaatctatccggctagttggtgcgcctgatcatcaatcaacaaacggcagcgaacgaggtgagatcgaaaccgattgatcccttacctaccgacttaccagcccacccgcggcggaggggaaaaggggaagaatgaccgcgcgagaagaggaaggaagccatgggaccatcctcaacgaagaaaaagcagcgaggatcgggctgcatttatagaggagcggagaggagaaccaccgaggaggaaaccgagtcggtgggctggagccgggttgcgagcggaatcggtggtcgcccgcctattcttgtcgcggtcggagtcggagacgagactaggcgatgttatctggcgctttttccggtgtcatggtggggacgttcttatcgctttttcttttttttttagaggacgttcttatcgctttttctttttttttagaggacgttcttatcgctagccgaagcagacacgcttcaccgtcctaatcggctaatcctcgatgattcgtcgttagcagcaaccagttgtgcagctgtgattttacgtcatgttccatcttccatgcttccatggagcacagtaaaaataaattatttgtcatttttgtttttcaaccgaaacaaaccgtgttcacacttgatcaaccatcgatatttggatggttgctggttcacgaaggttccaagttccaaccatagctggaaatttaaaaaaaattagattcgaccaaactatggtgatttcgtggtcaattccacggaactaaattaagcacgacaattgcattccacaaagctagctgatctatgcatttccacaacaaaaagtgtgcgtatttgacggggaacatttcaatggtcttcagtgctggaaatatttttgtcaatgactgctgaacatgtcttccaaagttttcagccagttcatatattgccaccgctccttctcaaccaaatggtggtgaagtgagcttgccagtttggaattaacgcctcttgccaccagatatcctttcagtgcaacctgtaaccgaggatccaaatctctgcaaaaacaatggggaacactgtcattgattgcaaataggtacaaggaaaccaaccttgtaatgatcttaatcgaaacaacaggaatagagacccctctaacctcttatgttgccaaaaaaaagggaaacaaaggctatttgatgtttaagggaacagaaataggccccttcagtggagcaatgtgatacagtcaactttcaatttcataagtaccatttcatgaatgagcagtaaaaagaactatagaaacattatagctcaacaaacataaaacatgtttgccattgaaccagatagtaaggatacaagtaatggctaaggttactttaactgctggtgacaatgaaatcctaccaccaagcctcattacctagaaattatagaccattgagtccctaaacaatcacatcacgatgctatctatttgagatgacatgtcctgaggtcattttgctaacaaaaaaaatacaaatgtagtgatgagccatctaagcatagtctagtcccaagttaacacatgtagcgtgtaccaagtggctgatgagatgcttacagcccactgattctataaatttgtactgactcgcttaaatccagtcaaaacaataaaatccaaaaaaaattgggatgaggaattgattaaatagaataaaaaggtccaatattcctccttgtttattttagaatatctattttaatccgaaaccaaggatcgattttcagactttcatagttatatgctgcttagttggttcttactacacttgtacctccaaaaagatcagcatcgcccttatgctacaaaacactttcaaccaacaagcttttcttgttcattttgcactttaaattaataaatggaggcgaacatgtgaaggttccaaattttagcatgagcatactcacagtatggccaagtaatcaatatgtttgaacaaattcatgtgaatccagccacattcatgttgaacatatttggacatggcgttgcaagccaatataaaaaaaatctctaacagaagacatcgtataaatttactctataaaaaaattaactgagaattgcaggtgcaagcaagagtaatggagaacaggaattcgtgagacctctccaccaagtttaccaaagttccttttaaaaaccatccatcaagatagaacgcaagaaaaattctacattgaattttgacaatagggtataactagatattctagcaaatgaagaccctgcggcttaacatggagttaataacaaggacagatacttggttcactgtcatgacaagactgtaggaaaataatacatagtaatagattttcagtctaccaagatactatgttgtaagacaatgtaatcaacaatcagcgcgttagaacagtaaaccacaaaaaaatatacgcatgttcctctacttttgtagaaagaaaagataggtggtactgaatttcctggaaggcataggctctcctgaaattgatcatgtgctaattttttttctaccggtcactagaattacagagctccaccaaaatgccatgaaagtgcttgtttttccagatttcttggaggaactccaagtttatgagcccactgcgcgcatcacaatatccacaaacattgtgtttggttcattgcttcaacttgccacaccgtactttaggctgccacacctccttagccttggcaatgttagttaagaaccaaacagcccctaaaatcacatgaatgaagaaacatcacctgaactcaggcccttcatacttgtcttccccagcgtcgccagcaaacgggtgataacaagcattagtaacatcatagtcagcagagccgccatcaccttcatctgcaaacgcgcggcagtcgaaccgcatcaccggcttcacatcaggcttactgacgaacaccttcatgagcgcgtccctgggcaggggctcctccccttcgaaccgcagcggctcgagcaccgccgacacgaggacctcctcggaagcatcccggcggcgcaggagcacttcctgcccgcgcggcgggtccgacacggtggcgaagtcgggaatgtcctgcgagaaccagggggaagtgagtggcgctggattgggggcgggaggatgcggtggtgggtacctgggattggagcgacgggggagaggagggggtggaggaggagagctcatgcgcgatctcggcgcggacggcggccaggacgccgccgttggcgccgccacggcggagggcggacgcggccaggcggcgcagcaacatcacgccggaatcattagcgagctgtcggtcggtccgcgaaccaaatacagtggaaggcccataaattaaattggccaatcctgcaaggcccaatccgttaagagtccatgaaaactgaaaagggcctggtacgtcaacgacccagctatgaaaacatttgccttaaaatgtcgtcggctatgaaaacattttagtttcactttacccccaaaatatcgtgggaaatcacgttcacaatttcgcctaggttcttctccttcacaagtttaacggcgaaatgaagaatgacttctgcggacagcaaaagtaagtataagagagaaagaaaaatagtgactttgtgctgtgcttaaccaacactttttttttgaacattcaatatattaaacattaaaagcacaaaacgtgcactggagatacatgattgtctttccaaagagcagcttgtaagagttgctttgtaggacaagtattgttattacaagtatgactaatattttgacaatttagcacttcagattcagaagatgttctagcttttttagataggtagtctgtcattttgtttatgtctctgggaatccatttgatgttggaggggccatcacctgcaaaaatttttaaaagtgcaagaagaggtaaaaggctccagtggcaattctgattgatgtaatcagtattttgaagtaacagtgttagctcttgattgtctgaaagaaaaagaggatttgcaattttaaggaaatcacagatgaagagagcaagtttgaaggctgcaagttctgcttgcattggtgatttgtagagacttgatttcccctgcacaaagatagcttgatgattaattggattatgaagaaagaggccaaaacctgttagattgtccttccaagaagcatcaaagaagcatctgtttcctggtaaaaagtttagacaaacagtaggattttcatttatgataggagtgtcattattatcatcatcatttgataaagcagtaatgtagctcttagacatggcattggaggcattacaaatttgtaaaggttcccaatctttttttctgaagaagtgatcatttttagctttccaaatataccaaagaagaatagagataatttgaaagttattatcaaaactattagaagcaaggagatagtgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaagagctaagccttgactagaactgcagcgggaacaccactccacaggcatcctcgacggcacggacgaagcctactcctcggagaaacctccatctgacacatactcatactctggggttgggaaaaaaaatagagcaagactgagtactacccactgtactcagcaagtcataccggaataggggtatgatgcagggaattatcaaaggagagctagagtggttcgtttgcataaaacgagcatttataaacagaagttgaaagaattaaacagttgcaataattaattaatattgatcatccgctgtccaacgctatcccacgttgcaacagggccaaccatccacctatactatccaatttcattagactaaactagggtaagactaatcacggtgaatctggttgaccgcccataaccgcgggcacggctattcgaatagttttactctgatcagaggtgtacaactgtacccacaagacatagccccacgacacgtttccgtgcgccgacatgccaccacgacataccggaaagaggccgtgacaggacccttcgcataaccccatctaaccaagcacaccacacctcaggtttcaccccccactcctcgcaaggcagcgggcagtcccctctcgtgcctaggtgaatccggaagcgacagaggccgtcgcagggcccgccccgctccatcacgcccacccttgcctggatgcgtcagctagaggaaagctacactataagcccagccgttgcccacgctggcttgtggtaagtacgataagttcttccagggcatcccgtgaaccggtccttaactgtcatgggtgtgactagcaaaaccatgcacccacagcccaccatgtgattcattttaattaaccaacaccaaaatggtggtactaaaccaaccttaccaattgaacctaaagtctatattttagtgagctttccccattgtgtgctagtggaactaagcatggctaagcaattcctagtccaaaatctattcaagttataacccaagctaacaaaggagcatgatatcaaaatagcatggctgtaacaataggtaaacaccccatagtaacattataaaacaatgcaatatttgaagaaaaacaatagagcatttgcaatataggatcaacatgttcaagtgacaagcatgacttgccttgctctgctgctggaggaacctcggcgactattttgaagtacaccggagcgtcggaagaaccggaatctagcgacatacaaggcaaatattgcaaacaggctataagactactgaaacagggaacaaaaccatttttaatggattctacacatttttcttgatttactgagacttgaatgggcttaaacggagctcggatgaattagttatgaattttagaagattcactgtgtttattactataaaagaaaaaccttaaatcatttattgcgcaataaatcccagggctgacgtcatcaagggggacgcggcgccgacatgcgggccccactggccagcggctcgggagagggaggaaaaggggcgccggcacgcgggcccactcggcagtggctcagggggggcggttcaccgtggaccgggaccacgcgggtggtccaccgccggtccacgggaccgacggcccagatcgccctcggggccgatcggacgggcggtggcgacccggctcggctcaagaccggccaagcggccacggcgacggcgacggcgcgcgcacacgcgttgccggcgactgcaaccggcggcggaggcggcggcgcaaaggcggcgccgacgggcggtggtgctaaagcgacggctaacgggcggcggcgctaaagcggcggctaggagggagagggaggggaatagaggggagagggcgcctcaccgagggtggccggcgcggaggaagacgacggcgaacggcgacaacgagccacgggaggacgacggcaaccggcggacgggattcggggtgccctaaggaaggagaagagagagattagagggagggagatgaaccacggcgaccggcattcatggccgaaggcggcggtagaggttgaactcaccggagcgcgaggggatgcgaattccggcgatgaatcccgacggggaaggggcagacgagatggagttcggcctcgcaaacctgacggcgacggcggcgcggcgcggcggcgaccctagcggcggctagcggcgtccggagtagcgggggcggcggcggcaagtggatgcacggtgcggggacgatggagagctcgggagagagaggcggcaaaaggaaaaacgaggaggagagctcggggatggattttataggggcgggaaggtcaggaatgacccgagcgcgtccgatttcgccggcgacgtggggaaggagagagagaaggtgagggaggattcaaaatcgaatcccgcccctctcgtgcgcgggcgcggccgggagacgcggggagagggggcggcgacgtagcgtgggcgtgggcaacgcggcgtgggcgcagggaaagcgggggaggtggggcacggcggcggcggtttcgggggtggtgaccagcgcgggcgccaggaggttgggggaggacccgacaggtgggccccacctgtcggcgaccccgggagaggagggaggcggggcggcctggctgggcctcggcctgcggccggcccagcggggaggagggggagaaaaaggagagaatgggctggcggcccattcggaaagggaagggaaaaagaaaaagaaaaaggagaaaaggattttccctagaattaaaatattgcttgctcaattttaattggttaaaattatttctagggctctgaaaattccactaaaaatcctgttagtgaatttcgacatgtagaactcaagaaaaattccacatgccagattcgattactatttgtattacttccttagggttttctcttgatttgcaccggcattttcttagggtcatttataaattaaattttcggcttgggaggagaacttcggggtgtgacagataggcaatgatttcagaaacattatgcctagagtcaatgatagaatgattgaaatatagctcagaaattttccaagtgagtctagcaaaggtgcagtggaaaaagagatgagtatcagtttctgggctgttgcagcgagagcaagaatctgaaatgtttgaaactttagagtgaaggttagcagcagttggaagagcatgtcttagggcagtagcagtgcggtagcgcacttgaggagcccaaggcctccagctagactagaaaccggttagagaaccacacctcacaatgcatgtgtcttagacagtatctatgttagtgggtcccacccatattagtaggacccacccatccctcttttcacttccatctctccctcccatgcatgcaagcatgtgaggggaccactcacagtttcccttttggcatgaggaaaccgcaccctggctaggggatgcaatccttagcaaagatatgggtcccgccaccttttttcattcacatcagattttgaactagctggcaaacgaggtaaccctccagctaggagtactgtgaagagccttataagtctccaaatgaaagttttgaccttaggaggaatgcattttgtagaccaagtttttagaaggatactgcgatgtacagagttaaagttggaagaatttgagtgagaattgctagaaacctgtttgtaggcacttttggaagtgcaaattcatgtggttgttggagtccagcaaagtctgtcttcattatcttgtgggacaatctatacctgtgttataatttgtgccatttcctgataaaaatttgattcagcttgtttaggtcccaatcttttctgtcattccaaagacgaggcttactgacgaacaccaagctaaccaacagtagcttaaagcattgtgacagtgtgagtggtacccgtcaaatgtcatccatgtcgcttcactttgcaactactcctgcggcgatatatatggtgctttctcagcattatcgctcagtacctaaacattcattcatcatcgggcgaacacagcaaagcgccgagttactgtgctcttccatcagaggacggaaacagcaaggcaagcaaaatcagttgtgtgcccttagccgtcagagtccaccggattcgtcggatccatccatccataaattcgagttaacggaaagtcctagccatcgcctagtcaatatcttttttttttaatggaatcgcctggtcaatatcaatctctcgtcaaaaacaaacgaatttgaatctaattcagtacaattcacacaggaaagaaagattcaattagaaaatggcgatccgatcgcctgccattttccatattctttatcccaaacatacagggcatatgcagttgtcttcttttattagaccaagaagttgtaagctttggagaaaaaaataactcctttccctctctccccttcctctccggccgggcagagcagagtagtagtggaaagtggagtggtagactgcgctgcgtgtgcgtgctcaccggccgcggccggagatggagaagctggacaggtacctgcaggagaacttcgatgtgccggccaagaacccgtccgaggaggcgcagcggcgatggcggcaagccgtcggcaccatcgtcaagaatcgccgccgccgcttccgctgggtgcccgacctcgagcgccgctccttggacaaggccaaggtccgctccacccaggtactaactaaccacgaactagccgctctaatccattcccctcacatcgttctccatttcaagatatcacggtttttctgtttgatcccctctctctttctaccgcatctcatcgtgctcgtgggtcgatttgcctagcaagaacaacatttagctaacaaaaaagaactgcttttggtttgtgtgttcattgttcagtattcagtaaccgttgtatgtcctgtcttttgccatcagatcgtgacacataatacagttctcctcttgtttagatcgctctacatgtttcgtcccgttcatttgctcatcggtgccaaacaattaagacaaaaaatcaggttatttatgctattgctccatcgtactgggcacagacgcacagtaggtccgtatcatgttgacatgtataaaagatcaattactttcaaggaaacttccgcgaagcaaccttacaaaaaagtacgaaataaatggtgttagaaaaggacaaatatatcaccctatcacatcgattctgttatgtaggagtatgtatagttatctccacctgtcagtctttgcaaatatgagatcattgtttaaagtccctaatttggagtactattgatttcaacttttcttgtcttcatgggaaaagaataaagaactctatgtttgtttggctgggagaatccaattatggccttgtttggatcctccgggctattaaatagccctccggatccaaacagggcctatgtcttcagagttgatactcttaattcagggattaattctacattactatgtgctgtatattttagtgatgtatacgctatgtgctctaggtttggtggatagggtgggcagattcctatttctgacttctgagccaccctatcagatactccctcggtcccattttgagtgtaaccattagtttctgtgcccaactttgatcgtccgtcttatttgaaattttttataattagtatttttgttgttatgagatgataaaacatgaatagtattttatgcgtgacttatgtttttaaattttttttaaaattttttcaaataagacggacgatcaaagttgagcacggaaaagcatggttgcatttaaaatgggacagagggagtattatttttatcacacaaattcacaaaagtccccctattttacggtttattcatatgaaccatctaactccagtttcactagggaccttcttgttttataaattcttctagatgattgagtgcttaacattttgttctctcatatgccgatagttttgattggaatgtcattactttatgcttaacaagtcaactaatttaattttaacaatcatgctgggaaaattcgcaaacatcagcttcggtatactggttggtctgccttttcagcctagaaaagtagtgatggtatttatatattaaaataaaatgacccagtatgatgcaggtatagtggcaatgtgacttcacatgtaataggagaaaaagaaactgcaataaagtagccgactatcatgtttgcaacacaagcataaaaccatatttcttgtaagaacaatcaaatgtggagatcttgcactactatattttgaatattgtgcacgactgaagttatttatattgttgccatccgaagtgttggattaattaaattcattttcatggactaaacaacagtattgctattccttatcagttacctttttgtaattttgtttctgttaatggaaacaagagaaggctggctctctttctcaaaaaggaaaaaaaatctctaccagtttccacattatacagtatgtgattttatcacacagctacaggaaaataattataacatatatataaccagtaaaagcgtttccattttttgtgtttgttgtcccaggaaaagattcgggttgccctctatgtgcaacaggctgcactcatttttagtgatggtatgggataccttttttacgttattgttcattttgttgcattatcaactctctgtaacttgatttaatcttaatgttttaaacaaaaggtgccaaaaagaaagaatacaaactaacaggggatattattaaagctggatatgccatcaatccagatgagctagcattgatcacaagcaagcatgattcaaaagctttaaagatgcatggtggggtagatgggatatctataaaagttcgttcatcatttgatcatggcatatatgctagtgagttagatacaagacaaaacatatatggcgtcaaccgttatgcagaaaagccttcaagaagtttctggatgtttgtttgggatgcattgcaggacatgacccttataattcttatggtatgtgcattgctatctgttgcagttggtttggcaacagaaggttggccaaagggcatgtatgatggcttgggtataatactcagcattttcttagttgttatggttactgctgttagtgattataagcagtcacttcagtttaaggagctagacaatgaaaagaaaaagatatttatccatgtaaccagagatgggcgtcgacaaaagatctctatatatgacttggtagttggtgatatagttcatctgtcaattggagatcaagtacctgctgatggactgtatatacatgggtactcccttttgattgatgagtccagcttatctggtgagagtgacccagtgtatgtttctcaagacaaaccattcatcttggcaggaactaaagtgcaagatggatctgctaagatgatagtaactgctgtcggtatgcgcactgaatggggaaaattgatgagcacattgagtgagggaggagaggatgagacaccactgcaggttaagctaaatggagttgcgaccattataggaaagattggactggtatttgccatattaacatttttagttctgctggttagatttctcattgacaaaggcatgacggttggtttgctcaaatggtattctactgatgcattgactatagtaaactactttgcaacagcagtaaccattatagttgttgctgtacctgaaggattgcccttggctgttactttgagtcttgcatttgcaatgaaaaagttaatgaatgataaagcacttgttagacatctttcagcgtgtgaaacaatgggatctgctggtaccatctgcacggacaaaacaggaactttgactactaaccatatggttgttgacaaaatatggatatctgaggtttcaaagtcagttaccagtaacaccatttcaggagaacttaattctgtggtttcttctagcacattgagtctgcttttgcagggaatttttgagaatactagcgctgaggtggtcaaggaaaaggatggcaagcaaactgtcttaggaactccaacagaaagagcaatattagaatttggcttgggcttgaaaggagatcatgatgctgagtatagggcctgcaccaaggttaaggttgagcctttcaattcagtcaagaagaagatggcagtgctgatttcattacccaatggcacgtccagatggttttgcaaaggtgcatcagaaattattttgcagatgtgcgacatgatggttgatggcgatggaaatgctattcccttatcggaagctcagagaaagaacatcttagatactatcaactcatttgcttcagacgctttaaggacgctgtgcctggcatataaggaagtggatgatgatattgatgacaatgcagatagtccaacaagtggttttactctaatagccattttcggtatcaaggatcctgtgcgccctggagttaaggatgctgttaagacctgtatgtctgctggtatcacagtaagaatggtaactggtgataatataaatacagctaaagctatagctaaagagtgtggaatattgactgaagatggtgtagcaatagaaggaccagaattccatagcaagagcacagaagagatgagggacctgatactaaatattcaggttcataatgttttcctcagtctatgcgtttactaaaatcttgaccaaactttatatctggaaatattttgcaggtcatggcccgttctttaccattggataagcatacactcgtgacaaacttgcgaggtatgtttgatgaggtggtttctgtgacaggtgatggtacaaatgatgctcctgcattacacgaagcagatattgggcttgctatgggcattgcaggaacagaggtactgtttcctatgcagttcaaaacttatgaacgtagcatcaatagacattaaaaaagtcagatatttaggacgaatatgtcagtattcactcttactgaattaagttgatcctgataatccatttttcatcttctgaaatggagtaattttgtcttgtatttgtgcaggttgccaaggagagtgcagatgtcatagtacttgacgataatttcacaactataataaatgttgcaagatggggtcgtgcagtttatattaacatccaaaagtttgtgcagtttcagttgactgtcaatattgttgctttagtcatcaattttgtctcagcatgcatcataggtgagggcaacattatagtattcatctgatgctatgtatttccattaagtggttctccatgatctccaagacagtactaatgttttgctcttccgtcacagggagcgctcctctcactgctgtgcagctgttgtgggttaatatgatcatggatacattgggagctttagcactagcaacagagcctccaaatgatgaaatgatgaagaggccacctgtccgaaaaggggaaagtttcattaccaagttcatgtggagaaatatcatggggcaaagtttatatcagctatttgtacttggagctctcatgtttggtggggaaaggcttctgaacatcaagggtgcagattccaaatccatcataaatacactgatattcaactccttcgtgttttgtcaggttagtgcattatggaacactgtaaccgtgctagtatttccacaaaccactcacataaaatgatgtttcttttttggccttaagacctatggtgaaactgaggtctttccgaagtctgccacaatatgtgtttggttggtcacagcttatatttccaatatcatgcttaagaatcctgaactgatagagttatcttttttttttaaaaaaaatcatgatttggcaaagggaatttcttgttctaatgatgatgttctggcaaatgttgtaccaggtattcaatgaaataaacagcagagaaatgcagaagatcaatgttttccgtggcatcatcagcaattggatcttcattgcagtcatagcagcaaccgtagcatttcaagtggtgatcatagagtttcttggcactttcgccagtactgttccactcaactggcaacattggctgctcagcgtcggccttggctccatcagtctgattgttggtgtcatcttgaagtgtataccagttggttcaggtgaaacctctgcaactccaaatggatacaggccacttgccaatggccctgatgacatatagctgaagagtaatcactaataagggaaagtagaatccagggtgcaatacagcatccagctgcccagctcagttcagttgttttggaatacactaaccaaccactgattttgttcaaattttgccaaactcctgtcatgtaattgttactacatcacacgttactgatgtgcacccttaccactctgctttcaacttcagacttcattgtatcagtgaattcatattatcattatgacggttggtggtttggattcactctgaaataatcttttgatgccatatatgccatttgaaacagatatatattagcacccttaaggtcctgaacaggagttaaattcataaaacagagtaaataaagaactagaagtatcattcatgaacagaacagaacaatctcctaagatctgtctacaaatcagtaactacattgacaaagaatcatcagatatatgttcagttcttccatcgtctcaaagaaaaaataaataaatgaataatcatcgactactctaccccagcgattcaattcattcacatagtatgtggccgtggctgtctccaccctcgttgggattgggattgggatcaccggcgccgtcgaagtcgacgaacaaatcgttgaagaaatcattcatctccacctcacctcctacttgtggttcttgtctcacctcctcattgaagccaacaccatagccgttcatcggtgagaacaaggtcatctccccgttggtgttctgcattgccaatggcatctgtccctgcgtcccgatgccaccgtggccgttgccgcagagaaccagctccccgtctgcgttgatgccgatgccgtagtcgccgccgtcgtaagcatctggcttgatggcatcaacgtcgccgtagtagtaggcggcggcattggccgtgtcgtccgccgtgtgtgtcgtcgtcgagcagcagtagtccatcgaggcggtcgcttgagacgtctcgccgccgccggagtacgagcatccgacgtcgggctgtggcgtctccggcgccggcgcgtcgtagccggtggcttccgcctctcggagcctcttgggcccgggaaccacgttggtttcttggcgttcctcctcgtcggccgtcgcctccttggccctcggcgagaggtagaccttgcagatgaccatgatgccctcgtcggtgatcgccgccggcaggttgctggcgatctcctccatgagccagttcgtcttcttgttcccgggggcgcggtactcgaaagcctggcggtcgccgtagccctcgatgacgcggcggcgctgcgagttgtgccacgtgccgccgccctcgacgcagcggttgagccggccggcggtgccggcgccgcccctgccgcccttccacttggcgacggtgaggaagtaccacgacttgccgtcgtggccgtacgccctatgcgcctccgtcagcgtcgccgggtcggagccgtagacgtcggcttcccggacgatgtcccggagctcctcgatcggccggccggtgatccagtggttgaggtagtcgcggatgagctgctccggcttcggcacgaagaagtatcccgagggcaccgtcacgtcggggcccttctgcttcttgtcatcttcttccgccattgatggtgatcctcgtcgtgcgtttcaaaactaggttttcgcgcgcgcgctcgatcgatccgtgtcgctgtgaaaggaaagcacaggttggtgttgaatttatttggcatgatctcgttggttcgagttcgaatcggtgaagaatctcgagtccgagaaggcaagaaccctttcccgtctcctctcgcgttcgctaggggtggagcggcatctagggtttgtgcgccggccgccgccctccccgctcggcgccggcgccgccccttctcctccccgcccgacgccgccccttctcctccccgtccgacgccggcgccgctctgcttgtccccggccggcgccgagcgtgctcctccccgcccgacaccggcgccgctctgctcctccccgaccggcgccgacttgctcctcccagcccggagcccgacgccggcaccactcatccaggtacatgtttgttgtgttcgttggttgcagaaaagtaatcagattaggaccttgaacacagcagcaaaaacccagctaatgctttagggtgacaccttggttgctgtcagttgttagcatcataatctttttttcttgcaaggtttggggtttggttggttgtccccatcagaaaaatttccatactgtcagccaatgggcacccaacacattccccaaatggagttggtttgtcttcttaaatgtaaaagtggggtaattatgtatttattcatgatctactagtaatgcaaaatggaatataattctgtagttgtgtccttcaaaagaagcaatcttgtaaaaaagttctgtacataatggttgacagattagaaatggggacctcactgaccatactagtatcagtacactggtaatagacagtttctgcttaattagatatgcagatgcagatgattcaacagaatgatacactcatctgcattcagcaagacaataatcaattacatgatcttgtttatcaggacaagaattttgcacatcttcagtgtacaacattatattcagttaatgtacatatactattattctcatcatcgcatttcattttaaattctaattgaccgcccttgccgcccgacgccgccccggctccgacgacggcgtccgcagcccgcccgacgatggcttgacaggtgctccgacgacggacgatgagagtgaagatgcagagaatgatgataccatgaatactatttgtactaggatagctgatgcattgagtagtgcatgaggaggatagttattttgagatatggcatcattgtatgaaccatttatcttttgctctgtttatgtggaccatatcactttgatatatgaaaaactaatatattttgatgaaaaactttgatggatgaaaaagttataaatttttttctttccaattagccttttaaatacgaaatattgaacggattaggtttttacgagtaattagcatataaacagtctcataggcctttaggggcattacaggtatttcttctacaacctacagttttgcaactgctctaaccaaacgggtttctacttttcccacaactgatttcccacagctgcttttccacagcccacagtagcttttccaaaagccacagctcaaccaaacacaccctaagctgtgttcttcgttccatttcgtttagtactgcactgtttagtgacatggagaatggcgggcacaaatacactgctgcatccatggattctcgctaggccaggtagtgctagcgtcgtaacccaagttttcgggggcaaggtggtgtgtgggtgttaacgaccaaatttgataaggccatgggccggattcaaaaccagagtcaaagcaaatttggaggaattctatttagggaaatctatacggagctaccccggaggtcgccttcactcctagaccgagtgactgctccagcacaccaccacctttttttttttacaaatttagaaaatgcagttatttgaccacatcttcatatatctaccgggtaaaaatgagcttaacattaatatattcatatattggcagtttatttggccacatcttcagacatctattggacaaaaaatacagtttttgcagtttatggcacattaacgcgccccaccccaaaaccctagtagaaaaaaccggaccgggtcaacggttcaaccggaaaaaaccagaaccagaggtctccacacggttcggttgcgcgttcaaagaccggacatgcattcgacccggattgaaccggctgaaccggccggttttgcactaaaccggatgttaaaccggcccggtctggccacacgcctgtttttttcctcaaaattcgcagaaaaggctggcgcggcatgggattcgaacgtgggtctgtgcgatgagagcacttggctctagccatccggtcattcgccactttgttatacaggaaatatacaacttttatatatctattgaaccgtggttcaaccggcggttttccggtcggaccatcggaccggcgaaccgagaggttgttcggtcctctccggtccggttttttacactatgccccaaaccaacatatgccgggtaaaaatgagctcaagatagacatgtcctaactagcactttatttgtcggaacttcttcccaagagagtaccaattctttgcgtggctactcggaaaagatgaattgaaatcaagtgcagtcctaactttgctgcaagtaatttcaaccatccattttttttcagcaaatagttgagatctgatactacagtctacaattctattattgttacagtacctctatagttttctccgcgtgtgaatagtactacatataatttggacccttggatttacatcaaacagtccatcagatccaaatccacaaaggaaaggctaccaacaacgcaaaatctattcaaaaagaacatttgccaactctccaatatgtgagatatgcaaccaagacctggaagacgctactcatttttgtttccgttgccctgttgcgatggaattctgcactgcaattaaagttaaccccaaaatcacccggactgaaagactacacatcagctacaactgataattcaagcgatatcaaagcacttcgaaactttcatttcactcggcttcgtcctctctctgagtcatttcacaaatgcattgaatttgtcggctgatcgatatgtgatgtctatcggaagagtcatgacatcattttcggagctatatatcctcacatacatgagcgttgtaacttgtaacatgcccgatcagggaagcacttgtatcatttcaaatccaaacaataaactcagttaaaaacaagtcgatgaacacacgttacagaaccgtttcaacacaatgggcatggtctcctgaaaggtcgactgtgcagcacactgccattttatgcaatgagaaaagggagtacagtcagcatgaaagcctcgtaagtaaaagtcgcagagcccgagaaggctgtgtctttttccttgaacttctcagtcagaccctgtaaaattgttacaaatgaatgttaaaagagtgaaaacagaacattgtgctaggacttaacagcgcctgtgaaggcattagtgtattaccttaactgtgaggcagcatctgcaaaggcaaacaaaatagtgttaggactgttatataggccgaattggaatgatagaagatatcaagattttaaactatatccaatatttaactttgaggttaggacttgcttggctgtggcttataataagccatgacacgtgaccaaagcaacaaaagacttttatatttctacacttaagtggtttaaaatccaaggctgaaaaatagaacgatgaaaaaacaactagatcaattcaaagttttgcatcagaaaacagaagtagaaagactagttgatgcatacattatctttttagttattgcctcaaaatgtgcaagaaacaatttaacaattatatttgataggaaatatcatctttaaccagacatttgatcccaaagactacttttgtgtcaacaaatgtccaaacagaaaatgttaaaaataaggctgaaacgaatttgaaccaatcctattattagctgaccatataaacatatgctaaccaagttttggattttttttagataatgattggatgattggataagctaatagcttgaacaattactaagaaagcaatctgcaaaacataattggagtcatcttactcaatgaagttatcatattcaatggctttgttcttgcccccagtcttgtcaaactttgacacaagcaagtctagcacagttggagaaactgaatatcccagactgagaagagcatcacgcaattctgttgcatcaattttaccacttcggtcacgatcaaacctctcgaaaatggactgcacagtacaagcagaaaatgcacgtattcagtttcaacagtaacttcattagttccaccgcacagaagaaaaggaaagctgaagctgtagcatctcaccctccaattctgaagactgtaaaacacagaggtaaattccttgggacctgaaaggatcaaagacacatattcaatgtggtttacataaaaacgaataatataagaaatgcttaagttcaaagtacagtatctagcaatccagtatttgttaaatcaggtgcatttcacaggttagaactaaaagtccaaaattccatatacaagctcactagctgatagcctgaaacatagcactggtttcagagtatacactgctcaagcaattcaaagctcatgattcaatctctagttctctacacagaaaacagatgccaaaagaataggacaaatggcattgattaaagttgcaaatatctagttttcagtttagcagtaatttgaaattgtaaatagaactgacaaacaaaagttagtatacaaggtaacatgtataaactgccaaagtagcatgcccttttactggagtaaacccaaaattctttctacatcacaagccgggagaacttacaagttcattgtgcaaataaaccagtatatgtgtctatgctgtaccaaagtagaccacaacaaaatgagctaggattttccacaattctattgaatcctatcccacaaagaaattgatgcaatttaagaaacttaattaaaagaacccgcatcccaacacctaaaagtaaactccagcttttaacaagttgccactatatcgttgcccccaccacgttcccccgtcttcctcccaaacgacaagtcctggccgtatgatgcaaacactgactacagccctggctggaagactccatctccgcatcggaagccaaaagtcgcatactggcatcgcaaataccgtgggaagcttgataatcccgcggagagccacgtgccaatcgcgtgccactcgtttgactacacatcgcccaaagcacaaccaccattacgtatgccgctgaccaggacaacgcgcacgatagcaaccatggagcgatcagactaacgcacaccatccccaaggccagaactattcaattcgcgggtgagaggatgaaacgatgaacttaccaatcttgcggacgttggtgttggtgaagaggtacatgaggaggtggacggtgcggaggctgaagctctggctgtacccggacagcgcggactgcagctccttgtcgtcgatcatcccgctgccgtcgcggtccgccgcctggaagcacgccaccacgttgggatccgtcccgggcgggaacgccgacggcaccagcgacgcgaacgggctgccgtacccgccgggcgccccgtagggcgccgacgagggcggcggggccccgtacggcgcgccgtacggctggctggagggcggggcgccgtagccgcctccgctgccgtagggctgggtggatggcggggcaccgtagccgcctccgccgccgtagtaaggggcggaagaggaggaggtcttaccttccttgggaggcttcgccccgtacggcggggcggagggggcgggggaggagccgtacggcggtggcggggcgccgtagccgccggcgccgccgtaggggtagccggagccgggatttggcgggtagccggccattggagagagggggtttaggagagagcggaggttgcgatgcgcagctgcagcttggggaaatttggggattgtcaaagtcaagctgtctgcgtcctctgatattttgtgtgtttcgaaattcaaaatggaagaaagcagtggagtacggtacgggttcatatattgaagaggatgatgacgtgggaagtagatgcggtagttgcaggcttgaagaggtgaggacacacggtgtacgcgtgagttgtgaaacgtcgatcgataccttgtatttgaggacaccgggacatatgtcacgtaccgttgggtcgaaggtggtagaagaaagggcgtaatgcgcgtgggcagcgacggcacggccgcgcggccgccggcgaattgagtgtgtggcttaccgttgcgctgcatgtttcattgttcgttcttcaaccaaaggataagcacgaagcatcggggacgcgtttggtcgactggcacacgggaatacgggatgatccaatgaacgcatgcttcatgcttggaagtggtccatccctcagttagaccgtcggcccaaagaaattcgaggacatgccacttgatttgtctgcctctaaattttcgtcacccaatccacgtgcttttgaaatgtgaatattttgatttcgtactactttcaccggaggagggcaagaggcggcggcgacaacaacggcaatgtgcggagcttgggacctgggagggagggggagggggggcaagcctgtaagagaggttgaggtgatcggcgagcttgttcaagctcaagctcactcggcatctatgcaaaggaggtggccaacgaccttcatcaaagggtaggcctagctttgccgctggcacaccgagctcgcccttgcccctagccccccctccctccccttcttcgggcttcgcgtgggtctccagcacgcacgcacggacctaggaccattgctatcgtcagtgtcctccaccggcttcttccccgttgccagattccacagccgctacctagggacctcctccacctcgtcttccttcgcttcaccaagcttcgcacaatgaggcgttgccgccttcgcttcactcggtagctgactgtcgcgttatcgttgatgttgctgtgagggatactgtcacgcccagaaatttagcctaaatttctagactattttgtgtattaaatctctgtccaggcatcagccagggtacacaaaacgacaaattaatatacagatccaaacgtaaataaagcgtaaatacttacagaagaggcacttagtcctcgcaccgaaacaaaagcagcagtagcggaaaaaaggcgatcctagcgaggcttcagctccactccacaggcaaaactcaactggggtctgagccttggtcctctaactccatcttcagctcagaagtagtacacttctgaaaatggggaaacaatagcaaggctgagtacaaccaccatactcagcaagccacaccaatgatgcagacgtgcaaggagaacataaggacggtttgtggctatttgcataaaggcagttgtaaagcattttattgagcaaaacagtaaaactattgagtaattaaggtaatattaaatctccattgatcaacgctacaccacgttgaacaagcccaaccaacccacctgaactacagtgcattgagtcgatttattaagtgtgagactaatcacggtaaatctggtcgatcgcccataaccgcgggcacggctattcgaatagttttactctggccagaggtgcacaactgtacccacaagacacaatccaccggcatgtcaccgtgtcattatgtgcccatgatgaacacgtcaccacgtcgagtgattgtgacaagaccattcatataactctcccctaaccatccacaccacgttaaggtttcacccacactcctcgcaaggcagcgggcagtcccctcgtgcgccgcggtgaatccgacagctggacaaccggacaccccggccgacccaactccatcacgcccacccttgccactggtgcctaggaaagggtcgagctatacttcagatcaagcagttacccactcccgcttgtggtaagcactgtaagtcttccagggtttcccgtgaaccagtccttaattgccatgggtgcgactcgcaaaaccatgcacccacagcccaccattcagtcgcattttagttggataattacgaccatgaaacatggccagatgtcttgagcacgcagctcgtcatgatactaaaaggtctaatactataattatcccatcaactgagctagtggtaattaagcatggctaagcatatagttctagctaggtcaacataagtaataccagctagtcggtttatcactcaaggtcgacaaaggacagatatcaagtaaacatggcacaagtgagcagataggtaatacccggatcccatgtaattagcaagacatgcatgtttatttgtaaacggtaaaacatttataaattgggatcaacatgctcaagaggaatgtgtgacttgccttgcttcttcaaaacaatctttcgaactcttttcctcgcgaccgcgatcttccgaaacgacggattctacacgctggcaagcaaaacgaggaaaaacactaataaaaaccaagaaaacagtacatgaaaagtaaacaaacatgtagagctcaattttagatgaattttgcaagttgaatggcccaatttggagttcgaatgaattatatatgaattttagaagttgttgagtcattaaatgaatttctataactatatccgaattattgcgcaattattaattatttcccagaggaaaggcctgctgctgacgtcatcaaaggggccggcgccgacaggcgggtcccacgagtcagcgacacacaaggggttggcgcacagtggtcacggtccaccgcggccggggcggcaccgtggaccaggaccaccacgggtccacgggcggcggcccagatcggcaaaaagggagggggctggctcgccggccaacccgacaaggcggcggcggcacaaggctggacagctgagaggcggtggcgcacgagagggagcggtggcgcggtgcggcaaggggaggcggcagccggctgcccagcattgccggtagcgacgctggcgcggagcgcagcggcgatgaaccggccggacggccaccggcggcggcggcgcgtcacgagcaggcccgggaagcggtcggcgaaagggaggaagagggagagggaggggagtgctcaccgagaggccaaatggcggaaggaggcggttggcggcgagcaaggtgacggcgggcgccttgggatgacggtgggacggcgctccggcgatggattggggaagaggagtggtagacggggtgcggtagggcgtggcggcgctgtgggtagcggcggcatggccgggcaagacgacgctcgccggcgggaggcggaagtggctcgggtcggcggtggaagcagcgctacggcgaggcttcagggaggacgaatggatgtcggggtgcagcgcggcgtgacgaagctagtggtggcggcggcgcagtgcggcgacagcgggaagcggcggctggaggcacggcgacgagcggcggagcgcgggctcgcgcggggagcacgggagagggtgcgaggagctcggggaggagggggaaacggaagaggagagcacgagggtgctttatatagggctcggggatggagatcgtggccaggagaggtgggatcggccggcaatgtggggcgccgacgtggggaggttggcggcggttcggcgctgattttgcggggcggagtgggggaaataggggaggaggaggtggggatcgagtccacgcgttcgcgaggtgaggtggagcgcgggaagcgcggcgtcgtggggtgaaaccggcggccatggcggttgcagccggccggatggagggaggttggggatgacaggtggggcccaccggtcccacctgtcggagagggaaaggcgaggccggctgggggaggcaatgtggacttgagaaggaaagggggccgagcgggccgagagagagagggaaggggagggcggccaggccgggaaggaagagggggaggacttgggccgagcccgaaagggaggaaggggaaattatttgttttctttttatataattggataaatgatgtttgtgactttaaaattacttcttgagctccgaaaattcgcgggaaaatctggagagtatattagggcacagagaatattataaaatatttccggccaatgatttttaaaggaaaattttaatttcccctataattcacttaattaaattgctttaacttttatttaatttctagaaaatgtattatttaatgatttttaaccccgaacaaaaatcggggcattacagataccgcccgccgccaccaaggaccaccgcctcctaccctccttcgacgaaaatggcacgaaatcaaaagattagcacctccagtggcacttttgcaagggcacacagattaggtggcgaaaattcaaaggcatgcgaatgaggtggcataccctcaaatttctcctctggccacggtccctatatacatatggccttgatatgttcagtggcggagccatcggtcttgcaatatggcaatacctaaatacttgacctttagttcatttcctatccctaatctagagattgtagttagactgagtactcagtttgtgattttccatcttttcaaaataaaatagaagatggttatttgtgatattattggtagtttaccttgagaggatttagcaataaggactagttttaaactgccaatgatattattaaaaagctaaaatttagttcttttgaagaggactagtttacacattgattattatcgaccgtgaatattttatctcctttcctattgacactggttaggtcttacacacccaacctgaaatcccgctttgtcattgggtacgttgtgtcatctcacctccggatagttcatactgaggcccaagatttctgggtatgtttggattgatgccctaccaaaattttggtagtgccaaatcttggacaagttttggtactacgaaaattttggtagggtagagttgaaaatgtttatttggattgaagccaaaatttgcccataagagataagttcataggcaaagccaaatttatggcataggtagagttttagtagaaatgtttagtttgcaaccctactaaaattttggtagggcaaattttagtagggtaacaatccaaattggcccagagttaagtcagcccatcttaagcgatctacagggagggaggaaacagcagttagatggatggataatccgataggcgaccgaaccaacggcccaccggcttccacgtacccaaccaaacaagcaccgccttgcgccagccatccctgagagcacagagcactctaacaccactcggctatcttcgccggaggcccggagcggagcgagccaaagagcgaatggccaccgtggtgagggcatgcatgccgctgccacctgccgccgtcgcctcctcatccgccgctccctccacggacgcgcaggcgcagaggagtccctcctcctccagcgcgcgcgtgctcgtgctcggcggcaccggccgcgtcggcgggtccaccgccaccgcgctctccaagctccgccccgacctcaacatcctcatcgccggcaggaaccggttggtgccccctatatgctatgcctcctccgcaccgcactagtctgttacatactttcctcgcctgttttcatctgcagaatgaatttgcttcacttgtgttgcaatttcttacgtttgaacgaatgcaaacctcatctagccatttcgtagttcacttcaatagtgggaacagtttctttcttctgtcaatagcatcttggctggatgcctgcaatcttgtgcagttccatctgtacaatgagacgattatagtagtatgaccatttgtcgagtatcttttttttttttttggccagagagaaaggtgaatctttggcatctaaactcggggaggaatcggagtttgtccaagtagatattcgcgacaggaacatgttggaggaagtgctacagggttagtaatggagctacctgcttatgttgtacttttaagttgaaacaccgtatgatttcaaaaaattgttgcaaatattttgaaaagtcatccacaaatttcttctgatgtttgaccattctagtttttctttttttttcccagatgtggatttagttgttcatgctgctggacctttccaaagggagaatgagtgcactgtcctacaggcagcaatagcgaccaaggttagaaatgtgcaacgcctgatcatcaaatgcataagtttaataacacgttgaaatcagtgacatccttaacctttttttttttttacagacggcatatattgatgtttgtgatgatacagactattcgtggagagcaaagggtttccatgaacaagcaaaagattgcggtatcccagctattacaactgccggcatctatcctggagtgagcaatggtcttacttcgcatttctatcaaacatatcagtttactttgaaatttttcaagttacactgtccagatatcatcatgtgctctttcacaatgtccatcagtactcatggatagtatccattgctctttgaggcagtttacatatgtgtaaaatcaccaacttgattaatgccatgtattagtacataatagagagttagagacatgatctagcagtaaactatgaagacaatgttttgatctagctaggtaagcttcatatcttaattttttgagtgcttagaaatacactgttttcttcttttggaacagtgatggctgctgagcttgttcatgctgctagaagtgaaaatgctggtgaacctgaaagattaaggttaggagttatttatttcctgtaaaaattaaaggtcaaactagtcatgaagtatggaaagcgttgtcgtattcatcagaatctatgctagtatgttgctaaatcctttttctagattcttttattatactgcaggcactggtggtgctgggccaacaatattaacaactagttttctgcttcttgcggaggatgtaatcgcatataacaaaggtacttttcgataatttattagtgcacttataggatttctctatgaggaaaatctaagttttgttctcattacaaattcaggagaagaaataaagttgaagccctacagtggagctctcagcattgattttggcaaaggggttaggaagaaagatgtttacttactgtaggcactgaacattaattactttttgagatcttaccacaataaggaaaaaccactttggttagaattcaaaatggaagctaataaattttatattatgccactaatccaggaatttgcctgaggtgaagagtgcttataaggttttaggtgtgcctactgttagtgctcgcttcggtactgctccttttttctggaattggggaatgcaggccttcgcaaactttttacctgttgtatgtcttacttctcaaattatgcactatcaatttacttctttcagacacaaccggtgctattagtattctagtactagtaaactctactaaaaaaaatagaagttttaacttttaagcaaccaattgcttacattttattttattatttaattatgtagttggtgaaatcaactaatactattattactgttaaaccaacatggtttgcttgttttctgctgaaatcttaaaaatgggataatattaaactggtgatttggtgctaatgcggattacacctgactgcaacttgttcgtgttcaggaattcttgagggatagaaataaggttctaaaattggttggatttgttgatccttttgtccgagctatcgatggtattgctggagagcgtgtttccatgagagtaagtacctaaagctgtgttctggaggtgaggttgggaactcacttcatgcacccgcaaaattaattatttacttttttttttgaaaaaatgtattaatatgattttttaaagcaacttttgtatagaaattttttgcctgtgtgttttagaagtactagtttcttccaaggctccaagctatttccagagttaactgcatactctttcaagctgtggccagaataggtatttgaatgccagttttaaaatatttgttcagccaatttttcttcagttttttaaaataatttactttctaaactttgatttgatcaattataagattgattttatcacttcttcaaaaagggagcgaagtatggaccatgtaactctcaatagccatcgatttccacaaaatattggtacactgagactattgtttttactagttactggccaagatttgtttccttggtccaggttagcagcctagaagcatactacttctagtatttcctcaagccatacctggagtaagagtaaattaattatactcaaactttgtccaaagttgtatatgtagctactgatcactaccttttgatcaaatttatttcatttatatgcaggtagacttagattgttcaaatggaaagaatactattggattattttctcatagaaagctatctgtgtaagtacgcacttctgcacaagcagttgagcattctcaaggtccattacctaattgatatttaccatattagtcatcaaatatcaagacttttttaaaaaaataactatcacattttttgccctagatcgcaggaagcttcacataagtgctctctaaatgagaccccagtttcaaaaacttacatcctatgtataagagtttccttttattcaaaaagggattcctgagaaaaccatgtaaatctgtcctcatttaaaagctaacagggtatctacttcccagagtgattattccttagcatttgaatgatccagcatttttgtaatgctaacaccctaaatcctaggaattcatactcaaaacttggagcgatcttactacatggttgttttgagaagttccgatttactttgcagttttaaattttaagaacaaacaaaatcatttggtacaactatctgcattgcatcttagcattaatttttattggattttcagatcggtgggctatgcaacagcagcatttgttttagcagttcttgagggcagcacacagcctggcgtatggtttccagaggaggttagtggtgcactaatgggaggacaaaataacacactagtcgacacaatatactcactctgtccctaaatataagggatt

SEQ ID NO: 60403 - DNA, 1379 bp, Oryza sativa
acggtgtttgacgtgcaccgtggatcttattattatcaatgcctgaattcaccctagttaattatgtgttccagaattctgatacctacctccatctctcttaactcttgcagagtgtgtctgactgaaagtgatggcctcttgcatgcacgtggtataattcacatatatatcgatataagatgcatatttttttcccaagcgaaaatggggggaaaaagttggaaaaaaagatgtttaattttcagtcacctgaaaatatataaccacaaattccgttcacttttaaatggcttagattgtgcaaagattcgtacaatgcaacaaccttatcttctcccccttgcggcacgcttctccaacccatcgcgagctcatgcaagcgtacgtgtaaggccacctagatatgtctcctcggttctgccactcttctgtaagacgaacgacgatgagctatccttggcatgccttctttatcttctgtggctctcccgttcctagtcactccagatattccacgacccaaccaccaatcaagtgacttaaccctatttgattcatcttagaattattataatctgtattataaggagtaagttcaaacaaacaaatagattattatgatagattatcgtaatctataagccagattagtgtaatctaataatctcctttggaggagcctttttttgattatgggttggctaaagacccactatccttagatgcctccaataatccagagaaacaaacagctcacagcttattctatgtcatcttattataatccatcttagagtaatctaaatttaataatttatattacaataatcttaagctgaaacaaacaaggccttaggtggtgccaccgtgccttgccactcgctcgtttcgctgtcaccccttccatccctctaatgtcgagtaaacctccttccccctccatcaacccctaccataaaatcctaacctacaacaccatttgctctcgtgccgtcattgaagcacggatcttgatatatgtgcatcttatgttgagcaaatttgaccagaattttgaagattttaggcgagaagaaatcttgtgatccccccttccaaaaaaaaggaaataatataaaacccaatcgaggtgagcactatcgtttgcccttcagcttagctgtacctaaaatttaaattttaaatcttaattttagagttgattttgatgttttttcatcatagtttattttttaatgttagtttttaagtcgctaaaatacatataaaatttattttctgtccaataagaattatggtttacaatcaattttaggtaaaacaatgtaagcggtaacgatgcgatagagtattatggtttataattagttttaggt

SEQ ID NO: 60404 - DNA, 612 bp, Oryza sativa
aacaatattttttgaatagatcctcggtgccagttttgttgacattgaccactctatacatcttgactgtttgggacgtgatgatgttggctgccagtgtcattagcgctgagtgctgagatgttaagatctcgacctcgacgctacagtcatcgagtcattccaagatcaagttagtttaagaatctatttgtaaaataaatttatagaacaatcaaaatataggggaaaaaaccagcatgactgcacggacgatctgcggtccgcgacgcgagcgattaaatgcacggagtttacgtgacaccggccgtggcgggccggaggagtacgtacgcgctgcaacgcgcgtacgatctcccgtgaaccgcggggctcgtacgtacgtactcaccggccgttggagagaggcccccgcggccgcgcgcggcgcccccaccgaccggatcgtctccactcacgtttgtccaccgtaccacgcccgatcacgaacaaacggatggatggatcgatgcatctgcgcgcgcgacgagagcgagagtgaatgagctcatgtgcgcacgcatggctagctgcctgcctgccctgcatctgcgtgacactgttgagagtagt

SEQ ID NO: 60405 - DNA, 1310 bp, Oryza sativa
tgcaaatatggtgtgaagtgggtgtgcgtgtgccaactcgttgtttcttgcagctgtaaatttttgacggaatgatcattttttgctccagctgtgacaatttgggccattacgtttacacctatataaaagactggagccaaaactggatagtattgaattgtagatttgtagctaaaatgagcattttcagatggtagttacccagtttttacttatttttatagtgttgacaggagccatgatgtcaggacccgacatcttggtgggtcgtcatcccgttaagtaccagggatttttttttcttctgaccgctgatgtgtactcgctctgtcccataaaaatcaaccagtatcagatgtgacatattttagtactataaatttgtcgtattagaatatgtcatatcctattttttagacggagggagtaaatatataactagtgacattggtagcaggctgatcacacccctattggggcaaaaagaagggcaaaaagaaagttttgaaccgggagatattagcttaccatttactcaccctttactcattgcatcaggacaggcaagaattaatttcacacggttacttttctcaacgtttttaacttagcttcaatcattacttttttaatattatacatgaaaattataacaataaaaaaatattatgaaatcatgtttccagtgacaaatatagcgatatgagttctcgaatacaaattggtaccgttctgaacatactaatggttaaattttagaaatgtaccagtattatttttttttaaaaaaatgctaatagtgtgaattatatatggtcacaacttgcgcttcttcctctcctcctttcccatcctcactctaccgctgccgaaccaagccatcggcaagccgcggatggcagtggcggggcaacatcatagggcgtgagataaggggttgtggtgaaggtggagtttggcgcgacggtcggcaaagagcagcgcagtgcatcgaggcggcaatcgacgaggagtggcgcgacgcatagaggtggccatcggcaaggtggcacggccagatccggtgttcccttgactggatctggcgcctcctagccttgttcgcaacatggaggtttctcggtggcggtagtggctgccggacgagggattcccagcgccgtagtggggttggctatgacaatgaacttggtggcagcgatgagtgccggtggtattggtcggagacaggagctagtccttcgtccccctccctttatcaccgatagcgtgggctggtgacggacagcgggggggggggggggggg

SEQ ID NO: 60406 - DNA, 4287 bp, Oryza sativa
taaggtaattggtgaaatctttcgcacttgtgccgcagacatgttccgccaatcaaggcctcctcatttttcatccctaccatgtcatattctgccccatgttcacactaattgctcattttatacccatgggggagaaatcgctgtttggtgtaaactgtcagactaatgtagttacctgttatactgtaaatatattttacatttcaattggtaactcaagaagaagtcagcttggaataggacaaacaaatggtccactatttttgctctctaaaagtcattcaaactaggagtacagcctaactcgatgatgtcaaatcatacaactctgaaagagtctgctctggaagaaccttctaatctcacatttaaacaaccacctactgtgcgctctttttctacgatattgccatgctgcatcaggttcatcataacttatgttccatttcttttttcttcaaggctttttatagtttctgtctgattttctacgattgctctggtcgaacctattcgtttggtaatgatgtgattacgtctgtctaaatagctgggatatttatatccatggaatacaaaatattgacaatgatttctagtgttgccaattcttattgatttttggtgggccaattgggtcctatgatctcttttgtgcagttaatcattttttaccttcaaaatttgacattttttcagcttgttcctggatttctgatttcattaactggacttatattgaaacggaattaattacgaacctttgtactccatcacaggttgttgccatggctcccgctgttgaagccgtggagaagaagacaggctcagcccccgtcaaggcccctgctctgaatgaaaggatactgtcatctatgtcccggagatctattgcagcacatccatggcatgatcttgagattggtacatgacatttcatcttgacaaaccatcaattttctatatttctctcataacttacttataggttcctgacttcttcctgcaggacctggtgcaccaactatattcaactgcgtaaggccaccataacagattcacatttgttttttctcccagatttagtttgatacatgttcttattggaaacttatgtcaatagcatagcccttttgaagcgcctctcattttgaacttttagagttaatgtgctggctggtatttcacattacaccaagaatttctcgaccaaaagaaaaaagaaaagagaggaaaaactctaacaaattgtgtctcttttctgtcacttgtcaggtcattgagattcctaggggcagcaaggttaaatatgaacttgacaagaaaactggactgatagtggtaaaacaaggcgattcaattgattcatcattttttttagtgaaaccatatttttccagtgactctaaaatgttttgtacatcatttggttgtatgcacatgtaaaggtggaccgtgtgctctattcatcagttgtgtaccctcacaactatggattcattcctcgcacgctgtgtgaagacagtgatccgttggatgtgctggttataatgcaggtatgtctttgtattttagttggtactagaatcctattgcttgtactcttaagaaaaacagtgcacaagtttcttttcccttcagccattatgtaaattctggtttacttttcttgatatagccatgtgaaatcatgggctttggcttacctcttgtccaataatagtatcattctattaggttatattcacatctcactccttttgtttggggaaccatattaaattctaatttttgttcaaacaggagcccgttataccaggatgcttcctacgagcaaaggccattggtctcatgcctatgattgaccaggtttggcttcattccaacatttacaaagtccagcgaaatgctattctgatccccatgtttctattctgaccccatgtttgtttgaacagggagaggcagatgacaagattattgccgtttgtgctgatgatcctgagtacaagcattacaatgatatcaaggagctcccacctcaccgcttggctgaaatcaggcgcttttttgaggactgtatccttttttatcaacttaatatcaagttctgcattctaaatgaattctaggcaataactcatgtcctaaccttgaactccaccaatatgttgttcccatatgtgcattttctgaaagccatttggcactattttatatctcaactgtcttgtatcatatgcacacatggtcaaccacacaccaacttaaatactcttgggagtcccaggatcatgctaatttcaaaacacttgtcacctcttagaccgaatggtttctttaaccgagacattcagacaagaagaatgagaacaaggaggttgctgtcaatgacttcctgcctgcaagtgctgcttatgaggccataaagcactccatgtgagtacttcacttgcataagtactacaacatactgtacatgtttgtgtaaaatcacatcaagctgactcttaaccatgttgatgttgccattcagggatctctatgctacttacatcgtggagggcttgaggaggtagacttgtgccgcttcctggaccgagaggatggatgttgacgaaaattgtggagatattatcaccttatgaacaaatactattattttgttggtgtgtgatatacaccggtattattcacatttcaagtagtaacagcacaagtagaaactactagtagcacaacaaagagtgatattccttttatggccctcggtgccactacgatatggagtattggtgaatgatgatactttatgctgattctattgatatggttcgagcaaagatttgcatatttttttcatttattatcaagtactacatctgtttcaggttataaaactttctagcattgcccacatccatatatatgtctagattcattaacatatatatggatgtgggcaatgttagaaagtcttataacctaaaacggaggaagtaatttgttatttatagttattacaaatgtgcctggtcatatgtgaaccgaaggaagaaacagcaaaacttggacccatttgattgcatgcatgtatggaacagtttatgatttgttcacttcattgccaaaataaaccttaccatttgttggtaaagcaaaagtggcaatgccaaattttgatacttaccaagtgttgatgaagttttgtgagtggaagactctacaattatcaaattctgtttaagtttggaatagtaaaaacttgtttagtttgttactctacaaaaaaaaagactaaaattaggtaaagttcattttggaatgaacaagtcctcaattcccaaaatgatgggaaatctcatagtatcccagaagggcacatcaaagtaactgcggtagcaatatcatcaagagttaatgcttttagatcagattcacaatcaggctattaaacttactgaacacaaacaaatttcaattgagaaaccacatattgaagcacatgggatccagaagacaaagcgagacacttcatcttctcattagaactaccctagtgtcttgcaagctaaaatcgaaaacatccagttaaatgcctagtgatacgaactaatctcgaatcgaacaaactaagtactgcatatacagtgaccaatgaatggaaggacatgaagctaggagcgcgcctgcttcttgggggacttggcggctttgtccttggacgccttggccggcttgtcggccttctccgcggtcttcttcgggagcagcaccgggttgatgttcggcagcacgccgccgtgcgcgatggtgaccccggcgagcagcttcccgagctcctcgtcgttgcggatcgccagcagcacgtgcctcgggatgatccggttcttcttgttgtcccgcgccgcgttcccggcgagctccagcacctgcatcaacaacacgatcccggtcaaccatgctgggtttggaaggatttgggagaggaagggataaacagtggcttgcctctgcggcgaggtactcgaggacggcggcgaggtagacgggggcgccggtgccgacgcgctgggcgtagcggcccttcttgaggtagcggccgatgcggccgacggggaactggagcccggccttgacggagcgcgacaccggcttcttcttcggcccgcccagcttccgccccaccgccttcttcgccgccttgccgccgacgccgacgtccatctccgggaaacgtgagggtgaaatggagcggaattcgggggggatttgaagggattt

SEQ ID NO: 60407 - DNA, 23208 bp, Oryza sativa
gtacgggagcgacgtccttggccaacgacgaggaggaggaggaggaggaggaggcggcggccgggagcggtggcagctgccaccgattctagggtttttatttttttttgaatttttttcggatttttgtttttccatgcggatgtcataaacacccgcacacgaagcaaaaaatcacgatttttgcagacacctgggtgcgtgcgggccacctacccgcacataaaaccggttttgaccgcacacgaaaatctttctcgtagtagtgacagggttatgaaaataagcaaataattaaggactcaaagaaaaaagcagtcgagtccctccttcacttcttcttctaatccgatgaccaagatgacaaagctgatggtgacgactgtgaggacgaggttgactgctgaagatacttcccatcaagccacaaacccaacatgggcctctcacaagtgaaggttgaagcgaacccgatgaataacagaagattcagtctaaccttaaaaaaggtatatcggagacaagaaagggcatcaaattggtagcagcaaactggagggagatgatttaaacggccaacaacaccttgtcattgtggaggaagaagacctctcaccgttgggcaaatatgctacacttgttgactcaaacaccaatgaagaaccccgtaccagccttctagatggcacaaggcaaagcaatctatgaatttagagctcaagtcggtcatggaaggaggtagccaggatgaaaaagacgggtgttggcatttccatcgagctatataggaaaggggaagaagtggacctggtactaagataaactcgatatacaataggatgaacctgactacgggataaacctgacggctcccctaactctccatcctccctcgtcggtgactagcggccaccgaagacggagaggaaaggggatccagtggaggaaaagaggagtcgctcttttcttcgctcactaacagagagaggataaggtcaagttgacccctggatgatgtatcttattgttacttacccctctaaattgttagctagaattcaaattgtcaaggcctgattgagcacaaattctcccacttaattgacatgtctcaccgctcgctgcctatgctttgtaggtatagacgctttgatgcgcacacagtgacgataatgattgtaacatgataatacccaccggttagcaggtaaactagacaatacaagagagaacattgcaatataggagtctactacattcattcaaaaataaataaatctaagatatgatgagatattttctagtacaataaatttgaagaaagccttgtctaaatttgttgaactaaaattatcacattttactctaggatgtttattttgagacatataaagcctgttcactttgatgctattttcaaccttactaaattttagtaaagttaccaaaaaagtggctacatttagtttgttgccaaattttggtaactatataagaaatcctgccaaaattttgataagttgccaaatttttggcaataccaaattttgataaggttttttttggcatcaacgtaaacaggcccatagtgtagttgatatgagtcgtgacaagacatgcactagccaggaaggtcgcagtggcagatgagatggcttccattcccgttaaaaaaaaaaaccatgcagaactattttctgttgtggcacattggcagcgcccgaatgaagggccacgtcagctcctttgtccggtgcgtaacggttaaaagcggtggacccatccaacatggccggaccggaccggaccacccgctgccactatcaaccaccacagtatgccacttccactgtccaaccttgtcttgttaagagcaagtttagcgcccctttgaattataggaatgaaaaaacggagaaataagaaaaatatagtattttaatatgaatgtaagtgtaaaacagaggattgtagaacacagagaaaacgtagaaatgaccgtttgattagaccacaggaaaaacacaggaatttgaggagagataaagactcaaagattctatgaatttcctttgaatcaaaggggaccttaatagtataacgcaactaacaactctaatttatctataatcaatgtaatagctaattcatacaatagttatttactatactattaatatatagtttcacctgtcatatacatattacgtcttagagtccgtgctgtagttgtctatatatcggtagaccgctgctcttttatcttattttttatcttattaaaatatatttatagctggctaatagtctattattgttgtacctgctctaatgctaatgctaatctaagaggaatcccatcaaatcagcgagtaagggttcaccaatcaccattgacgccactctttcccccctcccgagcacagagcagagagagagagagagagagagagcgctgcggaggagaccgatgccgccgccgccgccggagccggagccggagccggtggtgatccacgcgtggtcggcgccgcgctccctcagcaccagcctcatgtactccttcgcccaggttcgcgccttctccttcgcctcgcctcggactcgcccaccccgctgcgcacgggggatccccctgggccggcggcgagtcggcgaaccgggggccaccgccgcaaccagctgcattacctgcacggccggctcgcttcccccgtttcgctttctgatgattttttttttaattcttgtgtttgggatagagggatgacatggaggtgctcgacgagccgctctacgctaatttcctgcgcgtcaccggcgtcgacaggccgtatcgcgaggagcttctgtctaacatggtaaaccttgacaaatggtttgattatttaatcacactactaccgttgctactggagaaggaaatttttgttgcgtgatctttgcggcatttagtaatggatgtttatttgaagtagcggtcgtttggaactgaaccaaatcagctgtaatcatgctcttctgacatgattgaaacttgaaaggatggggagatggttttgacatcctgcttcgtgaattaccttttttttttggttgcttctagcacttccctgactactggacctttctgtccaaatgttctcaatgtcttaattagatcatttccatttcaatatcgaaaataatactgtgcaccatccttgtgtgtgctttttaaaactagctctgctaagttaccataaatttctatactagcaatatgcatggagcatggagccttctatataatagaatcactaggaatacttccagtgcaggatcctgatggtaacaaagttatcagtgaagtcatttttgggccagggaagagaaaatatcgttactgcaaggtagattttttattttctaagatgttgctcacagatttataaatgatcccttaatccctcaatcttttgtttgtagcacattgcaaagcagcgcctccctaacctgtcaagtgacctgatgaaaaagggaaaacatttcatattgatacgcaaccctctaaatatcctggtattactgccttttgttttcagtatcacatagacacatacatttttactcatttttgctttgcatactgtattgtgtatatatttcctcctgctaatagcattcaacatacctcagccatcatttgacaaagtcgtcccaccatcattctttgagctcggcatagcggaacttgtctcgatatacagtgaattgtgtgagcttgggagccctccgcctgtgatagatgcagacgatctacaacgggatcctgaggtatatctattcttggatattcaatgatgttattactgtggacactatctacttaatatagtgtgtggcatgccattattttgtagtgggctgctttgaagggcatggcattgcagtcctcaagcaattagtctaggttatactacactaataaaaaaatgaagttcatattatcttcatttttttgaaatcatgggggcctgaaatgatttttcatattagattgaaaaataataatccttgagataatttctaatattatgacattatctcaattcctgtattgcattcgcaaattgctttgtttttacttcacatgcaggctgtcttgagtggactatgtgaggatctaggtattccttatcagccacaaatgctccagtaagtatattctacatggtaaccacgctaaaattttctattgttaagtatgcacgttagaacaagcatggttggacatcaagattcaaaggcctgttcttcctttttagatgggaagctggccccaaggactttgatggtatttgggctccctggtggtataggagtgtacacaagtctactggtttctctatgccacgccgttatcctttggtaagcttgcatcaaacatttctttcaattttcagcatctattcttgtggtttttgcaaagttagtatccatatcatctatttttcaagacaagtattgcattggtatagatagagaacagaggacctctgaagcaacatgacgatgtaacagggagttgaaggggtcgcttgcagaaaatgtgcttagatattgtaaaacaaacgtgttatagctaaagcgagaaaaccagatggttggggataataccttagatgaaagttatttgaagttatgtacgtatatcttcatttggatagcctgatcattctgctgaatttctagatcatcccatctaattttttgcaagtagtttttttcaccattgtattgaatatgttatggttcttgcaggttagctttttgagaacatacaaacaatagggatatttggtttgaagaaataacttttggaataaataatagagcagtgtgatgatgctggaaaggtccaagctgaacttacaaaaatggtacaaaccacaaacatgaaaacaaacatacatatatggctaatctgaaagcaagaaaagaaaacaccaatgctgttcaaaagttcaccagatagattccttggttttgtccttaaatagattatgatacctacacatgatcatggactttttggcatttgtacactccatttattcgagaagaacatttttgcgtaccattgaaccccatgctgcttcatataggagtcaaccatcaaatatgaaacaccttatttgaaaagagctgatctgttaagtaaatatgcattctaacaaaatatccattgagatgtaaaagagtttaaccttattgagtggcagccctgtcaaacaagtttccgttcctaacaagatgcaattcatttcatcgtgagttggtgtaacatttggtacagcttttaattatcattgactttctctattcgatttcagacttttccatttgctttgtatgatctacttgaacaaagcttgccattttacaacgtgctgaaacgccatgtaagcaaaaccataggatccccgcaaccaacattacctgatcctcctcttccagtacctgaaaataaaaaaattcttgtttgggttggagatgagcttttgccccgtgatagtgcaaaggtacatcacttataacttttggtatgctctcagtattataatggtcacacttgagcagttgttccttttttttttattctaatcatttatcttgtaaaggtttcagtatttgattcagttgtacaaggaggggatgctgtgtgggaaggattacgtatatacgatgggaaagtgttcaaacttgatgaacacttggataggtgcaataactatttctgtatttccattcttttttctgcttgtgatatatgagaagattgtccttatgtttttatctaggttgtttgattctgcaaaagctatggccttcagcaatgtgcctagtcgtgattgggtaatttgacttgactgctctcatctatactgttcgttacattgcaagaaatatcaaattaatctttgttaagaatctttgatgttctgttgtgccttttttgcattgatgtttcagcttgtgtagtaatagtctctgaaattttggtttctaatattaacagttgtatgtccaatgaaaagattattgctgtgggccaatgttgaagtttgaactactcctgaatcaagcttccattatgtgcatgtttctatgcagattaaggatgccatctttaggactctcaatgcaaatggaatgttcaataatgctcatataaggcttacactcacccgtgggaagaaggtaaaaagatgaacctagattcatcagtagtgtcacttttcaagtatatatatttgtcgacatctttgcatatcctgcttgatcacttcattcgctaccttcaatttcaaaaaactgcaggtgacatctggaatgagtccagctttcaacctctatggatgcaccttgataggtattcatcctcctagtcctatcttgcttgcatgagaatgccaagtatttgttttcagttttccaccttgtggcataaggacattatgtaggacaatgtgaaggtttagctgcttaatcacctgtagtgcttggtacccatactgaaaatctggcgttgctactgttggctggccagtgctggtataaaaccacataaccaatgatatagagtagcaacttttgagtgcctagcggtggtatgctattaataaattgaccaattgtattgtgaaaaatatatgtatgccactatatatgatttgcaattctgtggaaaactaagtgggtgcaataatgctaatttctaataagacctgttctttcagtgcttgcagagtggaaaccaccagtttatgataactcgcatggaataaagttggtaactgccaccacgcggcgtaattctccgaatgtaaggtccatttggaaacatatacatgatccatgttaatttgaaagttcacaaagcatcctgtttagtttcctgtttgggaataaacattgactttggctgctcttacgacttttcagagcatagattcaaagatacatcacaacaatcttatcaacaatattctggcgaaggtactttatcctttagatttgtatagctgtccttacatacatttttttaaatggagccctttattaattgtaatagcactaagttgctaatgcttttatgcagatagagggtaaccttgcacaggctgaggatgccatcatgctagataaagatggttttgtatcagaaacaaatgcaacaaacattgtaagtgtacatggctgttatcattaacatatctcgaatttgcctcaatattttttattgaaggagagagtttacctcaattttattcataacttttgttttctaaaaatgccactgtgttaattgcagtttatggttaagaagggcattgtgttgacacctcatgctgagtactgccttccaggcattacgcgtgcaactgtaagtctaatcaggttccagttggaaaactatcagcagagccaatctaaaaaattggatacctccattggaatgacatggaagagaatttattagaacttttctgtctaattgcagccactactttttcaaggagcgttattgcaatacacatttcatttatacactattttgacttgtacaactatatttgtactggaaattattgtgaaaatcagagaaatttttgtttttactgacaaagaggcccgataaatattgaatatgaggaaccacttctgttactccctctttttataatatatcttgaggttcttgaatcacgggcattttataaattatcttcaagagaaaatgtaaaatatctgatagtggctttgtaccatgagatctaccgagttactttgtttggcactgatagtgccttttttttttcttttcgtttcctatgaatgcaaaattgcaaataccacaatatgtttacctaagcctatagttatatcatgtagatattttttactggcttgctgcatcatgacttcaagaaatatgttgtatctacttacgtgcaaggaagacgaaatttgtggtttcagttagcatgaagcactatgtgattatcaagttgaacaaacttcttttctggaaaaatcagaagagtcatatttgctgatgctaatatttttcatgttggatgaaattaacaggtcatggatcttgtggtaaaagagagcctggtgttacatgaacgtcgcattagtttatcagaatttcatgctgcagacgaggttccagtcttattcatggacataagttcatatatgatttttccctctatgcaatggtgaatctttgttaggaacaatgaaacctgccttttcaagaaaaaaaggaagtgtttatggttttaaggaaacctgcttttctagggtaaaaagggtagagaaaatgccatgtgcagaggtctgaattggcttgaccatagaacccccgttacagcgtgtagtactgtaatcctctgagtaaacgaaatgatcgacaatactccctccgtttcatattataagtcgtttgacttttttcctagtcaaacttctttaagttggaccaaatttatagaaaaaatatagtagtattttcaacacgaaacaaacatattatcaaaatatattcaatgttagatttaatgaaactaatttaatattttagatgttgctaattttttctatgaacttggtcaaactttatttctataaacatattatcaaaatatattcaatgttgctaaatttttctttaaaaaatcaaacaacttataatatgaaacggaaggagtattattttgcttacttgaatgaagcaattgtgattatcaagttgagcctacattgttttctgaaaaaaaaatcaaaataatcatctttgcatatgctaacatctttcatgtttaactagatagttcttatctaccttttcatgaattactataataagatggacatgttgagatgttctataacatttacttgaaatctgaattttgataatgggggttttcacctgcaggtatggactactggaacgatgggtgaaatcacaccggtgagtttacatttttgcactatgcgctcatgttttcccttagccatttaacagcacagctatctgatggttttgttgaatttaataataaatatctagtttacttgcatgtattctgttttctaaaccagagtatttagtcactctagtcaagtggccattttacacctaagttattatcataaaattgtgttccctattaatcggggttttccattttgctagtattttattagatacgtcaagcataaatagactgcgaacttgtaacagtgttggcacgtactgcacatatgctcgttgctgacataatctattctacaacaggtcgtaatgattgatggtcgtgaaattggtgacgggaaaataggtccggtcacaagacaaatccagaatgcatacaaagtcataactgcaggttctggagtaacaatacccagaaatgccgatgaataacaggtgtatatgccttcctggtctacctgccggaaccagtataaagcaaacttgattgttagagaaataaatgtgaaaagatgcatcactaaattgtcgtgccaattggaaaatgtgtatgaagcatgtactctgtttttcttagactcagtaggggttttcgccaaaattgcagatttcatttgtggacgattatgaattcaataaacatgtccaatgctagtagctcagtttggcactgtggtggcctttctaaaaggacctgtgcattatattttttttcttgaaaagttagttcaaagcatttatcttgaggccgatagcctcgtgaaaatgactaaatattccttttcagaggatttcacggtgcggtaccaccccctcattcggaacaaaggaatatagtaaagttgcatgtgttccaaacatgaactgtcatttaaaaaagtctttatgcattttattcgaccccattactcaacctggtaatttttttcgtgaagaaaacggaaacctagatggttgttttattcagagtttgatctccgtcggttcatcccctaaactgagattttaacattagcataatagtgccccccaaatggcattcaaatttctgcttttgttttaggatcaatacgccaaacaaatacgtgccacatggtacatacattggtactcagcaaaggaatgcttcaaccaggtaaactgtaatcactaatcagaaatagctctgtccatgcatcccatttactccaacatgataaaaacattcagatttccaaagagccaaagcaggatgcacacagaacataacagtaaaggagagcaaaagtagctgcattatgcatagatactgccagtacaagttaagcagatgatccatagaacgaactcctgcaacaaaatactaccttgcatcaactaccaattcttaactttttcgacgaatttgctcctgtacctggagcgcgacatatttggcaagatcactaatgatgctgttattgcatctctctgaagctaagttttattttggtcggtcaatcatgtttgatgaaccacgctaaaaaaatgtttgaccgcggcgcacggtccagtccaggtgaaaatatgctgtgtacaaacgggcctttttgttagcccacataaaaaacagcccaattacggcctttgctgcatatttaatttggcccactgagcctacaaacaagcccatgtaagaacggccgaatagagaataagttcacttttgatacctcaacttgtcttcgagcctgaaattaccccaactcacaataccatgtcactcaaggtcataggtaatattatacccaattttagctgacatggtgggctgagtcaacgtggaatccacgtggactaatttttacttctttctctttccacctctcttcatatctcatttggggcagcatgcagtgggcagcgtggagagcacagtgggagatgcagagaggacggtgggcactggtaggaccgtaggaggctgtcccgtggtgatggaagtcagacaagagaggagacggcggctacatgctccccgtgccaatccgcggtccacatctctgactccgcttccggccagtccccgcctccgccttcgaccggccctcgccttcggctagtctcgcctctacttcggctctggctagtaagcgacggggcattgaacgagaaaaaaaatcgtccacaaataatcaaagtatcatatgccttgaaaatgatataaggtgctcggaaatggttgaagaaaatgaataggagaatcactatgactatagtctatagcccttggtagagttactaaagaagtaaatgatttatttgatattatggttgactagttacgaagggttttagacagctagcctaatttccttgtggaggatgtaagagaagaggaagaaggagaagggatggctgttgacatgtggagcctacatggatcccactcattatgtcaacaaaaaccaaacactatcctactaagcgcaagtactacaatgctccatatgctacccctaagagtgtcacattggattgagtgatgaggtggaggagagaagtgaggagagagatgatgaaccacccctaaattaataggcaacatccacataaattttaaaaaaggtgtgagagtattagagacattggtatttgtatactagaggtgacatattgtatgggtgaatgatatggataaatttggatgtggtagtccacaacacttgccatgtagactcatatgattatgtggaggacagaagagaatagagagagagaagaggagccacccctcgtacaaggagcaacctccacacaaatttcaagaaaatgggagagagagaaacggattggtagcaagtgtattgggtgtagtgtaagtaaatgcaatctattatatgtattacctctaagggcaagtacaatagcaggctataagtccgctgtaagcacatgtggagaagagaagagtgagaagaaagacatgatacagatttgtaaccagctgcagcgcggattccaatacattgtgtgtgaatgagatgtgtgaccatatattaatgatgcagtatatgttaatagataactattgtataaataaactattatattggtttatagataaattagagctaatagttggctatagtattaaacttgctctaaattaatgtatagatggtttaggcaaaattaaatgtgaccactacctctgctataacacatgctctaagggcagtcccaatccatagtgtccataagtagtgtctatggtgccatgtcaataagacatcacaatagaaactacactatacaacccatggtttcttaaagtgggccattaataaatacatcatctctcttctctaccaatcatatttattcttcatctattatgaagacactattatctcccaatacaaaacttggtagtgtctagtacataggttctcgtgttgaagctgtgtcttgcatgagacccagtttcttcctctcttcactctcttaattaatatagtaccacataagctaaaagtcctacatgacaatgtagttaataccatagacaccatcctaagtggagggttgggactgccctaaggaatcaaagtggagatggtactgtgagttaggggatgagttatccctaatatatttcggttcatgtacgaattttagacttgatgatgtggagggatctaaaagtggacttattccccgaataaataccgcccgaaggccatatggccaactcatcggtggcggatagagagctggaattgaatcgcgtgagttgagttgaatccaggccgttgatctcccccctcccggacggcggcgcgagcgacggtacggaggcgcggcctccggtgggcttgccgtcttggatagaggtgggcattcggtctaaccgaaaatttcggtctcggtcttcggtctttcggtcttttcggtatttgaaaagtgaagaccgaatttcagtgcaaaaatgtcagaaccgacaaattcggtctcggtcttttcggtctcaatctcggtcctgaccgaaattcaacaatattttcatatatgcaaagaaataatggaaattttcaacacaaaaatcacaaaaaaattcgtaagcacttatgagtaaagactcttattaggttgcatgcctagaagaagtagggatgtgaaaattagagtttaatcctattaaacatagtggattgtaggttgcatttagacattttttttagtaattcggtcttttcggtctattcgattacccgaagagactaaccgaattgaccgaacaaaatttagtctttcactatctaggaccgaattgatgaccgaatttctcggtctcggtctcggtctttcggttcaatctttttctgcccacccctagccttagagacggagaccgaagcagttatgcaccgaggccgagaaagaagagagagagatatggtctccactctccagactccgaggagtcaaccttcctcggtcaaaccgagggagcagcagcgccagctggcacagaaaaagcgcccgagccaatcatgggccgctgcccggtgggcccaccagcccagccgaagcctgggaagcctcgggccatgcgaccgtgcagggcccacccggctctctctcccggatgcaacggggagatctccggccgcacgtaccgaggaggtggcgtacccacccaccccgccaggtgggccccacccgtcggtctcggggggtctccacctgcgcggtattactccagcctagttgcagttgcagttgcagttgcacttgcgccgttgcgttgcgcgctgggctggctggctggatgcccccaataatgtcctgcacgtggcccaccagcactggctgggcccacctccgaggcttttccagtaggggcggtttatttttgcacatgagacctctctgtttgtgatttttttttttgtttgtgatattcaattattatgtttgggttttgttggctggctgaaagaatgagaatgtcaaggatggacaacagtgaccgaaatggtcgtttgtatgatgaaaagaatgtctggatgtgccttcacgaatactaatactactatgacatgtggttttgggtgactatgacatgtgatgacggatgactaagaggaagtaagtagtttgtaatgtaataatcctatatacttatatagttcatccccactaagtgtagttaatgatatttctctcttctctcattcaaccacattatcccaatcatttctagcttttggatgatagatctatggtttaaatcgtctcttctttactttctcataacaccatgcaatcttacttatttttaggctcaaaattcataagtatcaattaattttagttttaataattacattgcatcttatgtgtacacgttatgtaaattaatttcccgcagcaacgccgtgggatattcatctagtttatctttagaggatgtttgtaatagtttaatactcctatcgtttaccatttagcttataagcagcatctaaaatttaaatttaaaacttatttgaagtagtatatttttcaacatttattttagactgctaagaacacacatatatatacaaattgtttttttttccgataagctgttacgacttacaaccagcacaagcaaaatgatcacggtgtaattcgatatttggtcaaggatgatgggtttaatatctcgagtgtgatacatcgccatcagtagagtcattgtgttgaggtttgcgtaattaagcgtccatgtaaaaaaatgagagaaataccatgcgtcaaatttggtgtaatgaatttcataaaactattgggcaaaacagatcactcattatggctatatatgagcatcttacacaataactgatccaatatttattattgaggtggcctttaactttgtttaatcactacttcatttgtcctaaaataaacaaacttagtactctatccgtcccaaattatatggtgtcttttttaaggaaaattaaactcggtaacttttgactaataatcatactaactatatatatatatatatatatatatatatatatatatatatatatatatatatatgctaagtattatatatgttacataactagattcatattttaaagtactttaatatgatgtatttgtaactagaacataacatgaaataaatcaatgatcaaagtatgtcattgaaaaccgtgtaaaaaaaatatagaccttataatttgggatagagggagtacgagatataacacatcgtagtatctagatagagacatctagattagtagtactagattgtgtcatattccgtattagatttgtttattttgagatgaacgaagtaatcgcttagcttggctaaaaagtaagacaaataatctagtctaattttgctttggccgttgcttcttcctattgttgctgcggtgtacaaacttaaactatctaacaaagagtttgttgcaagacacataaatttattttaaaaattaatcgagagatagatgcatacaaaaacgacataattatatgatatataatacctctgttttttaatagatgacgccattgactttatcatatgttcgaccattcgttttattaaaaaaaatttacgtaattatatatttttttggttgtgagttgttttaccagttaaagtactttaagcatgatttatatattatatatttacatttacataaaatttttttgaattagacgaataataaaaacatgtgtttaaaagtcaacgcgtattctattaaaatagggaaggagtataatccaagcaagacagcaccaatcggtgtgaaaacatcaaacacagtcacagcacaggtgacacactgtgtgacaactgacaaatgacaaaaatccggtaggggagcaatcgtaccaaaaataaaagaacagagggtccaaaacggcaaaaaaaaaaaaaccggtattccccctcccgtcgccttcccgtcccctgctgcgtttgccgtcgcgtcgcctgccgtgcggagccgagccgtacgtaggccgtgagccgacgagggcggaaaaggggaaggcaaactacgcaagggaaaccccaaccgaagcaacaattaaaaagagggaaggtggccgtggtggcctcgctgggattgggggatcagaggaagcaaggagatcgagagacgcacccaatctcccaatcgcctcctcctcctcctcctcctcctcctctctccgtcgccgaagatttgccttgcctccgtctctctctttctctcccgatggaccagctcgtcaatttcatcatccgcccgcccaggtgagagcctctccgctgacctcacctcccgattcgtggatctggtgggggggatttcgctttgcgtccagccccgatttggttgctgccggatttgggggcgtaattccggcgggatttcgtgggttagtagtggggcgtgcgggaccaggggcttttgcagctcgattctgtggagtgtctccccccgtgtgtggggggttaggcttctgctgtgctgcgaatgtgtgggggtttctttaattgtgttctcttagaaattgtttagctgagagtcggtggatttctctttctagagtactttttttttaagcgcgaataaggaatgtgtgagctgacatacttgccaatcagcttacgttacgggatgcttgtcaatcgatgttgtagttcatgggcttatcaatgtggcatttccttgcgtatccttaccagcaatgcgtgtgcatccgttccagcataacaaagcgttctacttgaccgaatacgacggtttcgggagtagttcttgctaccatgaactaacaagctaatattgtttttttgtgaccttttatttcacgtgtacaagacgttatgttcctttgagcaactcccaaattatatgttgctgacttaattaacttgtctgttatatgtcggtatattgcagagctgagtacagtccaaatgatgatctattggagcaggaattcatgttgaaaggaagatggtttcagaggaaggatttggaggttatatgtttgcttcaatctgctgctaaaagattaatagaaaccttaggattatctacttctttttgcgttttagtaatacttttgtattcgtggttaacgtaataaaatctacatattgtcacatttgtgtctcaaaattttaataccaacatatttttcttgtcctctgcttcaaaaactagaaaagcaattcttgcctctggtgaatagcactgatttgcacaaaaaaaatggcatcagtttttatttcctcttcatttggtgccccaaccaaccgggttgcattggtttttgcatcttaacgagaaaagagcttcagctaaacaggataaatttagtctcttagatttctccttgtttctttcatggtgctctggtttaatatatgcaatatctgtttcaggttgtaaatggccagggcaagaaattgcaatgtagccactacatgcctgttgtgattcctgaaggaaaagctcttccttgtgttatatactgtcatggaaacaggtaggggtatactatatattacatgttaaatacttgatgaaaaatataattactattgcttattataggtcgggtgtcagttttagcaaaatacttttacacatgtggcgtccctaatgaagcgaaaatataatccttacatatgctaatatattatattctttgtattttctaggcattaattaaatggcattattttttttccagtggatgcagagccgatgctagtgaagccgcaattattcttctaccatcaaatattacagtctttacactggacttttcagggtctggactctctgaaggagaacatgttacattaggctggaatgaagtgagtcattcttgtacttatagaagataaatatgatacttgttcttttttaaaaccttctgtttgtacttgttcttttttaaaaccttctgtttgcttgtaaactttgtgcattcaaagctagttgaatacttcatatttcttcatgttgtcgttcagaaagaaataacctggaaaatgattataacagctattaaatggagggctagagagtagagactgaaatataaacctttctacagaaatcatattgacatgcttcttcttcaattctgcatcagcttgtctcagtaacagcacattgccagcaaggcaccaagcatagatttttttaggctaatgcaattcttttacactattcgaagagcataatggtagatgatatctgtttttctttacagagagaagatctgaaagctgttgtcaatcatttgcggacagatgggaacatatcttgtattggtctgtggggccgctcaatgggtgcagtaacaaggtatcttctttaaatgagtaaattatgttaggatggcattcatctttagtattcttttaggacacctgctatcccaatacttgagctgctaattggaaaagagtgatgccgattatcatcctttagtatgtgaaatattatccttaagtatgtagcacctgccgcccccaaaaaacacccacagtcccacacaaatctcctcacatttacagtcgttgtcctattgtacataatacacatcatcattctatataattttagccttttagtgtttatgaaatctgctatctttatttttcagtctgatgtatggagcagaggatccatcaattgctggaatggttcttgacagtccattttctaacctggttgacttgatgatggaactagtggatacatataaatatccactaccaaaattcacggtaagcatcatttgatgaaatgaactttttgcttttcggtgatgaaattgttggtccagtaactattatagttgatatgtgctttaactttactgtgctgttattaacagttgctctaaacattactcccttgtggcacctgctaccgtgactgcatgatgcttgcaatcatactgcattgtaccgcataagctagcttatatagatgtcatccttggctgataatccatatctaatcgtttctctgacaaataaaactaaacaaacaactaatcaggctttcattgaattaataaatccgttcttataatctcttagctgacaaacttggaaacaaactgaacttgtgtagaaagcaacctagtcttgccattggatgattgaccttattggggacacccatggcaactatcaagttagcaactacaatttgttccaatggtgcataaactgtttccagccatctgtgcatttctcagaagattgtgacatctgttttttggtgtttccagttatatttaatttgttaactgtactaattttatttgatgatagatatgcttagtctttatgacagtgtcataagggtaggccccatatttgtatcttatttattgtggaacttttgtttgtttcttaggtgaaactagcaatacaacatatgcgaaaggttgtcaagagaaaagccagctttgacatcatggaacttgataccattcaggtttgctaccgtccatatactaaatattgtgttgctccaatgttttggctggtgtagtgatttgcccctccttgtctagattacacgcattgtatccatgggggaagatttcatttatcataatctttgacctctttatttgattttgattcagtttgcttttggtattaccctttttctaatctctattttgtgtttgcattcttatttttggttattttgcatgtcttattgaattttaggagcttttgctatagcatctctgttctttttcaattttgatgcccagccctagattgctaggttggctttcatatacaattctttcttcattccccccttgtgcccttgagtaaacaagagcagaaggctgaataagaaacaaaggaaggcaaaccttttcataggatgtgcatgcattttcttctcccaactgtgaatgacactgcaattttatttgaatagccaaatacttgtgtgttgcaatctattccaaacaaatatgtgacaatttctaaacttaaatggagatatatatttctctagaaaagaacatgtacagtttgcaccaaaacatcaccatacaaatagagtcttatatctatccacagaagatactgatattcaagtggtggtagtgggatggcatactgcctccaccactactatatgttgatttatatagttgagataatcagataatgctgtaaaacacctccgctccatttatttgtgacagttgtgaccatacatcagtacacaattaatatctgaaatttaatttttcaggtagcaaagcggtgctttgttcctgctttgtttggacatgcgactgaagatgattttatactgccccatcattcagacaaaatctatgaatcctatgttgtaagtttccaccttacccttcaatgtggacaaatgattcctttgtctgataaggtagtaatatatggttgatttaaatgcatctgcagggagacaaaaacattattaaattcgatggggatcacaattcaccccgtccacaattttactttgattccataacaatatttttccataatgtgctaaaccctcctgatgttcctgatgaccattatttcctgacacctcatggaagccttggtcaggtactacaaattgacatttcttagagtgattgcaatatgttcaacatatcttaccttaggtcctgctgacagggtcattgggatacagaacatgacatagagtataggttcgctcaatcaccaacaggtatgattttgcaaacctcgatctgcagttatgtttggtgcatcaataacagtatgaacttatgtgctatttgttatgggacagcccgcacagctaccacagaagatgccattgcgcagttacgttctagaaggctcatgagtagaatggaggtgggtattttcattttgttatcattctgaacaatgctaaaattctattgtatctttgtgccagtggtcttggaagtaaccgatagtcatttctgtctgtactgcacatggaaagtcaatcactagaattattatattggtgatcaaaatattactaaataagttttcatatctgaggcagcagtgatgtctcctttgtggaggtggagcagcaaaagtaactcatggtttcttttgattgttctccaggtcccaactggtgccactgcagaagacagggctgacagaaatgaggtatattcttttttgctatttttcaatactttagaatcatattcaagtcatccgtttctttaaaatcttctacctgatcatccactaccagaatttcacatggtcactgttctttctagaaaaaagaaacaaatgagatgcttttcacctagaagtgcaatgctagctcataatgatttcccaagaatcatctggtttaacgtgtagaatgattcgacacctgcattttcgggatagttaaattaatatattttacgggaaaaaaatgtgagataggtggttgtttcagagcaagaggaggtggcagtggtaaggtccagactccataggggctactgctactgctaccagtgtcaagtgagaatggtgggtttggaagagaataatggggcttaggtgatgtttactgaaaagaatgatgcatagaagtaatagaaggggttagggccctagttattcgtgcattctactgattaggactctgtttggtagcagagtattacacaaatatgttcatatgccaagttcctaatatatcagtgggagttgttcctaataaatcacgcaacttaaccataataaaataatatattctttgttgactggcactgaaatcgatataattcaaatgaaataattttgcactatgaaaattgaatctcatactagtaatagatatgtcgataactcgatctgaaatagaaactaccatataagattattcactttttccaactgaagctgtaatcaatactgagttgtagtgccaattggatctgagtagaatggatataccaaatacatcttgttcaaataagagcacaatcatccttgacggtgttgggattgtggctgtagtatcatcattatgacacatcagttttctttcagtatatatgtggatgatacaaatcttttgagctttcagaatataatgctcagagtatcaccactggcattgagattgctattcgattctgtttgtacaggtaatggacagtgataatggtccttcctcttctagtgtatctactgcaactcctcctaatggccgcaatggaaggctcctgactccaacctctgatgatggcgagtatgtggagtactcatttgatagtctatcagatatgccctacactgaggaagatgaggatagagtaagttataccttaacatccttcagatttttcaccatgtcatcatgttgcactaccttttgttgtttccaagacaccctcgtagacggttcaacatgcataaaaacattgtgtatcacagaaaaaaaagatctagtactggagaatggttgtgttggcctgttgggagatgtggagctgattaggcccaatatatttaactattgatagctttgctataagaaaattggattcagcatgtggatgggaatattacaaccatctaactttttttttgttggccaaagcttaacatgttaatatggacttctctctaaatctttaattgatatgtctctaaatcttaacctgttaacacgtgttttaagaaggatcacaattaccggttgatgtttccattatcagctgtttatctcttttttgctatactgaaatgcagatgctaatgcaagcaattatggagtccttgaaggatcttgaactgtcaaatacaaaagctgcgcaatctgccgcatctgatgctgcatccaaagaaaataaagaaaatggttgcaatggtgcaaccgtgacagtattggagccagatgcatcttccacctcggcgcgtcccactcccacagatgctcctggcaaggatgtaacaacctgcagtactaaagcaaagtcacctgaagtgcaaagtgcaagcaaccacaccacaaacaacgccgcttctgtgaacacctctagttccttagagtccaatgcatcaacccatgttacgaacggaaaat

SEQ ID NO: 60408 - DNA, 11267 bp, Oryza sativa
atacaaacagagaaaaaatctcaactatcctacgcttcgcctaacagagcaacaaaaaaagggacatgctctgatagaaatagaaaagctgatgagacaagctggaaaaacacttgaggaataccctgatatagagctaccaaaatgtgctgaactacgggaacttggaaacagacttctgaatgaagaaatgagctatgacaaagacaagcagaaagaggaacatgatagcatatttggtaaacttaatgcagaacaaaaggtagcatttgattcaataatagagtcaaccaacaaggggttgggaaaactaatgtttgtcgatggctacggtggaacaggaaagacttacctgtggagagctatcacaaccaaactacgttcagaaggaaagatagtactcacggttgcatcatgtggtatagcagccttacttcttcatggggggagaacagctcactcaagattccacatcccactaattgttacagaagagtcaacatgtgacatcaaacaaggatcgcacctggcggaactacttaaaaaaacatcactcatactgtgggacgaggctccaatggcaaacagaatttgcttcgaggcgctagacagaagtctaagggacatactaaggtccaagggtgaagataacagcacaaagccattcggcggtatgactgtggttctaggaggagactttcgccagattcttcctgttgtgcgaaagggaagacgcacgcaaatagtaaatgcatcaataaaacggtcctacctatggcagcacttccacatcttcaaacttacaaggaacatgcgcctgagctgcatctcaagagatgaagacgagcaaaaaaggactgcagatttcgcacaatggattttgaacattggtgatggcaaaacaacatcagcggatggagaggaatggatagaaatacctgatgacctgatactgaagaaaggaggtgatccaaaggaagaaattgtgaagagcatatatccaaacttggtacagaattataagaaacgagatttcttagaacagcgagcaattctatgcccaagaaatgagacagcgaggaaaattaatgaatttataatgaacatgatagaaggagaggagataacatatctgagctgcgacactgtatgcaaagcaacaactaatgacagtgaaaccgatgtcctatatccaacagaatttctaaatagtctaaacttccctggaatgccaaaccatgtgctgaaactgaaactaggccttccagtgatgctactgcgaaacattaaccaaagttcagggttatgtaatggtacacgaatgaccattactcagctcgggaaaagattcattgaagcacaaatcataacaggaacacatgtaggagaaaaggtatatatccctagaataataatgacgccaacagagtcaggatggcccttcttgctaaaaagaagacaatatccactcagtgtgtgcttcgctatgaccatcaataaaagccaaggacagtctctaaacatggtaggactatatctgcctaagcaagtattcacgcatgggcagctctacgtagcgttctccagagttacaagacgagatgggctacggataatgctagatgacaatgaaagcccaggtgaacatatggtcaggaacatagtgtacaaagagattttctagaaggtattatatcattctcattcatctatattgatcatacaaactatgttgcaaactactcatgggtaccttatcattgtaaatattcattgcagctgctctattcctgcttctctccagtacaacattgattgtgctacaacatactctagcgaaaggctgcaattcaaaattaccatttacagtgagtatttttaccagctgaaataggatgatatttcaaacattatatcttcctttcacaaacaatatatttcatctttgtactatattcaataattactacctctgttttcaaatgaatgacgttgattagtgcaattttgaactaaccggcgtcaaacaaaaagaaatggagagatataaagttataggataattacattttccttctattataacatttttccccagaaagtaaacatccatgaaccatttatttttttagacaatggattaaacaggcttaaacatccaaaatacatgtacacagccaatgagccatttaatcacatcataattccgcaatctttcgtattatgcacataccgtctttccatagagctgtgaacaacaactccatcgctgccaattgtcccctggcgaacaccccagcagctgatgccaaatccactaatcaaggaaaatagagaggacataaccaatacagacgaaggaagatagagaggtcgacacaccgcagccgccaacccacccactgagctaggagataattcaaggaggatgttgaggtgaggacggaacatgggaggtggatatggacatggcgctgcaagcctgcaacagccactggagggagggagacgggaaactacaggagacccacgccgtccccgccacccgctgctctccgcccgcggaccacgccatccccgcctcctaccatatgaagttttgtgaaggtctggtatggtaattatatataaaattatcaaattgaaagcattttttactttgaagttacaagctttttttactacaattagttaactacgaaagctcaattatacagagccatacagacaccctttatgatgggccaaaaaatctcaaatatgcagtacaagagggataacttgaacgtaaagcagagacaaatcgatacagagcaaagacatgggaacagagcaacaggacattagtgcagtacacattgacgatgcagggatgcacgatgcaatacctgaggacagcgcctgttgtacagcccaatcgcgagtgaagcggttggcgatgcagtagctcggcggcgcaaccagctcggcctcgcactccacaaccttgcgggagcgcacgtcagatcgagacctccgtccccgccacccgcgtcgccgtccccccgtccacagcgcctgcagctctccgctaccgctctctgcccgcaacccacgccatccccgccacccgccgccgtccccgccatctacgccagcaacccacgccatccccgccgtctgacgccgtccccgccgcctacgccgccaacccacgccatccctgccgcctgcgccgccgtcccccctgcccaaagctctccgctcgcacctccggcccgcgccatccgccatccgccatccgccctcctcgtccgcccttcccctcagacctcatcctttccattttcccctcttctgtcactctctccttgctatccatacgtatactcgtatagcggaatagaaaagaagagcaaaaaaaaatagcttagacagagttacagagtattagttgcctactactaattagtattttagtcaaagcaaagtgatgcaaaatttgtttggttaagtgcagtttttttttcacaaatgcataattatttcatctacatagattaacaaaatttaacaatcatctgtttttcctgtacttgcgagacgaaacttttaaaactaattgcgccatgatctgacaatgccgtgctacagtaaacatttgctaatgaccgattatttacgcttaataaatttgtctcacagtttatatgcggattatgtaatttgttttgttaataatctatgtgttaataattcagataaccacttttctctatcctctattttacacatgcttctaaaaaatcctacgctatcacatgatttaaaatcttagacatattattttggaccattacattatatcttttcaaaataaaaaacatatataaaatataagaaaaaaaatatgaccattgtaactttaatcggtaaaacaattatttacatccgatagaccaatccttaaaaatacaaatccattccacctctctcccatacataatcactcgtctctccacgatatctgtacgtacatgcaagatatatatcttgcatataacagaattttaaaaaattaccatcgagacaatcgtcaagctactaatgcaaaggttgtttgattattatttgtccagatgataatttgatctaactgggttaatacattttaaattttttacactctatccaaacatccattctattccatactatattttaaacattcatttctatcatatttatataccattttcttttcttttctcaaaatcatttatataccattttctattattttctaaaaatcctgtgttacaaaggaaaccctaaattctttctaataacaacaaaaattatgatagtttaaataatatgcccgcgcaactgcgcgggctaccttcctagttattaactaaatagtaaattaaatacaccaccaacaaattaaaccagaacaattaagtgctgcttgtattgctcgtcagatggtgggtcacgaaactcaattgaaaagaagggtacagtagtgttccgctctactctcagtaagaagatggtaattaagtgtgatggatttgatcaagtgagattgtgcttgaaacttactgacaacaggcgatggcgatcgagtttgacctgaacacagttgatgatacaaatttggcatttcacatgtgagacttaatataacaatcgatatattaatttcacttcatcactagctacagggcgtcacgacacgtcgtaattaaaattaattagaccagctcgctaattaactatactcttcgatacaaagtcaactccatgcgcacaagctagagacgaatgcgaagaagaagaagaaaacttagaagatgcaactatatatcaaacatatatataacgagatatatatagtattagcaaagaaagagagataaattaagggatatatagatatattggtagatccttttgcaaggtcaactccataaacaaagcattgatgcaatggcaatgtcaacgcccctccctcgccgcccatttttgccttctcccgccgcgccgccgccacttcgatcccccctccgatcgatgcgcgcatcggatcgccgccgccgccgccgtctcgtctgagtcgtcctcatcaccaccatgggcaacagcttggcgagcctggcgacgccgtgcttcgcggacgccgccgccggtggtgggcgcgggcgcggtcaccacgccgccggcgacgacgccgttgcgttcgacgacgacgacgccgcggggggctgcaacagcatcggtcacattctgagcttcgatggacgcgatgcgccggcgttcgccatccatggcgtgttgctgccgtcgaacccgtcgacgatggcctccaccggcggcggcggcggcggcggcgcctccgtcctcaacgacggcgcgctgtccatcgggtcgtcgtcgttcgacagctccaactccttctcgttccggacgctccagccgcggcagtactccgggccactggagtactgcaccacgtcgccgtcgacgtcgggcgcgtcgtcgtcgcggcagctcggcccgcgcaccgacaagcagatcctcaacgacatctacgccaaccggcaacgccgccggtgtcaggggtccaaggggccgccgctcctcggccgcctccgcaaggcggtggcgtcgctgctgcgcgccgggccgtgcggcttccccgagcaggaggagcccgccgccatgatcaacggcgtcggcgtggtgaggaacggcgaggagagcatcagccggaacgtcgacgcggcggcggcggacgacggtgcggagagggtgcagtgggcgcgcggcaaggccggggaggacagggtgcacgtggtggtgtcggaggagcacgggtggatgttcgtcggcatctacgacggcttcaatggccccgacgccaccgactacctcgccgacaacctgtacgcggccgtgtgccgcgagctcaacggcgtgctctcggaggacgagccggatccaccggaggcggcggcggcggcggggcggtgcaacgggtgcggcggagcggcgcggcaccgcgaggtgctcgacgcgatggcgcgggcgctgcggcggacggaggaggggtacttcgcggaggcggaggcgcgcgcggcggagtgcccggagctggcgatgatggggtcgtgcgtcctcgtcgtgctgatgaagggcgccgacgtgtacgccatgaacgtcggcgacagccgcgccgtgctggcgcaccaggccgagccggacctgtcccacgtcgtgctgccgcggggcagccaccacgatggcgacggcgacctcgccggcgtgaaggaggcgatcaagcggcagttcgacgagtgcgagatgggggagctggcggcgctgcagctcaccatggatcacagcaccaatgtgtacaaggttattatactccctagtattcaccattgcattcagggtttaatctttcggtttggacgtttctattgaagggtgctgagataccaacattttgaaaaaaaattacacaaatttaaacaaaatattgccaaattcacaagaaaaaaaataaaaaatttggctgaaactatatcatattgtggggaggggtctgaaatgaccgaaattttgaaactctgattgcattgacattgtattggttggttctgatggaactaattgattggatcgccattgaaatgtgtaggaggtgagaaggatcaggagtgagcacttggatgatcctggctgcatcaccaatggcagggtgaagggttgtttgaaggtgacaagagcgtttggagctggctacctaaaagaggtgtgcatatttgtatctaactaaattttattcttaaaccacatattaatcctttagtgactaactatatcaagcctaactatagaagaaactaactgtaatgactagcttgcgtacatttcaagttaactttgatcaaagtcaaaacaacttataatctgaaacggagggagtatttggtgttgcagccccgttggaacaaggctctactagaggtgttccaggtggattatgtgggtagctcgccgtacatcagctgccgtccgtacatccgacaccaccggttaggggcgcaggacaagttcttgatcctctcgtcggatggtctgtatgactacttcacaaaagaggaggtggtggcacaagtggaggccttcaccgccggctaccccgacgaggaccctgccaagtacctcagccaccagattctcctccgggccgccaatcaagctggttagttttactctctatatataaactccctcaatcttaaaatatataacaccgttgacttttcgtataacgttggaccattcgcgttattcaaatttagtaattctctcagtatctccattacaagaaaaccgacaatagaaaaatgtgatacttccttaataaccgtaaaatcactccttctatatatgttgctatttagttggcaatgctgtttgttgttgttttaactttgaccaataataatcgtaatagtgcttgtaaatttactaaaatgaatggtcaaagtttgaatgtaaatgatgcttgatgacaaatttttaggaactgaagaagtaatagaacctttctttctcatagttattgtagaagaaaacatacctgaaatagcttgttaattttctggttacctctatcttgttagttgcactctaatcaagtcttcatttttttttctttcagagtcaagaacatgtaattgtttacttattattacttagggttaatattgattttaatttttttgatgcattatttgtgtagggatggggttccatgagttgctagagattcagcaaggagatcgacgacagtaccatgacgatgtctccatcattatcatctccttggagggaaaaatttggagatcatcacaatgaactaatcctgtccatgtactagtgattaatctctaccaccaatattgcattggtagcatacatgatgcaatctacaatgtacaaaggatcaatcaatcactgagggggagtagcacatgcaatttttttcccctcttgtaagtcaaaatcaatcacaaatcaatgagcaagttttggcggcagtttattttttaatcttgcttccatcgagttttatgaagggattatacatgatacttcattttaggatttctgttttgattctctgtgtactaggttaatataggttgcgtttagttccgtgtcctaatttttttaagtatatggacacacatttgaagtattaaatatagactaataacaaaacaaattacatattccgaccacaaactgcgagacgaatcttttgagcctaattaatccgtcattagcacatatgggttactgtagcacttacggctaatcatgatgtaaataggttcaaaagatttatctcgcgatttacatacagcctatgcaattagcttttctttttatttacatttgatgctccatacatatgtccaaacattcgatgtgatgaaaaagttgcaagtttgaagaaaaaagttaaaatctaaacacagccgtagtagttttttttatctcaccttctatataaaaaagggaaacaaacaaaagagctttatcaaaatgacaataatttgtatgtaagcagaagacagaaagacacttagattttatacttcggagatttgatcatataccttcttttatatcgaaaaggtaggcaaaatgtgagaaaaatgaaccaaaaagcagagctgttcccataagcagttttccctcattggcctaaaaaaataagtcaaagctaaaattttaaattttaaaaacttaattttgaagatgtttttaatgtagtttctttttagcactgacttatagatcaaacacgtgtataaaagttttacccacattgttttgattgctaataaaccgttacgacttgggtaactgacgaggcttaaaacctatgttacttaaataaaaaagtattatgttttcaacaacatataggagggagctatgtaaacgggtttgatttgaaattaattcatctaaaaatgtttgaattcctctaaaaaacgaaggagtttgaattgagtgcgagcagctcacttggaaattggaatgtcccaagctaaaacaaaaagagtgaatccactagtgtagtgctccactacactcttgcaatagcagagcagggtatataaaatctggcgaatcgagaggaggaggcgatcaattcgattaaattcactaaaattcaattcgaattcagatcgaatcgagggatcccccatccccatggcgtcgccgacgtcctccgcctccgcgccggcgagccaccacctgcgcctctggtggcgccgccgcggccgcggcggcgccgtcggggccaccttcaccgtcgcgctcctcgccgccgcgctgctcctcgccctctccttgtacgcctcctccctgccccgcgcgcctaccacgccctcctcctcctctaacctcgtcggcctcaccctcgtccgccgcgccaaggagaagggcgcgggtcagtagtcctctcacctcgatttgatcccctttcgtgttttgcaacatagttggtcaggtggagtgtgtttatgcttttgagtgtgattttgcagtgtgcttggatgggagcgcgccggggtaccatctgcagagaggctccggcactggatctcaaaactggctccttcacttggaggtgagcagccttttggatctagttctattgatttagatacagaaccatgaataattagtttagtttagaggacaatgcatgtttcgtgggtttcaaaacccttgaaatttaagcgctggaataactgcactttcgagtaagagttgctcatgttgttcatgtcatggtatgatctataaacactccgattatgatagcctgacacaaactttaggcatgatttagctgtagctgactcggtgttgatgaaacaatgggcctagaatggttttgcagaaaactaatgtttggagcatatcagcgtatagcaatgcgctggtaatggcacagttagattattcatgaaatgatagtgttgtggtatctagagggcttcttatttttaccatttttaactaatggatacttgctaattgatgctcccgagcttcagtttcttgtctgcccagtttttcttgtttgcgttattgtctttgccattcttgtcagcttttcaatttcctgaattatcgtgttccatgagctttagggcggaggctggtgccggaatctgaggtcatgtgcttcacgtcaaaaatcggtgttgggttcatcgcaatacatggaatgccagattgagtttgctgggatcttgagtaatgacaaatttcaaaacccaggtagctacattttatttttatactagctgtctgctccttttattaataatgtgatccagtattcaaactgctgtattgcatcattagtacaatctacagtgtgtacagtagtcccaggtagctacattttatttttatactagctgtctgctccttttattaataatgtgatccagtgttcaaactgctgtattgcatcattagtacaatctacagtgtgtacagtagtcgtgccttctggtaaaataatcatgtccaaataactcgagttctgttgttgcaacagtttttttacaacagtgttttcagcagcatgaacaagtcctcattgagactttgaaaatttcttggatagttatttacttactgtattttgcagcttaacctatcgtatcatattttactgattgtttctgacataaataatatatttcaccatcatctgtatataactagcagttcatgcatttgtatcatgtgttcaaacagaactatccatctagtatttacttggtgtgagatcaggccaattgttgactacagaacaaattccttgctcctttcaggagtaatatttttgaactcctaaatactggtagtctcattcagcttgccttccatgtgcagatttttacaattggaataaagttaagataaggtattgtgatggggcatcattttctggaaacgtcaagaacgaattgcaggtctgatttgcccttttttttttcaatagatgttcttagtaactcagtatttgttctgacatccaggtattgttaatcattgcagaatggcacaaaattctttttccggggccagcgtatctgggaggcagtaatgagcgaacttctactaaagggactcaggcatgccaaacaggtaattcctagcaa
